United States Patent 7,745,391 (HUMAN THROMBOSPONDIN POLYPEPTIDE) - sequence listing, part 291

SEQ ID NO: 936123 - protein, 97 aa, Homo sapiens
CLERTITLIAKINMYLTSRVLYALCRLGVEKGYIPALKWDPFPLHTAVIWGLVLWLFEYHRPTLQPSLQSSMTLYEDSNVWHDLSDFLIFNKSHPSK

SEQ ID NO: 936124 - protein, 129 aa, Homo sapiens
PGLCLWCLRFQRVQEEQGSQERGMLGTWHEVLEGERRHEHCGSHGAFWVQEWQDQQEDHHFRLWTALISFDLRAFYPSNHSFCSSGERPYPICSQCPVISALTEVLWVPYFPHSPSSLAGLQSEVYDYE

SEQ ID NO: 936125 - protein, 133 aa, Homo sapiens
LCWSSGLLGLVGLPVLIIGFVTAHAIARRFGRPIEALAKAADNIGQGNFEVTLPISSAMEMNQLTKRFGLMAEAARASGDKRGRIAGRSALQAVLDSIDDGLLMIDREGHLEHLNPVAQRQLGWDSDRKAWAP

SEQ ID NO: 936126 - protein, 50 aa, Homo sapiens
MKPRAGGICPLKYPIEHGIITNWDDMGEDLAPHLLTMSSVVASRGAPHPG

SEQ ID NO: 936127 - protein, 133 aa, Homo sapiens
MVSAQCIGNACSTPPGQPSFAAERLGLLCLASQHPCLLRFLPCLHRIGASLHQRWALPLPGAACSMEDSSFCLLWNLDGSFHSGSKGEEVALDAKASRAESRIARFKKSHQGNTQKLCQRIFGRCSQIAERKA

SEQ ID NO: 936128 - protein, 110 aa, Homo sapiens
NRSQNITYHCKNSIAYLDEETGSLNKAVLLQGSNDVELVAEGNSRFTYSVLSDGCSKKTNEWGKTIIEYKTNKPSRLPFLDIAPLDIGGADQEFCGGWPRLFQISELNLN

SEQ ID NO: 936129 - protein, 84 aa, Homo sapiens
KLSKDPNIVIAKMDATANDVPSPYEVKGFPTIYFSPANKKLTPKKYEGGRELNDFISYLQREATNPPIIQEEKPKKKKKAQEDL

SEQ ID NO: 936130 - protein, 88 aa, Homo sapiens
TNKKTTFFGGNSISMIDLIWPWFERLQAMKLNECVDHTPKLLWMAAMKGDPPVSALLTSEWQGFLELYLQNLRPVTMGSERGSQQSYV

SEQ ID NO: 936131 - protein, 214 aa, Homo sapiens
MRLPPCHVVYRPRPRALPTQLPLPRPLFDSPPRASGTQAPASRLEAEEERFPRHRRVLRAAPRLPEGPKVSSSPSGPVWILPAPVPRTSASPGPRAPAGAPPLWSAAPETPGSPPPGISLPEFLKLICRLRNFSVLPLSLRGPPCTPRGVLWSPVRPRLFCVAPPGSPPYARGCSALPCPRPAWLGPSPRGPTARAPISCQQARERSRRAEPPP

SEQ ID NO: 936132 - protein, 132 aa, Homo sapiens
TVTLGGIFQLGNWSGLNSVRDHNTIWKSCKLEPTLKNARIVGELTGFRPVRPQVRLEREWLHFGSSSAEVIHNYGHGGYGLTIHLGLCKEAGQPLRENSRGKEVVQVASLPPLRTLVITVCPKTTPPSANDM

SEQ ID NO: 936133 - protein, 132 aa, Homo sapiens
QQDEVDCNIKEAHEKLEMEMEVARLHQCQVMLMRQDLMRCQEELWRMEKLNNQEMQKRRQLEPMREELQALGGSNALGNGRKDSLGTFSDMRQQEDTDGPDCEVPIGITGGTMPPASCASWPFLQEPETYDA

SEQ ID NO: 936134 - protein, 110 aa, Homo sapiens
GGAGLWPSLPSSGYGTNTPSSTVSSSCSSQEKLHQLPFQPTADELHFLTKHFSTESVPDEEGRQSHAASLPEPQVRVLSAHCSSACGFQLVCITQRWAHYAIKGQDSKYF

SEQ ID NO: 936135 - protein, 150 aa, Homo sapiens
RLPAGLNEVIIETFHHAFDDKLFWQWGNNESGVCFFKVCPSTTGNLDNVRLTSNSLESNSPRDVLVTILEVMKVSIVVTWLSGASTVMKRSFKSGPSSNLIWFIIDKGDVGIILNEFMSIREASLLNTSRSSSSSSRSSTIAQAAGTAAT

SEQ ID NO: 936136 - protein, 114 aa, Homo sapiens
NIKPKESWKVFEEMIEPYRLHESHKDLTTAEKLKRESPWKITDAELEAVKEKSYRQVRLNELLQEHSRAANLIVLAFQWQEKDLFPDLLYMAVVRNPDQRFLLCYWLEEITKMS

SEQ ID NO: 936137 - protein, 95 aa, Homo sapiens
NPPPIDPASLEEFKKRILESQRLPVATLLPNPAVEDPAAADAGCQNRHLWMGAAGATVLDTRACRKPPPPRLWHPFTVPCIPAIPQTLDLRHTQL

SEQ ID NO: 936138 - protein, 40 aa, Homo sapiens
MADYTGAAAGARGMGHGMGNRGGFHRGFGSGIRGRGHGSG

SEQ ID NO: 936139 - protein, 128 aa, Homo sapiens
TLSPRKRHGGSLKAGRFSAVAKELELSYSEAGWSDPLMCQHFSRTSLPKDGVVPSTFTSPKPPTLVPRLHLSTGPVRGVVSVLLGADPCLGTLESPASVVELLFWLASQPCNKSTWGLDKVGLPDRFN

SEQ ID NO: 936140 - protein, 86 aa, Homo sapiens
LPVTYSKPRIGHILAYAKVELVPPTPAEIPTAIQSVKKIIQSAKTGSFKHLTVKEAVLNGLVATEVWMWFYIGEIIGKRGIVGYDV

SEQ ID NO: 936141 - protein, 147 aa, Homo sapiens
QNWTNWPLPFPWDQNLGASVPHRQCPFCLSFFPLACSVSELCVLRSFHGWESLMLPLPSDAGLALLLQVFSHKLVAARLKFYKGRSPVGSLLAPKPTSWQLELVLNHTIWGAAPLGKGPFGGFLNFPIPFHCGLRGGVRGWRGRGCL

SEQ ID NO: 936142 - protein, 70 aa, Homo sapiens
GKRLSREETWPEPGSLSPSHASHVPYLLTPGLQCERAVNSDTLGFPQGPEVFKLSYAAYFLFFGPFFLEM

SEQ ID NO: 936143 - protein, 78 aa, Homo sapiens
LGSPGLEVLGNGTSNMSPSSEGSREVRPVAQFGGVQRYQVRSGSPEGKGGGLGRSVLLAPLSSNVQNVGGPLFISTPG

SEQ ID NO: 936144 - protein, 72 aa, Homo sapiens
MSFTFASPQVFFDSANVKQVDVPTLTGAFGSWHPMSPHYRSYGWAGSGSHKKTGPRLKYFVSGSVTVNADSS

SEQ ID NO: 936145 - protein, 123 aa, Homo sapiens
KFLSQDQINDKNGELDFSTFLTIMHMQIKQEDPKKEILLAMLMADKEKKGYIMASELRSKLMKLGEKLTHKEVDDLFKEAGIEPNGQVKYDTVYPEDHHSCAETTKGSQDQESRWRAFGALKT

SEQ ID NO: 936146 - protein, 101 aa, Homo sapiens
MESYSVTQAGVQWRDLGSLQPPPPGFKQFSCLSLLSSWDYRRLHHAWLIFVFLVETGFQHIGQGWSQTPNLAIRPPWPPKVLGIPGRDNPRPGQSLYLNSS

SEQ ID NO: 936147 - protein, 110 aa, Homo sapiens
SGGAIETHPRRVPGLPALPSRSASASASSLARSASLLPAAQWVWRWRRWRRSSGHAPGTSSCRMKKSLENLNRLQVVSTLQQFRERYFDYKDESGFQSPILQCSYNTAQL

SEQ ID NO: 936148 - protein, 122 aa, Homo sapiens
AKKEAPAPPKAETKAKLKAKKAVLKGASHKKKKRTSPPSGGRRHCDSGDSQISSEEPLPGETSLTTMLSSSFRLTTESAMKKIENNTLVFIVDVKTNKHQIKQAVKKLYIDVAKVNTLIRAD

SEQ ID NO: 936149 - protein, 128 aa, Homo sapiens
TLQSQEISWHPPGKRDKSCPGTSRLKVTLPEHAQMNQGFNHGWNLRSQTGEQGLNEDADPEWQDTESNQMEPWCHLMAGSSQIMRPWQHFIGRLNQIMAHYCTPIKPDPVPSSGRQIGAFPPVSLTIS

SEQ ID NO: 936150 - protein, 69 aa, Homo sapiens
CSVPSVENLFRRQAEATVQKDADAVDKVMKELDENGDGEVDFKEYVVPGGCSHSGLEQLLLGDQLSTVL

SEQ ID NO: 936151 - protein, 87 aa, Homo sapiens
HELAVLGSEGVIYRRLHCICRALIERNSPIAIIFGVWKVRDSFFEINLGERAISDERIVVSTAIRVIHASIGLLCALRPQEALLLRL

SEQ ID NO: 936152 - protein, 108 aa, Homo sapiens
MKQKITDYLDEIYGGTFTATHLQKLVTRLESAKRLITQRRKKHWDESDVVLITYADQFHSNDLKPLPTFNQFYHQWLQSIFSHVHLLPFYPWSSDDGFSVIDYHQVAS

SEQ ID NO: 936153 - protein, 104 aa, Homo sapiens
MLRLEYEGFSEGHGRRGSSHKGKYKNLGQQRTQSQLSPTTADEHGRLCRKEREPVLSNRYSTQAMVNCWLFAPHSILWQKGTINVDSSFSKRKLVKYRIVGLGL

SEQ ID NO: 936154 - protein, 98 aa, Homo sapiens
PPLQTSAPSGRIPTQSPGALDPALFPQHLPSPLPTAHVAPRSIAGGAPQKAMPWMEMRLDATGEQGAVRVVGTQMRAGRGGTQEGGGFLHDRTGRFYK

SEQ ID NO: 936155 - protein, 107 aa, Homo sapiens
MRTGRPARVMRRAERPAWRPCRPRAAAPGLATSWLRLRVVVAARSERSWGGTVDGGQGGAGVQVSQARAATLSLLPPGPTAAQAGAKLSLDAAGLARRGERKLTAFP

SEQ ID NO: 936156 - protein, 103 aa, Homo sapiens
TGKFGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 936157 - protein, 132 aa, Homo sapiens
MSPRSTPRRQKKDVRLRQLARTPALIRAGSRVAYRPISASVLSRPETRTGEGSTVFNGAQNGVCQLIRRRFQTSVISRDIDTACQIHWCRCNSEELLVLVLVLEQSLAVLSLVMETLHLKQLFSYAILGFLS

SEQ ID NO: 936158 - protein, 105 aa, Homo sapiens
CCLGLGPAADMNNARYLDFARVTPLRVLGALRELRATRLAASCARHRRSLRLLEPFEVRTRLLGWDDRAFYLEARFVSLRDGFVCALLLFRQHLLGTLPERVQHL

SEQ ID NO: 936159 - protein, 50 aa, Homo sapiens
MPVCAASVMPKHEFSVDMTCEGCEVSRVLNKLGGVEFNIDLPNKVCIDSE

SEQ ID NO: 936160 - protein, 111 aa, Homo sapiens
KTRFPESFKQAWEWSSTLTLPKKKVCIDFGHSSDTLATLNKTGKAVSYLAPSSQDLGESSGYKLKRQAVDLVSPADLEHQLLSPVQPSHGVPAQTGLPRWLPASFHVIKSS

SEQ ID NO: 936161 - protein, 80 aa, Homo sapiens
MPCRYSDHWTAMVLIIVGCASVSSNLVVQGAGGPGQAILESLYTFVADIAKGAIGEHRYKTYLPLLCAMFTFILGSNLLG

SEQ ID NO: 936162 - protein, 67 aa, Homo sapiens
GDRLKACEKAVKKHRSGEEHDKLQQLLEMEQQEMAQQERKQQQELALALKQERRAQAQQGIALPEEI

SEQ ID NO: 936163 - protein, 68 aa, Homo sapiens
ETHLHWHTVAKETCSEKSTNLHDYGMLLPCGIGVHLENNVERNKPFRLFTHPRLLTAVLNTSRCLNLN

SEQ ID NO: 936164 - protein, 107 aa, Homo sapiens
MPNWQQLNQNRPRHYPIIMTKMSLDDPQRLSDIWLRLSRHFTPESALFRHAVKNVAVVVLRLRNHSDNPECITGYWILLDKFVCLPATITPRRNRLEVELIGTVGIA

SEQ ID NO: 936165 - protein, 79 aa, Homo sapiens
IRDGGGWFRRCIGGRDRLAGPQARPFRRSLLECDPLSAARLSRTRRQRQVELGNKLTTYTELCRINEDQKVALDLDPYV

SEQ ID NO: 936166 - protein, 181 aa, Homo sapiens
GPESWRGVRAPSALLRVVTLGATGAPGTQEPEIEWRWRRRRVGRGIDGKPVPPLSPSSSCLGAWRDGSYSFCPAPGPGEPGLHVEAGGAKTREYKTSFHALTKYPEGRRLKGHLHWAVRLACCVKHLTTTRLGIYTVLFERLTGADGYSPGFLLKAVIGMNRSAGAFVGQPKCSYPNADAG

SEQ ID NO: 936167 - protein, 176 aa, Homo sapiens
MYAFVRFLEDNVCYALPVSCVRDFSPRSRDFDNQKVYAVYRGPRNWAPGQRSPPRAPRDWGLLLHKAQILALDEDKSDLENSVIAEENKNPQAFSYHVRRRWERLKIMGEEDLQLRHIKRPEGRNGESGAQEHRGSCGSLEKQNGLSLGHSTCPEVFREASQAQKDMDSLEDSVGP

SEQ ID NO: 936168 - protein, 138 aa, Homo sapiens
SLDLPAVARSGKDTVASMLLKHEGVTTYALADPLKIGCQILFGLTDAETWHDNIKEEVILHWGWSPRKFFQTVGTDWLRELNSDHWLLRANLAFNQYKTNEPDKSQLDFTDPKAPFKLARASYFWNYSRRVLEPFIIK

SEQ ID NO: 936169 - protein, 116 aa, Homo sapiens
AAVYPARQPRVPETLGNRPELRERGGYGGPPGAQAQQKFHLVPSINTMSGSQELQWMVQPHFLGPSSYPRPLTYPQYSPPQPRPRKSSGPWALQGVRRRPCEQISPEKEERRRVRR

SEQ ID NO: 936170 - protein, 87 aa, Homo sapiens
VSGQPCTNWRESVFHFGGPTWRHFILDSNPLVLRLSVSCGCSIAAGLQTSTGRQPTCATPEFVQGKEFKDFPDVLLPNYFTCRRARR

SEQ ID NO: 936171 - protein, 89 aa, Homo sapiens
MGIVTNEVKSDGRGLTNNIYCESVSCQGAVFALNNDSFCISRGVVDIDGDIITQVDIARRVSCWGHYTIEVSCWIGGISCNSVTIINSN

SEQ ID NO: 936172 - protein, 84 aa, Homo sapiens
TPMLIGRLCGTRIETLALIHGGIIIASNCTQEPEFRSEIATSSQPLISYGNDAFRPCAMLSSHKAESGSPTLFTLVHLLPLLLQ

SEQ ID NO: 936173 - protein, 99 aa, Homo sapiens
LEAVSPAPGSHGSCGALLVFAAYSRHVELRAPRVARHSSLRLPDYHRVIHINEVVLLDAPVVGAVADESGHVVWRWLPPPETPMTSSHPLRGGTSSAGN

SEQ ID NO: 936174 - protein, 307 aa, Homo sapiens
RTGPSGTTGRVYVHLMEPSQWHYESSPLAVQNYREQAATYPIQISWWGQLRMVRQTRKLDVCYKQADQGLHPLTPLRVIGPIPRGAPLYCTHPGDDAFIIPQEQPTNTPPVYPPAPYSQAGFFRTPPQVRCSGSPFHEASSAFPYSVLLPAVNQPFFRVSPGVLPLSCGGSSNQSVFKVLSVLFQMITMLTPTFFCGAHSGCLPPFVFVNHLGRPIFPGGPKSKLCKKKTGFIPISLSLSFRQFHAPYGRNPGPWARPHRRLATPLVGRTTVYRHRPRPEQTSAGSGGPLSRLGRYAWEGINWGHRG

SEQ ID NO: 936175 - protein, 133 aa, Homo sapiens
VSYYNALEKARVENQDLQVQLGHALQQAADPNSKGNSLFAEVEDEGWQWNASINLMKDKYQSEEAKCVHQRSDEQDEVTNLHIAEDEGLADLSLNSRSLFAMIEQKNGEIKHLLGEINKLEKFKNLYESMESR

SEQ ID NO: 936176 - protein, 143 aa, Homo sapiens
HWGWSRTPDLKLSARLSFLKCWDYRHEHRASTLLFYFLIERRCHFVTQAGVQWPDIAQYSLEPLGSSNPLVSAFWVAGIIGTCHHTWANFFVVVSNICRDRVLLCLPSWYGYSDPPAFSLPKGNEVIGNGGHRTQPKTFRGER

SEQ ID NO: 936177 - protein, 86 aa, Homo sapiens
EVVATWEAISHGEAASAEYFNFAHDVLDVWSQLEKTGHRPPNPAFWWVNGSGTEVKWTFEELGKQSRKVAFISEPAKDGFWKDPKE

SEQ ID NO: 936178 - protein, 67 aa, Homo sapiens
IPPELQPRFRAAALPLNFRSSLSSQRIYSLKPETEPRHGKGVRGGAKPQQSKKNQRAAFPEHQLRVG

SEQ ID NO: 936179 - protein, 99 aa, Homo sapiens
STPAPAARTPGHSAPHGRASFPAPEAAAAAAMGAYLSQPNTVKCSGDGRRPACLPYGFSAMQGWRVSMEDAHNCIPELDSETAMFSVYDGHGGEEVALY

SEQ ID NO: 936180 - protein, 116 aa, Homo sapiens
MRSLAEKDVRSRSTRPCPILGLLLGLGRCGSCIDERVPLMKPVPPASALPHAPTPTEEPLSSGSQATQGLSVRKWQHVEVKSCSLRHLRGFWVAPAMTSPGMLAVEGLGPQAGEEE

SEQ ID NO: 936181 - protein, 49 aa, Homo sapiens
ALLPYALTLGAVDLYEYSGDEDLEPLCRRPENAATGPLPTCHHRPPRLV

SEQ ID NO: 936182 - protein, 90 aa, Homo sapiens
MAPHTRAFAHAGWVSPHTEVDWRSAGMEEEEVVTGLDASGTDQWGLGDAVERPTLAQRKRISLDIESGPRSWTGHFGNEVNSNLEGLSFL

SEQ ID NO: 936183 - protein, 62 aa, Homo sapiens
FGTQFFMLQTYGQQLQKAMLQLLEDKDTYSWLLKDVTLATTYEFLKERLARLTQARRRLASS

SEQ ID NO: 936184 - protein, 46 aa, Homo sapiens
SDCKGAGEEVTEGVAMGGRRGGERAPGSVQASPPSLFTLGPAHKAP

SEQ ID NO: 936185 - protein, 102 aa, Homo sapiens
EMEFHSFAQAGVKWFDLGSLQPPPPGFKRFSCLSLLSSWDYRRVPPCLAIFFFFFVFLVETGFHHVGQAGLELLTSGDPPTSASQSARTPWKHSVLSVKMAT

SEQ ID NO: 936186 - protein, 119 aa, Homo sapiens
WLDITHKDESFVKEHFPTLYARLLELGIDITKDMIPVVPAAHYTCGGVVVDEHSQTDIAGLYAIGETSYTGLHGANRMASNSLLECFVGMSATKHIQENFKADQPTPAVPTWDDSVTNP

SEQ ID NO: 936187 - protein, 96 aa, Homo sapiens
MKLLKLENWLNLPPDVIATLCMDNMIQMASLHRGGSIKTNHRSIQSDSEAKGAVVTSTVGQVSAALRHFSIGLVYPRVNSTLSDSERRDTEHPLLF

SEQ ID NO: 936188 - protein, 73 aa, Homo sapiens
SRKTRPIGVIAVETTDINTCTSIGRDFTSASKIDTGAIVIDGEAYTVRVFNGELSGAVSVELMPINDARHRYS

SEQ ID NO: 936189 - protein, 113 aa, Homo sapiens
RGGDRSMPPDMNSLEQAEDLKAFERRLTEYIHCLQPCHDVGECFLYVVSVCTATGAWNWLIDPETQKVSFFTSLWNHPFFTISCITLIGLFFAGIHKRVVRTINYELLDVERY

SEQ ID NO: 936190 - protein, 307 aa, Homo sapiens
RTRAGMAGAVAARQVTGLGAEERDLSGERAGAGASGGSEVPGPVHAGRCLRPGLLCQRRPRGVLARLGAAPAAPAAFSPAPPAAARPGPPARPAPPPPPSRPAPPRPPPPPLPPPPPPPPPPPPPPPRPPPPPPPPPPPPPPARPAPPPSSPPPAPPRAPPPPRPPPPRPPPPSPPFFSYALLPGVLPYSLCPAGGFAPSDVFPPPPPPPLCLLLELEEGKAGSGLRLSSLSKIEELQLIVNDKSQNLRRLQAQRNELNAKVRLLREELQLLLEQGPPPPPPPPPPPEKKVLVKVHPESKFVVDVDK

SEQ ID NO: 936191 - protein, 110 aa, Homo sapiens
THTHPTGFVKDAEPGNRIKLKTLRVGSIPLLNNIPANLLLLIVPILIAMAFLMLTERKIGYIQLRKGPNVVGLRATTTLSDAIKLFTPLKPATTITLYITAPTLALTIAL

SEQ ID NO: 936192 - protein, 149 aa, Homo sapiens
WRCFPISTITPGYLVSVETHWRNSASYSVLVEINMRAVPLIGEVYQFSGYCQRQSFTADGFTDSNAFNNISGNSRSDKLFIAGYGNKYFDCGVNAQIIFMQELAISAIFLFSEQFYAGENIIAEHNKKYPEGACCYRFATNVVQCCKLI

SEQ ID NO: 936193 - protein, 145 aa, Homo sapiens
APPLYWYQFIVLVCSHAADEDHTQNWAIYKRKRFNGLTVPHGWGCLTIMTEGKEEQVTSYMGGSRQSKRTCAGELPFSKPSNLLRLIHYHKNSIGKTWPHDSITSHQSLPQHMGIQDEIWLGTQPNHITCQQKYNASHISKKQKK

SEQ ID NO: 936194 - protein, 95 aa, Homo sapiens
EKTKKAERELSEQIQRALQLVEERKRAQEEAERLEDRMAALRAKEELERQAGGSDKEPGAAWLGCRIHLPRLPSWKRRGAKRMKFERVGSTAKRS

SEQ ID NO: 936195 - protein, 137 aa, Homo sapiens
IPRQMLTTPVEPARTNYWRVGRPSHLCPVPGGPQHHPELGLPPSMIADCFSPQSNDGRKQQTMDQAATISFSSGLAPEKNRQDILCPRMMKTQHRLALPNKSTVSPLGLFLCDMQSSLPGFWEILVTFLSIQFRSVE

SEQ ID NO: 936196 - protein, 146 aa, Homo sapiens
EAFISSTICQSQQSFPEVSRRLRANVIPEALLIHCIKACEISFICLLDLVVEDFNQGIFICASSLHGFLQGGRIKQGWCSNKSHHDVLEVAREITLQVIFQLLFIRCLVLLDKSACLRVRPLRQNVDEGFLVSPKSSDRFPDSFGI

SEQ ID NO: 936197 - protein, 76 aa, Homo sapiens
EEELSSSEEEGEEDRDADEEGEGEDTPTSDPGSCLTARNPYACSGRMSAEPHLVPRPPQLCFWAELESSLCPPDCE

SEQ ID NO: 936198 - protein, 60 aa, Homo sapiens
LFLIKEKSQLVRPLQPAEYLNTRGEWTKDVSLAQPAHLGDPTALRYLTYINPLARCCGDY

SEQ ID NO: 936199 - protein, 177 aa, Homo sapiens
KLSAVQVFLKLFLLQFGAFFCKRLRTLAFQHDPCLEVQRSGSSQSSSVKPKTMIASHQGGQQRGAANFNAATPVSQSPIISKSALRISFRRLRPPLRGFRGRLRRQAPRLRSGRRRRAPRPRHVGEHGRAAAPGHDQPVRLAARPTRRSSCCRRTPYETALSTFFQETNIPNSHHHH

SEQ ID NO: 936200 - protein, 104 aa, Homo sapiens
RPTFKQLVEALDKVLLAVSEEYLDLRLTFGPFSPSNGDASSTCSSSDSVFSHDPLPLEPSPFPFSDSQTTCAGEQQCCMGYAAHGGLLAELQPDASTFNVGSVR

SEQ ID NO: 936201 - protein, 153 aa, Homo sapiens
EPLRLGAKMAAAATARFLKQQLWSFLRPGRSGSFDSHRLPGDCFLLLVLLLYAPVGFCLLVLRLFLGITSSGQLRARQRPSQRSADHVCGRARGRQEDSGLRDHSVRVSFQPCDTFLTTTSQFAYHLYNPLLNKSPNFVCWSRGFMEMNGGLV

SEQ ID NO: 936202 - protein, 69 aa, Homo sapiens
GRQVEGMEDWKAGQPNFKKAPGGTSLMETPEKTSVEVLTNDKYTFPQEEAEPPGKTKTQLDPRDALSWR

SEQ ID NO: 936203 - protein, 316 aa, Homo sapiens
CCVRPRLSFLDALFMLPRFGPFHIFFALIGPFGPRFSLRVGQPLAGPPCARDSSPTGLGSPKTFCLTCLLEALFSPTDKPWFLPGATWCSFNLPRLGKSASPRAPVPRCPPRRPKVVLPSTGSSLGNFLDPAVPARPAVSSPRDRPWFGRDTSSPSCDGGRTLHRDTAAILRPVPASKFIARRYSGLLAQNGRTIFPRGPLRLVLPGEHRPCPWRTSTLVARSVTLPRKTMVACRRRPGAQHLFCPHFTRRWFLRHLAARLKGGPHPASLAPTVRGPRHLILPLRSPPLRPGSSSDQFPPLRGVAPLKNRPPPKIT

SEQ ID NO: 936204 - protein, 133 aa, Homo sapiens
KSKEDLVSQGFTEFTIEDFHNTFMDLIEQVEKQTSVADHAWPPFNDQSTRYCGPTVRAHPRAYLQREMFLRALHPRVDGLSRKFCQQEGGAMCKEKRPHPHHCAGPGLSVSIQVEYMDRGGGTTNPYIFPEGS

SEQ ID NO: 936205 - protein, 138 aa, Homo sapiens
RTGGGIQAPQQTPIMGSQSSKAPRGDVTAEEQALPPRRPTQEWHVKSNGDLSPRVKGSRPCERKQMRQPGHDCIEPAPPSQGEARGRSPKETPKKKKKFSFKKPFQIERLSFKRNRKEGGGDSSASSPQRKSRTGGIV

SEQ ID NO: 936206 - protein, 113 aa, Homo sapiens
CFRIKYVGAIEKLAVSEGKSLEGPLDLINYIDVAQQDGKLPFVPLEEEFILGVSKYGIKVSTTDQHGVLHRHALYLIIRMVCYDDGLGAWEKLAGTQDHRCKQRRVQPVGLPV

SEQ ID NO: 936207 - protein, 117 aa, Homo sapiens
GSRPKMAWSASVRGGQRVLACSRELHGAWHTCTPPLVCAKNRAARVPLAKGNKPVSYEEAHAPHYIATEKAWLSLHTGNLDGEDHAAERTLEDVFLRKFMMGFPGCLADQIVLKRRA

SEQ ID NO: 936208 - protein, 97 aa, Homo sapiens
SADHQCHGLSPRCHTCPHARHMDAHACAKTTQGPGTDLLPSEPDGPQVCSSKWPVSQAVGTLAAVSPSCRSALPKAPDFPQGSLTVFSIQSEKPLSF

SEQ ID NO: 936209 - protein, 121 aa, Homo sapiens
APAIGPYSQAVQVDRTIYISGQVGLDPSSGQLVPGGVVEEAKQALKNLGEILKAAGCDFNNVVKTTVLLADMNDFGTVNEIYKTYFQGSLPARAAYQVAALPRGSRVEIEAIAVQGPFIKA

SEQ ID NO: 936210 - protein, 50 aa, Homo sapiens
MEAIAKYDFKYFSDELELSKGGTSLKVLNEEFDQNLVQRQSLIEKTASFP

SEQ ID NO: 936211 - protein, 129 aa, Homo sapiens
RGGARRCSHGGARPAGLERGTRPRSDPDHTDTGSRSKQRINNWKESKHKVIMASLLRGNQDKDAHFPPPSKQCCFVQNQNCTSTRADLKRLMRRIVKEESFLEEKLLPFSLVSMLCHPGTKSTKVILGS

SEQ ID NO: 936212 - protein, 46 aa, Homo sapiens
LPQTFALNADRWYQYFTKTVFLSGLPPAPARARAEPEPEPALDLAA

SEQ ID NO: 936213 - protein, 124 aa, Homo sapiens
SGWKSTPVTCPRNPRASLQLGTGWLTQGGSGVPGRGVGVPARAECPGWSDLLRAALERWASWSQRLFPVVCPAAESPVQVDVLLDGVDTSQLELSSDPKLAIIPQEALFVQWDCSGKPGPPGPT

SEQ ID NO: 936214 - protein, 96 aa, Homo sapiens
SRNIVIRSPFACRKVLGRQCHYSSVIVITLNVPFLAENDRWRDAQSGILAAAGIYALKNNVARLQEDHDNACLEADSLRETGRENVMRQDTNMLVC

SEQ ID NO: 936215 - protein, 85 aa, Homo sapiens
KRLASVTHKISNTEFLQVIEIHNHQPSKLFSFYDYASEEESLDRILKDRRKKVGVVRFRRNTQKMSYREGHKQLTRILGVPTSAF

SEQ ID NO: 936216 - protein, 122 aa, Homo sapiens
AQKLSLCGFREKELCCHCSSGAAWGPARTVELFYDVLSTYSWLGFEILCYQNIWNINLQVAQASITGIMKRQWKQSLQVCFPAKDYTLENDFKAPCDNNFQNSQSFPKDFLGLVMLEKRKFV

SEQ ID NO: 936217 - protein, 126 aa, Homo sapiens
RLPTFGGLLVTNVLQVMAPESNWAQIVLSSNAVEPGPTPTYTSWISELQGCSAHLTLKLASLGAGIGGQHVLGVSASFCWCLYLCWLPTHRYQSHRTAPQNPCAWLPGDGFGAHVTGHRGPMGHLC

SEQ ID NO: 936218 - protein, 129 aa, Homo sapiens
KRYILHVVCDFVSVRIIIVQFLLLLYQYHLVFFLILRVLIRVFLSRETQNKSKLCNRKRNSLTTRTEKLPDLTCLGFYMYSFKWHPVTLSLLYSPNISSMFTSMNFRLKQHHWLLTRIFSSTNFKLEHQ

SEQ ID NO: 936219 - protein, 137 aa, Homo sapiens
QLHDPQTRTSAPPQISSCTTLKLEDELLTRVSSSMTLKLEQHQLLPESPAERPSNKNNIRSSLSLQPHNPQTRTSDLLSVSSCRTLIIEKRQRLPGSKAARPSNKNTSSSLGLKLHETQIRTTPAPLWVSSSMTLKG

SEQ ID NO: 936220 - protein, 125 aa, Homo sapiens
PQRGGNEHQLVHGQPRAYKRHHKFPLWSMGLACLAPSLQGLPGLKVGPHQGPTPFLPGTCVPPAAIHTQAVGAKVHCRPVLSCPQPLVNFPPKAHQCQMSGRGLSWQGAGMSALALSMCTSDWAA

SEQ ID NO: 936221 - protein, 99 aa, Homo sapiens
AQTRWACGARSSSNSSSSSNSSNSSSSNSAAAAAAVLTLCLHCQTACSEPGICFAAVLLPFRHCRQSGSGIVQRRHHSTGEDVKPSSQCKLSKLRRPRF

SEQ ID NO: 936222 - protein, 41 aa, Homo sapiens
PGPKPVPEPEPEPEPEEPVRGGSGMWDRWAQDWRPWEAFFG

SEQ ID NO: 936223 - protein, 83 aa, Homo sapiens
LRGGLSGACAQARGRAATPESANPSRCRIPSPPPRLQTGADPAREHGTWRTASGVVRRRPEPGANEEANAAGRRYEMLAMFDI

SEQ ID NO: 936224 - protein, 73 aa, Homo sapiens
RCRQQQQRRAQARLKLKPRLRLRLKPGPGQAPITAAAAESRAESNSTTTLPVSWGSPQVGVGDSNKPSPKLFL

SEQ ID NO: 936225 - protein, 127 aa, Homo sapiens
KKKDGCMITHDTSSSMSHVTPQPQTYPLHPLSTLLLTPCPAWLPANVPMPRLLFLPPPPAPSPCSLSLLSLGVGTTQVTARLVGRRVPWGSQEAKAQPSSVLWTWRLAVVFLGLQTLEMSIVCSVSF

SEQ ID NO: 936226 - protein, 132 aa, Homo sapiens
NSPGSWAISGPLSLKPGPAVLGLRPRYHQCPDITQIIGFLLFFPPQGGRGLAFRTVKSPKKGGSRGDWGWTLQPVPAGPLLSLLKHLDGSVYAARTCYNGGFSPRRGLSWRLWTCLALPNHSCQHVVCMKKI

SEQ ID NO: 936227 - protein, 96 aa, Homo sapiens
RSGKAGVDLGYQLGVAGSPTCGRDWDTLWPLFVPFQSSTPPLPGERKTKKRQNAPPARDDRCAHRDAALSARRDLDFVYKLCTLYIYVHRMYICWE

SEQ ID NO: 936228 - protein, 84 aa, Homo sapiens
LIAACNDQTVRVWVVATKECKAELREHDHVVECIGQKISISEATGSETKKSGKPGPLLSGSETRLLRCGMYWHVLMTPWDNWVR

SEQ ID NO: 936229 - protein, 133 aa, Homo sapiens
NTNLLADDTALRALIPQRADRFPMNAVRSTLKEEEKLVNSSDWGYGRSGLCPLAPEYGYFAKQAGFTVKTSASLAALWQVVNQIGGKERYFFGNILWQTRALMDRAIGHKLAKGRPEREYLQTGDAVDSWKVI

SEQ ID NO: 936230 - protein, 106 aa, Homo sapiens
LVRLRRTFCVECTRDRTAGRNYRWRRFRGVRSHADMVYNLPVLTPPRWVRSRTTPIALENLLHYLVALLDHPASEHRIFEAAGPEVLSYQQQFEHFMAVSGKRPLV

SEQ ID NO: 936231 - protein, 110 aa, Homo sapiens
TCFLCHLLRGRRQHGSLDTSLRAVLLLVLLGVCTVRSDTPANCTYPDLLGTWVFQVGPEVPEATLTARVMEATEEKVVVHLKKLDTAYDELGNSGHFTLILQPRLRDCVE

SEQ ID NO: 936232 - protein, 129 aa, Homo sapiens
HGDAGPSTRTSYAASGWQLWRILASRTRVLGPSEGTARVLLRQFCARQAWAVHRPMIAWEPAPQHCEAATPVVSRRPETPRSPKPGPCFLEVFSNHICYWKELYWLECSTSKKEKAEKLEKERQRHIGK

SEQ ID NO: 936233 - protein, 98 aa, Homo sapiens
GRVRLLNWDVCDMVGTFTDTEDPAKFKMKYWGYALQGNDDHWIVDTDYDTYAVQYSRLLLDGTCADSYSVFSRDNGLPPEAQKIVRQQEELCLARSTG

SEQ ID NO: 936234 - protein, 74 aa, Homo sapiens
PILPVLKPDKTYKLVQDLCLINQIVLPIPLVVPNPNTLLSSIPSSTTHYSVLDRKDAFFTVPLHPSSPPLFAFT

SEQ ID NO: 936235 - protein, 67 aa, Homo sapiens
VSDFGLALLEDDPEATYTTSGGKIPSLDRPEPFPTEVHLCRRTFGIVMWEGDDLMATALLEVVNHEV

SEQ ID NO: 936236 - protein, 118 aa, Homo sapiens
MIPVHINTNANCLPGRDTIDFLSVEKRMIPARRGGSTCGSSTLGGRDGRITGSGVRSQPGQYGETLSLLGMRELAGRGGGRLWSRLLWRVRRESCLNLGGGVCGELSPRHCIPAWATE

SEQ ID NO: 936237 - protein, 143 aa, Homo sapiens
IPEEEAWLGLTLEEPIEKQRLLEEKDPVPLFKDLCAGADPAAQQQALSEPAVVQKRPVASDHTAPPCLTNRPSFPCQALCTEDTDPGELLRATGGQWVDPGFVCCPCTFQPGPAWQGSPGGLGPQRLLSAGPRRLRQCSFGPW

SEQ ID NO: 936238 - protein, 71 aa, Homo sapiens
SFCFGSPANRKIGVCTKDGAPCIFGGTVYAAESPPEQLQVPPARALDGAVGCMPLCSDVRLSPDCFPRRVK

SEQ ID NO: 936239 - protein, 58 aa, Homo sapiens
HGRERHKHHAVARQFSTHRELWGAAVGKEDTDSHYPWSVISVLFKKFFTNLRITPSAY

SEQ ID NO: 936240 - protein, 150 aa, Homo sapiens
SFPHPRGPSRWRLRSSGLLISAKRLKDAPTADGTFSPPAGRTSSVPALPRRRRASQNRTPLDARRPAPTAQRRAPLHAIPASLAPRLLFRWRGLALKPRCAGRKAGEDRVDGKSGRMVRRKPALARPGSRSWGREQGSREGSAPNLNGSD

SEQ ID NO: 936241 - protein, 90 aa, Homo sapiens
MLDNSYDTYANSTTPVAPEQPHQDPHESGVRVKTCLSLYLTQKLGSLGELVEVCLNSECSGSGLHSLLVGSSLCQPQPLLRGTPCPLEAQ

SEQ ID NO: 936242 - protein, 82 aa, Homo sapiens
TAQGFRTLELVINYQQLCIYWTKYYDFKNPIIEKYLRRQLTENPGPVIPGPGGPLPGKTWVGGRTKRVWEASLATKKLEALA

SEQ ID NO: 936243 - protein, 75 aa, Homo sapiens
KKGQNPQAESGGLQQHLDTLTEHYDIPKSAGRIAACPSMSSIEGSQRHTGVVCVSLDNPGTWLTHLASSATDCFR

SEQ ID NO: 936244 - protein, 135 aa, Homo sapiens
MEAYEAGPKGTPEAERRRRAGSDQAVRPEGPRDSVFIPLRPFLGTPGPDPPTGRLLMSFSKKKKKKDKEKAKLLEAMGTSKKTERERSNTAWKRGPPPRQPPRNAGEAANGRILKKASKTHKQKWRTSTDTWAHS

SEQ ID NO: 936245 - protein, 322 aa, Homo sapiens
LESVMEAYEQVPKGTPCKLKGVASSWECTKRQEATHSTGTHSTTANTPWHSHMGNAANTAHRRQAAQRAAGPGTTACTLVTPGRNIPQHTHARQHSAHNRQQASVTAQAILNNRHQCNAAVRSALPSQHHPGTTPPLRSHSRTIPQQSSSRNAQSASTCTPKYWTPDIRRSISQQRPQLERVSSSSYSIQGILSWNTLGLQQHTICIILGLTRTWHYSQDLWYGLPFLANLHLTRKDSILGTSRFKGLSFGPTIPDRLHPINRTGHWTTPFLNVLSQQAYQTHSCDLRVNVQHWYKPRSSHCKRLCRPDQAVFSVAAAPPRG

SEQ ID NO: 936246 - protein, 109 aa, Homo sapiens
YYPFILFWISDMLSLLLLCTLHPSLSLPSLRLTLTPIRLNKLPGLHCHKASQTAPITFSEAQISSSSVSTPVHRSQLLIHAALLYTAGLHCFSKTSQLISPGANPQTGN

SEQ ID NO: 936247 - protein, 47 aa, Homo sapiens
DLAHANWPAYPAPSAASNNSNSLNVNNGVPAGGRALLSHRRSCLRHH

SEQ ID NO: 936248 - protein, 120 aa, Homo sapiens
PDCAPLARPFPASSGSGSTGGRVRVVARQNMIRRLEIEAENHYWPEHATYMTREQERRPPGRKEGGLRGNKGGRTSKFPRIDSLRTSSTISMSPRNGPNPEIVTLGFYGSELTIFTWSWN

SEQ ID NO: 936249 - protein, 52 aa, Homo sapiens
GGAWSLDPVTSSRLKHGSGRRNRPFSVLVFLTARTEPNPEERPLEQEPTRRR

SEQ ID NO: 936250 - protein, 31 aa, Homo sapiens
IRHGEEETQEETPGPPRPPRLEIQNFCLRPL

SEQ ID NO: 936251 - protein, 117 aa, Homo sapiens
PGLGTVALPKAVDPGAKPSQHVCGVTLLNNEGSLLAYSGYGDHVTPGSPRAIASNIWAAYDRNGQAFNENLKFILMDCMEGRVITRVANLLLVYVCQGYRWAFGMLKAKGQALVAGT

SEQ ID NO: 936252 - protein, 79 aa, Homo sapiens
VTTPAAHSSALHSRSLTHRPQPHLVEDGERTTYYDCFWGVNPMLEEFEKGLEEWPLKYHPDKNPNEGEKFKQISQAYRL

SEQ ID NO: 936253 - protein, 103 aa, Homo sapiens
ADGAGGRRGRRRSGVSGSQRVLMEPDAGAGVAVMKFKNPPVNSEPGVSDESWSSAVEKLENDKSFRCHSDLGPARVSSRPAWTTEMCGRPAHYAWVLERPVQE

SEQ ID NO: 936254 - protein, 103 aa, Homo sapiens
MAAYVPPLLLSAALAWVVAAPPGSHCNQDRSGGGMKRGRSIAHVGTVRAGRGEGKCNMAAAMETEQLGVEIFETCGPVRRILNHRNRPKIGAFLLSRYSLESA

SEQ ID NO: 936255 - protein, 35 aa, Homo sapiens
PHIEEYRCTSPMAYTMVYWHALDWRCPVQAVFARG

SEQ ID NO: 936256 - protein, 78 aa, Homo sapiens
LAAAAAASRRSALECYTCVQKADDGSPEQDEDSEVRAGVDVCTEAVGLVETSRTILAVGVRGTPGKNDRGWIRASAFI

SEQ ID NO: 936257 - protein, 114 aa, Homo sapiens
KRRLFLGVYLLLMSYRFQDILQGIPKPESSAAFSMCLFLFWGGGGMESCSVAQAEVAVSQDCAIVLQPGQQEQNSISKKKKRPGAGVTPVILALWEPRRGDHEVSRSRPSRLTR

SEQ ID NO: 936258 - protein, 66 aa, Homo sapiens
PEEETGSGLEKDPLQGAPWQVLVPTSAQDPAVLSEALGASVVLTAQERAEGGCPGQGVNFLPWFSL

SEQ ID NO: 936259 - protein, 95 aa, Homo sapiens
QSILDMMGLMEVLPERCVQIAKRCIFLEARGSIMYGFFINRAALVALANDSDGRPGRAAWSGRTSKCGSIPEGYATTNWGPCCLFKERAPFLTLA

SEQ ID NO: 936260 - protein, 34 aa, Homo sapiens
GPKSQGSGNEAEPLGKGNSATNTEDSRTTLSGPK

SEQ ID NO: 936261 - protein, 108 aa, Homo sapiens
AHGLGVEACPAADAEHARGRMHQRLRNSRDHPWGHHDRGAAGSLSSLWWPPCPPPDTAAVQAGRSGDQGLTIRTHCAVASTRARHLLHGLPLWGGPAGCCQPIPKFRR

SEQ ID NO: 936262 - protein, 61 aa, Homo sapiens
VQGARACRLPGRSVRSGYLLVKHSQTDQEPMCPVHNKLWSGYSLLYFEGQEKAHNQGPGAG

SEQ ID NO: 936263 - protein, 92 aa, Homo sapiens
QSARSQLQQTEQGGRTCRAPEVDNLTLDGNPSWSWNCPPPRGSMNSGVVQLCTFDLWGCREPGAAQGAGGFLRSRQIMNGKLPWVQGSPVRR

SEQ ID NO: 936264 - protein, 45 aa, Homo sapiens
QAQLKSIRSVGMVKHNYCRNPDNRSPWCYVQVGKALVQECMVHDC

SEQ ID NO: 936265 - protein, 74 aa, Homo sapiens
DFEDDPRALWTCFCQQYQLQEQMNRAVYEDRPPAAWCHVSSRGKSGMRGHVTERELCLCGMYHVFDQHVDEVQG

SEQ ID NO: 936266 - protein, 65 aa, Homo sapiens
MRVTAPRTVLLLLWGAVADRDLGRLHSMRYYTAMSRPGAGSPFIAVGYVDDTQSVRFDSDAASPM

SEQ ID NO: 936267 - protein, 35 aa, Homo sapiens
MEFKRGRFRLSLFSDLARGHGVAEEAETNLMMEGG

SEQ ID NO: 936268 - protein, 45 aa, Homo sapiens
MRARTSTRRSGPGSGEVLPLLMAATLGRRGMLPQNDTRLDPKPMG

SEQ ID NO: 936269 - protein, 33 aa, Homo sapiens
NTVGLHSDLEYTVTYMKEGLCSDLAVEGTIGDF

SEQ ID NO: 936270 - protein, 29 aa, Homo sapiens
CIEDKMAIDDKYLEEEYRGFTQDFKEKDG

SEQ ID NO: 936271 - protein, 30 aa, Homo sapiens
QVVRSGRVKKAVANAVQQEVKSLCGLEASQ

SEQ ID NO: 936272 - protein, 137 aa, Homo sapiens
RESRRTGAARQACGTCRGRTSSSPAAGEASGVSRPRVRKAPERLFSWGRTEKCLKETTEEIRQMGTESVYLHVMWATGTTVYQTAKAAEKVGDITILVNNAAVVHGKSLMWTVMMMPSSSPNTSTPLGQFWTTKAFL

SEQ ID NO: 936273 - protein, 76 aa, Homo sapiens
ILAGLIHAQGGALCRGLEFGADGSSGMTRRTRSQIRWPGNGFTDGGFRIARRLARTGPVVVAEQNFDKPCTLRGRA

SEQ ID NO: 936274 - protein, 98 aa, Homo sapiens
GHRGGRGGCGGEPGSRATPAQPHHRRPAAKEEMAAEGKRSPMDDGFVSWTRPPYVYRDRAEWADIDPVPQNDGPIPGQIIYSDKFRDVYDYFRAVLQR

SEQ ID NO: 936275 - protein, 31 aa, Homo sapiens
ERQKEIEEREKRRKDRHEASGFARRPDPDSD

SEQ ID NO: 936276 - protein, 106 aa, Homo sapiens
ADAHPVAAKRSRAVVPALAAANEDPLRSGNATALVAPDLKTFSMPESSPGGPREHSLPGPPHLVNADGQYFCRYWKPTRHTQGPHLCVPWKPEENSGRYEELGSEC

SEQ ID NO: 936277 - protein, 30 aa, Homo sapiens
DQNRPEWIISELACYTYSMVAVPLYDTLGP

SEQ ID NO: 936278 - protein, 79 aa, Homo sapiens
ALRRALEGEDGAQTLTMTPHRHAAPLLLLLALLLAASPGPGPRLRARGAGGLSGGVRGGGGWGVAARGEGCLRREGQES

SEQ ID NO: 936279 - protein, 28 aa, Homo sapiens
TARSAAAQRGRQRHERQRHSEVGSGTVG

SEQ ID NO: 936280 - protein, 30 aa, Homo sapiens
KRSAGVEPPIAVDSSGIDQRPRRPFHQRKR

SEQ ID NO: 936281 - protein, 29 aa, Homo sapiens
IWRVFRPLSSATVTEKLSDFGKQDVLTRR

SEQ ID NO: 936282 - protein, 31 aa, Homo sapiens
ALEVCQDSGTVFPAGRGNVVTGDRDHLTRCL

SEQ ID NO: 936283 - protein, 74 aa, Homo sapiens
ESPPRKASQVSCKPRAAQRAQGKDVTLLHLWLVLRLCVRPEWGCGDREAVALECLCTSLFQDTEQELGTHRGTP

SEQ ID NO: 936284 - protein, 29 aa, Homo sapiens
EPGRYKRQTIAAVKLSTSLASAATPDLLT

SEQ ID NO: 936285 - protein, 101 aa, Homo sapiens
ATDSRGASHLSKSQPVRGLSSPGFALSTLLPAQLRDRTEERAHATSPAAPDHSLGAACRPRRQAQSAVPRRVNAKYSHERKKVLADGGKKRVGEEPSNEGR

SEQ ID NO: 936286 - protein, 96 aa, Homo sapiens
DSWQAWRQNFQCFPQWPHWRGRGEDRRLGGGSKEEEREEATGGGLGWGLPLPAGGDGQLTTCTKCRGGSSDYGDAGPGHRNGFLTVGPLDPTGFGV

SEQ ID NO: 936287 - protein, 107 aa, Homo sapiens
TLRSQLGQSKKPKKAGGAPKKSAKKTPKKAKKAAAAVTKKVLSPKKAKVKPKKAAKSAAKAVPRPLSPRLSLKKAAPKEEISERLLLKPNVFSEPPLISIKELVNFF

SEQ ID NO: 936288 - protein, 150 aa, Homo sapiens
MEWNLMEWSRRNGQCSVLQWNGMDQNGFEQIGMKSNGMHWNGMELNQNGLERNVNNWNNEWNGKWNGMQWNGKERNQMESNGMEWNGMDWNRMDSNIESIAMVYNGEMNGMESNGRYWNRMASNEMNGTEWNGPEWNGMDSNVMDSNRID

SEQ ID NO: 936289 - protein, 71 aa, Homo sapiens
ESLAGRARFRTSACGFATGGWGPRIGGSGPRFRLGTGERELQEVERYGFSRAPAVQGLVPGAGAPLGPGVR

SEQ ID NO: 936290 - protein, 120 aa, Homo sapiens
RPAEDVKLSRLLRCGSALASLSSPSAAPARPAPAMEKTELIKGKLASSERYDDMATCMKAVTEQGALNEERNLLSVAYKNVVGGRSPPWKVISSIEQKDTFDKKLQLIKGLSGRSRTEIH

SEQ ID NO: 936291 - protein, 53 aa, Homo sapiens
ALEVASTLLVGAAGGAGKGASVRLSRGFLHADPRFVGLCWVTPCIRGAVVSTA

SEQ ID NO: 936292 - protein, 45 aa, Homo sapiens
DISYCDRQPVMDVAFVQFLAVSGKVSCLDTCGTLLVTLQILSRQV

SEQ ID NO: 936293 - protein, 82 aa, Homo sapiens
MDDSKVVGGKVKKPVKRGRNAKIDLKAKLERNPAECKRMPSPKKAEISVFGRVGIQSRKSYMCPQRGTGNVAVVHGNGPRKK

SEQ ID NO: 936294 - protein, 183 aa, Homo sapiens
GTLSAGNQWLMPYNPQPLWEGPRLGRIHEVQEIETMLAYTMVKPPVFYLKNYPKNLAKAGGRLLVPSFGRLEAGEWREPGRRSLQRAKVTPLHSSLGDRARLHLRKKYKRKERKPQSYEAITPKPSTKRSLISKLFSSPQQRSNILGQAQWLMPVIPALWEAEAGGSRGQEIETILANMVKPR

SEQ ID NO: 936295 - protein, 45 aa, Homo sapiens
KPSDYSSPFVIQTTQGLNVGNLHFGVQSLTCCEDLRNEGATPEMF

SEQ ID NO: 936296 - protein, 74 aa, Homo sapiens
LSNERLLCFVSLREQVTAQAWTPHQAGTGLAPCPHKNSQYSLNSVRSNQQEDPRFLSALHLLLLRVIQQFCDLH

SEQ ID NO: 936297 - protein, 101 aa, Homo sapiens
LSSPSQSWARSQSVQLSPPCPAPSSPRTSWRSDLRLLLSAGLSPFEHLPAYRSAPGAFCKVGQLRAQFCLSTSPSLPRRPRFPRSLSLGSSQFQRVNFAPL

SEQ ID NO: 936298 - protein, 58 aa, Homo sapiens
DVVASDAKTLRCWQSSPVQSPQQLGLFVGIVADNRTVIIDLITHQIARFVAVLGGCHN

SEQ ID NO: 936299 - protein, 133 aa, Homo sapiens
APRTVLLLLSAALALTETWAGSTPGGISHLRVRPGAGPFITVGYVDDTQFVRFDDAASPREEPAPVDRAGGPEYWDRNTQIKEGQDRVGRNLLRYYNQSEDGSHTWQTMYSTWGGRGLLRGYNSSPTTGLHRL

SEQ ID NO: 936300 - protein, 124 aa, Homo sapiens
RVVGWLCGPGLLRSHLHRPEAHGGCISVMSEVARPAHQDVVWCFLREREPQMAHAAFKRGAFILQSGQVPLSHSHVSTKTSTEEGASFTRDNVRCGAPVPRKGLTPDDVQWLQSPSMLFSGKFH

SEQ ID NO: 936301 - protein, 114 aa, Homo sapiens
HEKLRHAESVGDRRACSREKHALLEEGTKELGYTVKKHLQDLSGRLSRARHNELRRHWGAQPGRKASVKDLGSWQNFRGQPAVRLAGAGTGCRGKEGFVSWVTASRCPSRHGFG

SEQ ID NO: 936302 - protein, 56 aa, Homo sapiens
EPEEPGSDITVPPPSYQKRRSAHKHGFSWYGLVTPSSCAYTTDASPSPSVLPLVSA

SEQ ID NO: 936303 - protein, 53 aa, Homo sapiens
RAEPPGAGDPVQAPPLVLPARGRTRHDPLAKSKIELSEHARVDPAEFFVLMER

SEQ ID NO: 936304 - protein, 82 aa, Homo sapiens
MCTASHSDPTVPQRWSSLWIGYSFVMHTSAGAEGSGKPWRPPASCLEEFRSAPFIECHGPLDLQLLRKRLQLLARIESEMFK

SEQ ID NO: 936305 - protein, 46 aa, Homo sapiens
MRASVVLTSFKTHFERIPYCKIYLRFHARVYTPLALQTYEVLRPSM

SEQ ID NO: 936306 - protein, 63 aa, Homo sapiens
CIVGRTRVCHREVITGLSSEPVTSNPEFRYVADLQGCILRFSNKLTALYPYPTEDTDLVNLIS

SEQ ID NO: 936307 - protein, 62 aa, Homo sapiens
MVFQSVGNYRGSPLTAGTGGFAEGGYGAVFCFVWQNLFDAPLSNSISVPRRVTFGSELAARL

SEQ ID NO: 936308 - protein, 106 aa, Homo sapiens
LNFGIFSRRQVLPILVRLVKLLTFVICPTLASQKVLGLQSVSHCACPPSRKISSKVDAKTLAGTETRDQPRDTCPFTPHCPNGEPGQQACAPRVPGGTFASGPRNG

SEQ ID NO: 936309 - protein, 62 aa, Homo sapiens
VPSIGYYRCSPMTSEPWRVRQKEHYGAVFDFHAMQNLFAASLDIILLSPTEYNRSVSADHRI

SEQ ID NO: 936310 - protein, 79 aa, Homo sapiens
MRLQLVIQSVGNYRGTPLTEGTGRLAEGGPQGCSLAFTYGQKIILRHLIEIPVRYQESLKLEVSETAGWIKASYATAWP

SEQ ID NO: 936311 - protein, 110 aa, Homo sapiens
TTGVPFVSLNSSRVMRLPPAAATGQNPHSVRFRPPTGAFSKLIYTLDVVHPGADVNAWFDSPLGTALLRATSLTSPVWVGLGAVLPVPTTAYWDGPNKPIGRNEGIVELD

SEQ ID NO: 936312 - protein, 45 aa, Homo sapiens
ELLPQLLLHDERCLCYCSFHFILRAGSEGVRRATAPVPTVGEGYG

SEQ ID NO: 936313 - protein, 81 aa, Homo sapiens
GYRTMGYVSMAKCGSERVWCGVPKLLGLRRHRTDVSVSSLSARVDVMVLVYHLSLWALFPPMPPLAIFLPSPSISSLSILF

SEQ ID NO: 936314 - protein, 122 aa, Homo sapiens
APRGGKFFLTEFWLRHSRRPRAMDALKSAGRALIRSPSLAKQWGGGGGTQACLRTGQTRGRRCLEGMLFSLKYLGMTLVEQPKGEGACRPPPSRGSWLQLKASWEEACRKLTLERLSPRGKF

SEQ ID NO: 936315 - protein, 82 aa, Homo sapiens
MNHSLRNLHLHKLNAVVNDFWAEIESVDKIEVLYQKMKVSRSAVCSLSGIYKYFITLGAFEESLNYALGQEDLFNVNDNSEY

SEQ ID NO: 936316 - protein, 55 aa, Homo sapiens
EHIKQVESQLIMSLWRVSRMPNRNCDSNDRDMRDHRHLVDSLHNLTIKDQASYYE

SEQ ID NO: 936317 - protein, 53 aa, Homo sapiens
ALGLLTADLLSVLLYQWILCQEPAKFSSVRPFDGLVEEQFWLEVEEDTSKLLK

SEQ ID NO: 936318 - protein, 127 aa, Homo sapiens
SFTGGYHGRTLLTMSLTSKVMPYKKGFGPFAPEVYKFPYPYYYRANEQTIDEVDNQLIESLKQFFVAEVAPDHGEQQSKLNQYKEKGDLSVPSAKFMQADSVAFVMNTASSMIADEIQTGFARTGRL

SEQ ID NO: 936319 - protein, 110 aa, Homo sapiens
ELITLGSRPQRRQQCLDCFTYDECECARFIKLQIARHDAAETAPALVIEHTTSACLRIASRSLLRVNNPAVWFASRRRFVFRQINRRLSINESSCGKTRRKSASSRGFHN

SEQ ID NO: 936320 - protein, 38 aa, Homo sapiens
MTRKVVPSADFVRDVSNCFGLLNGMDVTSRMRDHIGTG

SEQ ID NO: 936321 - protein, 66 aa, Homo sapiens
MSRTASMSLIQAPSYGSDPQPLLTRGLSPVHGIVGQQCPEEESNGVFMADEDLALSPDVGVDCVRR

SEQ ID NO: 936322 - protein, 47 aa, Homo sapiens
GGSRISLYIDRFVNRDMFGYTVPTAMFQSINAFAVMLCGVFLAWVVK

SEQ ID NO: 936323 - protein, 50 aa, Homo sapiens
MRTNSLWIGEWIRVSQALHLALVIWRELSMVYTQTRLSTNFLMIPEGNKG

SEQ ID NO: 936324 - protein, 70 aa, Homo sapiens
HFKCGYPPFSKAQWLTIIFPMSSDQARYGVTWSQLGPLLPPPKFHHRQRLQTILCFPGHLVVCTVGDASW

SEQ ID NO: 936325 - protein, 105 aa, Homo sapiens
MLVPRRCQTNGSGFLACKLMCHSDLKDCDTTVTKNGNVTCNGTAEYYSDMTGVCLTKALILIAAYKRGRCKCYMNDGTAAITPEHRNREHVVAGWGSDVDFKVDY

SEQ ID NO: 936326 - protein, 82 aa, Homo sapiens
IKYLLRQNRRQLFVVPEREPRRSRRTPVPLVRCQSNRGQLSDGCIPGNVVDCVDLLSHVLLDRIPYQVRLFDVRCCRLDRLP

SEQ ID NO: 936327 - protein, 126 aa, Homo sapiens
RLASSPLLSGFPKAAEAMDLEPGSVPALRVHPRPQPETAPGEARQREATAPRGAKKSNAHSPRTGFPGGKGAFSSHPGGENEVEGKGDDTTWSMAYGLSEQRGLGSKKQQRQTADSKGLFRLYARN

SEQ ID NO: 936328 - protein, 78 aa, Homo sapiens
KPLAPSTGKSSQVRQTTRGYATNWKAQEGSQKEANKAVLSLHYSKNHFEGTSYRFQCVTTKSIEARGLEDCRLDHAFI

SEQ ID NO: 936329 - protein, 66 aa, Homo sapiens
TFMPWLTTCISLVQKKGPGTMYEPIKKFLACGNNNHFGQRLSRGQLIFDLVIDHRQGSRFVTVTDC

SEQ ID NO: 936330 - protein, 62 aa, Homo sapiens
SIGINSRSSADIISHVIYRTVVSLSTGPSSPPIPHAGLSNLVPALELSSGSSEYTVTSGRVL

SEQ ID NO: 936331 - protein, 53 aa, Homo sapiens
YSHNHTRLRTYHALSYSGSSRNVYIAGAYSTRAIELRDASTAKGSLGRFQARD

SEQ ID NO: 936332 - protein, 115 aa, Homo sapiens
ADFLLLGRRVLGWRGMTDDVTCVDSAATMGLWWRRVCLAAFHLHQCHLHTTIAKQLEKAPATRDLLLCLTRLVLAASNLLLIHACPRRPKQNEEREGLLHPWRPVWEDKHKYEEA

SEQ ID NO: 936333 - protein, 122 aa, Homo sapiens
PQKGGDPGPVRGTSVNHRRRSLPNRKSSVPKPPPVFYNKPPEIDITCWDADPVPEEEEGFEGGDYGGALGYPKAAHLHSSATPAVISQARLAPTPDSGPGWGLGRFPTTGPDFYSFSLFLKS

SEQ ID NO: 936334 - protein, 176 aa, Homo sapiens
MRECIIQSTLARHGVQINACWELYCLEHGIPMADTSDKTIGGGDDSFNTFSETGKMCPVFVDLEPTVIDEVRTTYRLHPEQLYHRPKKLPITMPGGTYTIGKEIIDLVLDRIRLADQCTGLQGFLVFHSFGGELVLGFTSLLMDVSQLIMQEVQLESLLPGAQVHSVSLNSSYTNT

SEQ ID NO: 936335 - protein, 56 aa, Homo sapiens
GHPRHRMQGTDRVERSKRLKAASWMPSWALTRLCHSPAEIGDPVGLDFNQNSLLNF

SEQ ID NO: 936336 - protein, 144 aa, Homo sapiens
DGEQDFGTVLIDLGGGQTTTSIIHDRKLKFNTVDLEGGDNVTKDISTVLGTSYANAERIKRDYGFTDPTQTRDDQTFLIDVVGESQPQTFSEKYLSEIIAARLDQFSHVPLNHYRPLTTEYARWFCLTGVMRLPEWLTFETILG

SEQ ID NO: 936337 - protein, 67 aa, Homo sapiens
LTPRRNKSAIMNKRSSRAGIKASRNASSVIIIIGDVIEASCPPFSGERTAFNMASSLFRTNRHDFRR

SEQ ID NO: 936338 - protein, 123 aa, Homo sapiens
MCEREIEHSFSKSKSSTLLLMVSRYGQWRLLRSSESTRPFFARTSRSGSESSSTPASPAQTGQQKPGPRARSPARTPHAHRAAPGARSGPAPDSLDATGAAPRLRFPRVEPRDSRLDRPDIHY

SEQ ID NO: 936339 - protein, 61 aa, Homo sapiens
NIKDITSSIHFEAYRVKRLNEGSSAMANWRRRSQKPRRCRRRPFLSRPPKSFPFLPPPITP

SEQ ID NO: 936340 - protein, 102 aa, Homo sapiens
MKGTPSTTPPTPAAPAESGRRHRHAAQEGEGPAGSSSSVYHPAQVRTTAGMHRLPVRQDPQQTYPAPSTWQMELTPQLLEFPGQEGSGHAGWGLIPLPSARR

SEQ ID NO: 936341 - protein, 132 aa, Homo sapiens
MASSDQVKELEKLPSKAFEHDSPRSKESVQNSPFPPKKKDLWRKFRRNEKPAEERHKEAELKQLAEKLRAPRKKCFQKAIEENNNFSKMAEEKLDPQNGSYIKRPEHKWLPNWNRLREKDKHIEEVRKTKES

SEQ ID NO: 936342 - protein, 36 aa, Homo sapiens
MSASIFLRTTACGIVPAGVMVVSTANRRHTAAPRLY

SEQ ID NO: 936343 - protein, 34 aa, Homo sapiens
QLLQEESRLAKKKLRAVVEAEKECNLELSEKLKG

SEQ ID NO: 936344 - protein, 100 aa, Homo sapiens
SAQDSQHVRDCSCRSRCRPARKAPVKKKAAKKAGGTPRKVPGSPVSELITKAVALKSVGFSGCSEKSVGCRGYDVGEKQQPYSNLVSRAVSKGSGSKRKG

SEQ ID NO: 936345 - protein, 93 aa, Homo sapiens
VAKKFRNPSSAGHWATGPAGINMEGKEDPFSGVTEYGIKTGHSRKRQHRALNGTRWRALIGYIPQTFNRMSVFIEKTAQCHHAAVFRTLPFQT

SEQ ID NO: 936346 - protein, 101 aa, Homo sapiens
LDGIPAGFLLWWQVAWYYAQGRSAWGKGQPGRGPVLLNFLEGVIGWKEARLGDCCAPHSLTAQSRLCWQEALRLPFLCIEKQCLPIYFAFNSKRSSGKTCG

SEQ ID NO: 936347 - protein, 107 aa, Homo sapiens
FLFFIEEALSLRLECGGTIAAHCKLRLPGSRHSPASASPSSWDYRRPPPRLANFFVFLVETGFHRGLNLLTPRSACLGLPKLWDYKHEPPHPAHFSFSIFWICVSCR

SEQ ID NO: 936348 - protein, 43 aa, Homo sapiens
KTDLNHENLKGGDDLDPNYVLSSRVRTGRSIKGYTLPPHCSQW

SEQ ID NO: 936349 - protein, 33 aa, Homo sapiens
MHRGSPSNVSAYPECPDVTRTTHNTTETIHIHF

SEQ ID NO: 936350 - protein, 44 aa, Homo sapiens
DLMVDVERSKLLLHMDKKQRNFDKIMAEWKQKYEESQSEHGVLA

SEQ ID NO: 936351 - protein, 75 aa, Homo sapiens
MYWVMAKVRPRILHQAVHSPKMPKAEGSPEATPSPSRKHGDFHQVARGVKPKVSMNSKKRIRYPGGGPLEHSGIR

SEQ ID NO: 936352 - protein, 142 aa, Homo sapiens
AVPAHAPPAEATGPIGEWHGARTGRAQLELDEDEASCCRWRRRGPRAGCHTRQASAPGVVLCDPVLLATTWSSLLLAAGGHTPSYSVLLQGLSLLTSCLAWYTGVLTHGALWCPLWGRLSSDPSGSTTLTRYHTDFIETTGT

SEQ ID NO: 936353 - protein, 71 aa, Homo sapiens
WMDPAEGTPPRGKSCARPRPTAQTPLHNGSLCRPRLECNGAISAHCNLRLRVGEASWTLGRVGTWRTFLSS

SEQ ID NO: 936354 - protein, 137 aa, Homo sapiens
GRALGCEWGVCREPGPGVPRGASWGGLHSRILPMCPELMCQPCESALTPWAVRRASRGDVEGRRQLCREPLQAVEGPSCDVSCPPCFHLWCLLASCVQGPFACSAMFLHLSFAFCKLLGSFSFDGIGTIYPCWARVT

SEQ ID NO: 936355 - protein, 41 aa, Homo sapiens
MTGCSGGARAEALGLGNAVASGFGSGIRGRGRALDGAGARR

SEQ ID NO: 936356 - protein, 116 aa, Homo sapiens
SQCAGAEKESLTFLANLLGASVQEYFVRKSNAKKGMFASDSSYTERTWWLLNMKPAKKWNLPAVTIAWLLELPRTGKESRKGHFLIENSTKEEPKFGKPEITKWNQSKFRYCRASL

SEQ ID NO: 936357 - protein, 33 aa, Homo sapiens
SYFSRDVARKVTGEVTDPSGKVHFALLGTWDEK

SEQ ID NO: 936358 - protein, 31 aa, Homo sapiens
LKVAPETKVKSSYHQAGSQGPQTFRQAGKYI

SEQ ID NO: 936359 - protein, 124 aa, Homo sapiens
RHRTGFIGTALTQLLNARKWSPESPGPADSRGMSSLHRGCRAAMPPSTWAGENILNPLRRWNETFQKEVLGQPPRRPPNCWVKHSPKAPQPPKGWGLVHRVLGFYQAQFLCGSYWIEGQAQGRG

SEQ ID NO: 936360 - protein, 126 aa, Homo sapiens
ASGSRVRPRHAASQDRCVVTFRRRGPPEAREPPDVQAAEEEKEMDLPEGFEGLLRILSMVNTDDVNIILAQKNMLDRFEKTNEMLLNFNNPVQVPGLQQMSEFLAPHEPSVEIKPGPTRFFGVGRK

SEQ ID NO: 936361 - protein, 130 aa, Homo sapiens
PTSKRGADVWAPRTGKDLLARACAHRLRHLPKAGWPWCRCSLEMVQSPGFAQGESASIIFIDELDASKRFDSEKAGDREVQRTMLELLNQLDGFQPTPKFKVIATNRVDILDPGLLRSGRLDRKIEFPMP

SEQ ID NO: 936362 - protein, 86 aa, Homo sapiens
SSTANAKNHFTNPNSQISARYNILILKPAYAYYIEHIKAAAPGPGVQASVMLAGRPAETVQSLASPQIFRGPKDHGNSWGNTVCGS

SEQ ID NO: 936363 - protein, 151 aa, Homo sapiens
QLQDRADAAAGDQPHAHTRRGACTWRPSATTTRCWRRLLSRAFDVNTPPGEPRLLRRPAQSCDFAVVNNNVYATELLLQHGADPNRVISPLLVAIRHGLPAHNAAAGPRREHRRYIATHTAPHIMFAMKCCRCSSSHGTGLRGEPVLMLGK

SEQ ID NO: 936364 - protein, 176 aa, Homo sapiens
GHNGAQAEMWSLKAPLPQGMAAALATWFNQPARKIRRRKGKPRRAAIAPRPVRITIQAQSCACPTVRYHTGAAPAGLSSMEELRVAGIHKKVARTIGISVDPRRRNKSTESLQANVQRLEYRSKLILFPRKPSAPKKGDSSAEGLETPPSLTGPVIARSERSRMEEASSSLRERRF

SEQ ID NO: 936365 - protein, 37 aa, Homo sapiens
PGQERLAYSLQKLEEAEKLTESERGMKVIENRAMKDE

SEQ ID NO: 936366 - protein, 160 aa, Homo sapiens
TNPIGVELEVLDGHDPDPGGMLCRARAHTSSRPGARRVGRVRGASFLPPEPGPFPGIVDMSELEVACEYRASLLAGKGFAVMALAYYNYEDLPKTMETLHLEYFEEAMNYLLSHPRGKRSRSWAAWNFQRGLALPFHGLFPEGHYGCCRHGSVAMLGDLR

SEQ ID NO: 936367 - protein, 66 aa, Homo sapiens
VKPASLFPDSLAPFFFPKQALSILGPLHSSTTYLSPGFQVAAFSIQMAASQGPFSNIIKASIPVTL

SEQ ID NO: 936368 - protein, 107 aa, Homo sapiens
TISHIQSPGMKGLNVERGGILKSTSKKCCSVWEVGRLQSQRFGKPRQVDHLRSGVRDQPEQHGETPSLLKIQTLAEHGGGILWSQLLGRLRHLNENRLDPGGGCSEQ

SEQ ID NO: 936369 - protein, 140 aa, Homo sapiens
GDGSLLPRLECSGEISAHCNLRLLGSSDSPASASPVAGITGACHHAQIFFVFLVETGFCCVIQAVLELLTSGDPPASASQSAGITDVSHHARPHFKIFWQRWGSCYGCPGLISNTWGFKESLPLGAFAKLLGIYRALNSP

SEQ ID NO: 936370 - protein, 115 aa, Homo sapiens
SLRTFCPRSSPVTASESLWVCSAFTLPLCVDVDGTSGRMCSPRGPPGVFPPVILWKERWRVCVPRRVPPGEFSDPVVMVYFSQGPKGFRHIGHWGPRGLDGPPEFEYPLPGDTAG

SEQ ID NO: 936371 - protein, 69 aa, Homo sapiens
MPWGRADRSSLSEKPPGPRRDVGPLVWGAWGGHCWCCCFWLGGPWPSSMHEGEEEEEEALEEQEEEPVH

SEQ ID NO: 936372 - protein, 59 aa, Homo sapiens
ALTSRAAIRTTKECSSNHLLPPRGHRADSGARTRFLLCVPCGKDKESGQGGMTLIDKAS

SEQ ID NO: 936373 - protein, 126 aa, Homo sapiens
MCFSQMWVIYYVDNMVVVSTLFSVSSLSYAPCCRPTISPVLLTCDVSTLVVGFFIREHSLELFLFMTVSRCCCLPSRSLLSLCFSKMYHTLCVMTRRGYLDVWCGGLWGLPPLYCSHEIIDCVYLF

SEQ ID NO: 936374 - protein, 82 aa, Homo sapiens
LATRTCFCARVVMEALRCIAATTPDHGRHRSMLLLPLLFLPAGAVRAGRQRRGPDSRRGVHYAGGQVYRERPGIGRDTVHLS

SEQ ID NO: 936375 - protein, 115 aa, Homo sapiens
PPGFSLNLSRTKSGTRVKARGTSTETLKGHMGTHIPANTHTDAQTGIRVNTQRHGWVHTQKCRHSQGCTNTRATHMQDDANVHAGTWVDLECAWTPLGTGRHRPRPSDTQRTHTC

SEQ ID NO: 936376 - protein, 43 aa, Homo sapiens
TAGPRSVPRAPATAGPQISAQGRATAGPQISAQGPPATAGPQI

SEQ ID NO: 936377 - protein, 34 aa, Homo sapiens
FSKKDWYDVKAPAMFNIRIGRRSQDPRNQIASDV

SEQ ID NO: 936378 - protein, 31 aa, Homo sapiens
MNDTVTIRTEKVMTNRLLQRKQMIDVTREAT

SEQ ID NO: 936379 - protein, 49 aa, Homo sapiens
LLKAKGVKVVACLSVNDAFVTGEWGRQRRKVRLLADPTVAFGKETDLLL

SEQ ID NO: 936380 - protein, 99 aa, Homo sapiens
AEQCLLHFRPPAAGAAADRERAKRLQLAGGGPLRTPPDSPLPAASHGTHGQTCARQCVSSYADLGKARDIFNKGFGFGLVKLDVKTKSCSVEFSTVRFI

SEQ ID NO: 936381 - protein, 76 aa, Homo sapiens
SGLATKCKLPRGDSQRKPPLNTRSQAPLLRWVLTLSVATVACRALCNVNAGASQGHELCPVEGLLREGLAGFLTGH

SEQ ID NO: 936382 - protein, 66 aa, Homo sapiens
ATLLLSSVGSAGSRAYSGLDNALRGATAPARYTRTNFPTSPLQKPVGRRSAEWRSYNPTATIPGST

SEQ ID NO: 936383 - protein, 136 aa, Homo sapiens
VDSGGGGEERHEAELVRVLTVLSICLSAVRAGQKEAADRGQEAGGPLSIKSKGDVLHMHYTGKLEDGTEFDSSLPRTSPLSPWHRQVIKGWDQGLLGMCEGEKRWLIPSELGYGERGPKDSRSTWCSRWTAQNRTN

SEQ ID NO: 936384 - protein, 97 aa, Homo sapiens
LQTRTPRHRALSAAPSHSSRASSGQHGKNSLQRLSGASSPDCCLQKYAGKDGYNYTLSRQSKLHESELAAQRTEGPGVCDRMMKKLDTNSDGLDNLI

SEQ ID NO: 936385 - protein, 49 aa, Homo sapiens
KRTTTMQVPPRGALSPVRLKTEAPFYPTRHIPAPQITGLIVPRALRVGL

SEQ ID NO: 936386 - protein, 155 aa, Homo sapiens
SLSQRQKRPSGRPGPSGLFPGFLAGSTSPHAASRRGGTEAAALQGAELALLQSHQGIIADMRPQGWGLAIPGLLIFVVFLSRTTGLRDALVQCVKNNPPPTLRTFQLCTKRHLGRECGICGCPGDVVPPPPRTPAGAHFVASQDEPLSQSDPRSL

SEQ ID NO: 936387 - protein, 88 aa, Homo sapiens
ATNVGDEGGFDPTSWRTMRVSELGARPLALHMGRGGCRQGALESQVLSGPPPALELLKTAIQGGLLPRQGCDHCWQHLSSIRNEVRSL

SEQ ID NO: 936388 - protein, 115 aa, Homo sapiens
LARQMGKKICVLFIDWEAQFSCTINYVQSLRELYTDVIEEFYWVRSRLRRKIPFHNTNPNGSAGNLMSNGYVNLPKMRYTDPDFFCFYQPGMTFGTNLYVSFARMGFHKKRSGGE

SEQ ID NO: 936389 - protein, 109 aa, Homo sapiens
PRSGLSGGQEDGGLWADEPGTILGVTKGSITSSVLLAGGATGSACHAATGLATHRDHPHTAAYLQELGRMKWFLEAPDETTLKELAETLQQKEHTTLFWFANQRLFAIC

SEQ ID NO: 936390 - protein, 52 aa, Homo sapiens
YHGPPDGPGRCLLTGLVASGLRTRSSVLRATMTDTVLQQLLHVAPCRTVSCV

SEQ ID NO: 936391 - protein, 77 aa, Homo sapiens
QVHPPGPRELRVYSLLLELSPAAFRSCSVPKGSAEVNAVRRDGGLRQSVIRNTARHAVRLAHQSQSNLRYIYMRYSN

SEQ ID NO: 936392 - protein, 97 aa, Homo sapiens
ESYLQWLRDQTARRSEAPAAPESQHMHPRPQQQPPVAWRRWTSRSPRQRCQPRHLEHPELHAELGMKPLSPGTVLALAKTFLRPLWARYKASQLGKG

SEQ ID NO: 936393 - protein, 189 aa, Homo sapiens
HRRFSEEMYTQVVAQNCLWTHLGPLSGWCSFSKGGGGNKNPWLCNTPFSRELDHTSHHGLTRLRVPYSPLVHTGPLWGDTPTYLREPLSPRRDSRGPITTSSCGTQRGAQRYPPTFPPAPHGRYPWSQSTAHNGRFALYCFFVHAMMEILHSHTLAHWRATPSTPLRYHAPGVFPRKAELHSGSPAVRL

SEQ ID NO: 936394 - protein, 102 aa, Homo sapiens
MDIHIDIAIIFIGILICVWCRLRYRHFAARAVSIAACIGAHHASNLSGQSQGRCGKTTLTLVLRQRGRRRPRVTRESTPNPMRFIAGWGASANEQGKALRFD

SEQ ID NO: 936395 - protein, 145 aa, Homo sapiens
KETLDWFIRLHQPTRPIVPYWQALAEFRDLGRRHAGTVARATLTGRRPDRYGQRVIASSPGRSGAGGRAARRPSEYVRPRDPAGRAIFPAEIDALRKMPKSSLRPAPQKRPAENGIIMGIGEQIDAQPVRLDFRLAHQATVFADL

SEQ ID NO: 936396 - protein, 46 aa, Homo sapiens
KYCQAPRQVGDSMDRSILRPGERPGLQLRNTSRSEEDGTGTWPLPG

SEQ ID NO: 936397 - protein, 123 aa, Homo sapiens
KCREKMDELQFLSGWRGWCVCVPTGPGATSAEGTLRGRQARGPSGGGRPRIPRPRRAGSGLSGRACGLGMCGAWTCLRISRPRTNQVALFRAKAPAKRLFEVRIPCLGGVVGGGPQAQGFGLS

SEQ ID NO: 936398 - protein, 126 aa, Homo sapiens
LRNLRGYYNQSEAGSHTLQWMYGCDLGPDPSSAGYDQSAYDGKDYIALNEDLRSWTAADTAGQITQRKWEAARELDKWRAYLEGTCVEVAPQIPWKNGKETLQRKHPKTHVPTIPVSHEATLRCGP

SEQ ID NO: 936399 - protein, 86 aa, Homo sapiens
VVVLRSAGCCGDQSGSQAGLAGPGGRNTSHGVFRLRRLFDLFFFPAERDPESPVVRLATRLRDIWPPLPQLEAPLVEALPYEIHTV

SEQ ID NO: 936400 - protein, 47 aa, Homo sapiens
CELYGDAALAEEFIGGDRTDNENGRLSRLELAHGGTCFLKRLNIWRW

SEQ ID NO: 936401 - protein, 98 aa, Homo sapiens
RKDNTTVTRLLNINPNKTSASGAPTCDSGAAQEGTTVLLFQFGMNASSKPGFSLQKEIQFEYKFLSLTARDPLPFKKLANGFPLAKRLGPQVREISLQ

SEQ ID NO: 936402 - protein, 56 aa, Homo sapiens
WRYGCTGDIAPVSFTLSDAACNALSGLTFLFDHCFITTRPPFVYALRNQAVVLRGE

SEQ ID NO: 936403 - protein, 114 aa, Homo sapiens
AAAVAGRAPGPSALRRCSPGGGHGGGRAAARPLLPAGALRGSGHGSDPIFTLAPPHCHYGAFPPNASGGSSVPMPAGQVASAALASAASRVAKNKKPCSGFARRTSTIAQGLGL

SEQ ID NO: 936404 - protein, 92 aa, Homo sapiens
LRVYLEPSESSMDQEPGWPMDFQKAPLWGCFWGETHSWTSLSDPCNVSQQPNYPTNALPHKEIGNNGNFTGRNQYWITYTRLTGGQAPSNYP

SEQ ID NO: 936405 - protein, 65 aa, Homo sapiens
TERKILGYIQLRKGPNLVGPYGYLQPFADAIKLFTKEPYNPPHLPSPSTSPPDLSFTIVYYEPPA

SEQ ID NO: 936406 - protein, 130 aa, Homo sapiens
PRVRQWLRLVKAGFGELTAPRVFPSIVGRPRHQGVMVGMGKDSYVGDEAQSKRGILTLKYPIEHGIITNDDMEKIWHHTFLQLSFRVGSRGPTLLTEAPLNPKANREKIDQIMFETFNVPAMYVAIQAVL

SEQ ID NO: 936407 - protein, 121 aa, Homo sapiens
MAALLAAYEPERPACGSGRGAVRMLVPPGGPAHHPVGPTVVQTSMSRSQVALLMSLLLMLLLYVGLPGPEQTSCLWGDPNVTVLAGLTPGNSPIFYRQVLPLNQAHRVEVVLLHGKGFNSH

SEQ ID NO: 936408 - protein, 117 aa, Homo sapiens
MAVSDAMHPDHFFHVRVMARRKGEDTASAPNNRWRMELSHMKRLPPVLPAAPMTWRRRPWPQTMESGGVAGIAAVQPWRPYLRETEEFNISLDLDFILSNSADPSSGVSGRQRVVSV

SEQ ID NO: 936409 - protein, 103 aa, Homo sapiens
RPSWVAPELYHQLSRPSDMEDLAAWSRPQSPPVAAPFLAELREAVGLRSFVNPVPLRPPPRRKLRKPRALSPRRRRFRFRLLAPKASKLLCRATLPTVKPQAP

SEQ ID NO: 936410 - protein, 62 aa, Homo sapiens
MVLTTNYDNLHGGLCDRQNKPMESLDLKDKTKVGLGVREAICDRQNKPMESLDKDKTKVWAG

SEQ ID NO: 936411 - protein, 48 aa, Homo sapiens
MATYRQTQLVGEQTFQLAERNVRRLCQGLGRDLATQLLIADSARSTLA

SEQ ID NO: 936412 - protein, 33 aa, Homo sapiens
PLDKKQRNFDKILAEWKQKCEETHAELEASQKE

SEQ ID NO: 936413 - protein, 54 aa, Homo sapiens
MCDEDETTALVCDNGSAWGKRLRGNDPSGPCSVIVGAPTQGVMVGMGQKDSTWR

SEQ ID NO: 936414 - protein, 42 aa, Homo sapiens
APTWCWMARSAAVILTRARIDDLGVCWQEVGADLVCSHPRVD

SEQ ID NO: 936415 - protein, 94 aa, Homo sapiens
LLPKIQKTSRARAPKAQPLSSARAGESPKPRRQRPQRAKTMPPHSSPGNRARLHLEKKKKWLLHRQSSPEDCWFSVFVEVQGRRRAPFKFSNLP

SEQ ID NO: 936416 - protein, 33 aa, Homo sapiens
PSKGAIPHFTAGETELQSLSALSHQEQMLDQIG

SEQ ID NO: 936417 - protein, 85 aa, Homo sapiens
MDALRPPCHLVGAVGAASSMAVLRPPCHSGLLGLSLCGTCSTSSNIQYYMMFEVMEPTWHILGKPEILPPTFDDVLGHHTGFLDT

SEQ ID NO: 936418 - protein, 130 aa, Homo sapiens
NGFKVTSRGTLAAQPEGSRAQWRGRNALHGIWRWCSHDEEQATGLEREIMLAAKKGLDPYNVLAPKGASGTREDPNLVPSIFNKKNVGCICEEDNTKRSSGFGCTKAKAQRMPPLLKPIYKLVPPASLAH

SEQ ID NO: 936419 - protein, 191 aa, Homo sapiens
DSPPSAQPSQVSYTATMPFGNTHNKFKLNYKPEEEYPDLSKHNNHMAKVLTLELYKKLRDKETPSGFTVDDVIQTGVDNPGHPFIMTVGCVAGDEESYEVFKELFDPIISDRHGGYKPTDKKTDLNHENLKGGDEPGPQLRAQQPGPHWAAARANTFGPKIAPVASAGAVEETLLWKLLKKADGGSFKREI

SEQ ID NO: 936420 - protein, 54 aa, Homo sapiens
MSRQRSKIRKAFLLIGKDQPLLIRRKKLEDGRTLSDYNIQKESTLHLVLRLRGG

SEQ ID NO: 936421 - protein, 149 aa, Homo sapiens
LFPPKKKGEPYEQKTFPGNSFQKILLVNSGLPDLVLAHLQESQVPHFSPQLSPQACGRPAPMLEKQTPRTEPSPRLQAVSACCIVNIKVVQFTLIPCTTLSLLILPTQNRPVHLKLSMMKDPEFVCLFVSFLPNLSWTNIFVDNKTKLP

SEQ ID NO: 936422 - protein, 161 aa, Homo sapiens
SAACEEHVAVNAKCASLEKTKQRLQNEVEDLMIDVERTNACAALDKKRNFDKILAEWKQKCEETHAELEASQKESRSLSTELFKIKNAYEESLDQLETLKRENKNLQQEISDLTEQIAEGRKRIHELEKIKQVEQEKSELQALEEAEASLEHERERSAHPA

SEQ ID NO: 936423 - protein, 72 aa, Homo sapiens
RRFPTVSRHVAARLALGLEAPAGSAGVVAESVSSLTIADAFIAAGEQLRPRRAPSQEVHLLPDCSAITALEA

SEQ ID NO: 936424 - protein, 148 aa, Homo sapiens
PCGNGQLIFQAIKKNLNYMGFFEKGYFTFYDFSSSTLKSLHVTSLQTFHCGLLNQWDAGRCPACGLSAFGRLRRADHEVGGSGPSWLAWWNPVSAENTEGPGVVRTPVVPATREAGAGQWCGPGGWSLSVAIAPLHSSLGDGVRLCLK

SEQ ID NO: 936425 - protein, 68 aa, Homo sapiens
LVGVSWPCVRRDTEKGVPYRHIADAGNPDLILPVPAFNVINGGSMPGNKLAIEENDSACGSSQGSNGN

SEQ ID NO: 936426 - protein, 108 aa, Homo sapiens
AEDPGVAMAARPVVTGIVRTSRYPKSRFCRGVPDAKIRIFDLGRKKAKVDEFRLCGHMVSDEYEQLSSEALEGCPKFVANKYMVKKLWQGWLPYPGCGFHPFHVIRIN

SEQ ID NO: 936427 - protein, 36 aa, Homo sapiens
TPGRADHCPSSRLNPHNAALRNPAPNKKRKSKLIME

SEQ ID NO: 936428 - protein, 182 aa, Homo sapiens
LILTLTSEEGVSITHTLDGQFDEANNAEKAMNNLKDGLAKLGQTLYYARDVQINLPGCLYQTVCVNQFRREAADMLDAARLASYQRGVNRLLILRRFIRKQHLSFLANVYNQKAREFYHRYGVQLIDAAYEAHEEKGEILMITKHCLRFALICARNRRKGNIKSWATQCNWLTAMKFNAKVD

SEQ ID NO: 936429 - protein, 77 aa, Homo sapiens
NSHGKHEQPRQTQATANTSHGKHGPRQTRTATANTGHGKHGPWQTRTAMPERARLHLIAEAKQGWAWLVLETNWVQV

SEQ ID NO: 936430 - protein, 110 aa, Homo sapiens
MPKLLPPHLDPPETVPQQEIYLKKSFYTKNCDCPPEVRGKEYKNNEYPNSLILFGLLDPFGNPSFLSKVNKKGKPQHRMFLTHKWESNNENTWTQEGEHHTLGPVQGVGG

SEQ ID NO: 936431 - protein, 123 aa, Homo sapiens
QRSNPWLKKLDWQEKLVAWPKFKARFQNPVFFMQIFGQFFQLNRTSIDFHIHYRQQMLSLVHQHYGLYLCVSAILLFTATWEQVSLGPTSLGHLMLSDGFFGQVFPHLFQVITSHFLCCHSSK

SEQ ID NO: 936432 - protein, 77 aa, Homo sapiens
HPHHSTQLRDGTCTHSARLPPNTAPAPIAPSSEMAPAPTAPGSHPIRHPHPQHPAPRWNLHPQRPAPTQYGTRTHCI

SEQ ID NO: 936433 - protein, 146 aa, Homo sapiens
NYHLLNEAAFEQMKNGVMIVNTSRGALIDSQAAIEALKNQKIGSLGMDVYENERDLFFEDKSNDVIQDDVFRRPVCLPQRACLPGHQAFLTAEALDQYFSDYAAKLKAIWEKRPKTLPRTELGFKSLAGSPCIPRGADFRLIPNDP

SEQ ID NO: 936434 - protein, 52 aa, Homo sapiens
MGKKDLGPSRPFCGIQSEVRKHPLGQCLQALTHDLREVRRLPSAFLSFPSVV

SEQ ID NO: 936435 - protein, 96 aa, Homo sapiens
PRLESGTSAHCKLHLPGSHPPASASRVAGTTAPATMPGYFFVFLVEMGFHYVSQDGLDLLTSLPADSGSQSAGITGVRHRAWSPSNDFLNIRFSPP

SEQ ID NO: 936436 - protein, 157 aa, Homo sapiens
GPLTALRAWVSIGQGTRSEDRRRSPQPQCPSPPPAWPRASAPPHEGRGEGALWIGVPPRYPGCELMDGKRGQAGRQATQGVGSGMALKMSKDSTGRVDRRGAAKTLDTPASVCPLALAGCREQRLKREGSRFVHPLWCGWGDGGVGGGAHNMAGRNS

SEQ ID NO: 936437 - protein, 96 aa, Homo sapiens
HTVLRDCVQCQWQAKVAKYGDWFSYDGSPRQIFRRNQSLVQDMDSMVRLMRYNDFLHDPLSLCKACNPQPNGGGMLFSRSDLQPGPMSLPLSRGLR

SEQ ID NO: 936438 - protein, 76 aa, Homo sapiens
MYHASKSAKRALELRFQTEEKIERTQRTIRSIQEALARNAGRHSVAFTSCRRSWQPSASQFRAQEALQQEQRADTH

SEQ ID NO: 936439 - protein, 82 aa, Homo sapiens
SQISVQVTTAKDLTSLVFLLESLTCTPTQPPLKSSPWDHLKQEAWGKALPSAVSGLPSAGQEVVDGTAAGWARVGTAGMAGF

SEQ ID NO: 936440 - protein, 69 aa, Homo sapiens
KQEGLLRSLQEHGLSTSASTLRGTHLGAQRPQSVVLSQKQPQETNPARPDHQHGREGSKDLSPQDTVNT

SEQ ID NO: 936441 - protein, 56 aa, Homo sapiens
MSRLMLEEDPNCSRGNTRSEHSHLFGGKDSRKVVHRWVGRKTLRESGDNQFTFEYF

SEQ ID NO: 936442 - protein, 40 aa, Homo sapiens
DLAGKYRQILEKAIQFSGAEQLEALKAFLEALVIEIFSFV

SEQ ID NO: 936443 - protein, 37 aa, Homo sapiens
AGFFFQVETFRKQSSPELTGQAKKQPSLYPPYVFIWT

SEQ ID NO: 936444 - protein, 97 aa, Homo sapiens
LRAIQQAVGSSLQGTCPMIKMALGVMAFDGGAAVHGQSPVPRESGGTDTATVLGHGPRTASSQGVSVLGSPGYLGVSQPGTRPGGKVRDIVEFVGFK

SEQ ID NO: 936445 - protein, 148 aa, Homo sapiens
SGRLEKMVLRRLLAACVHSPQLVERLSESRPRAAHHGRSHCMQAQRAGQDAARQDLAAGPWPVCRREDVRDSFTQERYSAASESGATTKVARGALAQTFNPGLCGAEALAFPSGLYSGINVEGSFRALRRLRIPTGIVGLQDIPRIAR

SEQ ID NO: 936446 - protein, 80 aa, Homo sapiens
DATGTKRYQYQLTFLSLFGKRTNFLAHYRHPFPFLSTFFYMPTLSKKKSNVQSTGISLDCMTPGQWGKGYRGQGLAFREL

SEQ ID NO: 936447 - protein, 107 aa, Homo sapiens
LLEIFTSPLNLLLLGLCIFLLYKIVRGDQRRQRNKERRRAAPSAPPQGNFTPAELRLSRPGTRAYSWAINGKVFDVTKGRKFLRARGVIKGSFAGKRCIQGAPHFCG

SEQ ID NO: 936448 - protein, 49 aa, Homo sapiens
SSDIYEAVEIGDSYWIRCKDGVVFGEKNRPSKPYEGGSTKGFLMLIGKL

SEQ ID NO: 936449 - protein, 80 aa, Homo sapiens
TGRPGVLVVEFHHFGVVSLTIFGDVTLSQGEVEKRLTWNLIYTQAALPYHFPHKRGHTFWHSYLLASLIPEEASPYPREE

SEQ ID NO: 936450 - protein, 105 aa, Homo sapiens
EAERSACVGRHARMPDVVSWAPRPWLAAEAQAQRGEAQAHPERAFREELSRLYSSVRVKDSPPCQWSRMASEGTNIPSPVVRQIKAVSDQYMPGTVQESQGSSLF

SEQ ID NO: 936451 - protein, 32 aa, Homo sapiens
GGGSSGVRGFKSPKGKKKPGPDPYLSVAFLWI

SEQ ID NO: 936452 - protein, 70 aa, Homo sapiens
ERTKGKKKSKKQPPAEAAGEPVQNGAPEEQLPPESSYSLLAENSCENDPVTSGAVCRRTARSLVAIVLNR

SEQ ID NO: 936453 - protein, 69 aa, Homo sapiens
RDRLHDSPNPAAECQRYRSDRSPESPGPAGFTWDELAASGLPSCDAAVNLGRREHPQPSKMGMKPKKSL

SEQ ID NO: 936454 - protein, 31 aa, Homo sapiens
WKNQNSWGTGEDVKVILKNSQGEEVAQRSTV

SEQ ID NO: 936455 - protein, 78 aa, Homo sapiens
RHGGVGNGCRTWLFIREFPIYHPLNLELQTPYAQPSNQPAALALTSKGGLAEVIQAFSAPENAVRMEARDKPANDMGK

SEQ ID NO: 936456 - protein, 31 aa, Homo sapiens
PDLNCDPNLNCSPDRNPYPPPTSMARHVFLT

SEQ ID NO: 936457 - protein, 41 aa, Homo sapiens
SEAAGCFERTRWLCSTQLDPVAQAPPRPTAVSCASQRREFE

SEQ ID NO: 936458 - protein, 67 aa, Homo sapiens
TYSSDESRKSKLKTFWKGFTILDAMKNIPEEEVKISALRGVWQTLIPALKNDFEGFKTSVVKLADVI

SEQ ID NO: 936459 - protein, 71 aa, Homo sapiens
CLIVPRSSPNPRMEVLPREAAKSTLRVILHARPLLPPGGTSPSPPDFKLRIVVSLAGCRTEPRQPIHALCL

SEQ ID NO: 936460 - protein, 37 aa, Homo sapiens
RLHGYHTLEDQALYNRLRQENMHFEICPWSSYLTGAW

SEQ ID NO: 936461 - protein, 62 aa, Homo sapiens
MCLEKLQTLNASPMKAARRETVPCKATGAELAKTTGTHLLHQRDPDMRHGVKEILEALDLTA

SEQ ID NO: 936462 - protein, 35 aa, Homo sapiens
GTSCGGECSEAPGQYYKDAMEQCHNYNARLCAERT

SEQ ID NO: 936463 - protein, 93 aa, Homo sapiens
MPLPCPEAQVCGGPPQARMPLLLESLSSTDVALLLPWLQTEGCHSPPCSDQAQENMAPEPPRECVLSKLTQKLCSLSGSVTQTPSSPCISQAV

SEQ ID NO: 936464 - protein, 69 aa, Homo sapiens
RDLGGLGADQGDWATLRSVAAGEESAGPTRAPLSDHGMMGPKQLSAFGEYVAILPKYVQQVQVSCFNEL

SEQ ID NO: 936465 - protein, 79 aa, Homo sapiens
KPVIVTGLQDTTVLQTVLLNLQLRLLENPTNCHLERPLHKEVNINSPEDKGGFFLEIHKTDTSDSGLYTCTVKIQLDLC

SEQ ID NO: 936466 - protein, 110 aa, Homo sapiens
EIQLNHANRMACGGLRNYRNTQGILKDTRSTWMMLSGPGGPEGIAGHGAQSNLLQAEIDELRGHSGTDEEQKIRRTRSSWDASERVQLLHPEHQGLNTQEGSETYFPKCQ

SEQ ID NO: 936467 - protein, 35 aa, Homo sapiens
MASNFNDIVKQGYKDPKQTPGGFISDAGLIFKKAF

SEQ ID NO: 936468 - protein, 50 aa, Homo sapiens
GLGSAGDGAAACMLLALTRKGLYFHIGETEKRCFIEEIPDETMVIGNYRY

SEQ ID NO: 936469 - protein, 49 aa, Homo sapiens
ALEGTPGGSDLRAGAGLGDVGCCELESACGGRGQFCVAIVFNASLNSLY

SEQ ID NO: 936470 - protein, 57 aa, Homo sapiens
RTKKIMAHERREKVKRSVLVLSTHVLGKEKIASMLPGAVRSCRPRRGARIPPRRLKP

SEQ ID NO: 936471 - protein, 114 aa, Homo sapiens
ATQPRVSLDVFGNRAMSTVLSVPAETSSASSTTLTSQSRDLQGRLPSRPHAPERHLKRVAQLPLKACLLEDFLDKVPAHPLGPGGGVHRSTRAALVVSHCQRWQNNSHRRARAC

SEQ ID NO: 936472 - protein, 38 aa, Homo sapiens
PPELRRACSRPPVLPVSRFSAPQPPVPAFRGPESQPTK

SEQ ID NO: 936473 - protein, 127 aa, Homo sapiens
GRKLTLGASQAPGVTQQKCIRKASGRPGFGAGVSTKASTPPETRSSPGRLLPPSLCTALFPFSLQAGLLLSSDGLRAVLFSCVTSSCSSSCSDGFTFPYSPLLSPLQGGFEVASSSRRRPKHRYGVA

SEQ ID NO: 936474 - protein, 73 aa, Homo sapiens
MSTGLRYKSKLATPEDKQDIDKQYVGFAHPNQVHRKSVKKGFDFTLMVAGESGPGESPHWTAFFLDRLCTKNG

SEQ ID NO: 936475 - protein, 28 aa, Homo sapiens
PRKGLGPVEPQCPFGLAVIADNKEPVAL

SEQ ID NO: 936476 - protein, 133 aa, Homo sapiens
RISENNVIFSSYKGKLETGIPSTGTTTTKTLLGTSRLFEDTVLLCCSGWSAMAPISAHCSLPPPQVQAILLPHLPSSWNCRWPLPHLANFCIFSRGRVSPCGQTGLKLLISSDLPALASQSAGIIGVSHHTWP

SEQ ID NO: 936477 - protein, 117 aa, Homo sapiens
HEDCIGLRGIVHHFALEQSVQFPRSRNVVFDVQIPKGAFISNCSMTVDGKTFRSSIKEKTVGRALYAQARAKGKTAGVRSSVFDMENFRTEVNVLPGAKVQFELHYQGGEVGGSLGS

SEQ ID NO: 936478 - protein, 75 aa, Homo sapiens
GTRGGHRGEQRLGAKSEPRCSGLRASRRSWTGEMKRKMREDVISSIRNFLIYRGPPASHSIYLKEIGQHMKTGHI

SEQ ID NO: 936479 - protein, 72 aa, Homo sapiens
MSDNEDNFDGDGFYDVEEDEGLDDFVRMSAERRHRECRDLSLSGSERKGTPRKRITHTIYSAQCARARVLCT

SEQ ID NO: 936480 - protein, 103 aa, Homo sapiens
SCIEVLVDSAEEGSSLRRRLAAQKAEQRLRKFRELHLMRNEARKLNHQEVLEEDKRLKLPANWEGQKSSFGVWDLRRGEGKGLRQEEKTIESEGSGISAEDAE

SEQ ID NO: 936481 - protein, 37 aa, Homo sapiens
MLINPTLRNALNISYIPFQHRARPITGTLLSETVTQG

SEQ ID NO: 936482 - protein, 91 aa, Homo sapiens
MEGFLRQKAKGGVFGWSRAVCCVVRMDHIVGVIAFYTSLKKPLGPFVPDERCRFCASMHTRGQAQWPTLRFSESFHEANTFSLTSHVFPRG

SEQ ID NO: 936483 - protein, 92 aa, Homo sapiens
HEVPEGKVEGNVGDRNALPGAKVPGACADLQPGNASPCILDDTGCFIGTSSPLCRLGIKAIFSLVKESAEHTSLSAFILLGRSGALMCWGGW

SEQ ID NO: 936484 - protein, 138 aa, Homo sapiens
SWETGKAFQELLSKRRIASTRKVWLSPEPQKPAGSSKGGPARGYTPTLPPAHGILQPDSVAQAAWLLSPLASSPGHTGDGPKHGLCCCHGAKGPGKHGVFLAGRRHRQNLSFALQLSLGSLDLMDPFNGWLIPPQSWD

SEQ ID NO: 936485 - protein, 74 aa, Homo sapiens
MAGRNAVAGCGGGNHHAGGKDSQYHTGCFLFTPGKTPHIEALLPGELIVAVTLPTLGGKHIYRKVIAPPTPLPW

SEQ ID NO: 936486 - protein, 52 aa, Homo sapiens
MKHQWGDSSSLEILKVFEEQGLWGFLQFLSWQVFHTEGAQEPGLKIIDAQTP

SEQ ID NO: 936487 - protein, 86 aa, Homo sapiens
KKWLEKGEIQKRGKKSSGITCLLCSDDVRRLENLLPLGSAPSSGVLFQPGALDALEETCSIRGAACRLHTAQDGFDCGPTQIHKLS

SEQ ID NO: 936488 - protein, 92 aa, Homo sapiens
GGHSELKRCLNQKASRTNLFKNKEGGVPAGRKLDKGGSLPAGYLQGNNRVLGFQAHPREGYLRGTYNSQGNAPSLGNVFHSRADPLLAVVTK

SEQ ID NO: 936489 - protein, 127 aa, Homo sapiens
SSKFHTQATLDPYAPSCLAPSLPWGLGSPCLSFLFPLSFPSLPLPLSTLQPHDLASLCHRIKGSIMEGGFPKHPHVLTYKWDLDDKKTWTHRGEQHTLGPVGRWRVGGGRGSEKMTNGYWASYLWMK

SEQ ID NO: 936490 - protein, 91 aa, Homo sapiens
MGLSDGEWQLVLNVWGKVEADIPGHGQEVLIRLFKGHPETLEKFDKFKHLKSERRDEGILELKEAYVPHFLTPPWCAYLKRERGIYESTDL

SEQ ID NO: 936491 - protein, 76 aa, Homo sapiens
LSELQVEQTSLEPLQESPRHTGVWKLREVATEGIRGHRKMVLYNLRATKKPQDGQESCSFGGRLNRSTSSIVLASK

SEQ ID NO: 936492 - protein, 57 aa, Homo sapiens
HTAHLDISRTTMRWFRREFMQRRGQKWYSDPVHVLRADDLGGRGELAEEEASTSARA

SEQ ID NO: 936493 - protein, 135 aa, Homo sapiens
SRRGFDPLKLEIYLTDEDFEFALDMTRDEYNALPAWKQVNLKKSKRPVLSWETAKEPTGHVQEHHFTREIGNIFWGSGFSQRIFQSEVSGPYIVKGTPFSRGGDFVNVKGPLLELLSPFRGCRINKGPFMALSGR

SEQ ID NO: 936494 - protein, 43 aa, Homo sapiens
LLFLYEDSCLAVGVPGGCVSIKGQRQYFDKIRVRIYYYIVQGM

SEQ ID NO: 936495 - protein, 70 aa, Homo sapiens
SQPFPEVPPWTGEVSQAKRDGGALGGGPWTSSNRSSLLKRKLRALLTPLEASRPACLGEDEKVEPERLAI

SEQ ID NO: 936496 - protein, 35 aa, Homo sapiens
MSSFSTTTVELPPYTGNSRLLVKTRANPMYNGVSN

SEQ ID NO: 936497 - protein, 49 aa, Homo sapiens
KFGANAILGVSLAVCKAGAAEKEGPLYPTMRFGWDPYLYSSARFNLITG

SEQ ID NO: 936498 - protein, 48 aa, Homo sapiens
MLLQPAGSLGSYSYRSPHWASTYSVYVGGDRYAQYRVVVQARQQGPLG

SEQ ID NO: 936499 - protein, 52 aa, Homo sapiens
YLHANGLNYSLSASSYTSGEAILRIILYSEPEPSALSSCFALIATSLNRLCP

SEQ ID NO: 936500 - protein, 63 aa, Homo sapiens
PSQGTHDFCPSPSEPRYTQGGEHHGQPGTGKSWAKLRWNLQQEREVGWFFHHFQALNAGLISG

SEQ ID NO: 936501 - protein, 59 aa, Homo sapiens
SSESTSLESDLFPTSTSLSPFSFGHLLLRHQLFDTGFQNALEKDSFFNLDVSIFPETQV

SEQ ID NO: 936502 - protein, 72 aa, Homo sapiens
TDNTLRLSRCQEKLELAEKKATDAEADVASLNRRIQLVEEELDRAQKPPGNSFSELEEAKKAADKIKKALKS

SEQ ID NO: 936503 - protein, 87 aa, Homo sapiens
QAEGRWEANPDGSQQQQQQQKQQQQPPQSLQRHGSPDSTFPGVLLLFFLHWVSWGGVPPLGSPVQLGFELPVTGNFRTAVDSILGPQ

SEQ ID NO: 936504 - protein, 51 aa, Homo sapiens
KKEELLKQLDDLKVELSSCASPKWTGGAASKLSKIRVVRNPLPVFSQFLPR

SEQ ID NO: 936505 - protein, 34 aa, Homo sapiens
MPLLLYCAAGLATLRVELESPAKSSVLVVESSCL

SEQ ID NO: 936506 - protein, 145 aa, Homo sapiens
SSWGTVQRGTQGLPSWGQACHHPYLPYLHSQCGNALGPPPTSCPQCPSTSPAYWGVALKPEGPQGALRSRRPLPRGATQQKHLRRLGQPPSGPGGPWPRLGCSPGAAVRSEDRGRSSLPLPPLVDREQGRRLSATQQLENQAELV

SEQ ID NO: 936507 - protein, 85 aa, Homo sapiens
TTTRPHGLSPARRFCPRAAREGNPDRERRVPEPGAVGPEASISREPQVACKDVKVKKKTLKIAKMLLSQNAFIFRSLNLVLMVYI

SEQ ID NO: 936508 - protein, 126 aa, Homo sapiens
HRDMRDRPLSAISSLGGTCVIGDPCMSRARSLPSGMGSVEGYHRESAWCHPTSSPRRVSLVPGEGALEPGSLPPAQRLQICCRFRCSSSCCGLMTTVVGLASHGTGLRHLVADWVLRSEGQGGAED

SEQ ID NO: 936509 - protein, 61 aa, Homo sapiens
FGTAGSGPIDGVRGRRQMTAFGSEYPPFWYAAQRSPASFSSPHSKLSRSCSNADKVSTCQH

SEQ ID NO: 936510 - protein, 92 aa, Homo sapiens
EFGTSEIFRSLHTLVGQLDLRDDVGGKFTIRLGTRLPEPLWHSALHCSLSALEHTHFYINRPFFEQNFSLQLREEITTAVEEIGRNRHGAHK

SEQ ID NO: 936511 - protein, 41 aa, Homo sapiens
FHFTSHQIRRSPAMALLTAAARLLGTKNAILVLFLQAPACQ

SEQ ID NO: 936512 - protein, 33 aa, Homo sapiens
KLDELHFQFLVRSRAARTASAATYGSRQQYGIL

SEQ ID NO: 936513 - protein, 83 aa, Homo sapiens
MKSVLSVFPGEDSRSSCLGPSGQPRHLFAWLISLLVPFAECSLALRVALCWTQLTLPGGIIKPGGPQSSRSHSFHILFRQAFP

SEQ ID NO: 936514 - protein, 70 aa, Homo sapiens
HCPRFISYFLSQPKECDRPHTYTPMEYYAGKKDEFMSFVGTWMKLETIILSKLSQGQKTKRRVFSLIGGN

SEQ ID NO: 936515 - protein, 83 aa, Homo sapiens
PTVSVKVDLLFQALGRTYTDEEFDEPIFEFGLELDEITSEREYYGKDQGIVRQQEPLMLFFTKLTSLPIDMISVSGGLVRGLR

SEQ ID NO: 936516 - protein, 42 aa, Homo sapiens
MVNPTVFFDIAVDGEPLAGSSLSCLQARSKQAKFSGSSTEKK

SEQ ID NO: 936517 - protein, 51 aa, Homo sapiens
NPRDVEYGTIEGLITTNVGDSTLADLFGSIRWYNKEGGLWPPFSGSKTSAP

SEQ ID NO: 936518 - protein, 74 aa, Homo sapiens
RVQEEYWEDLEEREVEAYNLGNFFASRKGYSRKGFDRLSTQGSDHDKEDDGVIQRRSIQHSASLELPLLQTSFD

SEQ ID NO: 936519 - protein, 41 aa, Homo sapiens
ETEAADGAGSSYSAQVIGLKNALSSALAQNTDLKHLRRNPC

SEQ ID NO: 936520 - protein, 67 aa, Homo sapiens
IIRLLELPHSAGSVTQCTSLPSSGGGPPRSSFPGTSTFKRSRAVRARRGPSNKELPGSWGPRLDLAV

SEQ ID NO: 936521 - protein, 51 aa, Homo sapiens
TQKYIGMSSVLPRKIAEGRMPGWTSLAAPFADHCPRLGLQAGHPSGLTPAT

SEQ ID NO: 936522 - protein, 63 aa, Homo sapiens
KILGVAMGRRPTRCYRYCKSKPYPKSRFCRGVHYAKIRIFDLGRKKAKVGISFRFVAMVSDEY

SEQ ID NO: 936523 - protein, 42 aa, Homo sapiens
MCDFTEDQTASLPPSLSTLDLSQALEFREAFHCFDRQVMAGS

SEQ ID NO: 936524 - protein, 55 aa, Homo sapiens
RAAQAEGRWEANPDASQQQQQQQKQQQQPPQFLPETLVPKQEPSRGGSCSFFSSQ

SEQ ID NO: 936525 - protein, 129 aa, Homo sapiens
RRLSALALCMERTEPDEVVMSQAIQAAHATARGELSAEHLLKWIDTTGCLAAEKHAGDSCDTASADDIQLEETGRVGQVITIKAQDTRALSTSMEISIKVMAQDMLTGIEKLARVAFMTFVAPAGEEVR

SEQ ID NO: 936526 - protein, 69 aa, Homo sapiens
LKCSTVVCVICLEKAKYLLSSLPRALNSATLKLVLLRKNKISSSTKPVKPVENTDDDDSIAEFFNSDEE

SEQ ID NO: 936527 - protein, 99 aa, Homo sapiens
MEKKLEKGQSIDDMIPAQKEALPTCHRLLDPASGRAWPPESCPSLSPAPVQSPPGAFHLSESSSPESTNGSISDLAINISMAGPFFSRLTQPGVYLMET

SEQ ID NO: 936528 - protein, 53 aa, Homo sapiens
VNELAFTAQQDDGLTEGPRAVGLGQPGAFPGQRRLMLDAALASGRPEIFQQEP

SEQ ID NO: 936529 - protein, 80 aa, Homo sapiens
RKATSILKDVTLQSTVCTIPTLHWWEFGKVLRRPKQWGWTQGSVGPQRVLNFRLHMLKNRREYIAELKGLDVDSLVIEHI

SEQ ID NO: 936530 - protein, 133 aa, Homo sapiens
KVVTKLMPLGPPGRRRREEESGADHRAQAEPDLDGQEFPGNCGVREMALSPALRGPALDPAHICTGSHSTWEGHTQMPVLLPKQTHGETTDLDPPGRHCTAGMDSNCPHKNHVIPCAEPEPLPSSPSFILGLR

SEQ ID NO: 936531 - protein, 31 aa, Homo sapiens
MAPLGVDPSADGEEMESPRGGGLFKSPRKRV

SEQ ID NO: 936532 - protein, 67 aa, Homo sapiens
TMQFYSIKSELYEIPVIGSDPAHHGGFYLLMNIITQDVCIRGVVYPNHKIALPSTVNGSSCTFRKIL

SEQ ID NO: 936533 - protein, 125 aa, Homo sapiens
ARLITIEINPDLCRPFTQRIGWISLGVKDTGHPLLVWRRSRDIHSPQLEGRKVLIVGHTWTLVFSRTHLEGTGYLAGTRFLFGRECWPSLRKGGQFYLADNGDLPRCARLPSTRAPGAAAFECTH

SEQ ID NO: 936534 - protein, 154 aa, Homo sapiens
MTYAYLFKYIIIGDTGVGKSCLLLQFTDKRFQPHDVIGVEFGARMVSRGVQANLGYGVGKNPSVLSPVPTTWEQLEQLLVYDITVRETFSHLTSWLGDARQHCSSNRVIMLIGNKSDRECRIGEEEKKGRPLLGSHGRIFRGTSAKTACNEKPH

SEQ ID NO: 936535 - protein, 30 aa, Homo sapiens
RTHESPEQPHRRRRLVTITPREEPLPQPAP

SEQ ID NO: 936536 - protein, 86 aa, Homo sapiens
SRLTHLSPEEKAPQGGKPEKPEEPAFRTFPRGSGKEGLLNLVVALGTNQEWVGILGRRRNPKKLFFSLEKNQRFFLGEEKPFMPLL

SEQ ID NO: 936537 - protein, 95 aa, Homo sapiens
RSPLVTMNHICANLLFLSTAASSPNYEMLKEEQEVAILGVPHNPSSPMFNVIHNSQRDTSLPYTSVAWSLFQTHLFNETHSLALGFHMPYCGVSR

SEQ ID NO: 936538 - protein, 84 aa, Homo sapiens
GNASIQGNWKDKFMKEATTNAPFRLNKKDRKTVKMMYAEEKFAYGYIEDLKCRVLELPYQGEELSMVILLPDDIEDGSTGLKEI

SEQ ID NO: 936539 - protein, 110 aa, Homo sapiens
MKAHSQTDRANLGTLRGYYNQSEDGSHTIQIMYGCDVGPGRFLRGYRQDAYDGKDYIALNEDLLLDLRTAAQITKRKWEGPCGGRKKSTWEGPGAFDGLRKITLEEPGET

SEQ ID NO: 936540 - protein, 59 aa, Homo sapiens
MRALFPGWGLLRPGGWRPLQIAVENGFGGVHSQKKAKLGGVEDYFMRNADELDVEDFLG

SEQ ID NO: 936541 - protein, 147 aa, Homo sapiens
PEKLIQVPASRVASLPCSSLAPPRVCAARGLKIGQATAQENLLFPYLSMEKDSFARSGTCLKSQHFGRLRQVHLRSGVRNQPGQHGKTLSLLKIHTYKKISWTWWCTSVIPATQEPRQENLLNLGGGGCNGLTLHHCTPAWMTEQCL

SEQ ID NO: 936542 - protein, 116 aa, Homo sapiens
MATPAPGNLVVLGSLQPSGCLGSLHSSLLGTQGPGGIGLTRDKGPRWLDLETACKFGRLPTLKGKLVSESLHQQLESIQVLFTWDLTKVVPTTHGEQRKSTVVLTAYLGSHIGGKR

SEQ ID NO: 936543 - protein, 45 aa, Homo sapiens
DDEEMDPQTIDSLIELSALHLPADDVVSIIEEVEEKLEVEKFLPS

SEQ ID NO: 936544 - protein, 81 aa, Homo sapiens
YGNSTDPAAAPAGAAEQALQQQFQQQQQSLQQQQQQQQQQFQAQQSAMQQQFQVVQQQQQLPAAAAAAAAFIEIGIHSFRQ

SEQ ID NO: 936545 - protein, 39 aa, Homo sapiens
LMIKAFLPMLAQKSGNIINMSSVASSVKGTVDTPSLQER

SEQ ID NO: 936546 - protein, 105 aa, Homo sapiens
FEMEFHSCHPGWSAMARFSAHCNLHLLDSSDSPASARAAGITGTHHHTWLILISRDRASSCWPGWSRNSRPQVIHPPQPPKVLGLQALSHHAHPYSGVFEKENAT

SEQ ID NO: 936547 - protein, 117 aa, Homo sapiens
PNLTGGPLYPVLSLKTSPTLRALEWVNCFYLPTSLVNSRNFFMMKCPIYWAQVCWLKPVIPALWEAKVGRSPDPRSSRPAWATWQNAVSTKNTKISWSWWYMPVVPVTQETKVRGSL

SEQ ID NO: 936548 - protein, 69 aa, Homo sapiens
TGRIRQGGCSEPRWQQYSPASARHQRETVEEREEDRGREKRGRGRGLFLKFFKIAEQGYLWAVCQNTTF

SEQ ID NO: 936549 - protein, 101 aa, Homo sapiens
MKSLILLAILAALGKVTLCYESHESMESYELNPFINRRNANTFISPQQDGELKSKRGSNALSRVHRNREACDDYRLCEYMVYGYNAAYINRYFRKPPKGPN

SEQ ID NO: 936550 - protein, 69 aa, Homo sapiens
SFVPRAPFTMSPRRRFPRAGRELVWGPASARVPPPLWEEGAPSQPGLERRRPQARGHHGTNSLTDPAAA

SEQ ID NO: 936551 - protein, 72 aa, Homo sapiens
APQPLPPSLHLALPGLMYRALYRSARRAIRAGVRPGETFLVLSDDARTGGWPRGRSGETGYVPPAYLRRLQV

SEQ ID NO: 936552 - protein, 95 aa, Homo sapiens
MTDVALMMRRGVYDSSVGSMTGCGVDDGVWGLMTGHGVYDSLCQTKPHQLILSTPFLKTKDEHDQNLKTFFQVLKTDELLQVSSRLINRGKECWH

SEQ ID NO: 936553 - protein, 32 aa, Homo sapiens
QTPSYAERDSLSSSFRLVPIPNTSEQIPRLTD

SEQ ID NO: 936554 - protein, 40 aa, Homo sapiens
SPLREEHVTCVQSILDEFLQTYGSLITLSTDEVVEKLEDI

SEQ ID NO: 936555 - protein, 110 aa, Homo sapiens
WWRKGACPLEGASLPPWNLGCPLQWPSSLLSLTQAGKWRICVPKEPHSFQSRLPLPEPWRGLRDEALDQVSGPGCIFVHASGFIGVNPPRGCLEHGPTLAQRLIPPNLLV

SEQ ID NO: 936556 - protein, 91 aa, Homo sapiens
QLVGAAYHPTPVEKAWALANDSNSSADEVLMGRLVLDWQRPVVRRNGGLDAHLVQAKVKLYCQDMAGWWTQEAYPTRWYLANTEDVVHGGA

SEQ ID NO: 936557 - protein, 30 aa, Homo sapiens
EAIPPPLGHVLRAVTRYLCSPGAVTGTKVY

SEQ ID NO: 936558 - protein, 55 aa, Homo sapiens
KLYFTPLSTLLDLYSGGEQDRIDSIPPWQGPSPPGASIDLTIFLHLQVSSIYGTY

SEQ ID NO: 936559 - protein, 37 aa, Homo sapiens
DPVRVKSFSCIAKSCGIIAGSLEEPLQLEVVQGAGDS

SEQ ID NO: 936560 - protein, 109 aa, Homo sapiens
VLRRDLERKKPGRGPALASLLTGQNRAATPTPLRTACLQKSLLVSSSPRSPRGTPERKNELQNRKGARFSRDPSPLEQDGALYLRCPLPPGGAQVGAGSGAGTGRVRLL

SEQ ID NO: 936561 - protein, 88 aa, Homo sapiens
AERREALRVCAEVHAQTALPVVALRRRRSPKRAEIRLQATICSRPLRKTTSGEVATLMERFPRMARFPLLHKPYHLRDHRAVYVYLRT

SEQ ID NO: 936562 - protein, 114 aa, Homo sapiens
MADTNSVATVEIERTDAELFSADVNNYCCCLDAEAELETLQEPDKCCGGQSTICGRDRKRAWRQEHLLLVSYNVMCDIHTSNPGCSSDKNTSSESYETQTFNSMGVAATPAQRA

SEQ ID NO: 936563 - protein, 82 aa, Homo sapiens
SHVVSRFHVDSQSESRAQLYRQIVMHHLQADRGDYSSWEVVSRESWTHVAEARPITHVSYVLGELIGQPQEHLSFDVAQRKG

SEQ ID NO: 936564 - protein, 55 aa, Homo sapiens
MNLLESAGFSRAILIILLTRKDQPDGTAPDSQRLSYYEKELVLECITTEGGKHLL

SEQ ID NO: 936565 - protein, 54 aa, Homo sapiens
LHDDDEDEDMLETADGDSMNTEESHQGSTPSDHQPNTLRVHRRDLFNHSIVLLD

SEQ ID NO: 936566 - protein, 98 aa, Homo sapiens
MPLLLLVLNLDRSQTMGLEDEQKMLTESGDPEEEEEEEEEISDRTEAFSAYLATLEGRNVNFSYYLASELNGRRILHFCRQLALQLASARIPNNSREH

SEQ ID NO: 936567 - protein, 83 aa, Homo sapiens
KKEVPAVPDTLKTKRRNFAELKIKRLTQKFAQKMLRKARRKLIYHKAKHYHKDYRQMYSTQIASGEDGKDKLATSMYLQTQVG

SEQ ID NO: 936568 - protein, 73 aa, Homo sapiens
PKEGCEKKRAVLAINRRVNPEDYTIQPFTGAFHWSWAFKEGVPPWATSKEIPGNFPLREIGNLQMFRIDTRLN

SEQ ID NO: 936569 - protein, 95 aa, Homo sapiens
DNLTIVAGIFIGIAFLQIFVDMPGPEFGERYRSCQGELVRPPPTAAARHLTDPAFGTLPGAELIFELHGPNTDAACKSRLMELPLGECKPGKCCY

SEQ ID NO: 936570 - protein, 66 aa, Homo sapiens
MTSEWSVCAEGCSCSCRAVVAQTCMYLENWEDLVLRKLAGLETIGGGVQLGNLGELGDKRGELPMG

SEQ ID NO: 936571 - protein, 74 aa, Homo sapiens
KSKKYTSSSCQVDSKHVEDILGNHKSPSPVNKERCISQLKSMTFWMSKKRSALNDKGGQQKHSEEVPDPVIRLF

SEQ ID NO: 936572 - protein, 230 aa, Homo sapiens
ASCRNYRGGFNRSGGGGYSQNRWGNNNRDNNNSQQQRQLQPGSPATAATTAASADHSHHPSSHRHHPATALLGTPQGQHLQVRTATSLAQAPIPAPPPSAATALHSPSYSQPPYNQGGYSQGYTAPPAPPPPAPCGYNYGSYGGYNPCPYSGWKPAPHGPNSSSQLQTSISSMLQQWNACTISNQGQLAAILRGTTTYGSYSGNTQGWHKIHSSQCDPEAPGGPCAGSSN

SEQ ID NO: 936573 - protein, 57 aa, Homo sapiens
EDWRDEHRSNFAEDLVYQIDGGDIATGYFGSLVEHLAQVFRYLACFKKGDAMIMEDT

SEQ ID NO: 936574 - protein, 60 aa, Homo sapiens
VEEKKKEVPAVPETLKKSEEFPELKIKRLRKRFAQKMLRKARKEAYLMKSKALIHKDFGQ

SEQ ID NO: 936575 - protein, 72 aa, Homo sapiens
EVRDRRCVFSPTDSRSSRASAFEVAFPRGQPRKGPKRDNWILGTRPSWVAVCSSPRLGLSRGVQTSLCSVLV

SEQ ID NO: 936576 - protein, 61 aa, Homo sapiens
RILAGIKEGLTHSYYWYTDQRKYGTCPHGGYCLAFDRFLTWILNRYHIPDVSLYPPICPRV

SEQ ID NO: 936577 - protein, 54 aa, Homo sapiens
QTSDLATNLKPSWEHRTSKEMIFLGPHRNFHQLHEGLLLRIADNMRKDGPPQPP

SEQ ID NO: 936578 - protein, 87 aa, Homo sapiens
STRSGMEWNAIEWSGEECTGVEKYDIQWNAGKWNGMEWNGLEWNAVEWNAVEWNGVEWNGVDWRGMEMSGKERNGMEWKGVKWNGVD

SEQ ID NO: 936579 - protein, 49 aa, Homo sapiens
MAPPVRYLHPRRNVLCNFGGGAGRGSGTYTRHGVHLFVGCRLSDEEQQN

SEQ ID NO: 936580 - protein, 34 aa, Homo sapiens
VDQNQNCTSTRQRSQRLCENVMKKVSGRELCLFL

SEQ ID NO: 936581 - protein, 59 aa, Homo sapiens
LAHGRFPYVKKWIFLEATTIKSVLAWHVTGARHTGFFKRTLVKGRTYGGPQGYLEDIFG

SEQ ID NO: 936582 - protein, 40 aa, Homo sapiens
IGGSILVSLSTSADVISKQEYDESGPFIVHSKFFLTDLAD

SEQ ID NO: 936583 - protein, 96 aa, Homo sapiens
VDCPGHDILMATMLNGAAVMDAALLLIAGNESCPQPQTSGHLAAIEIMNLGIFWILQIKLDLVKEGQLKDHYEQILAFCPGYSSRGSSYYSNFSSA

SEQ ID NO: 936584 - protein, 74 aa, Homo sapiens
KKVQKAAAQDRVRNFLKGTLSGSCFNLLSLEVVRGGWRSIHYLLTMDKEKPVCCVSHCLEVPDFCFHYCSLPAK

SEQ ID NO: 936585 - protein, 67 aa, Homo sapiens
EKERSREPQGGLQEGGPGRREGASHLAPRFQELERYKNLILANLQQEGLLFPYKQQPPFYNSSLPYW

SEQ ID NO: 936586 - protein, 145 aa, Homo sapiens
MLFIISSSATKESDGLVRHPHVVEHGSWTHRYFCYAPKREQDNVIVGDPIAQRLVAYRDENGGHVIYNIDDVERDAHITCLLVVEVRLVYDIYAAFRVAIRVARKWFFSPHTLSRVHNGEHIHSLGGLYALDVDALFLARHGRSS

SEQ ID NO: 936587 - protein, 149 aa, Homo sapiens
LAVGLRTGLGVPESLSVEPAPVLPSFFCCSRATLFGRYFFRARVPAPRLGPYGRPFVGKNGSLYSGQHGFSPTARGSWRQCSPPRGFKTTFRLDSAESSWGFPDSWWVSRWCPSPPQCCVALPPRPPFKAPAGHPLGEGKTQFSCSFRL

SEQ ID NO: 936588 - protein, 70 aa, Homo sapiens
ADSDKERYQQLEEASPSLRDADSAHLDAHGRIPQQKESQAEWSKEIDSLKEKVPNRQQPLNYCSFLRKRY

SEQ ID NO: 936589 - protein, 44 aa, Homo sapiens
MCDFTGGQTARVQGGLPAVWTEQVDGKILYSQGDVMEGLGRNPT

SEQ ID NO: 936590 - protein, 70 aa, Homo sapiens
VEPQVAIQRIRITLTSRIVKSLEKVVFLTLVRGGKMERISKLEYQFECLPRLLRITTRITPCGEGSKTLG

SEQ ID NO: 936591 - protein, 43 aa, Homo sapiens
SCCGGFGYCGGSSVLAGPCTARFGASIVAFRGCCSCSQNETME

SEQ ID NO: 936592 - protein, 136 aa, Homo sapiens
RKWRPGLAAVPWREPELEPDLTTNSSGGPPSTSPSTTLTPRTSSPPSSYRSALARRMDGGSGGLVSGDNSPTTEALFVALGPGLTTLTHPLLYVKLLIQVGHEPMPPTLGTNVLWRKVLYLPSFFTYPKYILQLAS

SEQ ID NO: 936593 - protein, 56 aa, Homo sapiens
NRSAIRIPGLLAGEEGYFEDRRPLPTATLFGDRGLIRRVFLMKPAMSLPVQKLSRL

SEQ ID NO: 936594 - protein, 37 aa, Homo sapiens
CSQHHCDTKIWQTHNTTTTKLHANIVINIGAKNPTKY

SEQ ID NO: 936595 - protein, 84 aa, Homo sapiens
RECVEGKKEGGDPGKGGSNQEGHNVVFSNVFSMFDQAQLQELKEAFSCIDQIRDCIICKEDLRRTYSKLGASTNLQPCELGSLL

SEQ ID NO: 936596 - protein, 70 aa, Homo sapiens
KSILIFYKGATTYEVAARLAQQEKQDQVKLSLCKPDSFLGIWVISQWLLFLTISTGWSSITSVVLCAAVF

SEQ ID NO: 936597 - protein, 33 aa, Homo sapiens
VQPDLGHDKDKDKWKEVQKKVVESPYEVIKIKG

SEQ ID NO: 936598 - protein, 101 aa, Homo sapiens
MITVHCSLELPGSGDPLISAFRVARTTGAHHHQLIFFIFVEMRFHYVVQAGLELLASGDPPASASQSARISQCTWPLPFRLLLVVIPEQGLYCTNLYYPGA

SEQ ID NO: 936599 - protein, 75 aa, Homo sapiens
ERGGAAQSQEMMEVDRRFESQSPPMKRGEHSSRIVATSVTEPQDGEERGRRPPRGHKLPLDMKTITWTEMQQDVD

SEQ ID NO: 936600 - protein, 216 aa, Homo sapiens
GKGQPPRGNNSSRPGHIMHPPRSACHRPHKIPAAPNSPGADTRFYKQTGWGKTPCGPHMSDTTAVCREATPCGTRTHVPRQRPTLLERRAWLRQEMVSRTAPGGQHHDEGHPTRSPYSPGHKQLSPANRMSVRYNTYTTHVYHTHGRSAVKYSHARRPTTQAECLARALTRAHTHGRSGSVLLPTVRAHTQCLAPPHSTLSMGDKTPRHLNDHAGS

SEQ ID NO: 936601 - protein, 69 aa, Homo sapiens
MAALSDSSLHRCPEAALQRSRFWAGGHVATTAGDWLPTPSGYGAPYRAAQTGHMRMAALLLQGKASFEE

SEQ ID NO: 936602 - protein, 117 aa, Homo sapiens
RRLFFLLESHSFAQTTVQWHDHGSLQPPHPRLKRSSHLSLPCSWDYRCAPPHPANFCVFCRDRFRHVAQAGLKLLGSGDPPAPASQSAGITGISYCARPQFPTLISELQAHFSLLST

SEQ ID NO: 936603 - protein, 62 aa, Homo sapiens
VESELYFLIARYLSAGPCRRAAQVLVQELEQYQLLPKRLDLGGQRAQQGASGGSWSCPLGIW

SEQ ID NO: 936604 - protein, 36 aa, Homo sapiens
LWFWYIHDRIEDISHYYRLSCYDYNIYDDDDDDDDD

SEQ ID NO: 936605 - protein, 40 aa, Homo sapiens
TLQLDFLMPIFQITTTCKKTMTGKLNSSKELRQVYTMKVP

SEQ ID NO: 936606 - protein, 37 aa, Homo sapiens
MAAEGEPLGEDQLGSALLLLTMALPRFGNPSAEAFTG

SEQ ID NO: 936607 - protein, 53 aa, Homo sapiens
KTLVPGPGPKLIYWSTGRVFKVGLLISEYEVIRKIKLITEDVRVNLPPTSMAW

SEQ ID NO: 936608 - protein, 53 aa, Homo sapiens
DKPHMQTYEVDLNKCGPMVIGMLYIKIKNEVDSTLTFRGSCREGICGSCAMNI

SEQ ID NO: 936609 - protein, 52 aa, Homo sapiens
SVSFYTRRMGSYLYTPFTERYRDYGPESPAPQFLNAAINDQCHCCHGYPPGG

SEQ ID NO: 936610 - protein, 31 aa, Homo sapiens
WSEPKEKLEGDLKLTQESIMDLENYKQQLDE

SEQ ID NO: 936611 - protein, 53 aa, Homo sapiens
VRIHTYACACTHFAHVYVHNERHMQHAHLVWWQGSRLKAVTAFTVTVLYTYVH

SEQ ID NO: 936612 - protein, 84 aa, Homo sapiens
VRTLVDTKAFPTTVYSSQPEHSEVKELNTFQGKMTMGYELTVNVWVFQVAMCEVRFEHVRVPKENMVLGPGDGFEIAQGDLGPG

SEQ ID NO: 936613 - protein, 46 aa, Homo sapiens
KKEKNRKRRNRKKKKKPQRFRRGVLLELTGRKTQPVSRGSDSPAAD

SEQ ID NO: 936614 - protein, 68 aa, Homo sapiens
QCRKPKDFTLKLRPLVPVSQDDECKGKVLEEIKRATPMNTNNEKQKKLIVDGRGFIGLYRGSTHHTIP

SEQ ID NO: 936615 - protein, 56 aa, Homo sapiens
LIQLIVRSLLSLSSIHHASSDIQVKTERVLRPAFELISASVKDLSRFPFPFKRDLP

SEQ ID NO: 936616 - protein, 90 aa, Homo sapiens
ALGADLTGYLKSPPGQVTEAVKVSKLVGYRHIDCAHVYQNENRWGWHSETRDRCNVEPHRQQTVVTTMKGLVKGPAKTLSDLKLDYLDLY

SEQ ID NO: 936617 - protein, 71 aa, Homo sapiens
MLVIQITEKAQCIPWVIFVGNGNFSMAHTLQFFVILTHPSILMFFFFGNFYNGKLAEGPRYFFKGYRWLTI

SEQ ID NO: 936618 - protein, 55 aa, Homo sapiens
AGATVGSWSDRGCTRAGEHDCRRVQARALAKEPRVLFEPSSDPIITCVALLWSCP

SEQ ID NO: 936619 - protein, 32 aa, Homo sapiens
MTIDDIECSCEQHVLSRCSRSHVLAELCLMQT

SEQ ID NO: 936620 - protein, 62 aa, Homo sapiens
VKTPHMPPVWETVCYGVPTLPGINKHTLGERPYSCLKFEKTFGRGITSSGTRNPLHDRPAGA

SEQ ID NO: 936621 - protein, 90 aa, Homo sapiens
MSKNGDQHPSAILFVISLQDKAGGSQVGSPLKWLGPLSCGRAGVLLASCELGPQIAFSPEDSVCCCLPGAQELAQSLELSFIPGITLQPS

SEQ ID NO: 936622 - protein, 115 aa, Homo sapiens
RPRPVCADALARSSYDAHLACLAATLAWGVGPGSVGLRGSSLAEVQRLALSVCRDLAVYGLPQESSNGCFPSISWGWAPFRITPEDGLGFPLCPDSRSWYQSCFPEGSTARAGCL

SEQ ID NO: 936623 - protein, 91 aa, Homo sapiens
TGIAGLSPSLSYYHTLLKDLSDSLQDIAKSTLTLQSQIDSLAAVTLQNHRGLDLLTVEKGGLCTFLGEDCFSTNQSGLVRDAASRLNEKGS

SEQ ID NO: 936624 - protein, 30 aa, Homo sapiens
AVVPRRPEENIASWSGEQPFLQLKLEELRP

SEQ ID NO: 936625 - protein, 44 aa, Homo sapiens
QQRVRRHRGHGSLGGGEHSRMNPLRAVWLTLTAAFLLTLLLQLL

SEQ ID NO: 936626 - protein, 72 aa, Homo sapiens
EREEDDDDSDYPERMEDDDDDASYCTEAASGAIVPTAALQVGETKSTSASFSYIGEKTSALEFPSPLGFNGA

SEQ ID NO: 936627 - protein, 54 aa, Homo sapiens
MAEGEGYKDFLHIVGRERGSGKYFLNKQIFVRSHSLKTALVGMGAKPSRKLPGV

SEQ ID NO: 936628 - protein, 114 aa, Homo sapiens
YFSRKKMGVSLNVGPRLGLKNPGLKVIPSQSRPPQNAGINKTWSHPCPGFLFIIIIFIFYFFIFFETESRSVAQAGVQWRDLGSLQALPPGFVPFSYLSLLSSWDYRCPPPRQD

SEQ ID NO: 936629 - protein, 71 aa, Homo sapiens
TQQMRYSMLMDRRINIRKWHTAKQFKIQWHPIKLHDFLQKIGKATLSHGPKSPNSKQSYGKTSWGITLLLN

SEQ ID NO: 936630 - protein, 43 aa, Homo sapiens
QVDITQKQLEEEISRLPKEIDQFEKIQNNSKLFRIKLFNFKMS

SEQ ID NO: 936631 - protein, 53 aa, Homo sapiens
MARTSAVTKGGKKGAKKQRWVSPVGVSKRLLVSVKDTVVVVKYVSHVGAKHRW

SEQ ID NO: 936632 - protein, 53 aa, Homo sapiens
RLVPAALQSNQFVLALLALLFSLQGKRDDHRIILFMFDMYKEFQGNKIGGFID

SEQ ID NO: 936633 - protein, 59 aa, Homo sapiens
LVESANHREQRASLLWAFSDVVLHPATVFEMIQDGMTIAKEGDLRANYADPRGSRPLEE

SEQ ID NO: 936634 - protein, 69 aa, Homo sapiens
CGLQEAFWEQPLYTWKTGEPYCEKDYINLFSTKCHCCHLPPEAGDKVIEALATLGTTPLLFAQSCHVNL

SEQ ID NO: 936635 - protein, 41 aa, Homo sapiens
MAGTLSAEDKAAVERRSMIAPHLWEDGEKAAKEVKLLLLAP

SEQ ID NO: 936636 - protein, 56 aa, Homo sapiens
MSDVMYLPPIRNSGHIIIDISQKIVIAFMLWSPCLFRGPNVEAYCLRCECKYEGRS

SEQ ID NO: 936637 - protein, 105 aa, Homo sapiens
KNEKGLKQCLLDRTGHRTRNATWLKGKQSAAWSKKMMSHSVTQDGVQWQISAHCNLCLPGSSNYPASATRVAEITGLCHHAQLFFVFLVERGSPCRQASLGLLTS

SEQ ID NO: 936638 - protein, 53 aa, Homo sapiens
RQGGAIMGSWTSAITRDRKFRRKEPRARISYSGCWSSIQVLAEDHSHHQVVLK

SEQ ID NO: 936639 - protein, 58 aa, Homo sapiens
RDGQQEGGDRGKVAATKAGPTWVLPTGFSMFEQAQIQEFKGGLQLVSTRIGDGIICKA

SEQ ID NO: 936640 - protein, 69 aa, Homo sapiens
EPIMATPLSGGRLEATGEKVLRYETSIQLRSCSRDLSKGCLDHGDKVYSSLAKLPSNCEMSFERFQEAK

SEQ ID NO: 936641 - protein, 56 aa, Homo sapiens
DHCLAPSTMKINIIAPPERKYVRRRVGGVQSVAVAWSTVSSTSGRVSNARTVVTEV

SEQ ID NO: 936642 - protein, 67 aa, Homo sapiens
FRHEARSKRTPRAGSPLSPPVAAFASSAARTGRGERAPRQPSPAQPYSLPKPGQQRFLTKKMLEEES

SEQ ID NO: 936643 - protein, 47 aa, Homo sapiens
VKFSKEKYILDSSPEKLPCLQHCNPCPCRPCSPFCHSIACLPCRPPF

SEQ ID NO: 936644 - protein, 131 aa, Homo sapiens
RNKGLMVKMTYDYIKKLNGPLLTNSNPHSIATVACPLLCTDLMEQRTSFRHLTHPLRSYVSSQHGKILERRPNSFTGCHFLNFGKEYAPNPLISRGKVWRRRVFGVSSWFPAEVVKVNNRALDTHRNVTHS

SEQ ID NO: 936645 - protein, 128 aa, Homo sapiens
FGTGPKEHLGGDQAEAEVSHPFCPVCCQREEGEPMPASPGGPGDITRSLAGDRQTRRDNGHLRGMSHAAQGTAGWNAPAGPWAGPEATWMPLPTQPPGLPSPPPHGILPVPRSGCPHHMGAQRRRGPP

SEQ ID NO: 936646 - protein, 75 aa, Homo sapiens
MPVKGGTKCIKYLLFGFNFIFWLAGIAVLAIGLWLRFDSQTKSIFGQETSINNSSFFDEESIFLIGSRAPVSDLV

SEQ ID NO: 936647 - protein, 113 aa, Homo sapiens
APPSLCLAWLQMSKNVATPGQVVAVAPEELSAGSPGSPKGRAVVQQDVCAAQAGASFPLGSRVRTHTQWLKAAAGDLTPRPGLPSSHHTSGLGAPPLPQLGSPARTQLGVCSG

SEQ ID NO: 936648 - protein, 30 aa, Homo sapiens
ICACRRDGQGGALMQVEVYVAISLIFLVRR

SEQ ID NO: 936649 - protein, 52 aa, Homo sapiens
MPPRFDPTEIKVGIPRCTEVGRCHFCPGPQIGPLGLSPKKFDDIPGTGDWRA

SEQ ID NO: 936650 - protein, 36 aa, Homo sapiens
ASSFASPAEPHRSDTMGKVKVGVNRNLVSMGRLVTR

SEQ ID NO: 936651 - protein, 73 aa, Homo sapiens
GERTVERGSGAALLEIRGGRQDSLAAVPLLYIGLKTTTNISHERIQGRSSTSPSIINEGVIINGHSHEVDNPF

SEQ ID NO: 936652 - protein, 123 aa, Homo sapiens
PLGSFQAWPKLGKWDGGCPASPTPLPECVFVMSAGIIQRAGEANTQNSFAGQRFPHPERPHKPPPEPNSQDLRPRDRNGEGGPGERCPWDCSPSLGPNGVLFFGEVGGWRQLDLVSSSINSHL

SEQ ID NO: 936653 - protein, 104 aa, Homo sapiens
PNTHQLGALKKRRLERAIRFATQKALLKSQGGDEDVEFPRKHLTGNFAEEMICERAPAEYLACSSHPLRAPLPGVLDFLTRPDCAGFRLPAGGQYPRALELLLR

SEQ ID NO: 936654 - protein, 58 aa, Homo sapiens
QTLAGQAPPVRGLRPTLPSHSPLRVLQICQCTYKVTSRPVDSPSLTSSRGLACGFLEI

SEQ ID NO: 936655 - protein, 42 aa, Homo sapiens
LVPNPSLPILTTSLVCLIARFYDGERAIGKDNNLLAKFDLTR

SEQ ID NO: 936656 - protein, 72 aa, Homo sapiens
GKGVSPRWSGWSRTPDLMMRSTHTSAFQSDAIYRHEPLHPADTWGKFVAIQRHHKQCGKKIELPDVDVLSYK

SEQ ID NO: 936657 - protein, 34 aa, Homo sapiens
DSARRSPLEFMDDTSRSIIRNVKGPCAGDVLTFG

SEQ ID NO: 936658 - protein, 45 aa, Homo sapiens
VNQDDLYQALPSGSDCQPPGLDVTSPEPLPTNHPLLTLKDLCDSC

SEQ ID NO: 936659 - protein, 75 aa, Homo sapiens
MEHEDEPDVDEPLETSLDIFLDGSPLSQSKAAFEGSCSSCRRRQTRFELKRKDRNRLRGCLAGAQKQQELEEREE

SEQ ID NO: 936660 - protein, 47 aa, Homo sapiens
YTIAFISKDTSLRTPLYDSLKALLSKAPYRLGQKYLAAYSLKLGRSM

SEQ ID NO: 936661 - protein, 40 aa, Homo sapiens
MRPLVASYSLPPTRPRPFLFVPQFFDLNNIEAILLLPCFN

SEQ ID NO: 936662 - protein, 42 aa, Homo sapiens
GETYDAGEQLAVTPKKMAVFAPLIALCIRCRDFHDGSPNLTT

SEQ ID NO: 936663 - protein, 48 aa, Homo sapiens
MALGRGNPLSPPAVHLELRRDDEGVLRTCRDASLCKRFAVGIGYWHDP

SEQ ID NO: 936664 - protein, 40 aa, Homo sapiens
HPLPNADNMYYFSQLALTLNAWHSGTAPQTAGSRPGPETD

SEQ ID NO: 936665 - protein, 68 aa, Homo sapiens
DYRLLAQEQRANEQRKSEEEETSIDVAGQPNEVTKAAESPDQRDTHGGPQEEEIQSESMGLHGKLSSS

SEQ ID NO: 936666 - protein, 66 aa, Homo sapiens
MTLPTDLGSAVRGRDDVLGEPRAHQGHNFPEAHSTIFLGGSDGMDCGQESFQDTKVVMDDLARGPK

SEQ ID NO: 936667 - protein, 49 aa, Homo sapiens
PNGSLQKATASKGESPGFSTEKFKDNLTLTKGDKIKRHKVLEQTAEFLQ

SEQ ID NO: 936668 - protein, 30 aa, Homo sapiens
VCARFTVSCKARVHTADTCETCGCRGGPKG

SEQ ID NO: 936669 - protein, 64 aa, Homo sapiens
VEEKASRKERKKEVVEEEENGAEEEEEETPEDGEEEDEGEEEDEEEEEEEMKARREESSAEEDE

SEQ ID NO: 936670 - protein, 49 aa, Homo sapiens
TLVCPIPSQGFFMSDAPKSLAQLCHLSGVSLSACVCPRPQEWDVSYFMP

SEQ ID NO: 936671 - protein, 89 aa, Homo sapiens
PGSTMGDDSEWLKLPVDQKCEHKLWKARLSGYEEALKIFQKIKDEKSPEWSKFLGLIKKFVTDSNAVVQLKGLEAALVYVENAHVAGKP

SEQ ID NO: 936672 - protein, 126 aa, Homo sapiens
TNNILKIVADFFASFKPHTLLQRVKACTTEVQEMLMQITSLSLIAFLLPITVGLQGDRSYSYVGISSKEPDWSLIFLARLIPRMCHNVNRVVYIFGPPVKGTSYRCYSHFSGQQGCVLYAKLFEGP

SEQ ID NO: 936673 - protein, 84 aa, Homo sapiens
GVGASSQGPLGEPSLCSHLWVLAHQVNCIGELKYTGTYMCGSELKGSFIQAAKPGFDLKFCKNFRAPRVLILTQQGAKGAYGRF

SEQ ID NO: 936674 - protein, 56 aa, Homo sapiens
RAGLMWWPASQAFPGRHKTSSEPGQGFGGPQSLAFRPRELILGKGALTQGLARPKT

SEQ ID NO: 936675 - protein, 52 aa, Homo sapiens
GQVDYSKIMNGKLSARNRKVQCHVPGKEAGSTDCILRVISSQHWRFKERKLM

SEQ ID NO: 936676 - protein, 54 aa, Homo sapiens
RLQAALARPAPGGCSQEAFRFQDPGKGCFFVYQSRRGSLHPPAVESIQGSPLPK

SEQ ID NO: 936677 - protein, 134 aa, Homo sapiens
LMPYKPKHLGRLKWEGSLEPPGIQRSLGNRASVSPKHFLKICGSPGTVAHGCNLTLGGWGTFGGLWITRSRDDHPGQGETLSLLKIQKNSWMWWHVPVVPATREAEAGESLEPGSQRLQWAEIAPLNSTLVAEG

SEQ ID NO: 936678 - protein, 60 aa, Homo sapiens
APSHQGCAPPSSSDSSSDSSSSDSSTDDSEEELTQRLAELQEQLKAVHEHLQPSLSPSRT

SEQ ID NO: 936679 - protein, 35 aa, Homo sapiens
KIKNRYFPAFEKVLKSHGTRTTLLVNKLSRVCTFI

SEQ ID NO: 936680 - protein, 48 aa, Homo sapiens
DRPLLQEARTHHQLVGGQGPCCLTRPGASSCCLQQRIREAYVLLRGIG

SEQ ID NO: 936681 - protein, 38 aa, Homo sapiens
IGSHGGLAQLVSCARVLATVFFGDFALSGFSFWANFTS

SEQ ID NO: 936682 - protein, 73 aa, Homo sapiens
AALTERLLELVFGRDVSSELTFCFGKLAVGSRWYHGGSRPSRSGETNDGGFPGDSQYTTDTGLCGKAIESPPV

SEQ ID NO: 936683 - protein, 43 aa, Homo sapiens
AVDSLDDDSIALLTTTVSFSFTAFSSRSDRANPCTCRVTETDR

SEQ ID NO: 936684 - protein, 119 aa, Homo sapiens
AAGLRQLRERTGAAALDAPLSHRPQLKPSRSPARPPIAAVALWRHVQNGSAGMQEESLRVLGRTALTNNGNGGSVQPRFLFIMETWKKYCWTHSMSLDGVAPRALTVTAELARRHCKIR

SEQ ID NO: 936685 - protein, 78 aa, Homo sapiens
NPLVDFAAIIWLILCLSSHSAAAQQRHHHHHHHLLFLQVEEIEASNIDNVVLDEDRSGARACKTSGGTSEKKNLGEYY

SEQ ID NO: 936686 - protein, 62 aa, Homo sapiens
MVSGFWVNLVHLGNGALPLSRTVGLLKHISIDCGPHVLRTHALVGPLPGAMAAGRCPEALVV

SEQ ID NO: 936687 - protein, 164 aa, Homo sapiens
ESPFMGGARGHAVYVEPHGHGPALSVQGLSRATPVRLLSLAFALSAHSVFEGLAWAAGGGGESGEPVRGGGRPRDTGGRGLGISMARSATHRRSAKLAVTVSAMIPWHRLGWALRAPGLPGSVASVLLQGLAGGTFLFITFLEILAKELEEKSERLLQVLLLVL

SEQ ID NO: 936688 - protein, 35 aa, Homo sapiens
FRSVRHMIYDLIDWLITNLSWTSAYDDLKTLEDGY

SEQ ID NO: 936689 - protein, 47 aa, Homo sapiens
FQLPWLPEIVYSGGDDGLLRGWDTGYRHISLHQQRHTMGVAASEQPS

SEQ ID NO: 936690 - protein, 111 aa, Homo sapiens
FGTERSEFLLKRGLTLLPSLECNGKVAQCSLLLGLKRSSHVPRLQVHIIHGTGSRYIAQTGKFSIFKSGLGTPDSVFHRVTIYPDNAPFHAVFPHLQCSPIPPPLGCGLPG

SEQ ID NO: 936691 - protein, 37 aa, Homo sapiens
NSSNLRKDFLALNGNLQQRVTGHGNNTDSTKHLDYYS

SEQ ID NO: 936692 - protein, 80 aa, Homo sapiens
KQAILDDMTTKRAVPVGFLALPSVIEICPAWLSLWRRFARLGFALEHNNHLWGRVRSTTHSSFSKQKHPTMSEPQEHPPV

SEQ ID NO: 936693 - protein, 43 aa, Homo sapiens
KRCGPPSLALALPNDQGGSLDECRNVKRGNSGRTLGVELGLGI

SEQ ID NO: 936694 - protein, 64 aa, Homo sapiens
MGCGGDTPPPTVLRRQAAENDCLFCLGGNVPELGSSKAALLELLPSQLAWLFGYYCSMIFGSLQ

SEQ ID NO: 936695 - protein, 41 aa, Homo sapiens
KYGFEPKKLLDQLNGYLLTAGLCSVRESNVLNDQEDSNSTG

SEQ ID NO: 936696 - protein, 31 aa, Homo sapiens
VDPYHGGDHQRSPPHPAVFLDHCHSLRSSLT

SEQ ID NO: 936697 - protein, 110 aa, Homo sapiens
MLVQSAIRVATRGFIRYGWRLGLENCSVFLTIFNTVNTSLNVYRHKDALSHFVIAGAVTGSLFRINEASVLVAGGIIEPCWALLRSPADGISKYSGETVQERNRGIEGPP

SEQ ID NO: 936698 - protein, 74 aa, Homo sapiens
RRDYYDYYYSYYDYDDYYIPYYYDYYYYYDDSTRNEEYDSYDSAANTTTYDYYSGPPRTKEATAYYEAELDYDQ

SEQ ID NO: 936699 - protein, 46 aa, Homo sapiens
MDIDRDFTEELTFGTRLREADLGQLLGETVGYDDHTTLNLFTRLLP

SEQ ID NO: 936700 - protein, 40 aa, Homo sapiens
HLRELDFGQAWLKPLVNDVTVMILEIGNLSSTLESYLIPI

SEQ ID NO: 936701 - protein, 35 aa, Homo sapiens
NAQEEAEATFWGILDALPLRTRDFFLAGGTKPPLA

SEQ ID NO: 936702 - protein, 55 aa, Homo sapiens
YLGRKEHDILSQLQKTSSVSITEIISPGRTELEIEGARADLIEVVMTIEDMLCKV

SEQ ID NO: 936703 - protein, 88 aa, Homo sapiens
TYNGPRPLPQACPPRLTITCTPQNPDYVLDTDGDFDLEDTMDVARVEELPGPANGQSVDPARIVPRDLSIFSFFIFTRGITLVDVLIP

SEQ ID NO: 936704 - protein, 42 aa, Homo sapiens
ARCECRPGGASASVTRLAPGMAGTTGCQPVPEPEEVGTLPTV

SEQ ID NO: 936705 - protein, 37 aa, Homo sapiens
LTIVFKTLRGQILDENAVIAKGRQGRPLQFHYFPKII

SEQ ID NO: 936706 - protein, 41 aa, Homo sapiens
MSLRAHWEPEYLMKGYHRTQIPAYQSRLDTGNSMTKYTRRL

SEQ ID NO: 936707 - protein, 63 aa, Homo sapiens
GPTFKAAWGKVGAHVSYGLRPWERMFLSFPTTKTYFPHFDLEATALRVKGHGKKVAHLTNAVA

SEQ ID NO: 936708 - protein, 57 aa, Homo sapiens
GPAGPLVFLTAQSWLGNRVTDRYFRIQEVLKQARHFLGKAKSLLTGWAVRPVIRAFV

SEQ ID NO: 936709 - protein, 100 aa, Homo sapiens
QPRTGHDRQGARLSALAPSFVGSISQCLYLNSATSMAGKEFYSACVGQALPFITYFGTKDTVDPWLFQHINMWGGYNEHVQEVPFSYNRTAVSCLAGTAL

SEQ ID NO: 936710 - protein, 41 aa, Homo sapiens
DVVHWNSDIQSLDNYSTASSHSGGPPQPTALLSHSQSVADI

SEQ ID NO: 936711 - protein, 49 aa, Homo sapiens
TAPYEGGKRSQEKWLSFLEDCICEALYVHIRILEDVRHRTKDQIASDGS

SEQ ID NO: 936712 - protein, 87 aa, Homo sapiens
CSFLGGPGFLWQQQGGKKSVQKEKERAVENGMEHNEARTKHKEAPGGTQMEKIQYASRGERHSAYNEWKKALFPGEEMLQMRLHFVK

SEQ ID NO: 936713 - protein, 98 aa, Homo sapiens
AEGGISCRGGRGHSRSSGSVELPQRTAESGQRRRVSGHECGRHITPSTLSVPFPTPLEAEIAMGPWAPDAEPHQRVVWGRISQLSGQDPGSSAGKLKD

SEQ ID NO: 936714 - protein, 84 aa, Homo sapiens
HGPLRRRRRAHGLRNFLFLLPGTKAVAEKAFKFRDQFQPQLSIGDLELSLMLGLEAVQHPCRLGSDQSRLPTGRSLVQVHALCR

SEQ ID NO: 936715 - protein, 47 aa, Homo sapiens
EAIRIAAKNCELQARLQARKNSIRKSEGKRADIEKLNQAVLRYQMKG

SEQ ID NO: 936716 - protein, 73 aa, Homo sapiens
LVQRDPDSTVRVWHLYPPEGIIVGSIITKCSIPVLALQSGHAENCWDGIQRCNSIFLRLLLDRVCTAYRELDA

SEQ ID NO: 936717 - protein, 42 aa, Homo sapiens
NTTAIAEGLGFAWEPQSFDPDVLQACLCSLVRWLRGLRQARF

SEQ ID NO: 936718 - protein, 50 aa, Homo sapiens
PVAKKQQQLSAITGSLQRNLCRVPVNYGTGNGGQAYKGKAGFTKDLPEGR

SEQ ID NO: 936719 - protein, 54 aa, Homo sapiens
QVNPPEGKECTPEVEEGVPPTSDEERRQFRSENFQDCSNLSNQIIKKLNMSQAD

SEQ ID NO: 936720 - protein, 56 aa, Homo sapiens
SSETSQPWPCRECFDQDELGQLGPPSCSGVNIQSCGAMSLTVTNPQEGCPGRLVEA

SEQ ID NO: 936721 - protein, 106 aa, Homo sapiens
QTQRDQRRLKKVGETEAQKEGSEDVGNLPEAQEKNEEEGETATEETEEIAMEVRKGKRGVGRTPEGEEPREDEIPRLFMLHFFHFPENGAISTFNSSQPTHRSCLS

SEQ ID NO: 936722 - protein, 41 aa, Homo sapiens
MQGEDMSCKGAQCSYRALLCRCVPRQALEFVIRTCGGRSSQ

SEQ ID NO: 936723 - protein, 76 aa, Homo sapiens
PHQSEVLASVGGSMIIGGIDHSLYQAVSGLHPSGGSGIKVIIVRVESCTGSEMTQEITIQSIVTVHTTFVCQEVLS

SEQ ID NO: 936724 - protein, 63 aa, Homo sapiens
KGRARVAKGQGGGGPSYASLMKERSLALLGCSEYVVHRSEDEGRAKEQRHLHNKEHFRAKQKE

SEQ ID NO: 936725 - protein, 68 aa, Homo sapiens
KLQNSYNGKKRVLSHSQQATRLLTSSSPWIFAKMKDSALHFSCYCLWPLDKATTNPPGTQALSMDYGN

SEQ ID NO: 936726 - protein, 62 aa, Homo sapiens
PPSTTSGPVVPLTKLSAGDKLAEFLQPDRYYDPNGFNGPLPPKPGSSSLGYDNILGPQQPAV

SEQ ID NO: 936727 - protein, 90 aa, Homo sapiens
KKKPQRVRGGFSKSSGHRGERLNPVRWLCFPASYVEIHVCHSRTLNLRAQLYLFKRIFEAFKLTDDVRGEERRQKTDNWGLCSPRGGFKG

SEQ ID NO: 936728 - protein, 66 aa, Homo sapiens
NVYISDGPTWTSGDFLVTTAESSAHVKSDINVTPGVKSNVNPADNLDLFLLDSSKTMLCLGRYLTG

SEQ ID NO: 936729 - protein, 56 aa, Homo sapiens
ENEDSSVHISPRQKRDANFSIYKGRRCRMGLFDYFAENVQVSIPSKGGKLRSYQIL

SEQ ID NO: 936730 - protein, 72 aa, Homo sapiens
FWQFLQKQVEVPGFPRNDEHTLPRPYTGPQRIFRTVRGMLPHKTSEGRFSTSYGVFTGFHRLTDKKKRMVVS

SEQ ID NO: 936731 - protein, 36 aa, Homo sapiens
ERLMAIPTVSIAFTVSFNIFILRPHHATAMTYIELH

SEQ ID NO: 936732 - protein, 68 aa, Homo sapiens
KDACGLGDTVSGNGIPEPQSYAPPRPTDRLAVRRFAQRSVFHRFQPNVSCTCNCKRSLFQSMEITELE

SEQ ID NO: 936733 - protein, 35 aa, Homo sapiens
IVTPLDIGYNLVSLHVPNMTLDGTFLDTPRGHVVS

SEQ ID NO: 936734 - protein, 42 aa, Homo sapiens
MISDRIELRIDLYAEEKYTSIFAGLPCTLHRILNTCRDKLDP

SEQ ID NO: 936735 - protein, 46 aa, Homo sapiens
PLHYLPDTLANHLPNKFGDEIEDLALIVRKKRCKFTSIFARLPIPL

SEQ ID NO: 936736 - protein, 101 aa, Homo sapiens
NFLRDPPAGVQFNFDFDQMYHVALVMLQEDELLSKMRFALVPKLVKERCSRGLLLPRLLISSQPAHGLLPTAGRRKEERTLQKQISAAEQYAQTHRCINLA

SEQ ID NO: 936737 - protein, 37 aa, Homo sapiens
AISALPKIASKSEAMRTFLGLCPLMNYGVPAAKVYGA

SEQ ID NO: 936738 - protein, 53 aa, Homo sapiens
SRRPGMAAWSPAAAALFLRGIRGIPLNHRMFATRTEGELRVTQFSKKVPRLSY

SEQ ID NO: 936739 - protein, 48 aa, Homo sapiens
DSAEFTTVRATDTKAGKWSRWDELQEGSGESSSKAVILREEPIEFPSE

SEQ ID NO: 936740 - protein, 77 aa, Homo sapiens
RVNLKFLTRTRSTVAESVSQQILRQNRGRTVDPVQGAKKKKAEGTVFTEDQKFQQELLRQLAPWEGTVQEAFQALAF

SEQ ID NO: 936741 - protein, 37 aa, Homo sapiens
LHRRLGINQAVRLKRSFSLLIGLCGQSERTYKPQVAE

SEQ ID NO: 936742 - protein, 34 aa, Homo sapiens
PPEAFLLGKVESVVRSRSEKTPELDGFIHFEFYV

SEQ ID NO: 936743 - protein, 41 aa, Homo sapiens
VSHQNPSKNREATVELGREQSTVQSIIHAEQLEIDREVEDS

SEQ ID NO: 936744 - protein, 39 aa, Homo sapiens
CVLATEGFISGRHYWEVEVGDKTHWASGVCRDSVSRKGR

SEQ ID NO: 936745 - protein, 119 aa, Homo sapiens
DVEYYVDSSQDPDFEENEFLYDDLDLEDIPQALVAPPPPATAIMEDEIFNQSSSTPTSTTSSSPIPPSPANCTTENSEDDKKRGRSTDSEVSQSPAKNGSKPVHSNQHPQSPAVPPTYP

SEQ ID NO: 936746 - protein, 30 aa, Homo sapiens
LKFVFDAVAGVRGGEFELLGKVRGARMPAL

SEQ ID NO: 936747 - protein, 107 aa, Homo sapiens
SVTLCSTLTLAELPFPHRTKNSHHAALPPLVPGASQPSGGLPSPPPPPGDEEESRGPPCRCHGGPQQQKGISPFDLLQGWVSVGPQPGTFFSVEAFSMEAGGIFSGG

SEQ ID NO: 936748 - protein, 134 aa, Homo sapiens
APVPLPLCYPQCLPQLLTTAKPLPHFPVPENLLSPAPQPTFCLANPFVKPQLSLYLLSSGGPSWDAPPPPYISMWPVAAFLVFWHSTRGPLGRAGDRFFRVVIPRRHGGSSFHFKGSKVSVVFGELGRGGQGEW

SEQ ID NO: 936749 - protein, 46 aa, Homo sapiens
SRHCTLRTAAPPPPRGLAVPRDAPEQLAVGAPSSPGLFLRPPASGT

SEQ ID NO: 936750 - protein, 92 aa, Homo sapiens
EIPEVGADVTPEDSSSAERGLGMSPSGRGPAGSGKHHRQAPGSVWDASTQQEQPTSSSHHGGAGAVEIRSRHSSYPAGLEDDEGMGEEPAPF

SEQ ID NO: 936751 - protein, 55 aa, Homo sapiens
VRGKVRAVLKLLPQSRQWWLLACVCVVRDEVGTLLEALPHSGTDRLDPSVGRWWV

SEQ ID NO: 936752 - protein, 33 aa, Homo sapiens
TSFSGGDRKLSGGGGGGAPDQCASMAGSEELGL

SEQ ID NO: 936753 - protein, 33 aa, Homo sapiens
RQSKKVMFLAKKAKDKDVECEEQCIEGSGLITG

SEQ ID NO: 936754 - protein, 50 aa, Homo sapiens
VNQGLIRMYKACLEKFPVIQHFKFGGLLPIHPVTSYGGAKPKSHPGPQFL

SEQ ID NO: 936755 - protein, 136 aa, Homo sapiens
HSICRMHCPDPSTTTLANGSGSRKKSFFTRFFAQSTVRRSLTGPFIRRPGLDMSPAAGAAGAAGGTGATARRGGVTTAAGLGPEQPAPRATAGGSRMCRESSAMSRGGSGTPSSPAPPDFSYHVPRAAQAETAAAD

SEQ ID NO: 936756 - protein, 113 aa, Homo sapiens
RFLSFSFSTCLAFLPKVQIQTLNIQKEELNTDLYHMKRSLRYFEGGNLGTLSSFNLATLTGLQGESFGPHLNSLITEKSKDLAVRLQHSLQRKGELESVLSNVMATQKRRQTR

SEQ ID NO: 936757 - protein, 50 aa, Homo sapiens
ILHKKHHVKAVIQSVPWTRIDDGVGGGKRQLGEKNVLSGEAAAPLCPSSS

SEQ ID NO: 936758 - protein, 38 aa, Homo sapiens
GPARYLGPLTGRLCSSVFPPPGAIMRTGQSVLLGSVHH

SEQ ID NO: 936759 - protein, 36 aa, Homo sapiens
SAVCAGMRIVLRILRIESVRRTAESNYTNTAMTKID

SEQ ID NO: 936760 - protein, 120 aa, Homo sapiens
LCCTRDISIGNIGTIGTICPLITRIPVNLWERDLLYQWGAQISFPEGNDSQQSKDVMTKMGFVQGMGLGKLAQGITEPIIPTDESDYRTWLFFLAAVTIKPADPFDLERTQKPVWVDRGR

SEQ ID NO: 936761 - protein, 63 aa, Homo sapiens
EDLRKRRKGGEADNLDEFLKEFENPEVPRRRTSNNRHSAGVDVYRIEAPLLKEPRRASESSGY

SEQ ID NO: 936762 - protein, 97 aa, Homo sapiens
MLLHRPGGDLVITHHLDWWSPLSASSKGYWTCTRSRHSSSMLIVCSFCCSTCRTGGGYNRVSTGPTLPILLLRLPMSLPLGSSKADAEQSPQAEGSD

SEQ ID NO: 936763 - protein, 101 aa, Homo sapiens
VTTAASGTSSSAPVEHGNFQAPLGRLPLLPRLGLLALAFSDGKVLLFSLPHPEALLAQQPPDAVKPAIYKVQCVATLQGGDYFKLQSPLSVGECLCLGSDV

SEQ ID NO: 936764 - protein, 39 aa, Homo sapiens
KKVKCCTAQQPGLDVLEPPYDRAAHYLCCGTSAGREAFP

SEQ ID NO: 936765 - protein, 96 aa, Homo sapiens
GEGVSDPKVNGLCRTGQACPGHWAVGHEWASPGGVAGREKLARTWVHEAAAGPQGTCVWGLLENGIYVGRGDEIIAPSPTIFSCARRPEAVLAGGD

SEQ ID NO: 936766 - protein, 69 aa, Homo sapiens
GRWKEDGRRNAEGGRWKVEGQRWKKVEGGRWKKVEGGRWKVEGKWKVEGGRLEGRKEDWKEGRKEEGRK

SEQ ID NO: 936767 - protein, 113 aa, Homo sapiens
FLPLLPVVHQCQGPWRCRPPELALAAQHSPAPGPLECRPPERALAARRFTSARALECRPPELALAARGCVLPSRPTWFLFLGGFLSCFDNNILPVLYPTKGQTGLVFYASSYY

SEQ ID NO: 936768 - protein, 41 aa, Homo sapiens
LGSNRVTLGVLLTDSRTPGVLGPSSRGLHLGGSRGSNFPTP

SEQ ID NO: 936769 - protein, 86 aa, Homo sapiens
AKPSSVWTSAGYGGLGNARYLHGPGKRVRVCEVRDQADGPRVKPCRSTDREGPGIGPCEDVAFVFPSPEKMHTIEKRFQLKARERK

SEQ ID NO: 936770 - protein, 74 aa, Homo sapiens
LRRRRLPRLFTALTKYQHLGHGGVEVALSADGIGAAALWDPPGKWQQTRGAELRAVPMMLLTFGIRWCCRPGGR

SEQ ID NO: 936771 - protein, 50 aa, Homo sapiens
GLNCSSVSGTRYFLSRDYRPPRPPPEELRYAAKEGSHEERLSTLAETVGL

SEQ ID NO: 936772 - protein, 138 aa, Homo sapiens
FPGQFPPKFRESLYPEIVPRGSHPNGGPGGPESVKGCLGHFTFGLESTDLFFFLNQKSLVTYGPLHPGRFPVTGQFPGPLGPRWAGDAPGAFVAPSPFFLSPPWDSICFCKFLPTVIFRNFRRNSASFSKLGFKSYSN

SEQ ID NO: 936773 - protein, 52 aa, Homo sapiens
QREASPFVLQEVQDPRETVLGRAAPRQRPSPAGGSIRRGPSIYDRGARVVVA

SEQ ID NO: 936774 - protein, 67 aa, Homo sapiens
SRGLGRSKVRGLPGPRCFYELYTLTAKICSFTPEPSETTSPPGGNKQLQTRCLKSCNTCREGLQLHS

SEQ ID NO: 936775 - protein, 87 aa, Homo sapiens
SEGTEMLLKSAFGIFGKRMSGVLERESELSAVTGLKPKCSAQDVSISDWLARNCLHTSTSDLSSGESGDPQAENPRTREIATTDTPL

SEQ ID NO: 936776 - protein, 30 aa, Homo sapiens
TQGAERSPACYTHAPGVAAVTETINPDGHG

SEQ ID NO: 936777 - protein, 55 aa, Homo sapiens
MLAEKRRSRKAGGLVPGQQREAHNKATQRRQPGPPYVLCLPLCQSYHYAPRAQPP

SEQ ID NO: 936778 - protein, 70 aa, Homo sapiens
SCRIQHELVPNSARANPRGEIVIGGQNISMGYFKNEEKTAEDYCVDENGQRWFTGDIGEFHPDGCLQIGS

SEQ ID NO: 936779 - protein, 119 aa, Homo sapiens
VPNSARGFFVSFCVARCPGTCYAPLAQYACLCFPSAGIKGVCFQACLRYWFKLLDAYCLLHYKSIGVNWKSLLHYKHTHIGSFSGGHACVDKGLALELGVDLPPFRVLKLWVLSYYWEK

SEQ ID NO: 936780 - protein, 101 aa, Homo sapiens
GHRSVGGIRASLYNAVTTEDVEKLAAFMKNFLEMHQLVNMTSHALPVSSTQRRLEELGIDYRNLTDMDFFFPNTCLLQIPFSKNNDLNIKGTAELEGNSPG

SEQ ID NO: 936781 - protein, 70 aa, Homo sapiens
GLGHRSPPVPVWILGEVFLGAYVNLFDRGDIKDRRTSGTGARSPSGADLGSARPAGAVPGCRPGDRMRTG

SEQ ID NO: 936782 - protein, 84 aa, Homo sapiens
PNSARGHVGKQQSPVKCTVACRSHQFCLTTDVPEALELCSLYSLQSSSPRAAPCPHHWYKTLEAENRKQQETVFLVDCVGETKG

SEQ ID NO: 936783 - protein, 278 aa, Homo sapiens
VTSCGLARAGQRGGGRRGPGPGMAMFLQPGGLVLSSGSRRPGLAGGDCWLDVQEYTCPICLEVYHLCPWPSVQLACTLFCGECLQPCLQVPSPAVPTVPPALLPKKVDKATHVEEAALILQSALSRLHKKVTLCKDEECTFLSCLKVQGADWAMPQVRPRGAHITADPQNIPKWSTFACPYCGARNLDKQEGLVKALLLKSPPDGPQTRCGVAPSCSACPGCDPVTRSANFLQHLFTTQVSFDTFVTHRLRGALPVAAWLLGTKEAHAGLGRSPPVTA

SEQ ID NO: 936784 - protein, 79 aa, Homo sapiens
MRVVGSSPGLLLGRGMRAFLLLLWLAARGSALYFHIGETEKNGFIEEIPDETMVIGNYRTQLYDKQREEYQPATPGLGM

SEQ ID NO: 936785 - protein, 41 aa, Homo sapiens
WLTYVVVCKCRNLQVPESYFSERSKLLILGMSNLDVTVRVS

SEQ ID NO: 936786 - protein, 387 aa, Homo sapiens
GVQPPATGSARTTPPSTQQTRLTVVHHRTQTPPRTARTSCVSAAPGAENTSPGVSCSGVLLPVKTPALIGQNKLAWVHSALVAENNSTPTLAGRTYTLRISTPARQYMKAPRSQSQSRPSHQFGSLTKSALHKPFARRATAQAGFINTQESLFYVVEPHTLLLYMNDDNNCVLISRENDTHDRRTAHSTHRAVRAELVTADPMQVQRVRATLAGRQRPLTEQSHFAAGHSGGGSISCGRRLSSHRGTPPPTLDLFSEGRTPQEGFITPLSLFLDGDHRAEKISPLRPPAAPHSASLGLELHSHTIAGGRPQQRRALPSHDKYRLPSARRPTPSKRGLAPPTGGEANATPHGGAENLGGPAKRALLWGAGDTARLFFVFGGEKMGFFF

SEQ ID NO: 936787 - protein, 34 aa, Homo sapiens
MEGLLSGQKGPLIAPAQDRHVGNKVLEQGDGHWG

SEQ ID NO: 936788 - protein, 46 aa, Homo sapiens
RHPCAPLVRRGTFPALWIGAWARPILLGVGGDDLAASCRCSKTNEV

SEQ ID NO: 936789 - protein, 31 aa, Homo sapiens
GGSRAPGSGVNTSHHRGGAATRHRVGSRTRL

SEQ ID NO: 936790 - protein, 103 aa, Homo sapiens
RAAGWLGSVPWARTSCLISIRTHEAATGPRGQRASRPWLITRATEPTAQSTGPGQPRIPLPSSMTPTVGNPSKPGEYPATGADVAFSVNHLLGDPMANVAMAY

SEQ ID NO: 936791 - protein, 62 aa, Homo sapiens
QWASLLSTRFSVQVATEGGSDSTMPMCKGAGPGQAHTESDCAMQVYFRMPGTARTLGLSGIN

SEQ ID NO: 936792 - protein, 188 aa, Homo sapiens
MCFGKKAAWTETEGWSGDVRVLLEVGQASVPARCPRSHEVLSSASSALAISSASELLPSYSLDSLLDSLAASSSFSFLFGLWTPDPAALLSLDAGAPSVRLRVPGFRGWGSSSCSSGLLFSLSLSSLLFSKDVVHLKEEGSWRMGRELEGAGGPRAPVLMSFPVLESEIRTSGPGWALGTGIGWKAVG

SEQ ID NO: 936793 - protein, 34 aa, Homo sapiens
MARHSQGSTPLHEALETHLAIDTTTRQGYSCRYL

SEQ ID NO: 936794 - protein, 36 aa, Homo sapiens
ETAATITRKRIPPSLGGFIQTSEKLTGSDGGNSKIG

SEQ ID NO: 936795 - protein, 48 aa, Homo sapiens
NPAEARFSALCPPPCRRRKTGSVHRATGLSTSPRGGNFYGYYRSTSCV

SEQ ID NO: 936796 - protein, 74 aa, Homo sapiens
CFPAQEPQAVQPWPQGMDGLEAPLPQDWQRRVATSFNQPARKIRRRRPGKPRRAHRPDPARPIVPIVRCPTVRY

SEQ ID NO: 936797 - protein, 37 aa, Homo sapiens
DFDNQTLAVLRGPWCYLMRSREITLEQTTKDNQIDVD

SEQ ID NO: 936798 - protein, 139 aa, Homo sapiens
RNSVQSAHYVEACQKNSSRLWNSQAQIDQKLANQINDLCQSVTWLGDRVMNLQHRMQLHCDWNTSDYCITPYAYNQDQHSWENVSRHLKAWDDNLTLDISQLKEQIFEASQAHLSTVPWLTHFWKGITKNTKMILIPSN

SEQ ID NO: 936799 - protein, 32 aa, Homo sapiens
MAEPLKKYRLRVTAKMLSVRVAAAVRSALPRR

SEQ ID NO: 936800 - protein, 148 aa, Homo sapiens
LHDLTEQRLHGVDEVLGVVAHRRSGLRGRVLDQPVFAQIDRHQQNNGRYFALEPNASGLRLANTLAGLPTTSAGHVLDHERLRRTTALIRAGTPWPGSRSRRILDHGRDRDRQEVRVVDVVPTAEQVDVAGDGHVVADPQAGARVEQA

SEQ ID NO: 936801 - protein, 36 aa, Homo sapiens
KTESRSVVQMVQWPISAQCNLRLGDSSKSPPSSTSV

SEQ ID NO: 936802 - protein, 158 aa, Homo sapiens
LQRLYPSFIFKGPAPQSQYKNTKSPVSLITIKNPKSGKLRAREMTPRQGHGDPCSWHQAWLQGPPVLLLLRGWGAAIVLWEPRPSESGPSFLLGCAQLLHAPDLVQQARDEGLSGFVTVNYQLLDPSSPGIITLHVYKFIHIYLELRDLLLLAVVESR

SEQ ID NO: 936803 - protein, 78 aa, Homo sapiens
PLYARQGELKGLGSSLGTHKSARRCQRPPGALYFQLQHSQVFTAQGDGARVTRNPGEGRSFPGEGQRVSRIGLTQEGA

SEQ ID NO: 936804 - protein, 68 aa, Homo sapiens
MSKLKKIETQEKNPLPSKKRLNRRSKQANRNEACAPICTVLHSIASYYSLAVELCKMQEVGSVNDCAA

SEQ ID NO: 936805 - protein, 48 aa, Homo sapiens
MSKLKKTETQEKDPLPSKKRLNRRSKQANRNEAPQYPVLHSLPSYYSF

SEQ ID NO: 936806 - protein, 35 aa, Homo sapiens
LLAVIANNIITINKDQNVFDSKKKVKLTNAEGVEF

SEQ ID NO: 936807 - protein, 38 aa, Homo sapiens
WRPGLEMNPGYEVAPRSDSEESGSEEEEEEEEEEEPAR

SEQ ID NO: 936808 - protein, 72 aa, Homo sapiens
KIRAAVTCIIILTILFILLFIFIITSIVIITEALPILVISFLDSSSLPVLLTLSKSSFRASLSNILLSVEFS

SEQ ID NO: 936809 - protein, 45 aa, Homo sapiens
VVQLESKRKTMQAHLLTKEVTQVERDPLDRQAGQLRIQIQQVRGE

SEQ ID NO: 936810 - protein, 61 aa, Homo sapiens
AYCRINPKSGGIVMLFRSDFPSTPTVRFVCSEIYNIDTLNGKKVEVSVKQIIAGKAVEQGG

SEQ ID NO: 936811 - protein, 69 aa, Homo sapiens
GGAPATDRADWGEEIQAPYHPSTRPPFYGTPRAHAPVEFAKPCGYGRSPVTKPSLWSRLGAPLAELSSL

SEQ ID NO: 936812 - protein, 119 aa, Homo sapiens
IRNLDAVRMRAPTPAAECTALIAECAQPAEERPTFEFLQSVLRTLHATERSTSQQPPALRPCPLCADDPDFRAIPDGREGGVSPVPFSQTRNPVGRGTFAGGPRTDSFTDCTPGRVTRP

SEQ ID NO: 936813 - protein, 35 aa, Homo sapiens
DAYNSYLEDYALILKYFASNKGFDSSEDAKQYNLD

SEQ ID NO: 936814 - protein, 105 aa, Homo sapiens
GDCGVSVLNVDRLSSHEERWCQQGTSVRVGYKKEKNMEADIITNLLSLHRRFVIISAQYGLQLVESQNELQNQLDKCRNEMMTMTESYEQEKYTLQREVELKSRM

SEQ ID NO: 936815 - protein, 69 aa, Homo sapiens
METSGVVERVSRGPKPVRWRCSSDCGSRVLQTGDRSLLSPTATLHEKEDSSVCGSIPDGDLLQHWLEDM

SEQ ID NO: 936816 - protein, 64 aa, Homo sapiens
GGGGTLGQGGRTEKNHGYAGPEPSSSFSCPSSSSSIPLLLESVPPLTLKPFRFLLTSQSSTCLT

SEQ ID NO: 936817 - protein, 35 aa, Homo sapiens
MASGTEVGHVLSCWPFHVSDPENMSTALQMGFSGI

SEQ ID NO: 936818 - protein, 60 aa, Homo sapiens
MLTVTPNKRSRYWSCHMRLRLKCKKSHYNNDRYLSEKNEGFFGRNYRQLVLLYLTVRFYH

SEQ ID NO: 936819 - protein, 33 aa, Homo sapiens
GSHDIVDGNHRLTLGLIWTIILRFQIQDISVET

SEQ ID NO: 936820 - protein, 45 aa, Homo sapiens
VRHGGERAATNSPPPPFSDWGRLDSHVRRLEDLLAVSEQGEGGAY

SEQ ID NO: 936821 - protein, 45 aa, Homo sapiens
LLIWSWQAQCIENFSDYPPLNALPSEETDGQVISEERGADSREAK

SEQ ID NO: 936822 - protein, 51 aa, Homo sapiens
MVGRAIRLNKITKEVNKNKQSEKWALGIPNLRDSEEEEQSAEGNEKEQPVE

SEQ ID NO: 936823 - protein, 139 aa, Homo sapiens
ETAEVGLGSGETAAVALRLNVPFGGGGGWAEGHQSCSCVWYLPLSPSRGIGDKGLTLFKPRDLEADPRVVLPTPPLPITISAHLVTITYRSFRNEQAPLGPIPMSSVDIRDFARSVTLGFFTTPDTTTTTTSAGRGSVR

SEQ ID NO: 936824 - protein, 104 aa, Homo sapiens
GDLPWEINPPSSCSLLREKDPPTTSGPEIDQPKKHLTNFKSATPRGPGTLAQGSLTDSFPDLLGLVAEDWHCPIASVEAPKTITDAELRVTLTVEGSHGAPNPA

SEQ ID NO: 936825 - protein, 110 aa, Homo sapiens
FGTGQYPAKAQMLSHTFFKTACELGTILPFPVHKNPGPSLVEAPLSDTYLCWQRAFFSCFLNFHSNLTFVFTLLNLLRGRTKNSGCYLRLRETVTSWCTAEDYGHLFFEF

SEQ ID NO: 936826 - protein, 43 aa, Homo sapiens
NGTRGPFGAVGVPVTHYDRTEAALLQGAYLIVVLYSTLIVNVV

SEQ ID NO: 936827 - protein, 117 aa, Homo sapiens
GDLPWEINPLSSCSLLHEKDATYDLRSSDHQPKKHHTNFKSGPHWKSDCPTHLAATPRAPGTLAQGSLSPSPIFLAQRLKIDTARSPRKPPETITDAELWVTLTVEEDRNVRPLSPS

SEQ ID NO: 936828 - protein, 41 aa, Homo sapiens
NLCNKTYSTFSGLAKHKQLHCDDQSGKSVCKFCDKEYVSLG

SEQ ID NO: 936829 - protein, 94 aa, Homo sapiens
VGAAQGGQAKAAQDIASPGKRKDLGDFPFLAKGSHDRLYQENWDTATQILCFPNSLSKQHTRRLYPALGSAGPTPTEPCSLLAHSPRSNCKETA

SEQ ID NO: 936830 - protein, 39 aa, Homo sapiens
PVKAFNAFKVKTKSHPVFGKIAFSERIWTPHAYTVVCTW

SEQ ID NO: 936831 - protein, 122 aa, Homo sapiens
QVGGGGVGGDQAVLRIRNLLFIFCWFINCFAAVCISCAEINFMVIYSRRLYLIVGDSGLAHFCANYSSEKLAMCLAGRSELSESVCGANGASIVLALDASGVEGSESGHSVRRYLINLVFAN

SEQ ID NO: 936832 - protein, 69 aa, Homo sapiens
EFLLCQLRGAQYPGLSHKHLSVRALRTQSSRVLLLLLLLLLLLLLLLLLLLLLLQHCHLGRTQHALGPL

SEQ ID NO: 936833 - protein, 177 aa, Homo sapiens
APTPLMGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILCRLAVEGMLEDLINSHADVNAVDDLGKSALHWAA

SEQ ID NO: 936834 - protein, 72 aa, Homo sapiens
EKAKTHYDAKKQQNQELQELGSSSGRKTKSCELKLNGWDELQQAGLKTKEAEQTCRHLTAQVRWEAQVRIWL

SEQ ID NO: 936835 - protein, 143 aa, Homo sapiens
SGSGTAGGRPGVGETRTGCLRVRASVTMGDHAWSFLKDFLAGSRRRPRSPPSRGSNCCCRSSMPAKQISAENSTKGSLIVWGESLRSKGFLSFWRGNLANVIPVTSPPKALNFAFKDKYKQLFLGGVDRHKQFWRYFAGLASG

SEQ ID NO: 936836 - protein, 76 aa, Homo sapiens
HEGDTHIHFPLINDIEVVSFIPCNKRRKSTDTKYIQTYKLQFLLQTTFSNTVAETLEATSWVLPILFNDKIIQTLR

SEQ ID NO: 936837 - protein, 121 aa, Homo sapiens
MSLKPQQQQQQQQQQQQQQQQQQQQQQQPPPAANVRKPGGSGLLASAAAAPSPSSSSVSSSSGTPSSVVGSGGGRGLGRGRNRNKGLPQSTISFGILCKYEDGSYSYIKLVPNVKVQMKKW

SEQ ID NO: 936838 - protein, 85 aa, Homo sapiens
MSGRGKIWRQWPRLRPSRARRAGLQSQWPCTRLLRNGHYAERVGGCHVYLAAVLEYLTLRFCIWLAYAACTIIIRYSFPAICSWP

SEQ ID NO: 936839 - protein, 39 aa, Homo sapiens
ITTTTITTTSTTTTTITTTTTTTTTTINTHTITTTSTTT

SEQ ID NO: 936840 - protein, 140 aa, Homo sapiens
QHHESNVVSEVPMPVWVGAAFGVTSALPLLFLVTSASRVCGVSFQLTYSTFLDSFANGKLWGADCEGVYARHKGLHSVVHAGCPAGFTHGFTIRPWCVSVCLSACQCATTFPDVYNFHALPRAPHVQIAAHSVTFNKGSN

SEQ ID NO: 936841 - protein, 496 aa, Homo sapiens
MPRRSLVNWAAAVLTADASSSAMEAGLLRGVGTGESPSSPGVKEGLSNKWLPGAKIPPVTISWLLRLEGHFPESTAWQTRSIRFIRTRSLALQNVGTGEARCEAAFKLKEIARREKQQRWTRREQTDFYRVVSTFGVEYDPDTMQFHWDRFRTFARLDKKTDESLTKYFHGFVAMCRQVCRLPPAAGDEPPDPNLFIEPITEERASRTLYRIELLRRLREQVLCHPLLEDRLALCQPPGPELPKWWEPVRHDGELLRGAARHGAARHGVSQTDCNIMQDPDFSFSGCPYELYAEPSSRSTSSILVTLLYSTAAPAVYLTHCLTTAPGPDAPVEKSPEETATQVPSLESLTLKLEHEVVARSRPTPQDYEMRVSPSDTTPLVSRSVPPVKLEDQDDSGSELDLSKLSPSSSSSSSSSSSSSSTDESEDEKEEKLTDQSRSKLYDEESLLSLTMSQDGFPNEDGEQMTPELLLLQLQPLSSFVLSCSCADTLLLDAEA

SEQ ID NO: 936842 - protein, 43 aa, Homo sapiens
GVPPPGTRTPGIRTSTLTDGQRLTAARAAGGACEPGLRFMTRP

SEQ ID NO: 936843 - protein, 49 aa, Homo sapiens
AAPGPPVPAPPSGKRAKVLQQPPKTPGRLRRRLMGYRPEPHRVGAHTTA

SEQ ID NO: 936844 - protein, 112 aa, Homo sapiens
ASIGKEYDFIVSTVVLMFLQADRIPAIIKNMQEKTSIGGYNLIVCAMDTEDYPCSINFSFTFKEGELADYYKNWELVKYNENPGHLHRRDENGNRIQLRFATMLAKKSNKHE

SEQ ID NO: 936845 - protein, 135 aa, Homo sapiens
HASAASLPQHGDRGFPSAAAGASVSAASPAPPRPRPAAAMQFMLLFSARKLRLQKWYVPLSDEKKKITRELVQTVLARKPKMCSFLEWRDLKIVYKRYASLYFCCAIEDQDNELITLEIIHRYVELLDKYFGSVC

SEQ ID NO: 936846 - protein, 72 aa, Homo sapiens
NSRPGSIHHKLKVEPLGLFGASSAAVERALARFLRFLTVEPGSLMASLDLTGAAGNFQTEWKDTNLAGSANF

SEQ ID NO: 936847 - protein, 96 aa, Homo sapiens
MQELRPEKIDVRAPREFPNNVLLSKEGTLAFPGIFNEPSRYIDGGLCSPPNLSNRASICSCVNLIICLIFHTISGMAGSAAERGRGRGAGSGSMSP

SEQ ID NO: 936848 - protein, 72 aa, Homo sapiens
MEHSTFLSGLVLATLLSQVSPFKIPIEGLEDRVFVELQYQHHMGRGNRWDKFLDNTRLGPGKTQSWTHRDYI

SEQ ID NO: 936849 - protein, 53 aa, Homo sapiens
MHAAPPMASSSESEDDSRGETKGGPGRLELPAFGVESVISRQISNRLLTKNGK

SEQ ID NO: 936850 - protein, 34 aa, Homo sapiens
IIGSHGAFQVLIAVHSPTLFLIHLSSKLSTEGNS

SEQ ID NO: 936851 - protein, 95 aa, Homo sapiens
VQGPSGPCTVADIQQFRYDNYRLHQLGNNSVFTLTLQAGLSAIKTPQCYKEDGSSKLTALLCSRSLNKLAHPGPVATVPTPRLVCKISGDVNERE

SEQ ID NO: 936852 - protein, 118 aa, Homo sapiens
GARPALMRMRGSRDEAVLAGGAETRDAGRGSTLPGRRTLRRASWMALTTSRLLCFRPSTGPGGCLSLSKGWDYRRATGARPFLLLLLLLAAKFGLRCLRIPELFLLLGANSFWHMGQL

SEQ ID NO: 936853 - protein, 69 aa, Homo sapiens
MSVAPGAFPGPAAKLAPQPKFLGLPWATISPRRPRVALLLDSPTSARRAALLLFGLVLLLLRLLLFARS

SEQ ID NO: 936854 - protein, 97 aa, Homo sapiens
QGDQGPGSVRPLCVSATESDLADGTLDSCPHCFLSTSDGWKTRPLHMCVRIKPAQCPSLIPANYENYYIHDCPNPLGVGLEGEASQLDVETQAHAGP

SEQ ID NO: 936855 - protein, 106 aa, Homo sapiens
ECIRPGTCDRRRAGSSFLEPSGKGCAEGLGGTCRVRSLAPFQTAVSSSGAHPSPQPPPAPDIRPRPEPRQSPVPSRPLTLEISPPLPTFPSQGQAQGPESPTHSRL

SEQ ID NO: 936856 - protein, 51 aa, Homo sapiens
DDTDLRFMHLRVQTRQLADRSILSSRSPAILRGNPFITAVTFKPQRILRGL

SEQ ID NO: 936857 - protein, 33 aa, Homo sapiens
MNLRNNMYPGKVKILPALFARLTPIPAKGLREY

SEQ ID NO: 936858 - protein, 52 aa, Homo sapiens
EELSKAYEDDGDRYSSIMVKGAGGTGLAEAFCRRSSMKEFAENLWALLWQEA

SEQ ID NO: 936859 - protein, 134 aa, Homo sapiens
RGVLATLRKYKYSKNILDRQDPPSVVVTSHQPQEKKKKLKLAYDFYPGKIDVHWTRAGEVQELRGDVLHNGNGTYQSWVVVAVPRKTQAPYSCHVQHSSPGPALRGALGGQLGSKGWRQCGISDPVAALPACGS

SEQ ID NO: 936860 - protein, 65 aa, Homo sapiens
GQKLLTRKADSSSSEEESSSSEEEKTKKMVATTKPKATSKGAFTFPSKEASYGSRDNSSLFQAHS

SEQ ID NO: 936861 - protein, 65 aa, Homo sapiens
DVEGNVQLETGDKINFVIDNHEPYWCCMCSQHFDVEKETSPLSGEEFCAMKEAFGFIERGDVVKE

SEQ ID NO: 936862 - protein, 70 aa, Homo sapiens
MSALRPHPPELPRTFLAWTAVPLESGHTYVVPWATGLPPIEERESPAAQPLLEHQYLSYLAPTGPPPRIQ

SEQ ID NO: 936863 - protein, 61 aa, Homo sapiens
RSSRPKIFHNFMERLWAYLTIQQLRGKTVSASDADQQALRNQALNLSLAYSFVTPLTSMGS

SEQ ID NO: 936864 - protein, 93 aa, Homo sapiens
TYPMDLSRGPSEQLDYAFQSPGDSRLNTKTFPKNNKNEFVISYQLLLFSHLLISHGIGKDVESCPDMAALNILKVLSELGPQSTEMPRTGNGP

SEQ ID NO: 936865 - protein, 74 aa, Homo sapiens
SGPCTNKRAKVCSCISESWAKTFLCSGEHPAHFSPASVEGCVQKPLKDAPTRIPALGQAAPKKGGVRVGHSCSM

SEQ ID NO: 936866 - protein, 40 aa, Homo sapiens
QREVKSVMHHEALNETLPEDNVGYNVNVSVKDVRRGNVAG

SEQ ID NO: 936867 - protein, 98 aa, Homo sapiens
LQWMMMMMMQLKMIYFCFCVCFAFLSFTLVTTGVQWRDLGSPQPPPPRFKQFSCLSLPSRWDYRCPPPHPANFCIFSNDRVSPCWPGWSPTPDLRRST

SEQ ID NO: 936868 - protein, 50 aa, Homo sapiens
KRHGQGTCFYEPFSMALHASPNHFLQLSLVPEEPKQPRPRPPPAQDKAES

SEQ ID NO: 936869 - protein, 128 aa, Homo sapiens
YCSLFYFAGHPWGISYRTSLVVMNSLSFCLFGNVIFSITFEGQFFQIQDSCLIFFFSFNILNMLAHCLWSPKFLMRNLLIISLRIPCSWMHWLTPEIRALWKAKAGGLLETWSSRSAWATKEDLMSLI

SEQ ID NO: 936870 - protein, 86 aa, Homo sapiens
CRQFHRWNAQDWEHRACAGPLFEGSAPAIVFLQMMPVLWMHSLYREHMGLSVGNSQGHYDFYPNGSFQLAALPRLQTYFQGMAITQ

SEQ ID NO: 936871 - protein, 89 aa, Homo sapiens
PRWNASPEQRVAVPCGGLTQWLNTGKELALESGHLKLVDWELYMDGSSFTNPCKVTLKKDDKPCSSHTRKLTGPRTVKHEETHRGTNFP

SEQ ID NO: 936872 - protein, 199 aa, Homo sapiens
MRFPPVVFPPQGGGTILCWAGRACWGDHTGRSPSLLVFVGKTPPLAFQLLWRCLYMEGNTSLGPAPRGAVPPSLFPRPLSGRGLCRRCLVLLPPAPPRVFRPLPVPPHLGYPPPSLFSQALPPGFPRGCGGATEPSLDIPAALSVLTLGRPRRLPVEHPGAGRFSLRAARILPAALPSRALGAPEGGGPLSVLTNNKNS

SEQ ID NO: 936873 - protein, 126 aa, Homo sapiens
CLNEISLRDTGIIMDTVCEMSDPSSSLGTLYMAGALLTVHHHFCLQLTKTGVRHVPPWCYISEGLVPGSGCYSHLSPGWVLNPGGKLFPGWGTDTGSWGPHQGCGCVPSCPFLKLSKLGGWVLGNC

SEQ ID NO: 936874 - protein, 57 aa, Homo sapiens
ENLIHVGATDNVVICSNGVDAATRRQDVDAVKGSDVPDLDCLVGAAVQVALGQPPGP

SEQ ID NO: 936875 - protein, 102 aa, Homo sapiens
NAKLLITQIKQASGWKAVCSAGNFLGMSGSPSVVSLPWDCRQPAASRRPQVSKLSHLFSPGAEGSGFGEAEGPRVDAKDPTPSKVKLEAGEAHGRLKAGGLE

SEQ ID NO: 936876 - protein, 131 aa, Homo sapiens
KRGQLYSVDVTLDPDTAYPSLILSDNLRQVRYSYLQQDLPDNPERFNLFPCVLGSPCFIGRHYWEVEVGDKAKWTIGVCEDSVRKGGVTSAPQNGFWAVSLWYGKEYWALTSPMTALPLTRSRGVGIFLGL

SEQ ID NO: 936877 - protein, 147 aa, Homo sapiens
AAAVGFRNHHFKALRFILFTDVVHFRFEANQNIAQLGKSGGRATTASIEHFNVFQELGHKLFGFFVTTVFIRCAPCRQIGITRVTRRFRVRENQHVGHQVPIVDILRVTLTHQEHGGEERFIREGGTASRAGIKGFYRGRILVRRNL

SEQ ID NO: 936878 - protein, 65 aa, Homo sapiens
LRQQYIILKNILCCYYDILLTTGFCLILLDFLICKEVILISQERKGICLWFGFSRLKEIIITGLA

SEQ ID NO: 936879 - protein, 135 aa, Homo sapiens
DVTGERQVMNRCLVLVLNIKVFDYQLDIPDVQAQTHTLTGPVNDLELLFPDVHGDLSIEILANKQYDEPTLIQHAERLKMLIGQFAADPALLCGDVDIMLPGEYCAGAGQRHSGWRFQKPRLARLVGRQSGKNNL

SEQ ID NO: 936880 - protein, 144 aa, Homo sapiens
MGSGLNLCEPNNKEGYYGYTGAFRCLVEKGDVALVKHQTVPQNTGGKTPDPWKNLEKDYELCLDGTRKPVEYANCHLARAPNHAVVTRKDKEACVHKILRQQQHLFGSNVTDCSGNGFGPVGKPRTFLFRDEQFVWANFMTRNT

SEQ ID NO: 936881 - protein, 141 aa, Homo sapiens
MGVSAEEKHNSECKGMDHVGFSGNGSGSPESPGNRSWIPTPEVQRCAHFGLRILSQKMASSQIEDLKEVLLGHLQRGVEEVNVVGVLDAVLGCLWGGEPIVPGFTEVLVTERPSSNPFDLTRNDGWGDTDIQLPKHEVVVE

SEQ ID NO: 936882 - protein, 44 aa, Homo sapiens
MLAVLTALTRFGHSRQLLLPGGPTFGSILGAPSLYLGYSDGVPW

SEQ ID NO: 936883 - protein, 95 aa, Homo sapiens
VLVVKPWDSLTKLSSASWTVLDWISNCNKNGKVEDSLELCWYTTDLMCPPKMPVIGVLNKIRWRGDGSLGSRGPLVPIHPRFLNWSSCLLQSTSG

SEQ ID NO: 936884 - protein, 68 aa, Homo sapiens
RRTLSATALIIRESEDSTDFNDKILNPLKHSDFFNVKELFSVRSLFDARFHLGHKAGCRHRFMEPYIF

SEQ ID NO: 936885 - protein, 68 aa, Homo sapiens
RARSWRQAQVRSAIPAVPADTEGFSFLVITKCLDVPDPFVPEPYWLKSFDQFTCNLLYVSRKDLTEHL

SEQ ID NO: 936886 - protein, 147 aa, Homo sapiens
MKYPELCSLPEAVRVHHWKLATLVSSLVGYKYGRVVMFNIENWKSQEITLDEIKAYCFILEKLLENEETQIGCIIENSKGFTMQAVSLRTPVLRKMVDMLQDSFPRFKAIHFIHQMVFTTTYNVKAFLEEEKLFERVLGHGDDLLGS

SEQ ID NO: 936887 - protein, 109 aa, Homo sapiens
CFKGMYRSSLELPLEHQRRPVISAFPTEVTSSSRWDWLDNGYSPQRVSRIREGCPLIQEAQGVGELHPLAKGSPEGLCHKGQCTLQILHFSHGLCNLQTGRPRVPTSPG

SEQ ID NO: 936888 - protein, 51 aa, Homo sapiens
MLISLDNTFTDTPRDKYFASFNPIWLTLNITIRGWSWCCPELVVGCHFLGH

SEQ ID NO: 936889 - protein, 128 aa, Homo sapiens
MPIGLPLWESTVQETGISRVKVRRRVQYANRKNSWAVVGPGPLTPRYGTGEEVVQHSCRFQVTVDYVWPRFGFHPSILHELKGGDIQDLLFKVVRGQEEVVQGNKVALQEPHEQHQVTPSCKLGFQFL

SEQ ID NO: 936890 - protein, 96 aa, Homo sapiens
LNEASDVITQDNRVKCLQVMSEVFTAAPPITGPEASGGKSSFMGWAQGPHAVCSLGTWCPEAQLLQPWKGANTELRPWLQRVQASSFGSFHVVLSL

SEQ ID NO: 936891 - protein, 136 aa, Homo sapiens
VPSIGTDEKCLIEILASRTNEQMHQLVKRIIKDAYERDLGVEIGETSGHFQKMVVLLQGTREEDDVVSEDLQKDVQDLYEEGELKWGTDEAQIYILGNRKQHLRLVFDEFLEDTGKPIEAIRGSVNNEGVWEREKG

SEQ ID NO: 936892 - protein, 50 aa, Homo sapiens
AGSGDRPDGKLLSKALLRKGSLCITKWQDFHNICMYEFHILASYPSFSLS

SEQ ID NO: 936893 - protein, 32 aa, Homo sapiens
GRTVCHNGVLGLTRLLFLLGFLRIRRGQQASR

SEQ ID NO: 936894 - protein, 61 aa, Homo sapiens
QVRPPPIPRGRLPRGTRLLTTYKGRQVFSMKPGRTPERTAWSHPTRAALEVVPAAPPHRHE

SEQ ID NO: 936895 - protein, 74 aa, Homo sapiens
MTAAQRSPAQKQRRCKKSRGFLGDEDPRGPGHSELHNCIIDKEVSLMAEMDKVKEEAMEILTARQKKAEELKKT

SEQ ID NO: 936896 - protein, 79 aa, Homo sapiens
RHETAPGKKTAIIIVEHNSSPCLLHMPPKILKCPLGGSQCRLTLASWTAGSSCSNRPLPGVPSLPSFLLPPLDGSMSPA

SEQ ID NO: 936897 - protein, 75 aa, Homo sapiens
GTSLACAWPSSPTGLKFDPPPRPRASDLRTLPSHAFNPKYLRPVSVYFAKVKDAPVTASGGPDNRCLRWLGIQFA

SEQ ID NO: 936898 - protein, 309 aa, Homo sapiens
VLWFPRYTPWFVYTPVSLSSGGLPHLVGVALLARRPVGCLAFVGLPPPCARSWRGFIAPTSAHILFLVVAPSGCFSQRRVSPPGGPFCVRTYKRSAFLARQEMWRPPRDCLRRGAPLKSGPERAILARVDPHPSRAVGFSPFGDEYPVLFFLPAARGPSPRGLVTPLLPRFGCSPADIGLFSCRGHTVSQLVLSRVANAEHSETTEMSPPRRGRLWAHAPREPLSLPGIMSASSLIGSLFLPPTADVVYNLTAEKSHQGSLLSAHMSPVTRDVVAPPHTLGGQGSPTGWNSFEFAQSCPSSRARPVRQL

SEQ ID NO: 936899 - protein, 169 aa, Homo sapiens
RSVPGPRISEWTLPPIALQVLNTCWVPAVFGRLIPSSLAPASARFKSFWCRLIRKPGSKVPLIIRSPCTSRIFEEAKPPISASRTLAGSPFFEANSSASATAWMFRATMIWFATLAVWPSHWRPQGDVLPWLEQRGTFEVCGSPPIMMSGCRPWTDSPPETGVKVGARS

SEQ ID NO: 936900 - protein, 96 aa, Homo sapiens
SPCSEILLLLKLQTDKERWLLSHRSELLHHPVWWGLWLAYGCRCCCTSWVRELGPLSAISSPSHTQPTLQFSVNERASLNHQPSTFLGLAHIKIPS

SEQ ID NO: 936901 - protein, 102 aa, Homo sapiens
MNGISAVTTMKTPGVDFVRDQVGYPSLLRSDLSPSKRNWKELVNKPCFTRNGSTKILHFMLPHTWTKPYCCYLWMLIDSVTALLGHVPERLSEVKYMTPDVT

SEQ ID NO: 936902 - protein, 90 aa, Homo sapiens
MLDGVLEGKLNAAFIDGPINHTAIDGIPVYREELMIVTPQGYAPVTRASQVNGSNIYAFRANCSYRRHFESLVFMLTVPRELSMRWSLIH

SEQ ID NO: 936903 - protein, 137 aa, Homo sapiens
LLVPTARHVINDGRMLIKTTPTLKIKDNVRRDTFSRRICCPKLIGRINNEISTRCGYGQAIFNKRKNRESSAINKNTERKSSPLLLIIIEMNGSIVILPEHAISITPPVSPATRHNKSVKLAVIHRIACGSRGDNDS

SEQ ID NO: 936904 - protein, 109 aa, Homo sapiens
MARAYSFSLTTFSPSGKLVQIEYALAAVPLSVGIKAANGVVLATEKKQKSILYDKLLVKLSRTNYQAYRFGVQHGPDYRVLVHRSSKTELNNTILCTKNPFLQLSWYRE

SEQ ID NO: 936905 - protein, 70 aa, Homo sapiens
IRHSGDRSFSQKSNLITHRKSHILGDEVGLLLKAFAVGADVGLLAGVDAPVPRQWVCGGSACVSRDTRRA

SEQ ID NO: 936906 - protein, 69 aa, Homo sapiens
QVNAGHQQLDLVRLRFCLSPRECFTQLRWAFGVTSQRPGIPLTCWAASEGREERRRALEEGGHNSAHLV

SEQ ID NO: 936907 - protein, 44 aa, Homo sapiens
QLVSQVGKLLLAYSEPCVLRGALLDVCLEQGKTCHSGQLALDPS

SEQ ID NO: 936908 - protein, 65 aa, Homo sapiens
REPLGTSSNDSASPDLGPRGPGLAVLQAEREVDILNHVFDDVESFVSRLQKSAEAAGLEHRETRS

SEQ ID NO: 936909 - protein, 73 aa, Homo sapiens
VNLTDSEETNMNISVHRPPAMTVKKNPERNDKGPKKGTAALGKATDRCPLLASSRGNKLPSLVDQRLGVVKGE

SEQ ID NO: 936910 - protein, 105 aa, Homo sapiens
KDKHIPTFSKRQLWSSSHRRTRSFQRKSVDIKRGSSQTFFYSRQRVTPIVDKIKFAHGIKPLNRRFLRGPVIKDSSFSDTGFVVGRGFMERHCVFIFIGFVDIKA

SEQ ID NO: 936911 - protein, 112 aa, Homo sapiens
MGKKTLLLRHGLIVQDRHDEVITCVNAQFFWAGRSVTGHLKDAFHALFVELVVMTEGDQVQQFFSVNLASTILNLERTPIWLMGDQAVGFQQVAKRLFHYFFTTGGILQIVS

SEQ ID NO: 936912 - protein, 100 aa, Homo sapiens
MRNMRFVEYRFDVTTNDFPHFMKWRAAAHGGENIAFKLANLPFFGDIRKSHYQVLQMREHVINRADRGFNPFFTGARQQKFVLIAGEFSIATVVECGYRQ

SEQ ID NO: 936913 - protein, 69 aa, Homo sapiens
PVRPSRPYEGSGLQSHLAPAPKPFQVFEDLSPGLGLPPARKSWPAGSREPHDSEKQCLQQPLRLGSPKA

SEQ ID NO: 936914 - protein, 41 aa, Homo sapiens
LLPMNPEARNDLKRQKTGKIRQTCRKEIRQFLRCFWVPDDS

SEQ ID NO: 936915 - protein, 69 aa, Homo sapiens
MAHSTLAAGGAADPSFPDFPTPGVVFRDISPVLKDPPPSAPHRHPRHLKATHGGRIYYIAGLDSRGFLF

SEQ ID NO: 936916 - protein, 63 aa, Homo sapiens
PSTSTATPGRAGRANFGAQHPLLTFGSTSAQFDMPASLQMSGPTALLTRVSQLVCGLAGKLQL

SEQ ID NO: 936917 - protein, 136 aa, Homo sapiens
IDSQTTSHKSSTHIKKQMSSYFVNSFCGRYPNGPDYQLHNYGDHSSVSEQFRDSASMHSGKYGYGYNGMDLSVGRSGSGHFGSGERARATLQAPGTKPQGTASGTSTHSPQPDPLPCSAVAPSPGTATTAGKKSLR

SEQ ID NO: 936918 - protein, 102 aa, Homo sapiens
SPTAGTTFKSNRPLMSGYRMATAVDKLTAEQRERYLQASADCQSPAPASGVVYELFVAGKGKTFTAKPKPAEIASLLAKRSSCGKTLYFSLRYLPVAHGIEY

SEQ ID NO: 936919 - protein, 64 aa, Homo sapiens
LFDPIIEDRHAAYKPAIDKTDLNPDNLQGGDDWDPNYVLSSRRATGPQHPWLLPPPALQPRGAL

SEQ ID NO: 936920 - protein, 153 aa, Homo sapiens
SAPGEQKPGKAARAEALGAPAEEEPGKGVALHVAHFECGGDGAPVQHTQPLEVAQLRHREEVMLRSPGTWVVHCGPVVQQEADNFCRPGDVTQLPMPRQTDSSPHVSTKGLTPAWVTERDSIIKKEKQHNMDGAWLKVRADGCQPPMVVSAIS

SEQ ID NO: 936921 - protein, 130 aa, Homo sapiens
PFPHINEKEMKIKMTAPTSYVEGGPFSESTITISLYIPSEQQFDPPRPLESDVFIEDRAEMTVFVRSFDGFSSAQKNQEQLTLASILGERWKFRMRRVYYNCRLQQPCQIALIRNTVVGIPKKLNPTQTN

SEQ ID NO: 936922 - protein, 153 aa, Homo sapiens
PHAGQGVLLTDGSEKDKMGKGGTKTLMNTIMQLRIIYNHPNMFQNFKKSFVEHMGLTGGLISWLDLYRASGKFELLDRILPKLRATNHKVLLFCQMTSLMTIMEDYFAYSGFEYLRLDGTTKAEDRGMLLKTFNEPGSEYFIFLLSTRAGGLG

SEQ ID NO: 936923 - protein, 108 aa, Homo sapiens
VFVFITCMKLTSSQILFRLLMCPSSSAAMDTTRMPGPPPQSSLILGYAHAVGKNREASQMYANCPHSVGAPGNDPGGDGAWRSRKTQPYLTGERRIWSPSCPGLEPRF

SEQ ID NO: 936924 - protein, 58 aa, Homo sapiens
IRHTGGLSTVMVEYSTSRGSEEVDMFVAQAVLQFLCLKNKSSASVVFTTYTQKHPSIE

SEQ ID NO: 936925 - protein, 130 aa, Homo sapiens
SLSTINDEFPTMVFPSGQISQASASPGPPQVLPQVQPCPCSSMVSALARPSQSSPSPGLLRLWPTCPQATRLGKERCQRPAAVQFDDEDLGAVGTDRPICVTDLESVDNSEFRAVNQGYLWPQKLSHADD

SEQ ID NO: 936926 - protein, 84 aa, Homo sapiens
ATYVLIDMVLNKAKGAKEIDIAATLHLRDQRPGMVQTKEQFEFALTAVVSEVNAILKALPQGAALSEAGHKARLAFLFERVYHW

SEQ ID NO: 936927 - protein, 97 aa, Homo sapiens
QETPGRASQLPRNKGHQATNGLTNGTSNEFNSSFYRGPQDQPTGLLTGLESSLWRTIQQQGPIVAPNQQEVARAVIAQFPTAVGVSCLEGGLRGDAS

SEQ ID NO: 936928 - protein, 69 aa, Homo sapiens
FGTAGHWWASFFFGKSTLPFLATVLESSRHSEPPQASSSMTACALARDARYTQPGGQSSTAKRWLSVLT

SEQ ID NO: 936929 - protein, 47 aa, Homo sapiens
SVVPVCFLVQTVILILTNRSELISTRFTGATGRFLLNKVVNLQYSEV

SEQ ID NO: 936930 - protein, 84 aa, Homo sapiens
QLSGDFIVEQAMGMSAAVCTAYGRILLQIAQVRQKLILTLLQQNTLLWCIHNYRSYCSFCKTGTDTLARYVDNPHQAHGISSPS

SEQ ID NO: 936931 - protein, 67 aa, Homo sapiens
ETSVKSTLFRNASGVLYSGDVKRQGLTRSWLWGDNIGYPGAVDLGYDFIPAQCHKDVSPIWLWSCSS

SEQ ID NO: 936932 - protein, 96 aa, Homo sapiens
ELSPCLPVSQGVCELRQATPLWRRDRTGHYLCNALSQDEWAEQALIRPKKRLIVSKRAGTQCTNCQTTTTTLWRRNASGDPVCNALRLYYKLHQVN

SEQ ID NO: 936933 - protein, 111 aa, Homo sapiens
VVCSHTVTLGHQDHRGWSLGSSEEITAPSPLPPLPLPRRVPPDRSLGPDEARSAGASPSREDRHRFPAGGGRSPRILMLPGSLFSPWPRMHFSEVETGSCMWNVCFPRQDG

SEQ ID NO: 936934 - protein, 158 aa, Homo sapiens
LKLYQRQQHRQGLRPVPRPVPPVEGSVAPDLYCMCGRIYKDMFFSSGFQDAGREQAYHWYRKADVEPSLHSGINAAVLLIAAGKFEDSKELRIGMKLGCLLARKGCVEEDAVLLGIVGFLPWGAGSSPNDPTPGWVLGKEQGLLLSSNAPQYWVPWVV

SEQ ID NO: 936935 - protein, 106 aa, Homo sapiens
MHKHLSAAEDQEELRGRRMTLRGSHYQNHEAKDTLWACLRDGEEGPPSAEHIVHVRWDYSRHCKDTKRWLCGSETAAIPMTPDYKHGWQIDVTDEGAMVSMRMKLG

SEQ ID NO: 936936 - protein, 121 aa, Homo sapiens
LSARLECNGAILHRNLRLPGSSDSPASASWGGITGMCHHTWLILYFEKGRGFYMLVRQVLNPRPQVICLPRPPNVSSFFNLYETFTLSSSIGTALKVTNDFDFPKCNSGFPSPHLTCSISS

SEQ ID NO: 936937 - protein, 52 aa, Homo sapiens
MKRRAVLLHMAPLVSAGADDSSIPTDMTQLKRAETAESEAVINGQQDDRHMV

SEQ ID NO: 936938 - protein, 98 aa, Homo sapiens
ACCGFCSGSSGIGAWLWRVVSHGRRAGERGHPESGESTAAACVRSVQATRAAAGLSRSHVWKRGSFRRFVFTSSTMPREFSKISLVLFSSVKRPYPYN

SEQ ID NO: 936939 - protein, 124 aa, Homo sapiens
GSPALGRGCGLALPRLLARARGEGWKMSMDVTFLGTAAYSPTRGASAVVLLCEGECWLFDCGEGTTDTAYEKANFKSRIPSIWGFQSVEKKRPGKTQHRNFKDLWCSTRYLPNGKAEKMFPGCF

SEQ ID NO: 936940 - protein, 203 aa, Homo sapiens
SSSPERTDGPWASKVTRAAPSLTLQTPLSSPCLLPLGLSLSMAEWEQRWREPRPAPAPIRRRSSNYRAYATEPHAKKKSKISASRKLQLKTLLLTCKRWKEAEDRVEKGRLTRCQPLELAGLGSRTVRTCCRQLHARVDKVDEERYDIEAKVTKNITEIANFDFRRFLTFEASLSGPTCEERSLQMHDAGAFGARVKSPGLAT

SEQ ID NO: 936941 - protein, 50 aa, Homo sapiens
MVSDGKHDGPCLESEEMQVLQNNMVSLLYDFKIVWVNVHASHKCVGGWFT

SEQ ID NO: 936942 - protein, 93 aa, Homo sapiens
SCTSCEEMLGGELIHGLGPSGNVWLSYERKPRVQDGKPVISFSHSNSLCLTPSCGLSGEQEPPQLITSILLHKGACSVWAGHRPNCHIPLYFV

SEQ ID NO: 936943 - protein, 72 aa, Homo sapiens
QQLVHALRPFAGERKRHWRAELQKQTQCTVDIPFWGPATVLPENSGEADSVRLMRRLHPPLSTPAQMEEQVL

SEQ ID NO: 936944 - protein, 33 aa, Homo sapiens
PDAVDGQLDESGIGAGHEWVSSLVVADVDYAAS

SEQ ID NO: 936945 - protein, 93 aa, Homo sapiens
FGTGLTRVRGSRGSGKMAAVRAGCWVARADAVAHTGVRGGQVRGAGVTDGNEVKASNFLGEQTIFSRILDKLQADILYEDNSVLCSVMWPPFL

SEQ ID NO: 936946 - protein, 123 aa, Homo sapiens
EIWSGSVAQARVRWHDFGSLQPPPPGLKPSSYLSLLSSWNQRHMPSCPANFCIFCRHRISPCCQAGLELLNSSNLPTSASQSAGICIHHCAWPTFFFLTIILFPGSSESLTGPFQFLGLSYFL

SEQ ID NO: 936947 - protein, 32 aa, Homo sapiens
YKPVFVTEITDDLHFYVQDVETGTQLEKLMEN

SEQ ID NO: 936948 - protein, 60 aa, Homo sapiens
HTCAPCPAPGPLAAGFLAMGRSRRTGRTEISSPADEGDGGGRTLDEIHRELRLRDPHDPS

SEQ ID NO: 936949 - protein, 102 aa, Homo sapiens
PANTAKPRLHQKTKTSQAWWRAPAIAGTRQAEAGESGREAAVSRDGSSTVQLRLGISGRPWKERERETVGRGRPWGEGEGEGEGFTIFKQGYFVFLLKSSFL

SEQ ID NO: 936950 - protein, 51 aa, Homo sapiens
ITQARCQSPGGGSGRKDRLRSLRLGSKSPPYLGTLVRLVKGGQQAGKGGAV

SEQ ID NO: 936951 - protein, 36 aa, Homo sapiens
DSILHEGTALSCQFCVLEVTTSPLPALGLCAPSPGP

SEQ ID NO: 936952 - protein, 34 aa, Homo sapiens
GSPHQTGRPPLLNALEVQGGRPDWFGEVAQHLGR

SEQ ID NO: 936953 - protein, 73 aa, Homo sapiens
QGSQLILAGVLGMHYRHEYQVPRPGTVVHALIPALWGQGRWISRSEVRDQPGHNGETLSLLKIKISRSSGGHL

SEQ ID NO: 936954 - protein, 93 aa, Homo sapiens
QGVPKLNKGMISVGIALRLMPSAPIRAHGSCQPLEVPLGPTNVSRPQEESAWLHVPGAWGRKVDGAIRVVTIGEYTLHSTRVSRDISHWLSAF

SEQ ID NO: 936955 - protein, 175 aa, Homo sapiens
EITLTKGQKQKLGGATARPLVPPDLQGFGTEPGFRRGALIVLEGFNGKSTQSRKLVDLATGTELLRFPERSTEIGKLLSSYLQKKSDVEDHSVHLLFSANRWEQVPLIKEKLSQGVTLVVDRYAFGVAFTGAKENFSLDWCKQPDVGLPKPDLGPVPPVTAGGCCQAGERLAMSA

SEQ ID NO: 936956 - protein, 74 aa, Homo sapiens
RIKVERTGRLAATKCRKRNWRIMQKDKVKTLKAENAGLSSTAGLLREQVASSKEGHDHVSNGCQLLLGVKGHFK

SEQ ID NO: 936957 - protein, 172 aa, Homo sapiens
GAKVGGRVAQHPPNPKSPAPWSPPPAHAVGPAAESGSPGGGAGLTQTPEMQRVSLLSQVMTRSYRSTLTWSSPEDKDNPGRMMPWPDADRLAGPSCRALGRHGVHRLAGPAIKRGRMGSSEEGVVINAGKDSTSRELPSATPNTAGSSSTRFIANSEPEIRLDFKPAGPRRS

SEQ ID NO: 936958 - protein, 72 aa, Homo sapiens
LGASAQSVFSGEFGVDFSQATEDVVRGLPRLEILSHGSPPSAPPWSLPVYHKVVPQIPVKSGGPHGQGVLGL

SEQ ID NO: 936959 - protein, 52 aa, Homo sapiens
MEGELKQSGGIASPRKCKGSGDFPFLAKGSRDRLYQENRGTSAQIFVLFQRS

SEQ ID NO: 936960 - protein, 77 aa, Homo sapiens
AGNLHRSITSQTSRPEPSQRPMDDKKKKRIPSPAWPSTQAPGHYGGSLCLPATAAPWPRTSSSAIPVAGQVQDSRQR

SEQ ID NO: 936961 - protein, 57 aa, Homo sapiens
MAQQRALPQSKETLLQSYNKRLKDDIKSIMDNFTEIIKTAKIGRDAGTGHSRVEQGQ

SEQ ID NO: 936962 - protein, 134 aa, Homo sapiens
SIAFHSIAIELIPFHSIPYHSIPFHSFHSITDDSIPLHSIPFHSPVLGLIIFHSIPLHSVPLHSILLHSILFGLIPCRSIPFHSIPFHCNGVDSIPFHSIPDYSIPLHSIPFHSPLVLIPFRSIPFHSIPLQSS

SEQ ID NO: 936963 - protein, 53 aa, Homo sapiens
QVLLPPWPGLPGMYTESLGGLQGGNMCAMVPTSHSSDSARPALTTKVDGRLTI

SEQ ID NO: 936964 - protein, 78 aa, Homo sapiens
MWHPGGTQNTPVIALSLYGYYIPCPVLSKAQSVWGSTSSCIHTSDLLPRTHAHPKMGAVPSTVSPNDFFFKIKENICL

SEQ ID NO: 936965 - protein, 49 aa, Homo sapiens
EKVTPGRDRSDPEQEAATPGPETGSCVGRGLREPDLPLRSEWSRKEGRG

SEQ ID NO: 936966 - protein, 32 aa, Homo sapiens
DSLAQLPRLECSEPRYHCTPAYAAERDSVPPP

SEQ ID NO: 936967 - protein, 36 aa, Homo sapiens
DSYKAGGNQKDIKEYVKWIDVLDYCTFSPQARKTTD

SEQ ID NO: 936968 - protein, 71 aa, Homo sapiens
FNGGSGGSQRLALPLRGPRRGLAGVGEGGPQCSWVNYRCTLEFLVSLLGTDLARGRGNSANGPQPLLTQNN

SEQ ID NO: 936969 - protein, 120 aa, Homo sapiens
EIGFHSHHPGWNAVAGSWLTTTSASSNPHTSASRVAGTTGTSHHTWLIFVFLLETESHHVGQAGLELLTSSDPPASASQRLGLQARATVLSLRILSLYSPFLKNPQKVSFSHDSKPLFGR

SEQ ID NO: 936970 - protein, 41 aa, Homo sapiens
ITHFERSKMEKEWEDFAVKDGYHQGKRSSICVTLLLISVPV

SEQ ID NO: 936971 - protein, 78 aa, Homo sapiens
MRVTAPRTVLLLLSGALALTTWAGEVRGRQGNGLFGEERGDRSGGAGPEPRREEGRAGSPSSPPGSHSMRYFYTMSRS

SEQ ID NO: 936972 - protein, 42 aa, Homo sapiens
VCSQIPNHSRSIRHCCKPRQVLIEGLNDHHRLRPQPWIPGER

SEQ ID NO: 936973 - protein, 54 aa, Homo sapiens
RHSEFLNLSSSPSMAVRIAALQSHALTRLPTPVLLPYKPQVIRALANPWMTRRD

SEQ ID NO: 936974 - protein, 130 aa, Homo sapiens
FSCAGAAGLYMAPSGMGLEAPLPQGLAAARRPRGSTSRPGRSADVRPGKPRRRRIRSRPRVWFPIRPIVRCPTVRYHTKVRAGRASALEGAQGAGNQKRLARDQSISCWIPRKAEQSPRNSLARPNVATA

SEQ ID NO: 936975 - protein, 33 aa, Homo sapiens
NFVILHARADEHIALRREKLEALALTTFCEDFQ

SEQ ID NO: 936976 - protein, 139 aa, Homo sapiens
DRLTVPADVAQELDTIDVPDQGLAVAIHSRVWYIADFRHHQLVADVAGTAIEEEAFLPFVDGDRNTNPPVVAWECGRDGDVGQVGHDARATSVIVVEDSGLQRCLGGRSKQKGRPRGKRVVTALFSSSPGESTPKHPPG

SEQ ID NO: 936977 - protein, 53 aa, Homo sapiens
GIYLSLEIGKTLMEDVENSFFLNVNFQVTTVCQALAKPKQQGYNAMGSQGGQF

SEQ ID NO: 936978 - protein, 148 aa, Homo sapiens
PLPTRPHLPFRGAARAARLTTACGAVLSPPHRLRPPRAHLDLSSSPSRSTHPNDDASRRSSLSYGLECAHAQRSSVSPLSLRRAHAPRFFSDLLARATLRASHTPHARARCWRLQLAYTRAPPLLRRTHTRAARSSRASTFSFPPLTY

SEQ ID NO: 936979 - protein, 80 aa, Homo sapiens
GLQACFLGFALILGKCSYSPEPDQRRTLPPGWSLRADPEEELSFTFALRQQNVERSELVQAVSDPSSQYGKYLTLENVAD

SEQ ID NO: 936980 - protein, 74 aa, Homo sapiens
WSCPHNGWLSHNGHHEDAGVICSASQSQPTPSPDTWPTSHASTAGSESSLALRLVNGGDRCQGRVEVLYGWGTV

SEQ ID NO: 936981 - protein, 46 aa, Homo sapiens
MVSLISVISTIGIALGVAVLIVGLSAMNGFERELNNRILAVVPHGE

SEQ ID NO: 936982 - protein, 167 aa, Homo sapiens
RKKYCWTHSMSLGRSSSKSSHCDSPPRSQTPQDTNRASETDTHSIGEKNSSQSEEDDIERRKEVESILKKNSDWIWDVVKSATLSMRNTSVMKKGGIFSAEFLKVFLPSLLLSHFAGHDWGSILGRRLDNLPPSTFLDEELGSLDLGSVQLDYFLSLGNIASLEELV

SEQ ID NO: 936983 - protein, 56 aa, Homo sapiens
AVDEIFPEGAGPYDLDEAGGSTGLMDAANKKAVNADFFNDFKDLFNDDDIQENALW

SEQ ID NO: 936984 - protein, 41 aa, Homo sapiens
NITVTYRDGRAQLQVYIRGSKIRFLIFPDLKNAMLKSMKNK

SEQ ID NO: 936985 - protein, 66 aa, Homo sapiens
ILVGVGLEATPSPGVSSAIFFVPGFLLVPGVYHVILIYCAVKGHRGFQFFYLPYFEKLIAAHVGPL

SEQ ID NO: 936986 - protein, 75 aa, Homo sapiens
RIVGQEKKGYFEDRRPSANCDPYAVTEAIVRTCLLNETGDEPFQYKNYADSTSSDLEPFLVHPTPNCSLSHWSPL

SEQ ID NO: 936987 - protein, 143 aa, Homo sapiens
ALPCHWVREGLRDDFGGQQVLARQRRAANTTGRRDAVSKVPDGDFALHVVQPGHWQLSPCLLGQGTLITGSSIIGGGVKAPRIKTKNLVSIIFCEAVAIYGIIMAIVIKQHGLSLSVATDPKGHRHPELTMQGYSMFLGAGLN

SEQ ID NO: 936988 - protein, 106 aa, Homo sapiens
FDYGDRFWDIKSKYFTCCGSKCKHSAEAIALEQSRLARLDPHPELLPDLSSLPPINNLRTVKIQAGHCPSDIPPSEDPSKAWKVYSPSPRAGFSLGVSDFRAGLPH

SEQ ID NO: 936989 - protein, 134 aa, Homo sapiens
TFIRDKYSKRFPELESLVPNALDYIRTVKELGNWDKCKNNENLQQILTNATIMVVVNGQPRGNKFGRRSWERLEEGLRHGAGAERPPSTASTSMWSPGMSFNRTQTCPIIIGASHGPAKIMGCGPALDQPLQDA

SEQ ID NO: 936990 - protein, 141 aa, Homo sapiens
TAPNAASSSTSASWAKRINFPGEAGVAIEERCLRACQVWARPEEEEQQGIPGHKEEAPHSTSPADCFFSILCTGEGRPGDGSRLPWACPAPLPAVLGMPPLDYGIRRQPCTRSSRRPGPELGLLRGAGSEPGAQARSCRGR

SEQ ID NO: 936991 - protein, 46 aa, Homo sapiens
EHQRGRTLTMVSLGCGFGPVVGGWYKVLVRFIPGTTKVDALKKMLL

SEQ ID NO: 936992 - protein, 62 aa, Homo sapiens
TNQRPARKPQRARGSEGAKDLVQVKLKELSFLPGDVGSQLSCLLGVLKYPSVPLAADPRFMT

SEQ ID NO: 936993 - protein, 71 aa, Homo sapiens
RQVVQTLHLQLQCLLLERHVHFGAGGDSLDGEVVGVGGQDERQHGSGVCALPLPVGQGTRSCPVSISRSPS

SEQ ID NO: 936994 - protein, 59 aa, Homo sapiens
REAPVVPEASPQSGPPPASRPERGRQLLKGAAHAPSVGSARGPLATSWTLFRTFHRPLP

SEQ ID NO: 936995 - protein, 59 aa, Homo sapiens
MKFHSMKMEEINKIIRLWRSTYRGQDIDYIEIRSDADENSPSDKRRNNRVVMLKGDTAL

SEQ ID NO: 936996 - protein, 87 aa, Homo sapiens
NNKGTNDPVYAKNAVSPTVQGNANQNRNERDHLIPVRIAVIKKHKIKNVGNNVEKGNPSELLVRMEISTAFMENSMAVPQKINRTTI

SEQ ID NO: 936997 - protein, 73 aa, Homo sapiens
SRVTLMAQHGSDQHQVLVCTKLVEPSTPRWPLYIVLGELQHQQGQRLRGEEARVLDLVLEGMNLALVGNKSRE

SEQ ID NO: 936998 - protein, 95 aa, Homo sapiens
GVGETLGALNLGGGPVWIKETTRHLRSRDFLAPHRELQAVSDDGQVPEHLLHALDLQGPGVPVLRCARPPRVCLSKLQRSAVERVLSAVAYATSG

SEQ ID NO: 936999 - protein, 38 aa, Homo sapiens
LRWKPSSQPTIPNLGIVSGPAVLAVLAVLAVLAVLGAL

SEQ ID NO: 937000 - protein, 36 aa, Homo sapiens
KRVIGQDHDFSESSEEAPAEASSGALSKHGEKAPMK

SEQ ID NO: 937001 - protein, 53 aa, Homo sapiens
FGMREMPHGGQADDEVLADLQAGKARLPQPRRVPLPKLYRLMQACWALKPKER

SEQ ID NO: 937002 - protein, 105 aa, Homo sapiens
PPDLPRIMHVHEAHGQTCAPSSSGQNEIHTGPTLQVDLYPMYNFDPTEEQDELEQELLEHGRDAPLYRLLLLLQAMQGKTTLPSQGPLQRPSRLVFTDVANAIHA

SEQ ID NO: 937003 - protein, 36 aa, Homo sapiens
LVDPVHGRISTEEAIRKGYRWPRAQRLQDTSSYAKK

SEQ ID NO: 937004 - protein, 63 aa, Homo sapiens
DGRERSKLGPPKKVLRKLKGPEEAPNGRSDRPCCYEKRMAVAVGVRAAPVLGIRTENARTRRL

SEQ ID NO: 937005 - protein, 51 aa, Homo sapiens
NGVIYDWSHIAFYDAFCQPVASRSTDLCHVADIANIRDRALVNTTNADQHG

SEQ ID NO: 937006 - protein, 102 aa, Homo sapiens
RHEASRELDAKTKTRAEVRRRWRKAPQKGTGRAGMAASALRSGEEEVLPMPGPTSYYYMLPMKVALGLKVALTVKLADDLIMDSLELPTGDPQLDKSWRTAR

SEQ ID NO: 937007 - protein, 131 aa, Homo sapiens
ITVSSLNAAFFDNFRQTVLFLTDDRRASYILHRQRFNGAGNILMIGCHDDALGTCFTRAFKNMNNHGFAVNINQWFTGQTRGREAAGIMTTKLMIYFISSQHAGFRFQQHWNAITQRESEVVQFANKLLFF

SEQ ID NO: 937008 - protein, 116 aa, Homo sapiens
YITQLDEMQRHWAVEDEKKTLNSLLRMAIQQKLALTQRLELLEGPCRPGVAVPKPPPKKPATPSLYSSQDFGHPALVTLQPLPLPSRGPTMGRKGKPKKAHFRNFLEYATCKFFSK

SEQ ID NO: 937009 - protein, 105 aa, Homo sapiens
MCCVTEGKSLYLSELQGPHLKEDNNTAGLMGLRRGPKLPLTWALPLERVRIPLGRQQQQQQQTLSVYLSIYLSIYLSIYLSIYLSNLSISQLSSTQPALASCQLT

SEQ ID NO: 937010 - protein, 94 aa, Homo sapiens
AATSVTPLIARVDSADLGWLRRVSPSSLTRSMCVPPRSCALGRRGRPSPDREGPVFGQGCPPQVIAGFNLLRRNSEALASKAAELEMELNEAQK

SEQ ID NO: 937011 - protein, 67 aa, Homo sapiens
QEGWFHHLARAVACFLTRGDLWSWESGVRVFNELLLDADLSVNAGSWMWLSCSAFFQQFHCYCPVGF

SEQ ID NO: 937012 - protein, 54 aa, Homo sapiens
APMAGGTQNGRAGRLRQGIAVLPRLILKLLDSSNPDLSLLKIAGNYRATMQLVI

SEQ ID NO: 937013 - protein, 98 aa, Homo sapiens
SVSEYQQYQDATAEEGEMYEDDEEESAQQSEAARGSERQVAAGAPAVSKPPEPSCCRHPAFPSPWVPCRPPAVFMASSSPPRPRVSCSCLCLIASSKA

SEQ ID NO: 937014 - protein, 81 aa, Homo sapiens
MGPPNTDRRKPQIRLQEDFESQVLKGFESGPKCGDHLAEEYRAKSWDSEMKKLYSHADFPSSVAGVFKLAGISCFAGIWRR

SEQ ID NO: 937015 - protein, 62 aa, Homo sapiens
ALPPCVTGEEDVVTDKEPGPAPDCIMTMRHNWTPDLSPWVLLLCAHVVLLVRATTVLQTHQK

SEQ ID NO: 937016 - protein, 29 aa, Homo sapiens
SGNQELKSASGIDFLIGVSRVTGRTAMGV

SEQ ID NO: 937017 - protein, 93 aa, Homo sapiens
SEVGLSSETGRRIRPDVASEGQRQAAVDQRRVAELDVVVGPPGDAEAVERHLDVGPAARRLVQSEKESVEEAVGDGAAANRGKAGSALVGRTR

SEQ ID NO: 937018 - protein, 92 aa, Homo sapiens
LLKLSFCPIVTLVLLSAQLTHRAPFGHPQVSFDDASSTSTCSSYWGLHSPTLGTRNVGVIRPNIQAMGTPSRIKGMRKDKLRVYKVGPGAQR

SEQ ID NO: 937019 - protein, 109 aa, Homo sapiens
SEEAATVKQPQVVPDQGPERGRSARAEKVKLIRRTTNPWTGAGGEYKEMDKPCGCPPGVDHGTGDRRVPWYSTVGLLPPVRAMSQRNLNAKTEQGPTGVHNDIQPHKHG

SEQ ID NO: 937020 - protein, 142 aa, Homo sapiens
QHATIAKRVKETPNATWPVHAVITNSTYDGLLYNTDFIKKTLDVKSIHFDSAWVPYTNFSPIYEGKCGMSGGRVEGKVIYETQSTHKLLGFSQASMIHVKGDVNEETFNEAYMMHTTTSPYGIVGSTETGGMMKGNAGKLIK

SEQ ID NO: 937021 - protein, 140 aa, Homo sapiens
FSHAYDLGADVRQKVDLSTFSDEEVMRLAENLRKGMPIATPVFDGAKEAEIKELLKLGDLPTSGQIRLYDGRTGEQFERPVTVGYMYMLKLNHLVDDKMHARSTGSYSLVTQLGGEGTSSGSFRGDGSVGAWKTGQTTLQ

SEQ ID NO: 937022 - protein, 41 aa, Homo sapiens
IADQVRSSLKRKKQEVPVFKAVYSEPGGRGANYFIKVHVGA

SEQ ID NO: 937023 - protein, 122 aa, Homo sapiens
NGGADESCIWKCCGDVAQCDQTQGKHQAPPAEPCVSPLPKCQTWELTDSTACAGFKSPGQLSGNRRISAAIIFHGLSRSHDLQVGDQGKEELSLHANSKAQDQNVVRCPEMSLLKAPCKEQK

SEQ ID NO: 937024 - protein, 88 aa, Homo sapiens
MTIVDDDICFEIQCQTERIEITGPYCRPVIVHQCHFAVERAAAVLKNLNAAFNQIVIQQARTDSDNRHIRFALNQFDPHPPCRFTQGV

SEQ ID NO: 937025 - protein, 137 aa, Homo sapiens
TGHPSLSTASHKCQRAAAKNSNPGHIGTLCSDCSDHSKHKQPMSSSSKSFQAHASDTAASLYPYASQAQGPISKVSVDSLWLTQQINPHPPQTQPQSRPHPTVVTTTGQARGQHPGAKGDSDCKPRTRASPGPKGQM

SEQ ID NO: 937026 - protein, 107 aa, Homo sapiens
GDAFRSHLSPRLECNGAISAHCNLCLPSSNSPASASQVAGITGTCHHARLIFVFLIETGFCVGLVSNSRPQVIHPRPPKVLEYRCEPPPAVNFNLYKLYLNIFKRAT

SEQ ID NO: 937027 - protein, 74 aa, Homo sapiens
ESCSITRCCLPAALKIAALLGSGLMEEQGREPIWAHPGSLLGCRGPELELPCAQLVMAGFGGPSCGVCVRGGQG

SEQ ID NO: 937028 - protein, 105 aa, Homo sapiens
MSGSPCPANKGGGMSLRFLAAGNPLRWAPILTSRWNSTSIKGKGYGHLYHKSQEGPGEKLLLGSSVAIFAIGKPWLDVRFYILQGILGQEGLVLEVCAGRLWRPL

SEQ ID NO: 937029 - protein, 76 aa, Homo sapiens
WFNICLKNMISIPANLGKAINIADYIDPAIMKKKKWQKKKKHLCKQVRSKRGKKKHIKEEPLSKEEPCTSTAIASP

SEQ ID NO: 937030 - protein, 83 aa, Homo sapiens
LRPGPPRSQIQAPGRTMSGSYWSCQAHTAAQELLFDLSVNVGKRNARAAELKTQPREICRMDFLVLFLFYLAVLMGLVLICVC

SEQ ID NO: 937031 - protein, 62 aa, Homo sapiens
DVPDWKVGESCSTTAGAPLIGELYGCAPQRRLSMPRLHVVHVGPFPATWIPAPSWDGITLQT

SEQ ID NO: 937032 - protein, 137 aa, Homo sapiens
YSRKSEAEIDMELFHQNHLIVKVPPYHDQHITWPVSVGIYVVKNGRSHDVHPTYTPDPAAGAWVNVKEISPARPGSEEAMKAMKTTGCNLDKVNIIPNALMTPLPSSIKSEDGYSNGGRKRSSTIKIQGFGAQLRKH

SEQ ID NO: 937033 - protein, 55 aa, Homo sapiens
VGSPSSLQHERPQHPIFAPGRTAAPRAAAALRRSGHLRILGKPVMERWETPYMHA

SEQ ID NO: 937034 - protein, 103 aa, Homo sapiens
MSVRAEVGGSAEVRGSRPDWPTWRNPISTKNTNFRWVWWHTPVIPVGVTQGAYLLVRSTGASHSLDTSQPEMFTVNPGNLVEADFPFLRKLGGFGKKPPQDKE

SEQ ID NO: 937035 - protein, 46 aa, Homo sapiens
REGTMLVDGGFKNAQARTSSPDKAGSAGFKSRVFPGGNGINKKGHL

SEQ ID NO: 937036 - protein, 152 aa, Homo sapiens
RVGLTWRLRSGENALNHVNGSLTRTTETSHVTAGQALQISPENLCKVLRLITQCEGLQMVFFVKAQGFGAVCLNTAIGRALTPMDAKTDVETVLRDFRELNTFDDWAASFWFSALDCRAGVQGRRRGWRWSPPTAAIFPDLLLPARPTDVPR

SEQ ID NO: 937037 - protein, 123 aa, Homo sapiens
GLPEEHHKEIHIRLGQLLEGCPSHRASINDTGALAPQIREVGLQPSSELVYLGLLGCSLASTNGPHRIGQDDLVPVLHVICDDLGLENNFSVMVSLSSSFSPMKGITPSPSAREWALLPNQVI

SEQ ID NO: 937038 - protein, 152 aa, Homo sapiens
TTGHFSLPIFFQYHSHASGLIGSPTEPRMRSGTVGAFDRFIAFRHQRAVRRGCGIENIDLMLVHHLRHTGRRRPVGYAFKHQRGRTAGQRAVTASNCVRSPPHRRCTSRYHPDDNQRHIERSAPRTPDNRRQYAHLLAYRVEPECRRINSGI

SEQ ID NO: 937039 - protein, 35 aa, Homo sapiens
SNEEIFLKKVHEEEIRELQAQLQEVQVEMDMSKPD

SEQ ID NO: 937040 - protein, 50 aa, Homo sapiens
VSAPGPSGACARLGQVLLQGRCVHLCFRGQATSKSQRVRGHVPLVPSGAE

SEQ ID NO: 937041 - protein, 34 aa, Homo sapiens
DPKQSSDWGALASTTVMSPCGGEDIGGYHVASYA

SEQ ID NO: 937042 - protein, 106 aa, Homo sapiens
RTAYHLVFQHQLNVIDNHEEAPIVVQAVGDVITYSFVMEDAYDGCATGFGFANQFHHRGAVFGVQRGGRFVKQQNGVVDDKAAGDVDALLFATGKCRWCQVPQAFR

SEQ ID NO: 937043 - protein, 37 aa, Homo sapiens
NIAWQDGCWNNYFPPQSIILISIIVAVHGKHAKSSRR

SEQ ID NO: 937044 - protein, 48 aa, Homo sapiens
GNMALNGAEVDDFSWEPPTEAERRCRRDGSGKRIIHYLFVFTFYNLQG

SEQ ID NO: 937045 - protein, 33 aa, Homo sapiens
NFGYNIPLKHLADRVAYVHAYTLYSAVRPFGCS

SEQ ID NO: 937046 - protein, 80 aa, Homo sapiens
FQARKHRPKHLDSKMLAAWNGLMVSGYAVTGAVLGQRLINYATNGAKFLKRAHVCGQWRLDADLLHRPGDGAQQPTLLGL

SEQ ID NO: 937047 - protein, 30 aa, Homo sapiens
NEGVFIMGKTIEFHMGGNMELKAENSIILN

SEQ ID NO: 937048 - protein, 39 aa, Homo sapiens
MAELCFQEYKKLAGRGGSCRWPQLLGRLRWEVPLGLGGK

SEQ ID NO: 937049 - protein, 48 aa, Homo sapiens
KERLGCRQTGFDIKSHAFFRSIDDLLEKKQALPPVQPQITDDYGLDNF

SEQ ID NO: 937050 - protein, 78 aa, Homo sapiens
GRAIMDLFHEERDTDLSERCRLCCRRKMATRSPVGLMGLRAAIRGHREVWTSPGELIDGTLCSHLSVATVKYGPAQVS

SEQ ID NO: 937051 - protein, 155 aa, Homo sapiens
RGNRLRLRHPGLEQALEKTKANLIQAVTRRFSTEYELQQWFTENSKYPQPLKSPGPHARCPHVSIPAAGAGPPFLEPEAPVSSPQGQSLQAHVLSACEPSLVPDDPGCLSTSQPLPLNANPALGLAWHLSPSALGLDLREAQLQGQMSRSSRWTM

SEQ ID NO: 937052 - protein, 35 aa, Homo sapiens
MTLVDLGDMEVWPAPGAWGRTCGGGPPGTCIQPGI

SEQ ID NO: 937053 - protein, 58 aa, Homo sapiens
TSAFPYALLSNDNAFLSYHPHPFAQLLTARFQVNNTRPPHVQLLRRCFTAMGVLGCWM

SEQ ID NO: 937054 - protein, 47 aa, Homo sapiens
NGITPRRWLLLCNPGLADTIVEKIGEEFLDLSQLKKLLPLVSEVFHQ

SEQ ID NO: 937055 - protein, 43 aa, Homo sapiens
VNSRSPSRRPGFERQSNGSTYRRTESSREVWPVGWGRREDSPA

SEQ ID NO: 937056 - protein, 33 aa, Homo sapiens
EAHQNRVMTVWCNKKGLLATSGNGTIRVWNVTK

SEQ ID NO: 937057 - protein, 48 aa, Homo sapiens
GYLARTSGSVVIWTVPTEPLEISTLAKMSSVQVTTALHQATKGAATGD

SEQ ID NO: 937058 - protein, 46 aa, Homo sapiens
VPDEDEGWLSDGTGAFSPGLQAKKDLESIQRSQLEAQLPKNGLEEK

SEQ ID NO: 937059 - protein, 79 aa, Homo sapiens
LENGPPIQLQSQRASLTQSQLNDQRRKTEHQKPAVVVVTGRRIGRGGPNLGLLQQGKLCVALRYIFKELFFGRAQCSCL

SEQ ID NO: 937060 - protein, 154 aa, Homo sapiens
LERLDRYPKKLVQTYSVFPYQDEMSDVVVQPYNSLLTLKRLTQNADCLVVLDNTALNRIATDRLHIQNPSFSQNQLVSTIHVGQHHHPALTPAYMEQWTSSGLHRPRFSHPQGQFPSWNRTRFNYRPVKWASVRDQGSWDVHEGGCCPRNVIGC

SEQ ID NO: 937061 - protein, 60 aa, Homo sapiens
MSEVTLLLSALAGAQEADTGRAEPRPGPSPTARWDEAITAIWETPAKGQPLFDAPKFRRF

SEQ ID NO: 937062 - protein, 72 aa, Homo sapiens
RDAKGISQEQMDFRASFNHFRDHSGTLGPEEFKACISLYDIGNDPQGEAEFARMSIVDPNRLGVVTFQAFID

SEQ ID NO: 937063 - protein, 174 aa, Homo sapiens
RLHRRTRTHLPGREAGQRRLVGEIVLAFERKGFKLVALKLVQSEELLRDTYAELRELFYRLVKYMASGRLVAMVWKGLDVVRTIAGIGTTNPADAPPGTIRGDFCIEVGKNLIHGSDSGGECPPRDRSLVSAQTSSAGKKTLGTGCMSSRMRVKKALSSSSKGQVAGLFAQPKG

SEQ ID NO: 937064 - protein, 61 aa, Homo sapiens
KSETTTGLALLWSHSCVVLGACVYPGQPRTVYYSLVHKYYLVHNIQSLEDDPSVAAPFDVF

SEQ ID NO: 937065 - protein, 47 aa, Homo sapiens
CEPPCLAVIIEALAERSVKPVVPATWEAEVVGLLEASLGNMMRPHRY

SEQ ID NO: 937066 - protein, 144 aa, Homo sapiens
SSERGCVPWRTALVQIGADDSYQLCEEKKSETLPACSHLSRALSLFCSLPPFANIGFKPAQNSAQRKAAAVEQAEAVASPAAESTAASRCTILPTGSSSRRQLPCSSSHGVPRAGRATFPKAMDNVTVRQGGERHPQVYHKMTG

SEQ ID NO: 937067 - protein, 84 aa, Homo sapiens
LSMGNALFMNVESILKTSESLTCRWTTEKQKAEEAMKRLSYIKPEFQMPVTRPSNARKSPGERCCCCTEGKRTGAGHEKTLQSR

SEQ ID NO: 937068 - protein, 112 aa, Homo sapiens
FPLPISLTSPFKPKLEPTAHRPSIALANGSSAMTVQKQKPYDRLNKKPDEKAEEIDAKAEEEFNIEKGRLVPTQKPKRLQYYEKKRNIEQQKKIQMSNLMNQARLKVLRARD

SEQ ID NO: 937069 - protein, 37 aa, Homo sapiens
KAYVMESMTYLQHPCCEVGHTLHEYTFEPISDAWTNL

SEQ ID NO: 937070 - protein, 138 aa, Homo sapiens
FGTRQWSLKSSAQFLGSPQLRQVGQIIRVPARMAATCILEPARCCWDEPVRIAVPALAPEQPVTLRRPCREGRLFPGPRALPPDTLGELDLERAPRGNFRGSEPMGLPPGPLEPEETFWLRLVKRDVANALGRGAGGA

SEQ ID NO: 937071 - protein, 54 aa, Homo sapiens
MGNSQERRQRLSTASDNPRVETLQADIGTAVGTAGAVLTGPEYEALDALPDAER

SEQ ID NO: 937072 - protein, 48 aa, Homo sapiens
KPSTGSGTMVTRVFPCSLALAICQEKKPQLPHRHPHRPSSGVTSTGGP

SEQ ID NO: 937073 - protein, 142 aa, Homo sapiens
GSREGSLLNKTEVSSHKGVTSLYFICQITSIDSLFPVIHSSMEYYNSCHKSKCASPACSTGSLVTTCWGFATWPTNQQSLGLIMLTKIPSEPDCKTNICNPVNLTTLEPNWLVWTTGLKAPLRVQASSQEIDSRVYVYIIYI

SEQ ID NO: 937074 - protein, 120 aa, Homo sapiens
SNVSYVHTHMSAHARIHIHINTHIHPYETQDLDPTLLEPGFLPCFSPISLHLPPPVLFSWALGQDKFPARGLKKWGLEPGIKVLESKDVGDKPELKTSLPIPKEGLGPLRVLKELAKQLG

SEQ ID NO: 937075 - protein, 65 aa, Homo sapiens
MGLEDEQKMLTESGDPEEEEEEEELVIGLLSVTGNLGRQECETFPYYLASNGRPHSAIFGGSALS

SEQ ID NO: 937076 - protein, 137 aa, Homo sapiens
MRIEPASGFSWPVKGLEQRRLAGAVRTDDAGRNRPRQPERQVLDQKLVAEALVEALDLDDDIAEALARRDDDLCVGRLAVLRLLDQFLIGLDTRLGLGLAPLGDDWILASRQIDFWRAFVSRPSWIRRLALASRYLV

SEQ ID NO: 937077 - protein, 75 aa, Homo sapiens
MAARPGLNLGVLEFPGAGCGVLAGPAAAGRGRAVSRSAVGGTRLDASRELPAAVALPGSQLSALDGFCDELVAFD

SEQ ID NO: 937078 - protein, 111 aa, Homo sapiens
ALSPRLECSGAISTHCKLCLPGSRNPTSASQVAGTTGVCHARLIFAILVETRFHHVGQAGLKLLTSSDLPVSASQSAGITGEPPCPARGNCLLEGTCPTALSVGIKGVQFF

SEQ ID NO: 937079 - protein, 91 aa, Homo sapiens
MHLNFMDEKDRIITAFYNEARARQRTNRGILQQERQRLGQRQRHSEPTQGPEIVPRAGEGSTWMGPAVRSRFASFPRGSPKRAAIKVISAE

SEQ ID NO: 937080 - protein, 81 aa, Homo sapiens
EAWGIVLNPNKTKVGSCEGAHPHLLLFPYGHLSFGFMQDLQQKVVYLKLHGGGVQCVLPPRSTVDILGSECIPFEISKHPL

SEQ ID NO: 937081 - protein, 33 aa, Homo sapiens
KFMMTNKLDTALGGFSAVVSAMGAHTSVCDQAT

SEQ ID NO: 937082 - protein, 30 aa, Homo sapiens
FGTGRFRLSLQSSRAALLLTLCIDGLHLGD

SEQ ID NO: 937083 - protein, 108 aa, Homo sapiens
MSGRGKQGGKVRAKAKSRSSRAALQFPVAECTDCCERELRGSRAPGGSYLAAVLEYLTAEILELAGNSLLINKKTDNSPPPCKLAIRNDEGSETKLLGQKLTIRSGRR

SEQ ID NO: 937084 - protein, 81 aa, Homo sapiens
KSPWKHTEVFCSIPSRSLLSPSYYHSFGVTENYVIFLEQPFRLDILKMATAYIRSMSWASCLFHREEKTYIHIIDQRTRQP

SEQ ID NO: 937085 - protein, 46 aa, Homo sapiens
RFGGPVHHQAQRFRFSPMGVDHMSGLSVNVPGNAFGWCIFIYNLGQ

SEQ ID NO: 937086 - protein, 107 aa, Homo sapiens
FGTRRLALSHHHLRPRTVVTEIRGLLAKGLRPEPPPAGPLLNGAPATSPKAAPEASSPPASPLQHLLVWKGVPWAPQAQPGDWRAGVQPQARPALHTTTEDKCRGAD

SEQ ID NO: 937087 - protein, 68 aa, Homo sapiens
RRNLIPKTWAARHRARFRSIHILKVAEIEKTADVKRQVKQFLTKDLKFPLPHRVQKSTKTFYKPSTFY

SEQ ID NO: 937088 - protein, 126 aa, Homo sapiens
LGSIKWCSDSDTFPSGHKAPDESQCRTPSSQYSRVTLLRRTPRLLASGTRQRRNPAPVSWTWLDMVFANPQSHPALTAEQEAKTHTNNHYSPSVSRKQLKKTDLRPFSQDNWGLGLLRGGNVGAGS

SEQ ID NO: 937089 - protein, 75 aa, Homo sapiens
PCKAHQSHPTEKPEVNEDEKTKKTVEDSFKCSTGPGTAAPAWNPSIQETEWGGSLEEIKTSLDNMVKPITKKLRN

SEQ ID NO: 937090 - protein, 231 aa, Homo sapiens
HGKGNQEMEVKGAHPRSRKGCVTAARKTVVNRVISGSRGIQSVKEEKKRCRMDCQMSFQVGLRESLRKSKNETEKHPEQLSEKIRKRCMDLSSTDRYTEKVLVVARKKELLNGRLRRTWRTYTERTVPKRVELLAQPAGHKDTVNPCNGLRTNYSTQLHDTTTTLLSYPEVVGHAYSSAAQYRNARALSRKLTTRSGHEPSATLGTRGIHTRQPQELTHPMTARTIPIAHT

SEQ ID NO: 937091 - protein, 62 aa, Homo sapiens
MPNVPRKSGSSVNTGTRYGASLRKMVKKIEISQHAKYIALSVGKTQDEETSLLGIWHCGFLH

SEQ ID NO: 937092 - protein, 134 aa, Homo sapiens
MVKLKYTKNYSGVVAHTYSRIVSVIGRFLVYTDFKKKLQTLAVNVTVLKGSVSGICSLGCSDVLGVFSFWWVRDLTGSGMKLPDLAVSVTVLKAAYPELFVPPRGFVVSLASKVKLETFTASITAHKSNVEPNS

SEQ ID NO: 937093 - protein, 55 aa, Homo sapiens
MVRLLRSRDALVGLWFVSVTTGPWGAVATSAGASRFKCEDLKVGQYICKDPKIND

SEQ ID NO: 937094 - protein, 124 aa, Homo sapiens
MFGSLLLFALLAAGVAALACSSRSPEAEPARSRLSRGNLWATGHFMGKKSLEPSSPSPLGTAPHTSLRDQALQAVMICSDILLLKKALGRDFKPAPHPKIQYRRLLVQILAEMDTNNGGRHSVA

SEQ ID NO: 937095 - protein, 31 aa, Homo sapiens
SLSLELVGSGYRMSLVKRRFTGMYLVELLNP

SEQ ID NO: 937096 - protein, 142 aa, Homo sapiens
MSLSSSVVVTRPEPSVPRMPRGRRTSRMAPPAAGPSDESCTRPAQVAQHQQRDPILQLLLLLRPAGLMARWQPLQLAWLALLWGNIGSRITGGFSGGSNAEPARPDITYKEASGNPSQHSRSLLLLRSNSFLECQNKGDNSV

SEQ ID NO: 937097 - protein, 87 aa, Homo sapiens
LKVRLHDAYCREKSVKAQETPYFTPLILIPANILSTVACNTIFHCPEWNAVREAFQLRTNTPVIIKIIPAQARAGFMLMIENAFSVL

SEQ ID NO: 937098 - protein, 95 aa, Homo sapiens
MLTAVPVSPPKTADKLETVLVSTTGNIDIGSILDRSSVGFSSYMFVLHRSPPDILSVVFLCVGLLGSWACPGKLQVGGHTETCVLSVLLGNWRTA

SEQ ID NO: 937099 - protein, 101 aa, Homo sapiens
RHEDSAGAVEGSRAATPGLFIPSRADALPTEGRVGRLCCNEGEDYVLERGHLLGGNDENCGICRMAFNGCCPDCVPATTRWCGASPTASTCIDPQSGTHNK

SEQ ID NO: 937100 - protein, 33 aa, Homo sapiens
QQEAEEEEREEEEEAQIIQRRLAQALQEDDFGV

SEQ ID NO: 937101 - protein, 103 aa, Homo sapiens
ALCVLVITGFISTKLGSEFPQLSEGDFAVQQLRSPSTGLEESLRIQKNTEKLLLKSFPEIKAVFARTGTAEVATDVMPPNISDGYIMLKPRSEWPNPKESLEG

SEQ ID NO: 937102 - protein, 114 aa, Homo sapiens
KEKVEEQEQQQQQIIKIRITLTSTKVKQLENVSSNIVKNAEQHNLVKKGPVRLPTKVLKISTRKTPNGEGSKTWETYEMRIHKRYIDLGSSFKSLRESLKSPLEPVGCRSCLFG

SEQ ID NO: 937103 - protein, 138 aa, Homo sapiens
IRHGSWGHCAVGPWPRSRCDVHLYSAGQHRGHQVLGDGVSPCWPGWSEAPDLVICPPQPPKVLGLQTVTATPRLECNGVISAHCNLRFPGSTDSPASASRVAGTTGGKRDEELVLPINSSLSVTLHQDQLRNHHNSRH

SEQ ID NO: 937104 - protein, 117 aa, Homo sapiens
YCLGQMQDRAIPMLVDVLQDTRQEPMVRHEEGPGGHRGPGSSGDPEAVFLGPRHRGGRDLQLAVRRLEWLQQHGGDRRRDPTSPWTLPRRLRSVTCGPAGGAAGPIDSTMVVPEWVR

SEQ ID NO: 937105 - protein, 35 aa, Homo sapiens
MEQSWTENDFDELREEGFRRSYELQEEIQTKGKEV

SEQ ID NO: 937106 - protein, 57 aa, Homo sapiens
FKPAVIADSGSYFCTAKGQVGSQHSDILKFVVKSSKLLKTKEAPTTMTYPLATSTVK

SEQ ID NO: 937107 - protein, 67 aa, Homo sapiens
VSDLRFHASIPRRSGASPAPTPRPGRIPRGKSLSPRDRRGLDASRTEALARPGPRVLGRGKAGSSLP

SEQ ID NO: 937108 - protein, 149 aa, Homo sapiens
RPGPIDSTMVTEQLGCHRTLVDPKQPLQARFRACSRCVGSAAQALAWISQAFDDDSALLKHRARPTAWARCRMPSAIPMLVDVLQDTLTPMVRHEGEALGQIRGPGKFWRSLKQYSSGPRQSKVAETCQLAVRRLGSGLQASNGEPAAG

SEQ ID NO: 937109 - protein, 175 aa, Homo sapiens
MAENSGSDGKSSGTQPGAVSEQVIAGFNRLRAWRASKAAELEMELNEHSLVIDTLKEVDETRKCYRMVGGVLVERTVKEGAARFGEQQGSKIQKIIETLTQQLQAKGKELNEFPGKAQHSVSWEEDEKPAAKENSEGAGAKASSAGVVWSPRDQPLHFFSPDFPILISPLLLIIN

SEQ ID NO: 937110 - protein, 52 aa, Homo sapiens
ETDVYQDLCWEHLSDEYVCSRPLVGKQTTYTCCCLYGEAWGMQCALCPLKDS

SEQ ID NO: 937111 - protein, 67 aa, Homo sapiens
VCKLRHKEARGGSVRVPKPQKSGSRQHSRQVAKGREPLNCWCKPKSPKAEELESDVRGQEAPSMGER

SEQ ID NO: 937112 - protein, 127 aa, Homo sapiens
PWSSPQQLMSLGTPRSQAERSKVLSVGPWTQLLPGSGHPGDNRAPACAVSPQWARCALPMPPLPAGCQEYHKEARAGCLTAVIPALWEAEAGNLRSGAQQQLVNMVNPFIKSTKILLGIIVHALIPV

SEQ ID NO: 937113 - protein, 57 aa, Homo sapiens
MFTCGPNEAMVVSGFCRSPPVMVAGGRVFLPCIQQIEMAKAQRDYGLKKAAYDIEVN

SEQ ID NO: 937114 - protein, 113 aa, Homo sapiens
SFINPQGERCAGYAVITLGHCEAELIALIQALELSEDPSQSANTGSSGQETSQQDTDLPTRLIRRRDQAVAEDDSPALVSGGCPVYTRLKLEETTSPALVTHWQLNSLRMAEA

SEQ ID NO: 937115 - protein, 96 aa, Homo sapiens
VTNLKTPSAAYLWVGTGASEERRRGPRSCSGCCGPNLCRWQKAASRWFWAWEGCLPHIPTAEGQEDGPSSSPLCLLQQDKLAKGSLVELMQRPGNG

SEQ ID NO: 937116 - protein, 91 aa, Homo sapiens
PGDRLAAPELGFQWGHHWNRRPFPPRCLPLGVYYFLNLLSAGRNIYIVEERAVVLGFYLGLAEKGGEIRCLRACPGLDFGAPSGRGRWVGG

SEQ ID NO: 937117 - protein, 166 aa, Homo sapiens
DLEERFQWVSLCVTELKNNVAAYLDNLQAFLYFRPHEYNLDIPRGAQCSIAIWQETFTYEAFLKFKQRLEGLVWQPLCSLAKKPAWPQNLIKKRLDKLLDFERVEEKLLEVGSVTYQEEAAPAHIPGTQLRCWLSSHSLSWSCSGWADVHIRPPEGLQNKLLQRAE

SEQ ID NO: 937118 - protein, 57 aa, Homo sapiens
EIRMLKKVVSVHPGDVLTSCTYNTEDRELATVGGFGLEEMCVNYVHYYPQTQLELCK

SEQ ID NO: 937119 - protein, 89 aa, Homo sapiens
EPQVLHLGEPDRRLQKRKAIKLQILQMEPQSSAHGFYRGPLVQPAGPSITLENSPLEDTKLQGPFFTPNQQEVARTDLPHGSQQQLGVS

SEQ ID NO: 937120 - protein, 63 aa, Homo sapiens
IRELILACRNMIKLLTQDDTNLSKFISRQLSPTAAYHLVHEQVISPLHSHLTRLIAAWTGCDA

SEQ ID NO: 937121 - protein, 301 aa, Homo sapiens
HLSFTHPFRRWPYPGYGLLPGPSCSPVWTLSPRSQRPLKFGSTTRFNKRRPPPRRGDGTLFGNAGPTAKVPYVLGNKTRRVVALGDIHPPGVRPKTRPALRRCHEDNVPPGNFPGGFALSPGVLKPLGGPSPRKGGRPVLPAGPRGGAPYAQVSRRLPGGRSAPIGALPLSVARRGLAVFFKRGLLVANFGLLEVRGVLSPLAKGSANTHHRGVQSPNHTRPGTLQESTYARAYREWAKAKSAIHPLVTTPQGTGSTWVIPPAIPRTHGGGRKPENNTEHTRSNRPPGPKSGKPAFSKQTR

SEQ ID NO: 937122 - protein, 53 aa, Homo sapiens
VQLSVTDSFCCCKLSAGGAVPPPSPGIFPPSVNMVIKRPSGLGVPSSSSGMAS

SEQ ID NO: 937123 - protein, 38 aa, Homo sapiens
MIQQGDLMPQSALFTGIIPPVSTIFTADGQLDKPGTAA

SEQ ID NO: 937124 - protein, 295 aa, Homo sapiens
LGVPLGARPLLVAEFMCAAVLARAWRIAGAFNLGPPYLRRGPHGPRVCIAAPPAPVRALLVPPGTYWSVHEVRSLRGLVLVMKATRWCACGASQVPVALSPVGRESCPCSHLSWSGHRRHFIAPRGGVYRHHSGPRDLVVLDRRCVLDCIPRCVWKHMVIEGVVPPSLVPHPPVYSPPASLLGECVSIGHALLIPPPCGAPPSFRINPPRPQTVCKPPFFLTRVAPHTAAPLLSRRPLCAPHLACGAPTVQRGHRLIHPTGAQQVSLEFADSVHHSAPPGLPPLAGFILPDKQTK

SEQ ID NO: 937125 - protein, 127 aa, Homo sapiens
MSGRGRLAARPAKAKSRSSRTGLQFPVAVYTGCCRATTPSALASQSYLAAVLEYLTAEILELAGNAAGTTRRRESSPATCKLAIRNDEELNKLLGGVDDRQGGVLPNIQAVLLPKKTSATVGPNALR

SEQ ID NO: 937126 - protein, 154 aa, Homo sapiens
ISPSSSDSGEGTSLDAGTRSTKAGGPGQQGWGGGPAIRARYRSAVPHPPPPCQPGWGQPYFKVRWKLDPSGQPSLDTRGSPKRHHFQAARRSVRARSKEGRGNAPSTLKTPNKTQTGQGPKLSQALFICQILGGFAATGTLRVPAASAPSRDGV

SEQ ID NO: 937127 - protein, 144 aa, Homo sapiens
GRKKQRRNRTFNSSQLQALERRSSARTYPDAFVREELARRVNLSDRVQVWFQNRRAKFRRIERAMLAARSASLLKSYSQEAPSSSPWSPAHRPESRLSLLDSLVPLQHSCNPTGLGASGPNPRGSNMGQQASASLPSSRAKGSL

SEQ ID NO: 937128 - protein, 84 aa, Homo sapiens
AQKAVCKLRSQEASPNPNNSKVGKPIVQSSGQRPLAKHWGKSKSPTAEELESLMFPALEHRTPSSSVLYVSIYHISSVPLENSY

SEQ ID NO: 937129 - protein, 61 aa, Homo sapiens
ALLAASIATLSSLASPSPSLFVAERQPSAMTVVSVPQRQLVLGGRLARLVFLPRLLWGPPD

SEQ ID NO: 937130 - protein, 103 aa, Homo sapiens
NNPIKKWAKDMNRHFSKEDIYAAKKHMKKCSPSLAIREMQIKTTMRYHLTPVRMAIIKKSGNNRYWRGCGEIGMLLHCWWEGKLVQPLWKTVVCTQRIKSFYF

SEQ ID NO: 937131 - protein, 90 aa, Homo sapiens
FRFQAAEQDEMRLELQRSANSNPAMAPRERKAGFELADLCSQTPAMAPPRTQSWLQEFLLEDFHILLAFLTSIVHIKTSDPSPPHPISLS

SEQ ID NO: 937132 - protein, 32 aa, Homo sapiens
KHIWVGVVPRGPDGAQLSSAFRRFSEECLSSL

SEQ ID NO: 937133 - protein, 94 aa, Homo sapiens
WESQAPSPILHEDEEGTAADDLAETLRQAPPHRHPDLALPGLENAPARGLSQAASPGAGADTARETIPDPDPTVPNNCGPVTQGGGESQEEVEA

SEQ ID NO: 937134 - protein, 86 aa, Homo sapiens
RIKFAVMKDYIQCGQVNSVRTQLLSAPSTGRKCGLRGAAEAPFTGLQVESPGPVVSPSSSILISSSPHASRGHTKSILLLSYWASS

SEQ ID NO: 937135 - protein, 80 aa, Homo sapiens
VMTSPAEVAHCLFSQTVSPCAASTTTSPRDTVCHHRLGKTKYNANKTPDKLQRSPALLSNAECKKSWGRRITDVMICAGA

SEQ ID NO: 937136 - protein, 64 aa, Homo sapiens
DFKKSLDYPRLGDSVHGSNAFQSCSWRSPEYQKDQFLQLPFSVSGDASAGINELIRFDHIYTKP

SEQ ID NO: 937137 - protein, 73 aa, Homo sapiens
FGTGDAAIAQDYGVLKADEGISSQGAFFTHSMTKAYSSGPITVNDLPVAALWIETLRLVQAFQFTDKHAGSVA

SEQ ID NO: 937138 - protein, 43 aa, Homo sapiens
SCRVAAVSGRVPKRSGPRGAAEGLREQAARRDPGIAVRRCYPA

SEQ ID NO: 937139 - protein, 98 aa, Homo sapiens
RQNPAGHAQHSSHRKEDANENSGSDSSEMCAYENPAPQRPDSKSKSRSQGSTPSLEFGFLPSPTPRVRLRGEDQLTPSVVKPSPATRETQHGLFPKAQ

SEQ ID NO: 937140 - protein, 88 aa, Homo sapiens
WYLIITRYQETFNVIERCPKPVIAAVHGGCIGGGVDLVTACNIRYCAQDAFFQVKEVDVGFGCHVGTLQRLPKVIGNQSLVNGAGLHR

SEQ ID NO: 937141 - protein, 91 aa, Homo sapiens
PTYSRAASNQNPGDNRTIQGVEESSLSLDKTKFTWYLTMVNMSELIKIIRRRLQLNANQAFFLLVKDTRMVSVSTPISEVVRVRKEDGFLY

SEQ ID NO: 937142 - protein, 152 aa, Homo sapiens
FRHRHRWGLDLQLSWEQKEQPVRSPSCGGLGVPVVARPTVTLSLFPQTIKCLLIHPNPESALNEEAGRSLLENYEEYAARAVLLTEIHGGAGESGTGTPVRALASGPEASTDPGPGRAKLALKGPMAKKHAGERDKKLAAKKKTDKKRALRW

SEQ ID NO: 937143 - protein, 75 aa, Homo sapiens
PSASWVREKPVVAQPDFKNLKGEADSAASVAKGQEPLATNPLVQVLDSKELKNLEDVQEQEEWKKARRLSKQGRQ

SEQ ID NO: 937144 - protein, 76 aa, Homo sapiens
KIVEIDRHIGCAMSGLTADARSMIEHARTAAVTHNLYYDEDINVESTQSVCDLALRFGEGASEERLMSRPFGGCLV

SEQ ID NO: 937145 - protein, 92 aa, Homo sapiens
HQRETCRHRRQPRTSCRCCDTNRKPTKSHDTEQVDQDRPGERPPLEQRHVEHRRLGTQLAPHEQETHREAEKPRTGLSDSDHPRASDFDRVD

SEQ ID NO: 937146 - protein, 93 aa, Homo sapiens
SEVGAARLIGEDRSQQAAEAGGRSRPANLEAACPRKGVEVQRRTQGQTYGKYYIRIEKVWKLQEDVEKTVKGTRHTLAHGVTRLVEGLGLPPH

SEQ ID NO: 937147 - protein, 138 aa, Homo sapiens
PIELKEGKSKIVSGEPRFPLSFQTGVNNNSCEPQDEMCNPSYLAPDASSDFFLGPAPRCHCQGNESPLHMTGPIRPPPSCVSYFSASAPTSAFAVGPSVQITCPPRGPSLRLPRSSQSQGWVSGHLWKKPWPTDHVCN

SEQ ID NO: 937148 - protein, 38 aa, Homo sapiens
PIGDKPSSIADRFYLGGPTVRGFSMHSIGPQSEGDYLG

SEQ ID NO: 937149 - protein, 63 aa, Homo sapiens
HRTSHPSQTVDGRMESMAVATDQAGGPSGRSVGFPASGGRRRKLLMNSYRINRIMGFHRPGSG

SEQ ID NO: 937150 - protein, 43 aa, Homo sapiens
QTELTSPGVCPAEAPSMLGSSDRCGDQQNPYGVTPASPSGHSQ

SEQ ID NO: 937151 - protein, 64 aa, Homo sapiens
QTGADQASITARDHIQLVKLQVEEVHQLSRKAETKLAEAQIEELRQKTQEERAESEQEAYLRED

SEQ ID NO: 937152 - protein, 93 aa, Homo sapiens
KRPLEKFDYRKLFLQGWQTEKVVLLALCGFPTRTLKVTTRKNAVRNGTNTWDTYELKIYKRLVSARRTELVKKITSFPIDAGVDVAITIPHDQ

SEQ ID NO: 937153 - protein, 153 aa, Homo sapiens
IRHQGDHEQMAYVKKDQAPAQETQRVLVKMTSRNAKAVENVMTELLLHARNEKVVLRGPVRLPDPARCKSPPKTPVNGTNTWDTYELKIYKRLVELRAADGACEEDYILSPIDAGVDVRHHNPTRPVSLPRMWKVGGRAATVSCHLGGKSLFS

SEQ ID NO: 937154 - protein, 47 aa, Homo sapiens
VETLSVPPALTNCTKHSNFRNARPVHGRPLEGVLRGQVGVGCLLQHE

SEQ ID NO: 937155 - protein, 84 aa, Homo sapiens
NFHYGSAEGKFGLYSPHTGGHDPPSRLIGPPTARTLSVEELALNTNPAHEISHGGYTLQSHRCTLLVEVSHEPLPLQVNSHLPT

SEQ ID NO: 937156 - protein, 232 aa, Homo sapiens
PPPLLPLLPLLLLQGASSGGGGARAEVLYRSPRCTPERLAACRPPPVAPPAAEAAEAGGPHAKRGDVREQGCGCSTVCARLEGEECSVYTPLLRQGLRCNAHPGTEQPQQAQVMGEATSEKRRDAEYGAKEQVADNGEDHTEGGLEENHVDSTMNMLGGGGSSGRKPLKYGMKELAVFREKVTEQHRQKGKGGKHQLGLEEPKKLRPPPARTSCQQELDQVLERIFTMRLPD

SEQ ID NO: 937157 - protein, 69 aa, Homo sapiens
HLMPTRYSDIPLDKTVNKDVFRDPALKRKAPTGGQGQVLKGRYKTGKNKWVLPETAGFRCFVLIIKNYK

SEQ ID NO: 937158 - protein, 110 aa, Homo sapiens
DALEGKHPAVPVDVVHRALREIHERADAVRRQFQAMAAEGVKYLEENAKKEGVNSTESGLQFRVINQGEGAIPARTDRRVHYTGKLIDGVFDSFLARGEPVEFPVNGVIP

SEQ ID NO: 937159 - protein, 123 aa, Homo sapiens
AWNRNTLFTQCNINLVGIEQFGGKTPQLVDGLLHLLPCYVSTIAQSLQPATTKTQVIARFFNCFGRNRRQLRITAFHQTGKERHMPCIDEILACNGVGKIAVWLFQPTIKFAGTGAIALLSPL

SEQ ID NO: 937160 - protein, 79 aa, Homo sapiens
GMKARNKDALPCFCANRSASIPFTASIVIPCGGANIASSDIAINILINEKSFSRNFSGHQIDGRFLHNFIQQMNELNAT

SEQ ID NO: 937161 - protein, 83 aa, Homo sapiens
VGYLEDIIMDDEFQLQRFMDKYYLEFEDTENKLIYTPIFDEYISLVENTLKKLLQRPEFNMAAFTTTLQHHGEVAGDIFRHAA

SEQ ID NO: 937162 - protein, 112 aa, Homo sapiens
AQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAV

SEQ ID NO: 937163 - protein, 86 aa, Homo sapiens
MTRPTIGETSEEKILVTSRRFNASITDEPVNSALVKPMPIIAPKVCELEAGKPKNHVPRFQIIAASSMEKTIARPWVDPIFSNKFG

SEQ ID NO: 937164 - protein, 130 aa, Homo sapiens
IRHGRGNCSARAGSEEPSVPLGSGPAAYHPEPASHCLLLLPMPAAAAAAGPGAGPSQAGTDENDWVRLPSKCEVCKYVAVELKSAFEETGKTKEVIGTGYGILDQKASGVKYTKSISDPPDQDDLSSFQL

SEQ ID NO: 937165 - protein, 50 aa, Homo sapiens
HRNTCKLEENSVVLMGQGNGDDTTEFSSSLQVFLPWTPSFCTWGLGLGFE

SEQ ID NO: 937166 - protein, 43 aa, Homo sapiens
MPGQTGPKGDRGFDGLGLPGEKGHRGDPGPSGPPGPGDDGERG

SEQ ID NO: 937167 - protein, 109 aa, Homo sapiens
SLAQAGVQWHVLSSLQPPPLGFKQFCCISLPSTWDYRHVPPRPANFVFLVETGFCHVGQAGLELLTSDDPSALDSHSAGITGVSHPCPGSFSTLLSFLILTSGTFIPGL

SEQ ID NO: 937168 - protein, 41 aa, Homo sapiens
CLDLLGIVGSSLHSTLTASQFQGSRLQQGVVDAVGEYSGSN

SEQ ID NO: 937169 - protein, 34 aa, Homo sapiens
FLESLLKKACQVTQSRNETMTTSHLKQCIELGAA

SEQ ID NO: 937170 - protein, 66 aa, Homo sapiens
RFTGKFHAGTDIMTDRTGIELEVRLVWLVRILLLTSLVFAVRDQVQLFTSLVGCVIFDPPIIAVIR

SEQ ID NO: 937171 - protein, 33 aa, Homo sapiens
SPLKVLCTPPLKMLGEAAGMGASPMPVCNPTVG

SEQ ID NO: 937172 - protein, 40 aa, Homo sapiens
VLEGDNLETPITLISMWPEHYDPSQSPQLFHDDTHSRIEQ

SEQ ID NO: 937173 - protein, 90 aa, Homo sapiens
KGGCGSYGCSQSSCCKPCCSSGCGSSCCQSSCCKPYCCQSSCCKPYCCQSSCCKPSCFSGCGSSCCQSSCYKPCCCQSSCCVPVCCQCKI

SEQ ID NO: 937174 - protein, 45 aa, Homo sapiens
CNPPNLALYLLGFLKKPVSTTNLQDPGVLGCPRTCLHINILEKGT

SEQ ID NO: 937175 - protein, 111 aa, Homo sapiens
HINTEHLLAFKVLTTMMSTLKGEGVPKPLRTIENHINIIPPSWPARPRLSPPPDSVTQIKPHSTVDFRVKAEDTVTVENVLKQNEQYKVLISNLEKCGGGSVLISRVRGTG

SEQ ID NO: 937176 - protein, 70 aa, Homo sapiens
LTLAVARFVWAGEGGEAWLGCLTGEAGAEVQPPSPTAESKTGLPVSSYFYWFPCSTMLRAKNQLFLSPHY

SEQ ID NO: 937177 - protein, 99 aa, Homo sapiens
LVHTGDVMIFPVLSCFTRFMAGLIFVLHSCFRFITFVCPTSDPLRTCAVLLCVGYQDLPNPVFRYLQSVNELLSTLLNSDSPQQVLQFVPNGRYSLRGP

SEQ ID NO: 937178 - protein, 68 aa, Homo sapiens
LVRRAAGVVFTALCLLLLEAQLLWPRYLQVLGDATAKTGPTGSLEMVRVPGPTSRRGRGWLELVGSKL

SEQ ID NO: 937179 - protein, 99 aa, Homo sapiens
MPIISALWEAEVGGSLEPSSSRPAQSNMAKPQLYKKYKKISLCWCMLVVPATREAEVGGSCEPGEVEATVSHDLTTALQPAGQQSETLLQKKKKKSCYE

SEQ ID NO: 937180 - protein, 113 aa, Homo sapiens
APDRFFRTPRWSPRCLAQLWKAPSVGLWFRPAARRPFFYPGLPTRGASGTVLNYVLGYTQESSLECGLLSPIYGGPFSSAVSYWFRHKARGVPTAEGGHSGGDEPRVLCRRLF

SEQ ID NO: 937181 - protein, 57 aa, Homo sapiens
YNSINATQFSCNISHLSSLIQLEEKQQQTTRELLKDIGDTLSRAERFRIPEPWFTPP

SEQ ID NO: 937182 - protein, 33 aa, Homo sapiens
LVPSGKMAIKSIASRLRGSRRFSGFVAGAVVGA

SEQ ID NO: 937183 - protein, 130 aa, Homo sapiens
AQVLAARGIRLGTVLRIRGLVPPNASRFHVNLLCGEEQGSAALHFNPRLDTSEVVFNSKEQGSGRPREPAAVPFQLRAAFEVLIIASDDGFKAVVWGRPVPPLSATACRWAPCLWKVGGDVAAGLREILL

SEQ ID NO: 937184 - protein, 53 aa, Homo sapiens
REPTMVLFPADKTNVKVWGKVGAHAGYGAELERMFLSFPTTKTYFPHDLSHGS

SEQ ID NO: 937185 - protein, 80 aa, Homo sapiens
QEALLLPVQAQDVQHVPFQDPCGEVKKAEHVARAEEKAREAESKARYIEVRLGGDLRDSRVMLRQVQNRAITLRRDADVK

SEQ ID NO: 937186 - protein, 101 aa, Homo sapiens
NRVSICHQAGVQWRDLGSPQPLPLGFKRFSCLLNACNIFRTVPFSLLKLMIFAPSLFLSLLSSWARWLTPIIPAVWEAEVGGSGGQEIETILANMVKIRLY

SEQ ID NO: 937187 - protein, 34 aa, Homo sapiens
MVRVLQEAAKLSSQVAAPFCVPTSNEWAFLWLHV

SEQ ID NO: 937188 - protein, 40 aa, Homo sapiens
MFLEGPLYENHFPQPVELPELASHGSQESAVPIPTDTICF

SEQ ID NO: 937189 - protein, 40 aa, Homo sapiens
GIAMKVLGALALFWIIFILGYLTGYYVTSEINARMHAGGR

SEQ ID NO: 937190 - protein, 48 aa, Homo sapiens
SFKVYCNFTAGGSTCVFPDKKSEGDKARTKEQPSTWYSQYKWGSLLSY

SEQ ID NO: 937191 - protein, 58 aa, Homo sapiens
MVLSPADKTNVKAWGKVGAHAGEYGAELERMFLSFPTTKTYFPDLSHGSSQVKGHGKK

SEQ ID NO: 937192 - protein, 56 aa, Homo sapiens
GNGSGGQGGCRRALREEKARGTQLPGALQVLVSSGRAIRASCTGSFSPDTFQVLDK

SEQ ID NO: 937193 - protein, 96 aa, Homo sapiens
SLKYNPVVIDFMQPIHVLRQQAAILEARQNLRRALDQYLMEFNACRCGPCFNNVPILEGQLQVQSRLGSLGAACEQTQTRSQSRWELELLELLVCM

SEQ ID NO: 937194 - protein, 268 aa, Homo sapiens
MAPEDPCLLPALYISWPQIALEPLCPCLAALQVPDPEPVPQLDICSRVHIRKSLDSPGHPHRGARRPTEAQWHAPKETPESPQVRASPPQDPQPQAPRTSPQAQAPQDPAGPETAPLGLELGPPMKHPEGPPGHPRFLAFHGHLTTPLWGVFRDLMGNPHFSRRHGGAPPFPQCTRLTRHPPPGGPPPATSPSPQVGPKVTPGPSFASRPSGWSSCGPRCLRGPDLYGGQCPDPESRLRRFPGADRRGLGAPSLPDPSPRLCFAPPFP

SEQ ID NO: 937195 - protein, 111 aa, Homo sapiens
LVPCFTYFYFIFFVEMRSLYVPQADLELLASSDPSCRWPSQSVGITGISPCLDCFTFYIYFYFIFFSVALAGVQWHDHGSQHPQPTVLKPSSCLSLLSSWDVRMYQHAQLI

SEQ ID NO: 937196 - protein, 53 aa, Homo sapiens
VDASLDKFLASVSTVLTSKYREGASVAMLLAPWASPPAPPPLPAPVPPWSLNK

SEQ ID NO: 937197 - protein, 67 aa, Homo sapiens
QGEVTSGFYSLLRRPRNCIGQAFASATMKVVLALMLLHFRFLPDHTEPLQKLELIMRAEALRLRVEP

SEQ ID NO: 937198 - protein, 74 aa, Homo sapiens
TIQGLGAASAQFVSRLLVLLSTAQEADPEVENIFGMGVLAEHGGHQEHFPKLGLLFPLYRREHNDRVRDKLLGQ

SEQ ID NO: 937199 - protein, 103 aa, Homo sapiens
YSFLLLSSSPWYGWTTVCLIPSEDLFKILVPMQWLTPVIPALGEVKAGGLLDPRNSRPYWATWQNPVSTQNTKISWAWWCTPVVPATWETEIRGWFEGRQRLQ

SEQ ID NO: 937200 - protein, 92 aa, Homo sapiens
SLPFALQCYRKEVTTILCQAIFLASLPEIRFMKEPVKQAKVSLNKQVELNIIIDGEETSKHKRTAGGAVGWTVGCGGFVYDEKPCTVFSRNT

SEQ ID NO: 937201 - protein, 38 aa, Homo sapiens
STTSPLTRSSSKSSLRQRKTQSCLKSSQKTLLGETVDL

SEQ ID NO: 937202 - protein, 44 aa, Homo sapiens
VRRVKTNVPVKLFRSTDVTTSSAKIKLKSSELQAIKLTQIKSNI

SEQ ID NO: 937203 - protein, 54 aa, Homo sapiens
MPDAQVIGPTKAINVCDANSYQTYSRCQMVLDKVFTLAIRRDDIIYSSSVLNRL

SEQ ID NO: 937204 - protein, 52 aa, Homo sapiens
YIHPTAKVAPSAVLGPNVSIGKGVTVGGRLRESIVLHGATLEHTCVLHSIVG

SEQ ID NO: 937205 - protein, 38 aa, Homo sapiens
PVLATVVTLRTIWMYMFADVYLLTTKVDIFGVYLYKTF

SEQ ID NO: 937206 - protein, 63 aa, Homo sapiens
MGIRRGFTVVYLGDNWYKINDYLAAKLLQVKGSSPTAVPFENVGTGGDTRWHISDPGGQRLGG

SEQ ID NO: 937207 - protein, 69 aa, Homo sapiens
KHVLLLEEEIEPLFNACAGMADPAGILLAHRRTMSEYRQVEAEIRNLNTLQKGEVIIATVTGLATGIRL

SEQ ID NO: 937208 - protein, 104 aa, Homo sapiens
GRIHGLVVSDDAAAHVRIDLSQAMAHLVAVVPDRDEVRLRAGQNVATAPRSIDTPLNSPVDHVTLAVRIALHDRDALSVTPATSGTTLPSRNGTHTSWKNFSWP

SEQ ID NO: 937209 - protein, 52 aa, Homo sapiens
AETGISVMAARSNGTVSPSAFLEPYSPAVWVMMVMCLTGVAITGLHVRVLQP

SEQ ID NO: 937210 - protein, 108 aa, Homo sapiens
KYHVMANHNSLPILKAGDEIDPSRERLRTVSLELFGAFPSHLLRNSSKETGKAQVLECSSSFTLMGYLYHVRKGKGAAELEKMTLKCHHCGKPYRSKAWTCISPEVRA

SEQ ID NO: 937211 - protein, 69 aa, Homo sapiens
LLPGPAGSLLFARCPKQPARSCTCSPTRSSQEELEHGGPSEQGTPIASLMKGWRKTPASKSHYICNLNS

SEQ ID NO: 937212 - protein, 34 aa, Homo sapiens
HTYLNMLEEAERDHRRLAKQLDLFHMQEEAAGMV

SEQ ID NO: 937213 - protein, 114 aa, Homo sapiens
FIIQSSLAKLPPSLISFNIHSFILQRPLVIDCLVLSPTIEVSFSFCLIAKNRNSLKLVCIKGGELKRCPRMSCHQATFPKSSSEWDPSSYHSPWTCLVQERVGGTVPSKGACLM

SEQ ID NO: 937214 - protein, 95 aa, Homo sapiens
KPVPWQSLTRDAQGRQGDRGSPTTSLRSSNYWMIIPKCFIVGARQCGLKQMQQIPMPFAGKVVLMRHHDAQGIRGHLENNPALENFLISGGMWAL

SEQ ID NO: 937215 - protein, 104 aa, Homo sapiens
IVSPCFVCCAYKGNLKSVSFYYKDTCTRMFIAALFTIAKTWNQPKYPQMIDRIKENVTHIHHGILCSHRKDEFIFLTGTMDEAGNHHPQQLTQGTGNQPACSHS

SEQ ID NO: 937216 - protein, 39 aa, Homo sapiens
MSQPCHMCILVSYGDDEAPSARTIQRVNTELMKAAVRGS

SEQ ID NO: 937217 - protein, 73 aa, Homo sapiens
MSDNEDNFDGDDFDDVEDEGLDDLENAEEEGQENVEILPLFETAANQKRISPYMTKYRARVAGTPSAPDCDVC

SEQ ID NO: 937218 - protein, 30 aa, Homo sapiens
MGQKKISAFCNNECQPFEHYHQSHSTPLDA

SEQ ID NO: 937219 - protein, 60 aa, Homo sapiens
PLRQRQPRCAQAGLQALGCSAGLVCSGATTAHGSLSHPDVSSGSHLSLPSSGSRIRPTCG

SEQ ID NO: 937220 - protein, 82 aa, Homo sapiens
YVHKHRYSGRTALQMSRDLSIQLPRPDQNVTRSRSKTYPKRIAQTQPAESNSISRTANMNGENDGTIKIIAPSPVKSFKAKG

SEQ ID NO: 937221 - protein, 38 aa, Homo sapiens
RRLRFELAAPGFALSLPKVMKRGDRTPMLLKRRLSACH

SEQ ID NO: 937222 - protein, 56 aa, Homo sapiens
MPNKTVLHHVYDSDNLSSSDDLVRYLIVTIQRIERELYGYLALSTVVETLRRDIGR

SEQ ID NO: 937223 - protein, 37 aa, Homo sapiens
MYPNDGHWYTKLWTPLLQSLIGLFEVTQKMITIPDED

SEQ ID NO: 937224 - protein, 87 aa, Homo sapiens
TDQEQPGRQQAGSPTLTPGKLAQNRPSVITCASAGARNCNLSHCPIAHACTQGLPATGATEAATTCDPVVEEHFRRAWEELQGARAG

SEQ ID NO: 937225 - protein, 57 aa, Homo sapiens
PPLSLLEEEAGGGQDMPEAELLLMVAGEVKSALGLELSNSSLGPWPRRGPRWREQLA

SEQ ID NO: 937226 - protein, 56 aa, Homo sapiens
MDDTLFQLKFTAEELEKLAKKAEKDSKAEAKVKKALQKNVECARVYAENAIRKKNE

SEQ ID NO: 937227 - protein, 102 aa, Homo sapiens
KTEFYSPPGWSASGAILSSLQCLPGSPAVSQVAGIIMHHHAWLFVFLVMGFRRVGQAGLELLTLSPLASASQSLSLLQCWDYRHETLWPGMIFSHSFLLRVN

SEQ ID NO: 937228 - protein, 66 aa, Homo sapiens
LHNSQNWKGSGPWLATAASAMEKKGKGLGAVAHACKPRCEFETSLANMKPRPYKYRTLAKCGGACL

SEQ ID NO: 937229 - protein, 36 aa, Homo sapiens
FSGTQIQVTHIDITVDYCRNYGVAYDIGDLELTVLP

SEQ ID NO: 937230 - protein, 36 aa, Homo sapiens
RWEVEEDWCLVLRSYQAEHGPDFPWSVGEDMSDGRR

SEQ ID NO: 937231 - protein, 75 aa, Homo sapiens
VDKIKNKTHASKLLGNPAECVEVFGIPFLHLKVNWIQQFRCMLVPLVPNSAGAALIAVGVRLRKAKQLRVRDPQT

SEQ ID NO: 937232 - protein, 55 aa, Homo sapiens
RWSRVGPQNPRVALPPTLAMFLTRSEYDRGVNTFSPEEDYFKWNMPRSSLVLQPL

SEQ ID NO: 937233 - protein, 79 aa, Homo sapiens
SPTSAAPDQIDRFVQIVDEPTHGERLWETVPGFGLTGTMLACYLVKERGLAAGHEIRRLRPGSIETYEQEKAVFQFYQR

SEQ ID NO: 937234 - protein, 88 aa, Homo sapiens
IHTRLFFFLFLSWMYWLLPTWPDPVKRVACHGCELRRAGDADQAVMENDVSWTQGVSTCTLKLHSETVVHAAANCEPLNVITQLPSIS

SEQ ID NO: 937235 - protein, 54 aa, Homo sapiens
QGTGLPMASWLPSGLIAALPGHTPWRSLRRDEASEACTVASASGVPLLGGPLRP

SEQ ID NO: 937236 - protein, 46 aa, Homo sapiens
PKPGGGACAGIPGVGPFGPQPGVPLGYPIKAPKLPGGYGLPYTTGK

SEQ ID NO: 937237 - protein, 66 aa, Homo sapiens
EVLKSCVSNKFSGDAHAAGLQDNNSEDFFQESLMKYQNLKNQPKEDVTEEVLSPENCPFGAAEHPV

SEQ ID NO: 937238 - protein, 98 aa, Homo sapiens
RFYEKRKLASMAGEPLSRQPDLGGVGQARAVAQESARLPLASPLLSRVYIASGIEAADVFAGILNLGNNSFRLELQALGEELVDIAVGLMGDEHLDVV

SEQ ID NO: 937239 - protein, 47 aa, Homo sapiens
VLGVHGTWYVFLAQLGQSRGSLSRMTQLQALHPDPGFQGPWRLHRFL

SEQ ID NO: 937240 - protein, 112 aa, Homo sapiens
FVVVVTDRVRFRLPGWSAVAPSRLTATCGLLDSSGSPASAFRVAGMTGTHQYAWVIFVFLSTYRISPCWPGWFQTPGLRWSACLSLPRCWYRCEPLGPACTFYQQQQQAEGF

SEQ ID NO: 937241 - protein, 70 aa, Homo sapiens
GRSTLSPGLESSDAISVRFTATSASRIQAIPQPPEYAGNTGARHYARLIFVSLVDTGFHYVGQGLELLTS

SEQ ID NO: 937242 - protein, 37 aa, Homo sapiens
NCGGPQRDNLEAEAVAPCTLAARTEKKKYIGGFRSPS

SEQ ID NO: 937243 - protein, 50 aa, Homo sapiens
MGIIWVLDRPLLSQATREAEGEAVNPGGGGCSEPRSRHCTPALGDTVRLY

SEQ ID NO: 937244 - protein, 110 aa, Homo sapiens
ALRESHDQVADVVDRAALIFLGANEHVDLAVAEAVARRHRTLDLVDDLVGHLLRGQAAGGAILETDLDFRITALDGRLHVGNRRSVHQARQLLAGLFERREIVAAQDLER

SEQ ID NO: 937245 - protein, 120 aa, Homo sapiens
QAKERFGAVSFPESAAVTRSPATRRSRSAEGGIGALRDGEALLRTPASVGRGDGAKAMGSAVLTTAGAWFLAFLLSRVNGGDDGADLFGTVDESEVEREERQLTVFFWVMFVMKPAFQLL

SEQ ID NO: 937246 - protein, 45 aa, Homo sapiens
RSSAGLDKVIVLWTANTERFCEVIPGLNDTAENLLRTIGASGGFA

SEQ ID NO: 937247 - protein, 102 aa, Homo sapiens
PVESFTVSPRLFSGAISAHCKLCLLGSSDSRASASRIAGIGMHHHTWLIFVFLIEMGFILARLISNWPQVYLPPSASQSLGQTSHRTRPSFLPFKVRDVGLY

SEQ ID NO: 937248 - protein, 87 aa, Homo sapiens
ATAAIVGKNGQGEPCPGSVARTLLGEAQPVTAALRSWRAGEDHPDQGGGPWSLINGYIEDQVWERRTLSLWPHSSAEPPRVPPGAGG

SEQ ID NO: 937249 - protein, 37 aa, Homo sapiens
MTYIPHQQSNPPRLTSYNAMHAISGRGMIDRLKRTHS

SEQ ID NO: 937250 - protein, 36 aa, Homo sapiens
GTSGTSQDTLSRYAGRLPQTTAISIRGGHQENSAPH

SEQ ID NO: 937251 - protein, 43 aa, Homo sapiens
PPLSSLTTHTPFTSFARSQWISRRVVSECHRVDEWKLCGGEMV

SEQ ID NO: 937252 - protein, 38 aa, Homo sapiens
LRLAKFGDYGSIDYGRTTCSIHIGAWTDVCQNSLLLPW

SEQ ID NO: 937253 - protein, 54 aa, Homo sapiens
DEEQKPQQRPDLAVDVLERTADKATVNGLPKDRETDNSALAAGSQEVTYAQLDH

SEQ ID NO: 937254 - protein, 42 aa, Homo sapiens
DKSSGKHYGQFTEGCKSFFKRVRRNLTYTCRANRCPIDHHRN

SEQ ID NO: 937255 - protein, 35 aa, Homo sapiens
MAFPPYSSSFRKRDNASGASVAIDNKIEQAMDLVK

SEQ ID NO: 937256 - protein, 135 aa, Homo sapiens
IPGGGFTKHASVFWGKLFHDMGRWHLSVSSTLWCWNLSTRMGEASQELGNVSFALFVGKQKSCVRLAFYEGIQFSNHEKAVQFSAHWAIRVNETWLWSLVSSHQILFAHLFIVHFTSISDTLSLCQVYALKVITA

SEQ ID NO: 937257 - protein, 101 aa, Homo sapiens
FLNIHRNQTATSAEHFTGKKNSPHEGKLIWWKDNKNKTWEIGKVITWGRGFACSPGENQLPVWIPTRHLKFYNEPIRDANENASAETENPQSSIIDFCRVN

SEQ ID NO: 937258 - protein, 31 aa, Homo sapiens
NAMEDQSPRPGHPRWLYLCQEDDEGSSSHNL

SEQ ID NO: 937259 - protein, 108 aa, Homo sapiens
LLKDLATQHLKCWLNLHPKETYNQRPCSHHSQGAHHQLPRSLHLPHPKSPHPPSSLHPPPPRSLHPPPPSLHPPLPRSLHPPLPRSLHPPPPSLHPTPKEPAPTEPYA

SEQ ID NO: 937260 - protein, 33 aa, Homo sapiens
RDELTEIFKKIRRKREFRAARAVISLMEMGFDE

SEQ ID NO: 937261 - protein, 85 aa, Homo sapiens
TPQHQQQLFLKQQQQQQPPPAQQQPAGQFYQQQQAQSLSKYSRHYSPDEPSPEAQPIAAYKIVSQTNKQSIAGSVSITSLFLQGL

SEQ ID NO: 937262 - protein, 57 aa, Homo sapiens
VFVKVQRSKASEKVEPGTEESRGPCHRVWLVLRAKHRLGAISSPGQAQAAFCSCQRI

SEQ ID NO: 937263 - protein, 47 aa, Homo sapiens
EALKKANITFYMFEVPIVIKISHLINVLMWLEKKSAVAAKHDLLSLA

SEQ ID NO: 937264 - protein, 82 aa, Homo sapiens
NSTRRGHTPFNRSHGANSEDLVRTEPSRPQQCCVGDQVSDGELGDTSTPQHVPIVFLVAGVFEDGACMRFPAFFVEEVTCGY

SEQ ID NO: 937265 - protein, 40 aa, Homo sapiens
NEANTGQVCMLARGPRFRFTTPDPCFPSFRGPPEAGLTRR

SEQ ID NO: 937266 - protein, 39 aa, Homo sapiens
ALGLRHLVVVDNRNQVVGLVTWKSSYFGYIRLNKISRLG

SEQ ID NO: 937267 - protein, 50 aa, Homo sapiens
SGPPRSGRLRAPPRGRILGGREAEAQRRPYMASVQHVLLPVLDRATCNRR

SEQ ID NO: 937268 - protein, 46 aa, Homo sapiens
LCRRLSETRTRGSLNIIIVAEGAIKGKPITSEDIKNLVVKRLYDTR

SEQ ID NO: 937269 - protein, 77 aa, Homo sapiens
MIVATLSNVNRPEDSPSNHLLDRLYPIVDILDDMTLTCHTKVLIALFTYHVDLPIPADNLNLRTSPKLPHYSSLDTR

SEQ ID NO: 937270 - protein, 72 aa, Homo sapiens
ARVQTSTSLWPVRNRAAQDEVREHDCPSSTHFQISLGIRFPEEREPYCELRTWIWIALCFCEVGWQSLKTPA

SEQ ID NO: 937271 - protein, 48 aa, Homo sapiens
GTGSRETMENLGLAQNCTISIQDYVFRCEDSLVEKIKGVELRKSLLSA

SEQ ID NO: 937272 - protein, 41 aa, Homo sapiens
VSSGRGSIAHPSLRYNRMWTLQKQLAAWCSLVLSFRLKQSS

SEQ ID NO: 937273 - protein, 55 aa, Homo sapiens
LLLIARKKLLHNSEDEQRLKSEIEEEELKDENPHHYQCPVLTLPRAMLMIVKQRL

SEQ ID NO: 937274 - protein, 96 aa, Homo sapiens
PESCVHQLLLNTSKLCFYLRGPTSLGNLNTWNKNLLDGPFGIMNWTNCRFQDYRASNASMNNLTQLLCSGNEVTDGQPRQPLRRLRPPLWSIPEAD

SEQ ID NO: 937275 - protein, 56 aa, Homo sapiens
MNLFPHRQPNCYYGNRGRPDSSHRGITSNPRNKDRTRDEERRGPVPVSLRRRLRST

SEQ ID NO: 937276 - protein, 310 aa, Homo sapiens
VLYLVVLLSLLFLLFSVACRAFSGLVCVGVFCLFCCSVVCRVRWFLFVSVVFFALSGVGSCVVSVLSPLCVSASLLFFFFLRVLFFVFSPFLFSLSSLVFFLFSVYFRFFLVCVVVLLVVSLLHVCCPLVVVSSHMCHVLMALLLVFVIILCCISLGVDLAVAFCLSLLSVVSLLLVFRCSFLALSRSVLSIFYAMLVVCVIAILCLLDLVCVCYNSFYRPWSVSSVSELSDHLWVSSSWVLVIPRLPLNALFACIVYLLVTSQPWLSCSQLRGQLHKGTMVSWVITLWSQSSVLSPSSFSHLSPPAKVH

SEQ ID NO: 937277 - protein, 46 aa, Homo sapiens
SDADLDMSFDYRPSHYTHRASLVRNPLDAEPTMSTPLAKAFPDSLH

SEQ ID NO: 937278 - protein, 75 aa, Homo sapiens
FSLQSRNTLAYSGDWKCLEALGDKGLAGIMDEATLSGPAPRCSTFLSRSLSSIPSPCDFSRKISRIVFKPQGQAE

SEQ ID NO: 937279 - protein, 36 aa, Homo sapiens
IRAESGKGENQLRIGEDSREALLSFWGELGEEAANE

SEQ ID NO: 937280 - protein, 96 aa, Homo sapiens
SPHVCVQQLATALILLEALKIANYAQLTLYIPNFQNLFFSSYLTILSAPGSFSYTHSLLSPTITVVPGPDFNLASHIIDTTTDPHDCISLIHLIFN

SEQ ID NO: 937281 - protein, 81 aa, Homo sapiens
FFFEKTITFRSLGNATEVSANRIGFYLHASIPAKGVHLDRALQGEFVYQPNLGGSIVLTGEGMHELAGLDSMVIAALMHES

SEQ ID NO: 937282 - protein, 128 aa, Homo sapiens
TESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSENLIHVHITGIVVNKAKGGI

SEQ ID NO: 937283 - protein, 52 aa, Homo sapiens
AAVKLESENEYERARRLLAKALSAPTARVFMKSVKLEVQDNIRAAQDLCEEA

SEQ ID NO: 937284 - protein, 42 aa, Homo sapiens
HISQLHDELLVLQIMLAGFNQSQWLESLEHSHVVEEDLWTGK

SEQ ID NO: 937285 - protein, 31 aa, Homo sapiens
PDQEQDAITRNEKAGDIALLYIQAIERTILR

SEQ ID NO: 937286 - protein, 105 aa, Homo sapiens
RQGLTLSPRLERSGGITAHCSLNFPGSSSPPILASLVAGSTGVHHHAWLIFLFFVEDEVLPLLPRLVSQGDPPILASQSAAIIGMSHHAQPTMDINSSLVILISL

SEQ ID NO: 937287 - protein, 51 aa, Homo sapiens
SNQTSIQDEQPSNSFQGQAAQGVWNDDSMLGPSQNFKAESIQDNHMAEGTG

SEQ ID NO: 937288 - protein, 30 aa, Homo sapiens
MLGDVLLIVLVDIFGVTVTLIAEAVTFLTL

SEQ ID NO: 937289 - protein, 30 aa, Homo sapiens
RTIWEPCIKQLKIDWQAQAQRQVISAEAEA

SEQ ID NO: 937290 - protein, 47 aa, Homo sapiens
ASVRDRITPGRPCTLVLVRQETAPWWVLSESVAAANSADIDLQESSP

SEQ ID NO: 937291 - protein, 34 aa, Homo sapiens
MFRDQTLAVNPSSLCFGMEAAWFPRAQATPYHCH

SEQ ID NO: 937292 - protein, 94 aa, Homo sapiens
GFLIMVYTPPHWVSVLEARVRGGGGWFTQISTRGRQCTIGKEEYRLFRSLSEDELAQIAIEQSSEDKKKGPTTTDANPSFIFQPDNPPNSYPRS

SEQ ID NO: 937293 - protein, 54 aa, Homo sapiens
EVVDGCVQYTLRVYGDAAKGAPGEGPVEAGGPGTEWLRFGYARDGARDRPGDRG

SEQ ID NO: 937294 - protein, 78 aa, Homo sapiens
MIPKKVKTYSKKLCPREMSFASPISPALVSKRNQVYFNSFPELEFIYHKIHPFKVYLVFFSIHGIVKPPQSILEHFYH

SEQ ID NO: 937295 - protein, 72 aa, Homo sapiens
GLILGLRLRGQRNCDQFLYNQYAGHEDKKALSSQYQIIQRDDKTIFMQNVQPLNQTFINIQWLTLGDFQNKV

SEQ ID NO: 937296 - protein, 135 aa, Homo sapiens
WLSEAEACVSRALGLVSGQEAGPDRVAGLQMTLAELRDFLGQMNNLPCAMHQIGDVKGILEQVEAYQTEAREALVSQPSSPGLLQSLLERGQQLGVGGDLKPSSSKGRLEQAPVAAEVKRTLGPSAQGVPLAING

SEQ ID NO: 937297 - protein, 81 aa, Homo sapiens
SNCTVMKNTMTVGTDWDYRPCFLLRCQQLYPPMIWTINTNGHRRDMGQNASDIVYGDGQDLLEILTRPRTSPSGSPASHID

SEQ ID NO: 937298 - protein, 74 aa, Homo sapiens
PTQHMYQIVPGKTTKHSYIVAEIKFYYQIRIEENQGLHSNLEDIPVVGVDEHDDLDERLLHSHADCVHSHGSLL

SEQ ID NO: 937299 - protein, 96 aa, Homo sapiens
KDTQDHVDSPPPPVDNARPVFPCYQGQDVTVSGYTCCVHSMVLLDALFRVRRVVLAQGVTGRNWSQVLAVSAPLSDSLGRCVDVTRRGTLVREVSP

SEQ ID NO: 937300 - protein, 80 aa, Homo sapiens
MADGTILLTTTSGPSWPGGTSEESREADLTGACFGVPIPVLLLNEVFFFPLLGLIPKLSIKLGRLPFRLIPPKRLANLTI

SEQ ID NO: 937301 - protein, 66 aa, Homo sapiens
MVIDVLHPGKTVPKAEIRKLAKMYKTDVIFVFGFRTHFGGGKATGFGMIYDSLGYAKKNDPKHRLA

SEQ ID NO: 937302 - protein, 48 aa, Homo sapiens
KDYLLNMENQKFLSTKAKVSDLLSLNLELWLKLPKPNLDDTPMGRQLR

SEQ ID NO: 937303 - protein, 68 aa, Homo sapiens
MILAHCNLHLGSSDSCVSVSRVAGTTDMHHHQLTLPFLVEAGLRHVGQAGLKLLCRIRQEFMDTSRVQ

SEQ ID NO: 937304 - protein, 29 aa, Homo sapiens
KASSKPATSGPSSAVVPNTSSKKNITSKT

SEQ ID NO: 937305 - protein, 126 aa, Homo sapiens
PRQPKHLTRSRLVSSQHQIPGGHFIQANITESSQQEIQHIVTRHGPAADRHLLRCLFSACGFQRRWYTQRQRFPSDSASDPASVPLLIYKAKLSISTAVPTAIDYSHCNYPAEFYSPAPPTLFCPR

SEQ ID NO: 937306 - protein, 41 aa, Homo sapiens
LWSVNRYGQNGDFTRALKTVNKILQINKDDVTALCKVVCIQ

SEQ ID NO: 937307 - protein, 86 aa, Homo sapiens
VSTKRLNTQRSMCFQATRSSGAMITMHRGIETGYEWYTRASLQSLGRVEVTVRVDSMMSHSGLLPAARRSGRSLSLMLTLDQRIGF

SEQ ID NO: 937308 - protein, 109 aa, Homo sapiens
FIWVNGLSKAVSSHSMHRPGFGSHFEYGTLYCPSHLHNITPPPQPFRWPHSWTGWGGLASLLKRDVKAVEVGWNNLCLQSPLVGENRLRLPSSQLFVSRRGPTLVGFLV

SEQ ID NO: 937309 - protein, 51 aa, Homo sapiens
WDTMVSNEDELNLLVIVVNANPIWWGKQALKESKFTLSKCIDAVMVLGNCI

SEQ ID NO: 937310 - protein, 132 aa, Homo sapiens
RCAQTPGISQNIKRKQQDTPGCPDHRDASSIGSVGLGGFCTDSESSASLDPCLVSPEVTEPRKDPQGDRGAEGSLVPDHHPSQEERNPPSSIPFVELSPEVLVGKVQQRYLKIGPQDQVFPVGEPAPFSPGE

SEQ ID NO: 937311 - protein, 86 aa, Homo sapiens
QASSHDVLSTETYQALAAFRLEHRTPILRVLATVFTVSLPHEWTPPLKSLRRRHGDRSVFPPQAYTAAKERDDPGFYVTFAPLFGR

SEQ ID NO: 937312 - protein, 102 aa, Homo sapiens
KSHLACQDVEKENIGLRNVFLNMKLDSHCREMERGASPRPRNKVGHSRFSHLFLRVFRDNPHSKYHHFRKSAIYNTATIPCHSRQRCSRFMFCSNDFFNPWE

SEQ ID NO: 937313 - protein, 75 aa, Homo sapiens
SESKIQGATFDENQAQNFPATLDEAQEEGQVEAVMDAALRPKRSLWRKMVMGGLALFGALSGRVYSGTNWANPGL

SEQ ID NO: 937314 - protein, 69 aa, Homo sapiens
ETRSLADTGGGEESAELIRNAEMRFSLVTLLSEEAPPRLGRSINNGSPTILGKRIRAAQRGRRLMKSAS

SEQ ID NO: 937315 - protein, 59 aa, Homo sapiens
HLTKKATRPEELLDQLAGSNDFASNQASMVLIRFSNFLSVKPLVKGFPYSISSLINFSV

SEQ ID NO: 937316 - protein, 80 aa, Homo sapiens
SERRNPPSYAMAGKKVLIVYAHQPKSFNGSLKNVADLSRQGTVTVSDLYAMNFEPRATDKDTGTLSIPEFNYGVETHEAY

SEQ ID NO: 937317 - protein, 69 aa, Homo sapiens
GSPTPSKVRLDSWVPAPVKRRRMNWIDAPEYVFYMATEETRIDCKLLSSSETQGVLPPGEDFPLSRTLA

SEQ ID NO: 937318 - protein, 85 aa, Homo sapiens
QQEDHLERFRGQEVNFKTIIKKFLTREVERARLGITIVGPASGSGEAPGPTKGGTCVQDACEIYPQLSLQGSQLLMWYHCISVAH

SEQ ID NO: 937319 - protein, 51 aa, Homo sapiens
MDPASWPNSRSAPWLLTLHCGKSEASGPHPQRSNPAICPCSLLRCPHLRGL

SEQ ID NO: 937320 - protein, 58 aa, Homo sapiens
SPGARPYSPRPFPLVSSVHPGCTAVMAREAPALWPVSSNGSEGIAREEHLNPMGLDLG

SEQ ID NO: 937321 - protein, 488 aa, Homo sapiens
PTFVSLFCACTSRSDCRRTLHSIRFLALCFVVLFLPPRPSCFSCVVAASVVLPLVSSLWGVLLIVKVRSLPTIIVCGDGICVAPHHPREGVRARLHIYDIPPLFVDPHLCGAVTTLLWGVVVTQTLSWVTVSPAPPLTWGGRTFAWTPFFVVCSPGGCSSLRSPLPFIWCSPPSDIPPGGGANTTFAASPYVQTPRLVSGEFEYFGELLDSGSSPRGCCSAVVVFVVTSGLSPLTVSVLPRGMDSPRPRRAIVFEMPFLRGKPPPQPCLVFGTPSGLSFYLLGRVAMLGAPCASPLSASPRAPFFCSSFAGPPLWRNTSVAGPLFSSGLESAPICDYIREETLGGSRAPHTLSVLCSLSSLAVCALVATPLAPLSPQPRHRPPRPLHALEVSPTLSRPYTPRHRGDNAASPLAETHCGEEKKERHRRRRIHLFLRGNCPQRRVCLVFIRLSPRLHFFGWEHRQTDRGPTPRRPPGRRRGLFAREGPAL

SEQ ID NO: 937322 - protein, 34 aa, Homo sapiens
WGWSGNGDPPPQPWTRDSASPRKPSVPWQRQMDQ

SEQ ID NO: 937323 - protein, 57 aa, Homo sapiens
PDPPQLAVWAALGQSFGPLLCIAGAGNFPSPSGAAFAQRTSMTLMGLFVQDKVIFCL

SEQ ID NO: 937324 - protein, 73 aa, Homo sapiens
KTCDRFPKFLIVGPQKTGTTAIFFLSLHPAVTSSFSPSTFKEIHFFNSPNYHKGIWYMDFFPVPSNASTDFLF

SEQ ID NO: 937325 - protein, 73 aa, Homo sapiens
LYRAKVAYCLASQIVLHADTIRFPYHGSTLMGPATPERKHSDSHYTVTFSTSPAPQLTYVADEMYEFLAVRPV

SEQ ID NO: 937326 - protein, 90 aa, Homo sapiens
EWTDGDGALSEAEAQALLSGDTQTDASYDRFWAAIRDKYRSEALPTDLPTPSAPDLTEPKEEQPPVPSPTEEEEEEEEEEEEVEEEEEEG

SEQ ID NO: 937327 - protein, 119 aa, Homo sapiens
MTRMLSVATVFNIVLEVLARAIRQEKEIKGLHIGKEEVKLSLFADDMILYVEKPERLHKKMIRADKFSTVAVYEINIQKSVAFLCANSKQYEKNEKTNPIYSSHTWKFKYLGKLTKEGY

SEQ ID NO: 937328 - protein, 43 aa, Homo sapiens
AVFGAIISYFEQFFETFGIANQQYVSGDGSEASLHGVVDELVR

SEQ ID NO: 937329 - protein, 173 aa, Homo sapiens
LCGNLPPSLIRSSPLGGAFVSFPQLFLLRRQVQDPGSPAAPEVSACRFSSPPPSRSLAAPFAPLRAPVLFGPTPGASLYFRSSRGSFSTLCGFSLDRLRSWVLVFFVTSAPELLSALLCLLTLASMRAHVVFVLAPPPPRRLFSCFACVRQQRRRRPSPLFFFPDACSPYSQK

SEQ ID NO: 937330 - protein, 306 aa, Homo sapiens
LLCASGGPESGTWPCATLRRQLCWAGGGLLSHPRPCQQPCPPAPAPSRPRSLGSLGQRVPAALATAAQELPATLGGDGGKPALTAGEAALPGLHRLESLLLLRGADRVLQAHIEYIESYTSCMVVQAFQKAAKRRSEYWRGQRKALRQLLSGVSSEGSVGASLGQALHQPLAHHVQQYVLLLLSLGDTIGEHHPTRELVVNAVTLFGNLQSFMKQELDQAVATQALWHTLRGRLRDVLCTPAHRLLQDSQDVPVTVAPLRAERVLLFDDALVLLQGHNVHTFDLKLVWVDLGRTGARSPLTPEKSL

SEQ ID NO: 937331 - protein, 59 aa, Homo sapiens
KDCQGIIEDVILLGAPEGEAKHWEPFRKVVSGRIINGYCRGDWLLSFVYRTSSVQHVAG

SEQ ID NO: 937332 - protein, 103 aa, Homo sapiens
ARALDGASPLCGVELPCGVEPAGAQKSRFEVLEPPPRFKMYGNWLPRQKFAARGLSWRTSARAVQKGNLGSVPPHRVPTGALSSRPRVDPLTACTVLEKATDN

SEQ ID NO: 937333 - protein, 73 aa, Homo sapiens
GVKAAGFGNVYTPLLRPQAARAAAGSLCRHAGAGVSLSLMVPSASHGQLTALSKGAASGLGSGWRGGPGRRRL

SEQ ID NO: 937334 - protein, 117 aa, Homo sapiens
MLLQYVNDLLLGHPTAIGCAKGTDALLCHLEDCEYKVSKKKAQICRQQVRYLGFTIRQGERSLGSERKQVICNLPEPKTRRQVREFLGAVLRVLQVMDPKFAVLATLYSYRGDMTSM

SEQ ID NO: 937335 - protein, 63 aa, Homo sapiens
LIYLDSYAPRAEAEKTIYPLDLLLKLHDERFLVAFGQRDGIQGHAVLAINGMDVNGRYTADGK

SEQ ID NO: 937336 - protein, 61 aa, Homo sapiens
QSLREVGNAILFCLLIEQALQEEVDLLHAAPFQNIPRVYIKKGERLEVRMKRLEAKYAPVP

SEQ ID NO: 937337 - protein, 104 aa, Homo sapiens
SSHHDSWTSHYNSLPNQPTFQNPTPGPLLQDSQIYSPCSDILQFPTNHGTPKPLRAMHTAAEKDPVQCPQPLASVNMAKLRLRRVGSWPKVLKPETARAWGLKP

SEQ ID NO: 937338 - protein, 98 aa, Homo sapiens
ERGMLACGQDPELVRNICRWVRQAVQIPFFAKLTPNVTDIVSIARAAKEGGANGVTATNTVSGLMGLKSDGTPWPAVGIAKRTTYGGVSGDSNQTYCF

SEQ ID NO: 937339 - protein, 36 aa, Homo sapiens
GERFPYPSFHWDPIRDPLRDPYQELDIHQRPVGRDF

SEQ ID NO: 937340 - protein, 42 aa, Homo sapiens
EVTVGNFFNEGLNQPTVDSCFDPYTSHYVGDEWERFDSGFKL

SEQ ID NO: 937341 - protein, 67 aa, Homo sapiens
QESEVMSRAGGWKAGGQRMDAKRDQLRTSQWSHSVSPAPRFSESDDCREDADGTTGQNGLHWSWGVI

SEQ ID NO: 937342 - protein, 66 aa, Homo sapiens
LTLWESSPTIPIVGIIAGLVLFGAVITGAVVAAVNVEEEELRYKEVGRPPHPHVHHDPPTLTCAPS

SEQ ID NO: 937343 - protein, 55 aa, Homo sapiens
CILRASAEATENTASPEKNACCGQARWLTPVIPALWEAEAGGSPGQEIETILANT

SEQ ID NO: 937344 - protein, 102 aa, Homo sapiens
MLADELGHLEIGAVDQRSPTWGARCQPLFLEDPRIGGPLDQCEAEPVAIGDLEEERRAAALELPMGDDGNAVPKQVRLIHVVGGQKDLCGLAVYFRMKVPAC

SEQ ID NO: 937345 - protein, 112 aa, Homo sapiens
GFHFCGGSLISDWVVTAAHCGVRTSDVVVAGEFQGSEENIQVLKIAKVFKNPKFSILTVNNDITLLKLATARFSQTVSAVCLPSADDDFPGTLCATTGLGKTKYNGNKTPDK

SEQ ID NO: 937346 - protein, 87 aa, Homo sapiens
LPCSCYRIAALSVWKIKSSNSVTSSIDNYHLSKPVDLLGLVLGDIISIPKYVVPPCFMQQLITRRRIDQNQACFIDAQNNLCSGLRY

SEQ ID NO: 937347 - protein, 47 aa, Homo sapiens
PINSKELFVHPLWNRSFVACGNIALIKLSRSAQLEEMPSSSPSLPLV

SEQ ID NO: 937348 - protein, 263 aa, Homo sapiens
TAAVVGGGRRSVAAPPCPAMGLLSAPVRRPTHARLVLRLNPPLCVLNYVAGIAWIYALVFPPLTQRTYMLENAMDSIMVEEQYAARDRTRTFTRDFTAHRKKWGALPVAWFERTKRSVGLEVYTQSFSRKLPFPEETHEHQMVSGTNVYGILLAPPAASPSRLYLTVPCGSDSTNSQAVGLLLALAAHFRGQIYWAKEIVFLVTKQELLGTEAWIEAYHDVNVTGMQIVSLQGRAGAIKAAVALELSSDVVPASDVAVEGLNG

SEQ ID NO: 937349 - protein, 203 aa, Homo sapiens
MGSTMVEEQFAGGDRARAFARALRRPTARGRGLCQWRWLERAMRSVGLGVFTLFFRLPFPDETHERYMSVGQQRVRHPAGSACCQPESLVLTVPCGSDSSNSQAVGLLLALAAHFRGQIYWAKDIVFLVTEHDLLGTEAWLEAYHDVNVTGMQSSPLQGRAGAIQAAVALELSSDVVNSLDVAVEGLNGQLPNFDCSISSRPS

SEQ ID NO: 937350 - protein, 79 aa, Homo sapiens
VAEAEEKEERAVEASPPRYCYNQNLVEKGFTCWGPLDKKRCGGILDLLTELDLFGKFSNLNIEIASILIINVYIFAYYK

SEQ ID NO: 937351 - protein, 264 aa, Homo sapiens
FQPGQADFTSRRAHSRKAASWGRGPGTAVGRAGRRMFGAPAHPGLELPGSAASPRPVTVAPPAAPATGTGCQGAWLPGWSAPAGQHRGSGAHEAWQAQSGHHGGGQQEAQGEVGEGDAAQLQCQVDQGYQLQCHPAPVWGLCAYHPVGIVGQGQASCINRQLCEHHSLSICHWEVLGGNVLAQHWQDIEGTVPWPVRAAEVPRARPAPHPVMGEGVHWGQGHPGLLKAHSSLMQLHPQFQSLETKDQEQEADSGHVEADGEEAG

SEQ ID NO: 937352 - protein, 288 aa, Homo sapiens
MRLVRFCVSGVRCVVKVSVELGGNSSFHGALGNWASLEGRSGGFHLGPPCGVHPLFRATINQGVWAMCPRFWWATSCWICSPGPMGNWAPLIVLLQQCLGPKQTVANLQQLSHGVHRGLEAWWGPEHLLAEFNATLGLAPGPTKISPPRVVEKATHRGPTTTGAWIGHTEDWVAPWILTSRAPGNAGGWHYAPSHPNFLHLGLSLPGATPHTQGGPTHGWRAWQKASNGGPGDPRYMAGPRRGAETTPRTEHNGSTWHSLVPRGGRAAQEGATCAHWPRGWQAFPGTR

SEQ ID NO: 937353 - protein, 32 aa, Homo sapiens
ILTFLAAALAPFNDDDKIVGGYNKENFPYQVS

SEQ ID NO: 937354 - protein, 32 aa, Homo sapiens
VTVALASPHGGEHFKGEKVFRVNVEDENINII

SEQ ID NO: 937355 - protein, 78 aa, Homo sapiens
ASVTQVTGTTGMHHTRLVFVFVETKFHHVGQAGLELLSSGSTPTFASQHVGITGMSHTWSSVQITPKLNFGLGAMAHT

SEQ ID NO: 937356 - protein, 39 aa, Homo sapiens
MLLLLTLALLGGPTWAGKMYGPGGGKSTTEDYDHEITGL

SEQ ID NO: 937357 - protein, 92 aa, Homo sapiens
EPREVWVPRGVSLAGAHPGREGPDRLLKAVRSLGLLERFPSPAVRHSLPGPDFKTSSVCSGSGSDSHFNAFGVGFCVISFRALPEEVVLLME

SEQ ID NO: 937358 - protein, 108 aa, Homo sapiens
GDEVSLLSPRLECNSVISAHCSLRLLLGSSDFPASASQVAGITGIHNNAQLIFVFLVETGFHHVGQAGLELLISGDLPALASQSVGIIGVRHHAGQKFTFLECCLSLG

SEQ ID NO: 937359 - protein, 51 aa, Homo sapiens
MMVWVGVWVGARAVGVSLSFLTAFIFACLVTHLTLAQGSNFLSTKETPASV

SEQ ID NO: 937360 - protein, 40 aa, Homo sapiens
GNKFHEVMLALTVLETCVKNCGHRFHVLVASQFVESVLVR

SEQ ID NO: 937361 - protein, 66 aa, Homo sapiens
ELPEQVFGVAQIAGAPGSIGGHLILGGPLLQPLAAAVPIGIIGIHFQDGFLGLLGNSGVLKDEPLD

SEQ ID NO: 937362 - protein, 75 aa, Homo sapiens
PKKGGGGVSAPIRSRLERSEVGVLKIGGVEGGSRLSWYPSLMWEQDERNRDFRGAISYLMVWCSRDLFLMRQDPR

SEQ ID NO: 937363 - protein, 61 aa, Homo sapiens
MAWKLLKEQKYDRQLRRSLALSPRLECSGAISAHFKLRLLGFTPFFCLSLRVGCGVIMGKR

SEQ ID NO: 937364 - protein, 31 aa, Homo sapiens
ADLYCQNMNSGNLVSVLTAEGAFVASLKSST

SEQ ID NO: 937365 - protein, 198 aa, Homo sapiens
FQKGAEWGPWGVSVPARTGRSQFKKSTISRKSSQTGVEGPGTAVGRAGRCSVSDPSTPWASASQERAASPRPLTVAPPAAPAAGPGCQGAWLPGWSAPAGQHRGSGAHEAGKRRAGDTMVDGQPAAQVGGECRPAAVLVAQGYQLQCHPAPVWGLCAYHPVSHRPVGIVGQGQARCLSRLQCPPPSLSLCHWDVLGGH

SEQ ID NO: 937366 - protein, 145 aa, Homo sapiens
TCCWAPCCDWWLGGPAGILQPPAELHLSLCLTPSSSHCGRGQLDGAAPSSSLHRQRGGPQSLFLSACCRPAPCWWAPHDCRAAVFFSAVSVCGGSTPPCGAFFGDVFFCGARVASLFCTRGAENSPHAPLLPPLLGGKKEFFLPH

SEQ ID NO: 937367 - protein, 48 aa, Homo sapiens
VNLRKLRGYYNQSEAGSHIIQRMYGCLGDGRLLRGHDQLAYDGKDYIA

SEQ ID NO: 937368 - protein, 37 aa, Homo sapiens
EGQLSQMARPLSTPSSSQMQARKKRRGIIEKRRRDRI

SEQ ID NO: 937369 - protein, 55 aa, Homo sapiens
HSSGGGSSGDEEEWYQGLPAVPGGTSGIDGGQVGRAWDPEKLAQELSASLTRTLD

SEQ ID NO: 937370 - protein, 69 aa, Homo sapiens
MPSADNSSLGCDRKQWPFSSQFGCPCGFDFGATSSCSRQEMATVLCEFFTCGIRQQQAYMKSLNDSKIT

SEQ ID NO: 937371 - protein, 53 aa, Homo sapiens
VLLQANRDPDAGIDEAQVEQDAQALFAGELKWGTDEKFITIFGTRSVHLRKVF

SEQ ID NO: 937372 - protein, 65 aa, Homo sapiens
LDVCPLTLGIETGGVMTKLIPRNTVGATKKSIFTASNNQPTVTIKVYEGERPLKGHLLGTFDLTG

SEQ ID NO: 937373 - protein, 71 aa, Homo sapiens
FNCLVADPRKGSKMYGLKSYIEYLTPTNTNRSVNHRYKHFWLYERLVKFGSAIPIPSFPDKQVTGRFEEEF

SEQ ID NO: 937374 - protein, 73 aa, Homo sapiens
WNPWHSRVPLQFLGKLAFCSSLRAAFHTTTDPSPLKWGACLSQVFPTWQLCLYFILCTQLVPTALPACRFGSL

SEQ ID NO: 937375 - protein, 54 aa, Homo sapiens
LNTTKLSEELFYQILIYDFNFGVLRLSEPAPLFLAMALDSPESGWTEDGPKEGL

SEQ ID NO: 937376 - protein, 33 aa, Homo sapiens
FNHVLLQKYQPDDEFPASEQSLAGLTDDDFHLL

SEQ ID NO: 937377 - protein, 48 aa, Homo sapiens
MRLVQWACSRPHAFWTQTSQSNWNTPLLVKVLASCRGYRNLCRQVAPE

SEQ ID NO: 937378 - protein, 30 aa, Homo sapiens
MNIKGSPWKGSLLLLLVSNLLLCQSVAPLP

SEQ ID NO: 937379 - protein, 102 aa, Homo sapiens
SRRRGFSSLPLLGPRFPTFRSPLPAFSRHRRRRLPQAVSTAEKESPPNVAIQNLHSFDPFADASQGDDLLPAGTEDYIHIRIQQRNGRKTLTTVQGIADDYR

SEQ ID NO: 937380 - protein, 220 aa, Homo sapiens
SSLPLEPPRFPTFRIPPDRLSPATAADAFRRPFPPARENGNRISHVPRIHRTAPLHILTLAFACIADRSNWLSDTCKSRASATVTRYIIRVYTNFRTRRKRGNVTRRTIHTMSSIRELSMTDVTDVDTAHNEDERRLVKAHNTGLPCETAIRVDYASHYPERNCAETLQYHDIRQGLNPKRQRKALNATVSHRLREFGPELKARLTLERFNEVLHVLSSI

SEQ ID NO: 937381 - protein, 57 aa, Homo sapiens
MGLLLLLLLSMGGAWSREPLRPWCHPIIAILAVEKEGCPVCITVNTTIFGYCPTMMR

SEQ ID NO: 937382 - protein, 101 aa, Homo sapiens
MKWGGLPPRLGVVIYLSPVCVCSVSLVSFLDARRPVTCVVHTSSLRNRRVVVPPHHRPSYRREKIGGNTPPPLWRTPQVALLLGGRDFFGAEKRERERFGG

SEQ ID NO: 937383 - protein, 137 aa, Homo sapiens
MWESLELPRGLLNGFKDIDNDKDNENQAEVVSDGDEELDGSWSKDDSCVLAKRLMAFCPCLRDFWNFELERDDFGCLMENISKQQSIQEVTWVLLKAFSFKREAEHKSFGKICSLTYYDRGKTPFFGGEFKLGCQKF

SEQ ID NO: 937384 - protein, 76 aa, Homo sapiens
SCNFGRYTHQDRPYPGVSNFASLGHVGRRIMLDHTQNTLTLMIACEVKKKHKKISECFKKVYESVLGRIQSHPGLH

SEQ ID NO: 937385 - protein, 96 aa, Homo sapiens
LTWQRDGEDQTQDTELLETRPAGNGTFKWAAVVVPSGEEQRYTCVQHEGPKPLTLKWESSQPTVHIVGIIGLVLLGAVITGAVVAAFNVGGGTSSN

SEQ ID NO: 937386 - protein, 73 aa, Homo sapiens
TEEQLLKDKRQQKIKRFKLRQAQRAHFFADMEEEPFNPDYVEVDRVLEVSFCEDKDTGEPVIYYLVKWCSLPY

SEQ ID NO: 937387 - protein, 65 aa, Homo sapiens
MPYEIKVFASLPQLERGVSKIIGGDPKGNFLYTNGKCVILRNIDNPALADIYTEHGHQVVVGQVM

SEQ ID NO: 937388 - protein, 80 aa, Homo sapiens
WPSSSPTGLFDPPPRPRASLRTLPHAFLNPKYLRPVSVYFAKVKDAPVTASGGPDNRCLRWLGIQFAFIHLRETQDQYVY

SEQ ID NO: 937389 - protein, 62 aa, Homo sapiens
ANMAAERAREQQQSQEMMEEEHELPVDMETILDRDAEVDLHYRIGKIEGFVLKKVKTLCLRQ

SEQ ID NO: 937390 - protein, 54 aa, Homo sapiens
QQRKTPVQIQDSDPRTMNLISIALLLTVLQVSRGQKVTSLTACVDQSLLDCRHE

SEQ ID NO: 937391 - protein, 136 aa, Homo sapiens
HPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQYKAKIVFAVGDFWGRTLSAISSSTDPT

SEQ ID NO: 937392 - protein, 51 aa, Homo sapiens
GSQQHWLMLPQLGAEEGTGEGTIGSTLRTRKEPEGDGVEVEEGTCDLVCSK

SEQ ID NO: 937393 - protein, 37 aa, Homo sapiens
ETRSARDTAQIFRVNLRTLRGYYNQSEAGSHTLQWMH

SEQ ID NO: 937394 - protein, 34 aa, Homo sapiens
QIRATIERDGYAQILRDLGGIVANACGPYIGQWD

SEQ ID NO: 937395 - protein, 61 aa, Homo sapiens
NEAYVTHRQAGKVSVIAKSYKVVKTFDTPTHPNSLALSADGKTLYVSKQKSTKQQATQPDV

SEQ ID NO: 937396 - protein, 40 aa, Homo sapiens
KLREAPSPTEGVSFDIAGLLNNPVFMSMASNLMNNPQIQQ

SEQ ID NO: 937397 - protein, 117 aa, Homo sapiens
NQARSGLKRPRFLENCKSAAPQRKLSTPPSINLLRSVRGAKVVRLVPVRPEHFFVASTRVLINFGLSGGTASNLFFGVNINARLSSHIWNIFENSTHNDTGKNGVFAPHGIKGVPLV

SEQ ID NO: 937398 - protein, 108 aa, Homo sapiens
QRAVSLITAIGKHFLARCQTILLACTQLASRQPDENQCWIASYRSGDGVCQLCFFRRLVVQHAVRFDMTHYAALRTGNRCQRANLIQRLGVNGFWRCMALRPKFSLSG

SEQ ID NO: 937399 - protein, 100 aa, Homo sapiens
VTWRALESCSVWSFVSNTFPRLWSPAVCSPLVTWRAVESCSVWSFVSNMDGCGVVQCVVLCHGGLWSCAVCSSLVTWRALESCSLWSFVSTFPRLLESCS

SEQ ID NO: 937400 - protein, 43 aa, Homo sapiens
DDCKLELHTRTRSHYTHATLTHSHTRTLSRMLLSKPNITKGKE

SEQ ID NO: 937401 - protein, 60 aa, Homo sapiens
TAHVKEAHARCPINGDDVNGQTPLHSGGSLAHKVDIPSDGGVLNLIVIHQVVLDLIQQGI

SEQ ID NO: 937402 - protein, 87 aa, Homo sapiens
GFAARAIKAGDGDLLIAGGVESMSRAPFVMGKAASAFSRQAEMFDTTIGWRFVNPLMAQQFGTDSMPETQENVAELLKISREDQDSF

SEQ ID NO: 937403 - protein, 39 aa, Homo sapiens
LRVEVAGRVECAELVRVGEQSALRVEHLLDPAEASQEGS

SEQ ID NO: 937404 - protein, 113 aa, Homo sapiens
DHSKRARTDATLTANTTGRIGLHHLLAHRQRPHGASANTRGVFTLMAITGALMLSSRCTFSRGKKTSAFNSCSEEVSDHTGYFHKYGQPIQSAGLTIINGFITMPSYQTEFNI

SEQ ID NO: 937405 - protein, 52 aa, Homo sapiens
LWTQWQHGEVGPLRGDWIMKALFPLMNGFIMGELAALEERKRDLRKTLSTVS

SEQ ID NO: 937406 - protein, 91 aa, Homo sapiens
GLWGFHHMAELRDDKRKAIQLQGPDKKLVDPVDSRTLKVTSPKRKTSVSATSVSATNLISMVQGQEFLGKRGICCCIGQPIQYARSTCEAG

SEQ ID NO: 937407 - protein, 45 aa, Homo sapiens
MSFDELLQTNETSAVIIHNHDVFHLKNCTRSKMQLSEEKSGQRLT

SEQ ID NO: 937408 - protein, 60 aa, Homo sapiens
SQRRNNQGHDRNRKEPEGIGSKEGHIKRLLLRKVSSETNTHTDHTQTTTSIMGPSRPGNT

SEQ ID NO: 937409 - protein, 48 aa, Homo sapiens
QQPALTWNPSVPSSKATENHQALAKLKAIFDCAATSLKTVFNIPKEDK

SEQ ID NO: 937410 - protein, 76 aa, Homo sapiens
MRLRFWLLIWLLLGFISHQPTPVINSLAVYRHRETFGVGRDHPGQHGKTPSSQKLGNLIIIIIGVSSDGTTFNILF

SEQ ID NO: 937411 - protein, 69 aa, Homo sapiens
KYATGETVFLDTKKLPIIKKKVRKLEQNYDSRSLWKVVTFNLKFRDIDAATEAKHRLEERQRAEARERK

SEQ ID NO: 937412 - protein, 46 aa, Homo sapiens
KYDDIKESIRQRDLNTPPPTTRKPDEEKSRIRNNGDTRLTILNQLE

SEQ ID NO: 937413 - protein, 100 aa, Homo sapiens
PIVIVSKVQSQGQEQWLMPVIPTVWKTEVGGSLEARCSRPAWETWQYPITEHLKVSQAWWHGPVVPANWEAEVGRSLEPRSSRLQAVMAPLHFQPEQQRQ

SEQ ID NO: 937414 - protein, 56 aa, Homo sapiens
GSLSPPLSSGCVRLRFRDVRNSGVGDGSNSRCHLPGWYTPPPFPQPHSTARVEADV

SEQ ID NO: 937415 - protein, 70 aa, Homo sapiens
KTDLEAISNHKETEEKTASEALLMEPTDDGNTTPRNNGVDDDGNDDGDDDGTDDPRHSASDDYSTRARSF

SEQ ID NO: 937416 - protein, 68 aa, Homo sapiens
QREEKYRGRTAVEHLQEILCGWTTAQGKRGTGGRHEVGKEMARRSQGFVGYSGVNGRRQATFSLLISF

SEQ ID NO: 937417 - protein, 35 aa, Homo sapiens
HTTHDTHANTPDATERARERSSGSAAAHTRDKGGR

SEQ ID NO: 937418 - protein, 56 aa, Homo sapiens
MVVSYRSHNLNCHRINCFSSYSSGQAAFNFGESIQYLHVPCVFSRDILGLFHSPWV

SEQ ID NO: 937419 - protein, 46 aa, Homo sapiens
TTGLLKTRERLCSGADKDLTKVLTDTRGENLAIASTDNYVRNTAPK

SEQ ID NO: 937420 - protein, 126 aa, Homo sapiens
PGIGFGLCRYFFFETESLRHLGWSAVVGSLFTAALTSQSSDPPTSASQVAETTGVCPCTANFLFFLWRWGFTMLPKLVSNSWAQAILPPQLLKVLGTTGMKYCAWPGDQLHFKVPWCSKTTVFSLD

SEQ ID NO: 937421 - protein, 69 aa, Homo sapiens
CRKGVVSVTPSLLVIKPIVPELIKELNFLTPDICHARRDTTQDYEILFKVFTMIPGLKFLPSGADDIEK

SEQ ID NO: 937422 - protein, 114 aa, Homo sapiens
NNLLGRFELSGIPPAPRGVPQIEVTFDIDANGSVNVTATDKSTGKANKITITNKGRLSKEEIERVQEAEKYKAEDEVQRRVAKNALGVLRLSTLRAPFEGFGFKGKFSETNKFF

SEQ ID NO: 937423 - protein, 38 aa, Homo sapiens
GPQDIHVSVCPAALILCKSRFVITDGRVKPRDAQDLQA

SEQ ID NO: 937424 - protein, 59 aa, Homo sapiens
LKTRTAGHYANQEMDSKEEEEVPQPMPSIPELESQKAMVAFLNSAVASAEEEQARLFGQ

SEQ ID NO: 937425 - protein, 37 aa, Homo sapiens
KTSLDILQGHMVALLVILGSTLSSQEKPPSGLMYQER

SEQ ID NO: 937426 - protein, 37 aa, Homo sapiens
SQEKKVVTSCECAGGVESSSESNKVHIGQCSEDKDFP

SEQ ID NO: 937427 - protein, 75 aa, Homo sapiens
MTPWTEGSSVVKDVMQVNTCRTWTTKPATSRMHGDFWEGVDRILICDWNAGEEAEKRVKDNYRGGSICFLKEAEN

SEQ ID NO: 937428 - protein, 100 aa, Homo sapiens
CLRCYKHGTPTSGRNCICVPQKQAGKWAIIEHTLWLSVVWLWSEGGRHPGLWTQVTCLSRHPLTWEQRAVPQARVGARSLWGKLRCLSAVICKNKIFKSL

SEQ ID NO: 937429 - protein, 38 aa, Homo sapiens
GAPQLLNATAGPTAGRVIKLYTMALLKLKNHVILILKH

SEQ ID NO: 937430 - protein, 66 aa, Homo sapiens
TYRAVVAVLELEGEIADAAEAVDRITVALTNARFSSSDAINSSLIGRMTDSPCERRLGGRSPAGAG

SEQ ID NO: 937431 - protein, 30 aa, Homo sapiens
NIEVVNPIVDMDLYEWIALLSLGNLTVGKL

SEQ ID NO: 937432 - protein, 98 aa, Homo sapiens
KVACVLVTTIRIRRRDDDYPKSKVCEQPVMGRELRYEKNQEWKRSSIVVENHTNTADATMKNAAAYRAFFMVRICRVCNDSQHTLESRGLRKSMKVFL

SEQ ID NO: 937433 - protein, 94 aa, Homo sapiens
FWESEHEEGTQSCQVPESQALTSLGAPFCHNFLPLHGLELCPAPKKKIGLQHRRVSSPKSCCSFLAPSAAIFASQPSQFGIIRVSARGSVSFLP

SEQ ID NO: 937434 - protein, 47 aa, Homo sapiens
LEYLQPPVSRAYTTACLTTAAVQLELITPQLYFNPELIFKHFQIWRL

SEQ ID NO: 937435 - protein, 67 aa, Homo sapiens
MGPRSPDAHHPGLFMFEPILEEKCENACSEHGGQAGSIRCQGAKHNGKGGADAAEGEGRAWPAEGDR

SEQ ID NO: 937436 - protein, 40 aa, Homo sapiens
EGDIYAVEIVGGATRILLVKEEIRKFFGELSTTLNADEAV

SEQ ID NO: 937437 - protein, 88 aa, Homo sapiens
MAFSPFSIASLTQVLLGAGENTKTNLESILFYPKDFTCFHQALKGFRTKGVTSFIFHSPDLAIRDTFNASGTLYSSSPRLSNNSDGNL

SEQ ID NO: 937438 - protein, 84 aa, Homo sapiens
LTLNKVDEEFEEETDNEENFIDLNVLKAQTYHLDMNETKQEDILSTTDAAEQKWNVYYRNKSRLGLTIRIGESMLTKCTSTEVE

SEQ ID NO: 937439 - protein, 91 aa, Homo sapiens
PSGRKKLDQARGKEELLPPLTPHGSLRDKFVDLAISNGLHCGGCGDRSTSFPSITRLHQKTGSDFRSSRQDFEGIVIIFFVSLKLPFYLLR

SEQ ID NO: 937440 - protein, 51 aa, Homo sapiens
TASIYNACIAKTIENLEGALDGKAPQDAWLWVTEAKVNRGYIGSPLGIEAR

SEQ ID NO: 937441 - protein, 51 aa, Homo sapiens
QLVLMNGEKVSESYVITLERLEDDLQIKGERADQSYGYDLALIEAFSEVNL

SEQ ID NO: 937442 - protein, 36 aa, Homo sapiens
KRAPAPELLEKNGLSKRPRGKKRALLTISFLPAGIS

SEQ ID NO: 937443 - protein, 51 aa, Homo sapiens
MLGRAFVQVGLHYIMVDLTTVEDPSGVAEILTTKICSVLGQSVNHGLRSYG

SEQ ID NO: 937444 - protein, 68 aa, Homo sapiens
SYITLGLDLHWLRGSAGTHTCWVPVGSTQEDSSSLMPPAPGSRVTWAGGLAWQGSRVPLEAPMDLCLW

SEQ ID NO: 937445 - protein, 50 aa, Homo sapiens
MLFKRVPPPRMAVTKNDDPGDYVDMYTAIRNLRRRHMPRSPTQMTCKPCE

SEQ ID NO: 937446 - protein, 34 aa, Homo sapiens
QYHLCQLYIRKYIHFSTSILHFPEEMITSPPNKF

SEQ ID NO: 937447 - protein, 77 aa, Homo sapiens
RMRQNSTANSATDANSDQRESDLDLVLDAGQLIPEKSSVDPNRNRKKNIVINLKNSSGDKQSSYDSRGIHRTNQSFP

SEQ ID NO: 937448 - protein, 58 aa, Homo sapiens
MTGLALLYGVFVAFWACALAVGFLTETSPMWSNLGIGLAISLSVVGSLGHLYYRLLPS

SEQ ID NO: 937449 - protein, 41 aa, Homo sapiens
HSIHTLETKKTLCVCMCARLTRLYALYGGRFGYFGVTPPVF

SEQ ID NO: 937450 - protein, 113 aa, Homo sapiens
KDQFPSERCPLYPGKEKPPYHPSKFFVKFKKPTSSETDVNDSIYEDNFLGAPFRRVEDISSGQPDIWFFPYPDSMEDLQIRYYRKAKFMKRVNGDDCFLTRKSMPHFWTSSNG

SEQ ID NO: 937451 - protein, 46 aa, Homo sapiens
MQALVVNSTYSISSEGRGVRPTRLERREMRPAKTSERRSESEPEIR

SEQ ID NO: 937452 - protein, 52 aa, Homo sapiens
LATYSLKSLSLYIYLVRTPFTVIAEGVDISLLISDDTPADAQAAIQHLYTVS

SEQ ID NO: 937453 - protein, 49 aa, Homo sapiens
APVLTGAYQQSHSQGYGYMTPAQCEIHEIITAFNQSYGAYRGIVRLTGD

SEQ ID NO: 937454 - protein, 35 aa, Homo sapiens
TVCALSAPQIGSHYVCAPCNLVIFTATSDEVFIMA

SEQ ID NO: 937455 - protein, 59 aa, Homo sapiens
TACGTRQFLSSNRVHFHGRAVRSDSTFLPESTSLQRRGEYRRTSLAPDASTGQPEDSGE

SEQ ID NO: 937456 - protein, 49 aa, Homo sapiens
MQANWKKTVHIGLSSDAVGQQGEWILSNYVLNFWTYEILQGVSYVVPSC

SEQ ID NO: 937457 - protein, 59 aa, Homo sapiens
LAWLPVRCVGPLASEMLFTLNKAFLERFMFKNYSENSKKASISARLQGKPPQRSKSSSE

SEQ ID NO: 937458 - protein, 50 aa, Homo sapiens
SRSSGTVRCVELLQVVLPRKFHHITQFSGVASLVLIAPGPILGAWRWVVG

SEQ ID NO: 937459 - protein, 34 aa, Homo sapiens
EHNHQAQQHTFIRVRPLCSTETSYLFFLILEYCP

SEQ ID NO: 937460 - protein, 50 aa, Homo sapiens
LAGGPVISERGLAWLNNLKNLRSWTYRTSHAVSILDLSKLLGGGDVPNWK

SEQ ID NO: 937461 - protein, 83 aa, Homo sapiens
PSLNILIPVLDRIRYTESSGNRINVPEQSAVTLDNVTLQIDGVLYLAIMDPYKASYDARTLICRHPASSNNHEIRAQQTLSGQ

SEQ ID NO: 937462 - protein, 54 aa, Homo sapiens
TQQRLYYAKLSFIQAEIMIKRHEEEQQNIREELNKKRTPEGDGRMPCYIRHGES

SEQ ID NO: 937463 - protein, 70 aa, Homo sapiens
KLFMGIYPNNNEASGITSAPFHQSLCATKASFANFNCLGFKHSLPAVMPLLQTTTPGLDGPILNGNPGKE

SEQ ID NO: 937464 - protein, 50 aa, Homo sapiens
LKLLDTSVRKCSTKDIDVHCVAGKVEDKGTLFRRRLLMHILLCFLALQQT

SEQ ID NO: 937465 - protein, 51 aa, Homo sapiens
LEDCRPDCNFRVTDVIGGTEVQFQVRAENEAGVGHPVTHRIAIPLEDSNRS

SEQ ID NO: 937466 - protein, 48 aa, Homo sapiens
GSNYLYNEDCSQKREMDDTDLSDKRACPPGHLRCCNVRSTLREPVDCL

SEQ ID NO: 937467 - protein, 50 aa, Homo sapiens
CLSAPTWELWLPVCRQLSGEADRVGPHVEERSSKMNHNWRVWLRAFADAV

SEQ ID NO: 937468 - protein, 38 aa, Homo sapiens
GKDGNMFLSFENSQGVKNKAMLKANIHACNSRRKSKGI

SEQ ID NO: 937469 - protein, 90 aa, Homo sapiens
EFGSEGCEAAQCQDRAAGAAGESPCTMSLGRPVRKAQRVLPSICPGASAAKKRRPDTKLEESAGPGLYEHVKEKQLRPQRRFGAPRESGP

SEQ ID NO: 937470 - protein, 30 aa, Homo sapiens
ARLEEKGEEEGASSEVADRLQPPSGATGGS

SEQ ID NO: 937471 - protein, 87 aa, Homo sapiens
REPTMELSPADKTNVKAAWGKVGAHNGEYGRRGPGKDAPVLSPPCETYSTHFDLSHASARFKGHGKKVPDALTNAVRTWTTCPTRCP

SEQ ID NO: 937472 - protein, 123 aa, Homo sapiens
ALRVRQRAGLLGGRRGRRVLVARGTGWAGRQWSLSVAFPGSQFVVPRIHLFLPHAILFFLLYTLVLPELFPKAWRNGGGRECPVCRPGTLPCAFAVEWRRDPGYVVYDSRGTGHSVWENISFR

SEQ ID NO: 937473 - protein, 34 aa, Homo sapiens
MGSTKLLCFKEHGVAMALPHRVSRVWRSIQMRSG

SEQ ID NO: 937474 - protein, 58 aa, Homo sapiens
LSESNENYNGVPRRRAENSITKWNNVLTVRIKKNNTTNQVYQAIIAKAAMNNTTLNYS

SEQ ID NO: 937475 - protein, 104 aa, Homo sapiens
KEEVSMTVTNHLTNCISQALIDAWRSAMHEAPPMGEPLAANEKRHRTGPIATYSQLFTSQAHYTMTSFKTPNRTLEVNTEQDEGLTKRKLKLNSKEQEHDDKMN

SEQ ID NO: 937476 - protein, 115 aa, Homo sapiens
SAHRVGVRLVNLRPTASVHGTNAYVAIGHSRFSAALIRAYPPFACWSTSQFRRAPSSLFIYVAVSVRPAYIGAISIARGVPAFTHMKVGQHASAIIQQFSTEGLEVYYKGTNIRG

SEQ ID NO: 937477 - protein, 52 aa, Homo sapiens
CISLFAPSVPRKSYFIVVNIQFISIVQFGGFMRKPIAPISVLVVSFIIFRIC

SEQ ID NO: 937478 - protein, 71 aa, Homo sapiens
TQMSSSSPLSISTALIFLSLEAHNTTTTEILKGLKSNLTETSETKIYQSFQHLPCTLNKYNGELELSLEND

SEQ ID NO: 937479 - protein, 36 aa, Homo sapiens
SDPRSLGFRYFFSFLFSTSQGTGFHFATRTGERRKN

SEQ ID NO: 937480 - protein, 34 aa, Homo sapiens
MTIRSAFIDNEKMESRTHLSLFGPYRFATRVRRL

SEQ ID NO: 937481 - protein, 68 aa, Homo sapiens
RHDGSREENGEPPRMAGRARDRQDRGDGGPGLSGSPGVGSISNSGDFCFALSRASLGGGLVGGRVEGS

SEQ ID NO: 937482 - protein, 53 aa, Homo sapiens
VRHLTYAHNWRALDYAIPKVNRTTFGHAPRSGHHVILFTPVCALGPFSMTSQR

SEQ ID NO: 937483 - protein, 70 aa, Homo sapiens
DDIGNSCPLEACNHAVLPAGVGIPEEHYIKRGCWQMLPATEGNRDACTITACVHRTDLPEVEIISLLEEQ

SEQ ID NO: 937484 - protein, 50 aa, Homo sapiens
RIAALHGNDVTKVFTKVTELSNLRRHQRVADNKRLDGIQSQLIDASQRAT

SEQ ID NO: 937485 - protein, 60 aa, Homo sapiens
PLLINLRARLSLETFSNSMARHRTGQHTSRIMSRTNLAVFGQTPAGCWACSRSCHFVALV

SEQ ID NO: 937486 - protein, 59 aa, Homo sapiens
SQEKEVFRGPEDMAALEKDLRRLVEFVEGEGEEEGEDTKVKTSQGVLLRELSCFKHESV

SEQ ID NO: 937487 - protein, 102 aa, Homo sapiens
IHNHTKTNPNIYLPLAQQNFELGNEKIHLISTQSAIPHALRAELKDWNGRTSTADYNMPKTGPEADKYRLTRAYSTAGTAENTFTGDPVHKSHGQIQLTKTY

SEQ ID NO: 937488 - protein, 60 aa, Homo sapiens
MQQSYNTFKYYSHFLFKVVTKLVNRAPAPPGGLSLRINFNNYYQDPEAALRGTCTIKEFS

SEQ ID NO: 937489 - protein, 37 aa, Homo sapiens
SSLESEITKEIIEGVREMITDNDFGRLTFDPGYAEAD

SEQ ID NO: 937490 - protein, 101 aa, Homo sapiens
ITSFMGLEIVENSFPPTPTPSDLILVSKTSGQLIVNGFFFKKLNSGFYCSCVQWIHLVTGSRLCPSPIPHQADLQIHTIVPKERKLMTQYKPITTPRKYNS

SEQ ID NO: 937491 - protein, 69 aa, Homo sapiens
RKEGEEDQNPPCPRLNGALMEVEEAKSYRTHWIDVIRLRKCTLNYLTYSSTTEVCFTYPRHSTKGSTFT

SEQ ID NO: 937492 - protein, 70 aa, Homo sapiens
VPEAEEKFLEDVKKSYHSEAFTVNLKDTEEAKKQINDYVEKGTKGKIVDLVKELNRDTDFALANHTCSAD

SEQ ID NO: 937493 - protein, 70 aa, Homo sapiens
KSSPVEAQTPTKHFYGQYSFENEANSSRLLDPNSPQLIIQVLDEDTTVSELKLSKNRKNHRESNQNNHSL

SEQ ID NO: 937494 - protein, 37 aa, Homo sapiens
MGGPKPGGDEGLALSPCLAGGASPLCDGGPKSQWGNQ

SEQ ID NO: 937495 - protein, 137 aa, Homo sapiens
HIYCGRGSEGLQTTRAGASARTGARGRHLAQCSRERPGLQHPPPSPAARTSVRPVTGCSFRCVSAELPHAHEPSPDAETCFTLSAPGPAPSPSACSHPEGRSGAGGNSGHTGLYQGNSGTPRKMLLFSLSQDHNVGC

SEQ ID NO: 937496 - protein, 81 aa, Homo sapiens
KSQLFSSPHEKDLLFKDSAHEFSKVPPRINAKTHLSYEYTTAIRNLREGTCTEAPTNEMKAYEVECVDPPRATNESWTKCQ

SEQ ID NO: 937497 - protein, 79 aa, Homo sapiens
TGGFIWDWLIRVVENETPGESFYAYGGDSGDHPMIGNLVWMVCFSQTAPQSQPYWERHFVSSTLAFAVRTRLSPERTSY

SEQ ID NO: 937498 - protein, 38 aa, Homo sapiens
YKDNVAIFLDLNQRHSSTRFQNGIFQKFLSHLITTTVF

SEQ ID NO: 937499 - protein, 29 aa, Homo sapiens
MRQRRDDSARDARDAQKCMPTRYVHTNAN

SEQ ID NO: 937500 - protein, 65 aa, Homo sapiens
EDPNTMGVKHASIATDLQELPTVCFEIDMQICLRILTFRTENKFFNESIQQVLFIRLMRSIDNGT

SEQ ID NO: 937501 - protein, 80 aa, Homo sapiens
RLRSLIVDVLKPTSDQSPHRASSSPEDVRNRKARIHLPQRRDLHANPKDVPYDDENVIIESNLILIWASMPHLIHLASIN

SEQ ID NO: 937502 - protein, 67 aa, Homo sapiens
GDTGRHSSLAGIGSVRASQQRPTLPLGPGYLSGVQEELGHMNGLKSSVCGDLIEWWLLVGWELESRR

SEQ ID NO: 937503 - protein, 35 aa, Homo sapiens
MWFSGQLGNFRDVVTISLWFISRFNYCIQSLCSAF

SEQ ID NO: 937504 - protein, 57 aa, Homo sapiens
GSNNHRAHKNRPTDLTNIQRLTGPFKSSPRLNACRQVHGEDYYFLVANHPSGCPCVD

SEQ ID NO: 937505 - protein, 47 aa, Homo sapiens
MGEKKTAEMNERLQKTGESHEPGRQRLQGAEIVPLHSSLGNKSKTVS

SEQ ID NO: 937506 - protein, 96 aa, Homo sapiens
NKSSQFLLPGHEEDVQGASSTRWKQKHLPHFKRGAREQTVAELAFGVSVQHADSLENIDESRGREQRGADGRPGGEGSDDDRSTYCAHRFRDGDRI

SEQ ID NO: 937507 - protein, 31 aa, Homo sapiens
MYLRPPGCCSYSNSSPAVDVGESVTPDLDRV

SEQ ID NO: 937508 - protein, 47 aa, Homo sapiens
GPLINSLDAFQISQDPDVVIHSEHDPFFFQRSTTDGRVSLIPINLHT

SEQ ID NO: 937509 - protein, 37 aa, Homo sapiens
MMSKRFNNSQPWGHSGYCYRPESFAKMRRETPFERGF

SEQ ID NO: 937510 - protein, 30 aa, Homo sapiens
KQSTHVRPFHAHPNTLNLGDGAVLAVQDKT

SEQ ID NO: 937511 - protein, 50 aa, Homo sapiens
MIITRNDRPGNPPGYDSFLSSAKRSVHSLVLMTVPDTYEQPLVRLHFNHG

SEQ ID NO: 937512 - protein, 53 aa, Homo sapiens
NQYQSSPEIDEDRIPNPLSPLCNVSTATKKMTRITPTMKELQMMNITWQHRKG

SEQ ID NO: 937513 - protein, 65 aa, Homo sapiens
LLIAILEQGKGGLTSLRCSCHARQNQRRHTLTSLDACLDAFETAQRSPVLLNKHLLANCDDHNHR

SEQ ID NO: 937514 - protein, 36 aa, Homo sapiens
PQQVRDLGVQPAYNHSREKKKTCCFNTTREDLAINI

SEQ ID NO: 937515 - protein, 52 aa, Homo sapiens
LHWGKRIAPSNSVTDVARANSYPYQILDSNLQDIILADSDIRGQRSKIAWYS

SEQ ID NO: 937516 - protein, 57 aa, Homo sapiens
TPTASISRTKSQTILPEIVKLNTGGNHLTPENVPSQSSVKIKPHNNNNAYEILNSEG

SEQ ID NO: 937517 - protein, 52 aa, Homo sapiens
NRQIPHGQFGNKADVYTSMLTVPETKPLILTYCDTAKKKKTVITKSGIFRKT

SEQ ID NO: 937518 - protein, 71 aa, Homo sapiens
MTGGTAARLTLRSGSTGPLKTVPRHGGRHAHEIHIYELLELENEEERSPKIQGLLKSCGKPVEDFIQELLA

SEQ ID NO: 937519 - protein, 52 aa, Homo sapiens
GSCWREESLTQNCKTPVDFQALPHGDVNLSSRHGRLPKIPATKHGLASETFL

SEQ ID NO: 937520 - protein, 69 aa, Homo sapiens
TGNFYVPAEPKLTFVIRIRGINEMSPKVRKLSNFFTFIKSSTTFATQQASYSEDCRAYIADTPICIIND

SEQ ID NO: 937521 - protein, 41 aa, Homo sapiens
ARAQSLAFADPPPIHTCRQLTVYDDITLATNNGSNLCKAAF

SEQ ID NO: 937522 - protein, 64 aa, Homo sapiens
KPRSVRFRQQLQHLIFCDSRCPLLPISGNMASDVAVSDDVIKVFNDMKAHKSSTPEEVKRRKQI

SEQ ID NO: 937523 - protein, 49 aa, Homo sapiens
HSYRHYDAASYHIVDQSQTLIGYMVIHIATLMFTTVSSEWYNQINSLVP

SEQ ID NO: 937524 - protein, 37 aa, Homo sapiens
MVKAKRRCFGILFAAQRSLHEVEEILAVVKTDMASGR

SEQ ID NO: 937525 - protein, 50 aa, Homo sapiens
CFTILASTSLVLGTVRLPQQMRDLPTCTTPHPKKKNLLLHTTRGGPVINI

SEQ ID NO: 937526 - protein, 66 aa, Homo sapiens
RATFHPSNQGMLALSSMLSPFQPEIAQMLLRELQPIFSKQTDFLTTYIWLAAGDSMKSIFNTTIIV

SEQ ID NO: 937527 - protein, 47 aa, Homo sapiens
IHYAWPPQLLSSWILNLSCTNEFNGSALGPGVSCSNAPAATEGASNA

SEQ ID NO: 937528 - protein, 53 aa, Homo sapiens
MQCFLTVSKSSSVILLVEGNASFTKKGWNIIRRLIEYKMKLCVSLIHFVTLKY

SEQ ID NO: 937529 - protein, 67 aa, Homo sapiens
AERDESVVPQVLRARNILEPSLFVSSQGVSRKFRENRSVLVRVHCRVGPLNVCVLQTLSEVKVFLAL

SEQ ID NO: 937530 - protein, 132 aa, Homo sapiens
ELPQHLQSQLGSWSGKIRPVMYQNPGCPGEDVPRGLKSPPPLQLGNPAVKRLGPSVNGERHLSENRGASSQQQRNRRGEEPFTCMECGKSFRLKINLIIHQRNHIKEGPYECAECEISFREKQQLQVHQRIH

SEQ ID NO: 937531 - protein, 80 aa, Homo sapiens
LQEAGPTLAEDPGLAGSWTGIQESHGWAPQTCALRGSRSVGCRPQSAVSEPSTAQLGGTSGSGRSVWISFSAEERLAPGG

SEQ ID NO: 937532 - protein, 103 aa, Homo sapiens
GPGPWPVSCLRGGPLRHSICPFCSSLLQVPPPAPALHSQPWLPFPRQAGTYCECSLGSARRSSPSCGAGGISALFCARIVELVLGARVNMPEQVETGWWRILG

SEQ ID NO: 937533 - protein, 48 aa, Homo sapiens
QGLADNTLIAKVNNARGLDHPLEEDCTLELLKSEDEEAQAVFGALVSH

SEQ ID NO: 937534 - protein, 48 aa, Homo sapiens
MVLTSVRWNQWINPQVCLSFKWDNLRNALAEDSDDRAPTTHNRNLLIT

SEQ ID NO: 937535 - protein, 162 aa, Homo sapiens
QHRNVMLQFSGEDGMQTVRRVFQCAGNRKDVDFVAQATQGACQFITIQICAADFRHKKGGDQTDFHGCCRQYYVRSIASFRPWKRGDAERGFSVTPNEEGGRPMFMASRSAQVPHTSYGIRPGWGIPRTNAIKPRPRNRDSARISTLSRSTHAAGLRELRGR

SEQ ID NO: 937536 - protein, 40 aa, Homo sapiens
MNVVICVAIPLPAHTCTTAMGRSLLGAESLAEVINKPLEH

SEQ ID NO: 937537 - protein, 36 aa, Homo sapiens
KSTKASMHQFIPRSAIYDTYIYSRPLLTRQTSRNDQ

SEQ ID NO: 937538 - protein, 65 aa, Homo sapiens
IRHAERTNAATSHPLTTSHLQTTTFEIRTTWKMQSWYAFSIDLAANPEGRQLVSFYYSSVPLPHR

SEQ ID NO: 937539 - protein, 78 aa, Homo sapiens
APQPITQNSSPYPPQQAGEASPSNHEEQPPESSPSSSPMAGRNTYIDNLMTDETCQDAAIAGCKASPFVWAAVPGETL

SEQ ID NO: 937540 - protein, 58 aa, Homo sapiens
SWALADVHINKKGLKNIGHIIHTSQISHLYFKPLNEFHDLEGYKIVLRARAFGLFLEQ

SEQ ID NO: 937541 - protein, 85 aa, Homo sapiens
EDPRNHRTHNPAIYLRHNGMGGGRGQTLSNVGHFRTGAVLTFDKVDVIAINDLLTDFNCKIMIYVLSTNEQYAVAKIEHEPFGLN

SEQ ID NO: 937542 - protein, 73 aa, Homo sapiens
MTSKQQRSTSIEETMRPQEKQVTITETLWDQVLTVFKDIQKELQEDARIRGMSNCSMTPMTSAPRTGSIRPPD

SEQ ID NO: 937543 - protein, 104 aa, Homo sapiens
AFHLFYHVKTQYSRCLLEAEIPDTEPAVTLILDFPASRTFSTTGETSENLTIMVEGEANTSFITGQQEGEVQTKRWGFAMFLRLFLNSWTQKIHLPWPPKVLGL

SEQ ID NO: 937544 - protein, 76 aa, Homo sapiens
VFQKVTDHATIALLHYQLPQMPDVVVRSFMTWLRSYIKLFQAPCQRCGKFLQDGLPPTWIDFRTHRSLPSDLAALV

SEQ ID NO: 937545 - protein, 30 aa, Homo sapiens
QGDPRPRLRPDQLKILCSYSFAEVLGVECR

SEQ ID NO: 937546 - protein, 75 aa, Homo sapiens
NQPHSPRSNSHSHPNPLKLHRRSLSHRLPGASILIPFLPSKRKLRTHSQSHHNPLSRTSNSTPTNSFLMTSSKPR

SEQ ID NO: 937547 - protein, 141 aa, Homo sapiens
SVRGGPGGGHDLTAICDASELVPVCQCELQPWMRSLQQKPNINAATLEKVIEIRVNTGAVCRSRAGWAVPARGQAGETEEAETVSAMALLSVGAEHMVCGTPGTQPQAGRGAHGAGACPCDAPAPIPLGFTIVILFIFSIK

SEQ ID NO: 937548 - protein, 82 aa, Homo sapiens
MNAFMVWAKDERKLLAQQNPDLHNAELSKMLGKSGMRLTLAEKRPFVEEAERAVQHMQDHPNYKYRPRRRKQVKRLKRVEGG

SEQ ID NO: 937549 - protein, 55 aa, Homo sapiens
PLSAACQSYQPLGHLPPPSNGFSMQSLLGDSREEHPGQGWCHRAAQLLQAGLCHQ

SEQ ID NO: 937550 - protein, 58 aa, Homo sapiens
TWDVNDETGTLADMKELAYGTLAVKLQTIRQHETQFCYCNDDIVSDHKKKGDDQSRKA

SEQ ID NO: 937551 - protein, 161 aa, Homo sapiens
EFRSSPAPSSETDEAPLIFTARGETEERARGAPKQAWNSSFLEQLVKKPNWAHSVNPVHLEAQGIHISRHTRPKGQPLSSPKKNSGSAARPSTAIGSAGGARRPALCRHRPEYHRARAGERMAVPAGAQAHPDDIQSRLLGASGNPVGKGAVAMAPEMLPK

SEQ ID NO: 937552 - protein, 176 aa, Homo sapiens
KVCFSCCSDGNIAVWDLTTRPCQSSGNRWGTDRIPGWTTVDRGLKHILWDSEADTTQHDFFPDSPGYATWEWLAVGMESSNVEVLHHTKPDKYQLHLHESCVLSLKFAYCGKWFVSTGKDKLLNAWRTPYGASIFQSKESSSCLSCTFQRMTNTFYRLWWQEGHVYEGHYLTGLPQ

SEQ ID NO: 937553 - protein, 38 aa, Homo sapiens
VLDRCCWTDNQPCWSGTGSRPETIVNSGLISPEGLAID

SEQ ID NO: 937554 - protein, 126 aa, Homo sapiens
MAFIEFEEINLTELWGDMDNQKHIYEGFDKVLLEMNTLLSANHASKTQSKLLESPDQPKLNEQRTSTPSPNPPEQQRGVTAEQGPQRISIEEQQQGKKPTAEQELYIESVIEPGTHTESTLEQGSS

SEQ ID NO: 937555 - protein, 298 aa, Homo sapiens
GGPGRGAERQGRERAKRRSGRDTLQLAAAATEPPLCSLIRLLGHRLVDPRWEEEVKQDVAGSAKAGSYAFPWVRILWYMKKGYLQLQDLSGGTSVHGLPSWDPDSGDSGAFWQCIDDTHKKGRVHTLADMPGWLCANDEVVESGWLKGVTIASGGVLPLHAARVASEEGGIQRKVGSFQSHHPQAEKAKFSSLKKHVSKKAGGKKGARKYKKKQGEVSEAASAESTTEGTPGDGFTVLSTKSLFLGHKLQVVQADIASMDSDAVVHPTNTDFYIGGEVGNTLEKKGGKEFVEAVLELR

SEQ ID NO: 937556 - protein, 56 aa, Homo sapiens
MLAFDLQRGVAAQLTLIKRLLCAWYCASIRMPQRTRQTRSLCWGELTVQLRRRSKM

SEQ ID NO: 937557 - protein, 60 aa, Homo sapiens
MAPILRALTPHDEETPNPLTAPRGTWEKADCPGSMKSPISIMYLLAAIIYIKGTSPKIKH

SEQ ID NO: 937558 - protein, 139 aa, Homo sapiens
GSTPPEAVQNEDLTLLVKEMEQGHSDLEKMQDLYSESLIMDWWYNAEKDGDSKHQKEICSMISTPEKCAKPQSDVDSTQTSSLNMLKGPWGLSDQKVQKKKVLHAESTKTSLLRSQMSSLRSSACSERKDGLSNASSRR

SEQ ID NO: 937559 - protein, 77 aa, Homo sapiens
DQGGGLINLDPLRPAAEEVHSGQPLGQNAASPESSGSTTIILLLSRFDLLISLKRQTLLDTESIGGLRYFSVDRWCL

SEQ ID NO: 937560 - protein, 97 aa, Homo sapiens
TGSPPEPSLETSSLAILYIWIHDTEKLENDDNSSPVCMDADMDAVCHSYHWMGRNDRCNPAIVFSTLSSIFSTDIVFQSPCHTTAWNISQSGILMQW

SEQ ID NO: 937561 - protein, 40 aa, Homo sapiens
EDPKTMAFITPSRCPSHDFTIAKHNHTLTCIAKLTDDDVL

SEQ ID NO: 937562 - protein, 57 aa, Homo sapiens
IDLDLAARNIQLVTELVKNKTADHRVKLQESESLIANLETEDEMVTDKAFQDGFKAE

SEQ ID NO: 937563 - protein, 58 aa, Homo sapiens
IIIDIPINVYLLAEDPFGAEMCKLVPLIQKASVGITVLSLVSSIDRYSFVLGVELRNC

SEQ ID NO: 937564 - protein, 108 aa, Homo sapiens
MDTRRQEDRRSWTERDQDLTGYAVDHGSIVTEDKALKRNETILIKGLMAHTIQEISSATNSQQLIQRSFMNNRQLNKKMSLYCSKERRMPLFSLEQGRWGLTKDSLLE

SEQ ID NO: 937565 - protein, 98 aa, Homo sapiens
EDPQTMEHSRGCHSPMTTLQALTPAPHVIVQPQIAAALRSPPQTLSRSPQRPLPGTPASSQAPKAQFQNLYPRVIRRQLPVKGPNLARRLLFGLIAIY

SEQ ID NO: 937566 - protein, 117 aa, Homo sapiens
ILHLPFYGDLVCLEWTTLPTGSSIKLSPQTTAIGNLRPGGEHNGCMFGFWGIDPRRKPMYAPEGDFLLLNRESQFLSSWTMSTKMEGLGQHVPLGAGFLAFGERCKPRKIQGRNPGA

SEQ ID NO: 937567 - protein, 30 aa, Homo sapiens
PLYCSVRSYRFESNKKAFANEDEIAELRTP

SEQ ID NO: 937568 - protein, 33 aa, Homo sapiens
VKNNRKIDPEKIKQSKHFRGTKTLGSKTRSTTP

SEQ ID NO: 937569 - protein, 113 aa, Homo sapiens
HHINTKAIFWLGLFFTTVLKEHVHSLQLTSLHLLHQILFHALEVYAITLPGSTLYRLTAFTISNLKVPQSQKCTHLGTQNCTYLMKPSMSMERARLSLNPVLVRTASYFYLLC

SEQ ID NO: 937570 - protein, 143 aa, Homo sapiens
WDLIAGHEAQFGAELLLRLFTVYPSTKVYFPYLSACQDATELLSHGQRTLAAVGAAVQHVDYPWRAEPLADLQRSLRVDPANFPLLIQCFHVVLASHLHDEFTVQIQAACDKFLTGVPVVLTEKYLLSPPAQALVPACQYTEA

SEQ ID NO: 937571 - protein, 29 aa, Homo sapiens
EDPPTIARKCGKGPSSITNGKKAPSPMGH

SEQ ID NO: 937572 - protein, 72 aa, Homo sapiens
YAVDKRKWPCYLTSFRFDIALNVILYLHQIPILPDNLAFGNSFSFKIPICKTPKFHTYSPNGLSSPSLMVYS

SEQ ID NO: 937573 - protein, 119 aa, Homo sapiens
VFHICEWFHPLSCTFSRHFFEWMIFREVYCILTFSLPYHRHNKKIQETGPTRSFPFTYCCPCGPILFSHSRYHNYIIIPMLSFLSGGDTDFLSFVLKLTLNHPYRIPYTYHTVPYVPLH

SEQ ID NO: 937574 - protein, 49 aa, Homo sapiens
YYANQFGTSDETSGYYSHSQCQITICLEILSLGHVQSAGCNWVQGMWLR

SEQ ID NO: 937575 - protein, 49 aa, Homo sapiens
MDLSQSYAKGSFCLKANKYRSVASHFISTKMNHPFSHFEPKGDILTVTP

SEQ ID NO: 937576 - protein, 72 aa, Homo sapiens
SAPCDPHGPRRGDTRGSSMSSRSERRNVPHSNFPSQCHDGDDNPRSGTETTQNGTGNWPQTLKVRLHPNYIY

SEQ ID NO: 937577 - protein, 84 aa, Homo sapiens
MYKQILSSKCKVNPIDRPKKCFNWKTPYEVYFDEDVAVGLIIQGIKAISQSPHFPQPATKQLVYFEVSYGVQSLRDDLPRVIVG

SEQ ID NO: 937578 - protein, 49 aa, Homo sapiens
RTKYETSTLVIAAARQQQIDTANIASAPTYPCVLTDELAHWLDRLATLV

SEQ ID NO: 937579 - protein, 51 aa, Homo sapiens
VHLIHLLYPVTASEDLILSNSTIMRHLSGGTSALDLASPSYKPPDTTVCQS

SEQ ID NO: 937580 - protein, 42 aa, Homo sapiens
MLTCCDRERIIYQYRYAVRLSTFMPFSFIRHDEEESFELLTS

SEQ ID NO: 937581 - protein, 123 aa, Homo sapiens
IRHEDSVSWGWAAPAEPTKVDAAEGRPAHGARVLSGPYEHPERLRQLQQELEAFRGQLGDVGALDTVWRECKMRRNMMPEAVSIGIARCYSLKNRHQDVMPYDSNRVVLRSGKDDYINASCVE

SEQ ID NO: 937582 - protein, 80 aa, Homo sapiens
NNMAVNTFDVCLALIIRDGVRLSQLECSGNLAMYLTLGQAIPSSASEELGLQVCATTPANFYFLFETDSRFVTRLECSGL

SEQ ID NO: 937583 - protein, 38 aa, Homo sapiens
MVAWTPALESGQELDTIHSPTVARGFTDLFDLLEARPY

SEQ ID NO: 937584 - protein, 49 aa, Homo sapiens
TVCHSHIRSRVRCRLYAYTCYQTVSSFDITLVIAVSGVIWHISWRCTHS

SEQ ID NO: 937585 - protein, 78 aa, Homo sapiens
KKYGKANPEIKSYYVPENTLFYSFSVMAMGAGALLLSTIVALWMNRRKSQLSRHNVDSRDLWGSQLSRHSRSTQPVGQ

SEQ ID NO: 937586 - protein, 85 aa, Homo sapiens
RPIPQWWTKDGSGTRPGPFLEGAHHRSKTSPRTQSSTCAAEWSDSETHSVKKHLLFELLEDERRMSGVPPHSFSVSRGSTSDRTR

SEQ ID NO: 937587 - protein, 74 aa, Homo sapiens
SAQEEQLQLVTEAVAGQLVGDATLRGARDERDLGTMSDVAIVKEGWLHKRGEYIKTWRPPYFLLKNDGTFIGYK

SEQ ID NO: 937588 - protein, 95 aa, Homo sapiens
IRHQEEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 937589 - protein, 49 aa, Homo sapiens
DSCRLWSVANGAAGVLQTLHRLVLKATLNQLAFQELFSKVCVVRFGAWF

SEQ ID NO: 937590 - protein, 50 aa, Homo sapiens
CTCNLRRTCDRIQICTDACAMCLSIALDQAQTFHYVHELSSHQGMSASFS

SEQ ID NO: 937591 - protein, 122 aa, Homo sapiens
MSGRGKQGGKVRAEAKSRSSRRGAAVPVWPECTELLRKGNYADEWAPGGCYLAAVLEYFTAEIVELAGNAQRDEQEDQDNSRHLQLAISNDEELNKLLGKVTIDQGGVLANIQAVLVPKKKE

SEQ ID NO: 937592 - protein, 56 aa, Homo sapiens
VQKRFGDAKKKPYGRVIPLTLGHDTTKLQYTRTKASMKKQNIERRTLEIYQAKPEP

SEQ ID NO: 937593 - protein, 50 aa, Homo sapiens
TALTALIIATSLGRKLWWASVPPRNGLNIFISPSYKRGGLYTVIFYYEPN

SEQ ID NO: 937594 - protein, 50 aa, Homo sapiens
IIDSMLLYTGRYTAVQQGNHGSDSASGGDHGQRRRFVVDCRTPLGLSRFM

SEQ ID NO: 937595 - protein, 86 aa, Homo sapiens
QIATSWRKIENGQVDTSRGSRLNNGECELPQNQYPKLLEGNHIWFKRGVEEPHDTLTESMKLVAIQEQFRDTLRLTKNLRDASSIR

SEQ ID NO: 937596 - protein, 84 aa, Homo sapiens
TEQRKVLTDTYKLDESEIKLVLFEAAQQFQNMLQDRRLTDKALKYMTDNNVDLRLGAMVTGVDENGVIFKDDSTSPTRFLIRTT

SEQ ID NO: 937597 - protein, 80 aa, Homo sapiens
DRVTVREKERKEKGKGVGKDEEIGKHLQEAESFLKVMRSFTLRNFQAEITISVIPTNALSYLYKHFKKAEITPILTFKRN

SEQ ID NO: 937598 - protein, 76 aa, Homo sapiens
NIDDAKDAMDAMNGKSADGRQIRVDQAGKSSDNRSRGYRGDSAGGRGFFRGDRGHGRGLSRGGGDQNYRNNKLEYR

SEQ ID NO: 937599 - protein, 96 aa, Homo sapiens
DVGVGPGGRCSGRGSRSLMNGLGHPLGDEGTLTLSVHKIWWFKRVWHLSPPPLFLVPAFAMGLSMIPLPSARTKSSLEPPQKLSVGAMLLVQPAEP

SEQ ID NO: 937600 - protein, 37 aa, Homo sapiens
GQSTAAMPCLSGQQPPALRGKGLAGVSEHRGRRTGVQ

SEQ ID NO: 937601 - protein, 49 aa, Homo sapiens
STCGTWLACAARPPLLRVPLDSPDPPGSDVESQAQAGFRGWGTPGKDTK

SEQ ID NO: 937602 - protein, 110 aa, Homo sapiens
DVEVWKSEVCESAGLAALGPNWPDRSASPPALSPLLLGRDPFGATTNPVVLRQVYLESARSPLFLCQSLPSLVSPLVPRLPLLLQFPLMTLGLCPLALSHSLLATLLAIT

SEQ ID NO: 937603 - protein, 137 aa, Homo sapiens
QKLSSSCELLALEEFRWHVEAGVGRQGAEGRQERARAFLLSRLGLGNTRFLPVGVGRACGEMDTPPLSDSESESDESLVTDRELQDAFSRGLLKPGLNVVLEGPKKAERREWLKQCLAEFKRDLEWVERLDVTLGPV

SEQ ID NO: 937604 - protein, 50 aa, Homo sapiens
SLAISTKSITVIIPSSTVIESTICIRPYLMGKISNSHASRALSQSGTPYA

SEQ ID NO: 937605 - protein, 41 aa, Homo sapiens
SKNNHSSEDDDVVMIAIPFLLQHLTTAMGRLLLGQLWQRLL

SEQ ID NO: 937606 - protein, 94 aa, Homo sapiens
FFFSNENKSFLSGRLQTLKAFHNTPQFSNRLQGPKDPLTEIEQQENKLKDTRGPGPHHTNPHFQTGNLHRRGDFFAKATGQHTDQHIAQEPEVF

SEQ ID NO: 937607 - protein, 56 aa, Homo sapiens
MFSVQMASLDPTTVKTPTVHVGPRSAEHLSIKSRLHSQVSVISDEKDGKIGDSSPG

SEQ ID NO: 937608 - protein, 63 aa, Homo sapiens
FRLPGEAQKIDQMMEAFTQQYCLCNPGAFQSTDTRYALSFAIITLNTNFYNQKARDKPDLKRS

SEQ ID NO: 937609 - protein, 97 aa, Homo sapiens
DVGVGPGGRCSGRGSRSLMNGLGHPLGDEGTLTLSVHKIWWFKRVWHLSPPPLFLVPAFAMGLSMIPLPSARTKSSLEPPQKLSSVGAMLLVQPAEP

SEQ ID NO: 937610 - protein, 35 aa, Homo sapiens
MVQATAVTLEYKYAPDSLMQRHPKGHPNTINNRID

SEQ ID NO: 937611 - protein, 180 aa, Homo sapiens
DIIPEGLLNCLGEWKYRQYLTVPPGYCTDFLLCASSSGAVLPVRTQYPFLPYPPRFPPQGQAASSVHYIETLPRGLCWCCGKSWHFFRDGRVLLGSRALRERHLGLMGYQLLPLPFEELESQRVLPQLKSYLRQKLQPWACAGGLKGAEGLMWGSGMRRWGKDDLHFGSLCFDFSLKFLS

SEQ ID NO: 937612 - protein, 75 aa, Homo sapiens
TAITVASPIASSTRHIHREVEPALYFTLNRLTPTTTPPQWDKPTPPPHTLLPANVPYNHHDPLNICKTTLQPTGR

SEQ ID NO: 937613 - protein, 113 aa, Homo sapiens
FGTEVEPNIPQKSITYYSRSNSAYNSSIKSRIHETLSCFPIQQQNEDSTTIQRLSEIRQDSACSEFPYGLSHQPTSTFTSTPVSATRGGCILGLNLTSHNYINNHTIKKIPFA

SEQ ID NO: 937614 - protein, 164 aa, Homo sapiens
MGSGTGGISLSENKRRLSIIDFKQQSVKHRARFSSRTFLCSENWKNKKVYDVCVTPPELETKMNINKGGLVSSSANSTSIMYWSYQRQLAERLGVDDRCKAPAHPTNLTKRQQEYTSNDIRRRDTRRYIIHTARHDGKQQTSQWKLLIWAIPCTNLMSPRSIMG

SEQ ID NO: 937615 - protein, 113 aa, Homo sapiens
PPPLFFFGGTPWGQRGPPLFGVGGDFFPPRGGVFPPRGPPFSMAPPPPGGGKLGGGPGGGGFFPRGPEGGLGAPRGGPSGVSPFFPPFGPRGGAPFFFFGGVFFFFRGLLPPP

SEQ ID NO: 937616 - protein, 36 aa, Homo sapiens
MSEFQTPGTFENVITGTLFTYRAVSPSHWVRNYADT

SEQ ID NO: 937617 - protein, 80 aa, Homo sapiens
FGTEGKLRLQLQFLTRGSVNLQDLAGFQDRWVNLPGEVLVDKSCSPAVGVGEASVLRPSTSPNTSEVSALQCGKRGAERF

SEQ ID NO: 937618 - protein, 40 aa, Homo sapiens
LRRTNIQNATSPSEGPTRIRITWPETTYLAMMNAEDPDAV

SEQ ID NO: 937619 - protein, 100 aa, Homo sapiens
SVDQFTSIFPNLKNGESLWYSVGKTVSVGPGGRRAPPGLPAPRTKRGLECVVSKALNFSLFSIHQWICEMQCRGAGLSLVMSEDMSKAVSTAWNSSYSGG

SEQ ID NO: 937620 - protein, 76 aa, Homo sapiens
RAAQAAAQTNSNAAGKQLRKESRRPQDPFAPQALGLVTRKGGRKPPLAFEERGIRTGLEEALFTTLRVGGNYLLEA

SEQ ID NO: 937621 - protein, 32 aa, Homo sapiens
LNTGIFETVSVGDLTEVKGQTSGSVWSSYRKS

SEQ ID NO: 937622 - protein, 55 aa, Homo sapiens
QHRDDELSAATHKQRDSEITQQKQKKANKKKEEPKQLCGFTPNPLPFTCEPGASP

SEQ ID NO: 937623 - protein, 52 aa, Homo sapiens
HRRGFSSLPLEPPHFPTFRFPLPAFFRHHRRRLLQAVSTEEKESYCIPATQN

SEQ ID NO: 937624 - protein, 39 aa, Homo sapiens
SFCPRSSSERGGQGGGEKRRKERNKSRGGQGSRGLHPLP

SEQ ID NO: 937625 - protein, 62 aa, Homo sapiens
DRSGPSKSITTGACTGGDHDSRTSQAVFPQEGARQLSLIGERPSRGNNTGPGILEGDSSFNL

SEQ ID NO: 937626 - protein, 36 aa, Homo sapiens
EKLQLVTWRLRCGGGGHTLNRCSCSFRVLVVSAKFS

SEQ ID NO: 937627 - protein, 71 aa, Homo sapiens
RSQAVPAQSVLQQFASFHMTDAAVSFGQGTFLGRVELARAIFQDGRVAPIGAGKGFFSRVQAIPTRQIHSG

SEQ ID NO: 937628 - protein, 110 aa, Homo sapiens
LIEIISNAAEYENISIPHRDISEAVGSEGPPQAEITLKFNDPHVKTNLLLQAHIVSHAASPELQSDTRGIPGKAIRLSTAPWSSLTTEGAHPPLQLLDLPHGTTHVVKTI

SEQ ID NO: 937629 - protein, 60 aa, Homo sapiens
TTRFVTKKALCIRVFQETQKPKKRRRALKAAAARKTSKGGTQTALQSIQDTQDSNESVII

SEQ ID NO: 937630 - protein, 78 aa, Homo sapiens
IDGRSHSDVMRPVDYDPKTSDPCKEAGLKFATGDIIQIINKGDSNWWQGRVEGLLQGVSRIIPFPLAAGWRVASMAHS

SEQ ID NO: 937631 - protein, 39 aa, Homo sapiens
VVVNWSPSQLLGVNPTVQGLQSVVRGHPCIKLLAPMGPF

SEQ ID NO: 937632 - protein, 32 aa, Homo sapiens
ASAEILAAYQLLSAPPLHPTPHLSPNKGIFAG

SEQ ID NO: 937633 - protein, 101 aa, Homo sapiens
EPKSRSYASPLLYSQTCRTLVTPRNDGDRRLQNPLKRGLNGNPGLDIDFSTCNQSGFNWSPKPLPMEGLWHLSQPYHHQHFHELQAGPPAVLLTKCNKSLH

SEQ ID NO: 937634 - protein, 51 aa, Homo sapiens
SHSMGQQPLAAQSVYFRAIPICARTYRVSREWARLCPGQGSSLVTAQGGKG

SEQ ID NO: 937635 - protein, 83 aa, Homo sapiens
TIILNNVLLSLLMSYRNSRHQLLTVASQNHTPYPTTQDFIIDIASPLSLSNDSATHPPYRKARHPRKSNLILTMSRLIYIGLS

SEQ ID NO: 937636 - protein, 30 aa, Homo sapiens
MRCYPVEIRECDIFRTKFKKGLKFLNFKQK

SEQ ID NO: 937637 - protein, 67 aa, Homo sapiens
MLVQEQLLAILPEGLRAGGSARTDVIHWLSGGLRAARAALCADWGHDRARGAVVLGPHPVLMKNEFW

SEQ ID NO: 937638 - protein, 79 aa, Homo sapiens
LLLPMGPDVPQANQDVHYFLTYIYTGLSKHVEDAPAFKVLAHLTTSDSLISSKDKRYQPIGLYGHRDGYVASCVSSSAR

SEQ ID NO: 937639 - protein, 54 aa, Homo sapiens
LRRFVTKKALCIQAFQETQKLKKQRRALKLQQQSKQAEQRNPDSPAKAMPKTLK

SEQ ID NO: 937640 - protein, 110 aa, Homo sapiens
TSVYGDFSCKGGAKIDSPGGDIGLSLQRVFTDLRNMDATWLDNLSEPSSVALHPGHFLFTVAGPLGPFYFFRQAGPGIMVDMVQRGWIFLGPLTAKCYPIPRWGGASFLG

SEQ ID NO: 937641 - protein, 39 aa, Homo sapiens
ASAEDTKKVLDSVGIEADNNQLNKAISELNEKNIEDVIQ

SEQ ID NO: 937642 - protein, 99 aa, Homo sapiens
AGFHSMRYFSTSVSRPGSGEPRFIAVGYVDDTQFVRFDNHAASQKMEPRAPLDRDRRGPLVFGTTETRECVRAHSQSCSPEKPWGALSRLTIKQRRGPL

SEQ ID NO: 937643 - protein, 58 aa, Homo sapiens
LLGKISNIVIKDRRGIRGVQGCSCPSQEGRQEEFGVLGNLGILPFGRPAKEVLPSLRL

SEQ ID NO: 937644 - protein, 86 aa, Homo sapiens
GRDTEKTKLNNLSWLALIQLLLPCSSWLLRIGCFNPSVALTGSIKMGNFFASGFYAFNPILGPLVLIPFPQLRSREEGPKGPLCSC

SEQ ID NO: 937645 - protein, 80 aa, Homo sapiens
HRRLKLHRPPLEDLLLGSEANLTCTLTDLRDASGATFTWTPSSGKSTVQGPPKHDLYGCYSVSSALPGCAEPWNHGKTFT

SEQ ID NO: 937646 - protein, 111 aa, Homo sapiens
GHPRQQGRWAQPKSASSANQSHQVHTLARGTALRNQHLVELTEWVKAEIKLLREKCNTVHMYGAPLILKVEDGNNFRVSIQEDTVDQLWTVDSTAASSLMRLSNYYNTQGP

SEQ ID NO: 937647 - protein, 89 aa, Homo sapiens
PPSDTKALVDFDSPVGAREAGHSRVYLPVQSFSAFSVGQGRKQAGPGSQFSKAAGPTRGHSPSPLDTANQKLTRDLLGADAIKTNVGAR

SEQ ID NO: 937648 - protein, 67 aa, Homo sapiens
VALLLANINTQLSGIANAFRTVRQLNDLASYFKGIQAHVIYQMPSTAISWSTYELFKHFLTRPQLEN

SEQ ID NO: 937649 - protein, 35 aa, Homo sapiens
MGTTARAALDLTYLTVAPAVSEGDLPTTDSGSCGP

SEQ ID NO: 937650 - protein, 116 aa, Homo sapiens
MKALGQNPTNPEVLKVLGNPKSDEMNVKVLDFEHFLPILQTVAKNKDQTTYEDYVKDFGYLTKKEITPIISAEIRHILVTLGEKMTEEEVKMLVTEHEDSNGCINYEAFVRHILSG

SEQ ID NO: 937651 - protein, 74 aa, Homo sapiens
SNQRSMESQSASYWVTSSSGQGIPDGHHHMNGYGSHIIKLINANGEAVYCKFHQRTDQGIKNFYVEDATRLPKE

SEQ ID NO: 937652 - protein, 155 aa, Homo sapiens
TNTNSRAGASAQVVLLTAALSAVTGQISAKIIIVISRLTLILFSFSVTAAHDERPLQTTSPTQIGTARLVEFQSHFAGFIATVAKIDSGVFLIHVHDKLAVFIGSGSADMVVNPCVSQQCAVFRTDTTGDGNHLLHLWLNDSDIAWIESQTTFAA

SEQ ID NO: 937653 - protein, 68 aa, Homo sapiens
NTTDSKRRRKPKIATGTETYNTSNAGKKSRRSFDGRRTSGVRKTRNNAVQIHKNGETRGKALETKCKE

SEQ ID NO: 937654 - protein, 33 aa, Homo sapiens
AWRWLQTPEAYMQQRVFRSLAYMRPLSIWAMQL

SEQ ID NO: 937655 - protein, 113 aa, Homo sapiens
GAGCNRLLSWQFCVARLLPAAAAHKPRGGALRLPGLRRRAARARLCARALREPAGTCREGERSTVRRSSNGTQLQPGATRSLSWEIWIGKVDIINYYSHRFVFSRVSRSFSEN

SEQ ID NO: 937656 - protein, 100 aa, Homo sapiens
RPEGRRSPAAWRCQRSEGPPEGLKLPAQNLTMEPALHYPRSQGLGRSRSDIPAHVYLTSSHQALLDSTSDLDYGLSPVGLLVLETNLMQACKWVKDGTRC

SEQ ID NO: 937657 - protein, 93 aa, Homo sapiens
KIKNGLKTPNRKQQEDFDNRLVNHFVEEFKRKHKKDISQNKRAMRRLHTICKRAKGTLEYSTQDNLKIDYPLEGIDFYTSITKVRAKELCPIY

SEQ ID NO: 937658 - protein, 74 aa, Homo sapiens
IGSYSWSSLKKTEGIPGVLSLPNWTCNRDRIYCQGLSKLSPSTSGPHSHDYLPQEREGEGGLSLQVEPEWRNEL

SEQ ID NO: 937659 - protein, 93 aa, Homo sapiens
MDASVEEEGVRRALDFAVGEYNKASNDMYHSRALQVVRARKADRSLGGTTSLDVELGRTTCTKTQPNLDNCPFHDQPHLKRKAFCSFQIYAVP

SEQ ID NO: 937660 - protein, 84 aa, Homo sapiens
ETIINNETPKFQVDLSLVEEMFLAFRERVNASQEVEPVEPENCHLIEELESGSEDIDILPSELSFISSELKYPGMPNFAPDEPG

SEQ ID NO: 937661 - protein, 97 aa, Homo sapiens
RRSAVRSERSRHLLHTDAINGYRREKRCLPRNLPVWLSLARCHEGSRPCELDTDHESLGGVIPGIVCMLHFCQAQGGWVPWVPPSTTWGPKALQAKQ

SEQ ID NO: 937662 - protein, 87 aa, Homo sapiens
TLNGIPKFPLASIYLCCDFNAEMTWLSKASSLEVCWLKADIFKFVGNNTKLTSFVNDVVLICFEEDSLLQYIDLFIKRFPFGRIDAV

SEQ ID NO: 937663 - protein, 32 aa, Homo sapiens
RFFSILHPPKGEGLFPREKERGEKGKKPNPKP

SEQ ID NO: 937664 - protein, 36 aa, Homo sapiens
IQLLQADSLQTWTEFITPGAEKTEHKGVHKSRALER

SEQ ID NO: 937665 - protein, 68 aa, Homo sapiens
RHRGTWFLAAAHFGDACKARSGGLHGSLPMRTGSQFGLAGYFARNRAEVSWKLLEHKYVARGSCQTLP

SEQ ID NO: 937666 - protein, 140 aa, Homo sapiens
PGRGAPHFSDGAAGQRRSSHPGQGGRAEVLPTSQTMGSRGRDAPHFPDGMAAGKRRSSFLDGMAARPEMLLTFQTGQPGRGAPHIPHDGRPGRDAPHSPDGVVARQSLQSRHFGRPRQALGGEFVARRDTPLTQPWHIDT

SEQ ID NO: 937667 - protein, 65 aa, Homo sapiens
ATAELTPAVHAFLGQVFGFCEPFTDLQTLLSRSLGSRSSCPLDPTGPPPLLEPALPGLGIKFKRV

SEQ ID NO: 937668 - protein, 93 aa, Homo sapiens
GYSITSTKCTVVEVTPCQTSTTTLFPPVTSLSVTVRRMRVESSISIRAKSFPYAEITELPSFIVYDTVAFVGGRYQAVGISSFLVLKGSQQIS

SEQ ID NO: 937669 - protein, 85 aa, Homo sapiens
QPRVQEDEPLWPPALPGAQRPGFQATALFLSTPIPKPVPGLTNLKREPELEQDQNFARMAPAPEGPIVAVPTPGWGLSTVRLTPI

SEQ ID NO: 937670 - protein, 35 aa, Homo sapiens
AFARPLLEDRGDSTQTCAGKGDRGGGGFRGNRGLQ

SEQ ID NO: 937671 - protein, 122 aa, Homo sapiens
FGMRCSPPAGQAGARHLESYDIIANQPVVIDNVRPGSQGEGGRPPRGRRRQAQSERPPPASGVLRSLRGRRPRRPLVSSGGSAYLVFVRRPWGEPLAGVAEPLPRPLPESGGEVQESLSDSR

SEQ ID NO: 937672 - protein, 65 aa, Homo sapiens
MTLGRNSARGVAAQGSQFREVGAPGPQPARASPQHPARAFPAATMPKRKVSSAEAKEEPKRRARL

SEQ ID NO: 937673 - protein, 60 aa, Homo sapiens
AAQSLGKKFVPVVRRVKAHTRKPSEVKLRFVVVETTTFSAFLGDGGVRKPYGPKNPGKLA

SEQ ID NO: 937674 - protein, 69 aa, Homo sapiens
GHCWDQWCHGASEELFGLKAGSVPKSLHHHVGSHLAPQHSGQDRSLLSAHQTSCAALQTPCSPAIPTHF

SEQ ID NO: 937675 - protein, 94 aa, Homo sapiens
SAAARKQRDSEIMQGKQKKANKKKEEPKQLCGFASNPLPFTYAPRASPTTLAFPPVALTGPSTDGIPFDLSLQQAPFVLPSPQAASFPLGHSRG

SEQ ID NO: 937676 - protein, 102 aa, Homo sapiens
KETVSGWRDCYTVNRYPRPSSCFLGDMASPERLHLTCVETIPRRKGAPMTHTSTVKGERSGVCFLPVLLFLPHAPPRDSIPIPADIRAPVKSKLWVDPDINL

SEQ ID NO: 937677 - protein, 85 aa, Homo sapiens
GFDPVKATVAVDPDTGTKGGTKGMSSLSWVHWVSDAGNIYSAVLKRLQICNRQLVEELGISIEELRHFIDQELEKMALYSHARSS

SEQ ID NO: 937678 - protein, 30 aa, Homo sapiens
ACTDNAQNSRTSPITYPQQHRRRKQNKLKP

SEQ ID NO: 937679 - protein, 95 aa, Homo sapiens
MHLLPPLLLLPFGAGHAQGIEAPLGPRTLGSQPLELKEAFKVFQIQLTGVTLAQKSILTALDIFAHNLAQAQRLRRRTWHNYFGVTPFSYLTKEE

SEQ ID NO: 937680 - protein, 74 aa, Homo sapiens
MGKKQNRKTGNSKTQSASPPPKERNSSPATEQSWMENDFAGLERGSGNRSPGAAPHTGRRGTLQTQEATEVENF

SEQ ID NO: 937681 - protein, 151 aa, Homo sapiens
RHWARSDSRLQARGTVALPVPEGQRDTCSTAIPYTCEAPYSPQAPYTCNLPSPTRSLHLQGPLHLQLPYTCNLPTPATSVRLQPPFTYEIPKPATSLHLRDVTPAEALAEGGAGGAFANVLGPLSAACQSYQPLGHLPPPSNGFSMQSLLG

SEQ ID NO: 937682 - protein, 45 aa, Homo sapiens
ERKVPDVTEKKNKKLQKASAEATAGPEAAPSDEEPAPSIRHSTNL

SEQ ID NO: 937683 - protein, 95 aa, Homo sapiens
MKFNKGIPTWAPFNPATQITKQKWKAEPVYAQRAKAYLKEGRPSTLLKYLKYSKNIPNQQAPSYAAETNHQASGAKKKLQCKLATYIQNKLTYTG

SEQ ID NO: 937684 - protein, 45 aa, Homo sapiens
FVAAGFTTFDLISRMSIDDIRRIGVILIGHQRRIVSSIQTLRLHM

SEQ ID NO: 937685 - protein, 34 aa, Homo sapiens
MLGQCRSALHALSSVVEKECDLSPMSASLFPDIT

SEQ ID NO: 937686 - protein, 70 aa, Homo sapiens
SNRRSMEFLFTKNPDVLFRKAHTHILQTRKINSEVNAITNQLLTITSQEVTWTNWLSGPSYRLSVGRKNR

SEQ ID NO: 937687 - protein, 37 aa, Homo sapiens
MDYLETWTPKADQLEICTVHSTPRSHTEWKAALSSPQ

SEQ ID NO: 937688 - protein, 64 aa, Homo sapiens
TSVQLEASPAFLAVPVKKKQAPHCIYATKRQTVGLGSSLKVITKCESHRKHKNVRVLRTVFGKQ

SEQ ID NO: 937689 - protein, 56 aa, Homo sapiens
KTILIILTDATGKRVVFLKQLAVAYTRELDLWQLSSSTKTTPEIVIATSTEILQCK

SEQ ID NO: 937690 - protein, 39 aa, Homo sapiens
RLAHKCTELEEHPLNPQTKPINELNRPVRSKQGQVIPLR

SEQ ID NO: 937691 - protein, 30 aa, Homo sapiens
MSLLAATTCWLAERGADASELKLQQTVEME

SEQ ID NO: 937692 - protein, 103 aa, Homo sapiens
QRDRYRLDDGRRVRDLDRVLMGYQTYAALTLFDDVQGHTHGQCHPGHFGEVQWRLDTAGIHAGVSSAESREKLIPLARSGGLCGVTAVELTASPGTASLSCPA

SEQ ID NO: 937693 - protein, 61 aa, Homo sapiens
SLERNGFHVRYSCFTPPSVTVTRLSPYTDWPGTMLADQRVLRPADEEALVPVRSTDTTMAP

SEQ ID NO: 937694 - protein, 71 aa, Homo sapiens
VTKTEAKLGTFPRALKKLLHTINAPCSLASLLPRGHSKPATEPPFCFEPKTTLLDAVKGLSSDTLITVTRG

SEQ ID NO: 937695 - protein, 49 aa, Homo sapiens
MHATRGVTVAEMTDPRPRRLSLLGYCYYRLQEFALAAECYEQLGQLTRN

SEQ ID NO: 937696 - protein, 107 aa, Homo sapiens
GAFDASSLSQQKEKQVIQEMNGEGDEDIVSRRPARPQPLVRRKMTGSRDLNRTFTPIPCSEFPWHRPTETGPLSVNAERSVVGLCYGGFDPFPQGPSTDGFFLHVGR

SEQ ID NO: 937697 - protein, 81 aa, Homo sapiens
RPTLNGIPLTIRSSEVNKTAEDKLPECEAVCGKPKNPANPVQQIMGEHLNVKASFPWQARLVYHHNFASGVTLINEPWLLL

SEQ ID NO: 937698 - protein, 45 aa, Homo sapiens
TPHAQMSTLYASLQRTSGDRYLVCQRNQTMPAGSPDLDSQAKFAS

SEQ ID NO: 937699 - protein, 43 aa, Homo sapiens
IRFHYVVQAGFDIPISMIFLLRLPSVEIASANISSSQGGLHVT

SEQ ID NO: 937700 - protein, 58 aa, Homo sapiens
KPLMLEAVFTLTQTWGCRVLQDANRKRLLYNRKGRSEIMLMSQKHSEAVFQTSYEKKK

SEQ ID NO: 937701 - protein, 121 aa, Homo sapiens
FLSPLLFNIVLEVLVKAIRQEKEIKGIQLGKEDVKLSLFADDMIVYLENPIISAQNLLKLISNFSKVSGYKVNVQKSQAFLYTNNRQTESQIMSELPFTPLVSCISKNFIVFVAIVKLSSE

SEQ ID NO: 937702 - protein, 109 aa, Homo sapiens
EFHPSQLHSGTIKQSCVGLYAQTPTELVCLIGDTDIELSSCRKTFPPGTRVTRAFITHAASHGVYGSMCNVLTMMMMPLLFDQMGDVNRMKTKRAEVALNDLKMALGLW

SEQ ID NO: 937703 - protein, 90 aa, Homo sapiens
SEVVLKTPDKNVIFSPLSIFTSLAFLSLRAHNTIMTEILKDLKFNLTETFEAETNKNLWHLLCTLNQCSCELYLSMGNGQPRSSALKVCR

SEQ ID NO: 937704 - protein, 48 aa, Homo sapiens
TLLLLYEPRQAQRVAHADVFAPVKPMCRLERVSRCRAMGQCADSRTLT

SEQ ID NO: 937705 - protein, 73 aa, Homo sapiens
PSQTIIALLLRGQLFAVNSGNDATDIADDDCPKPPEIEHDYVELSTRYYVQELLQTAYRRRQSTILTVGVVNK

SEQ ID NO: 937706 - protein, 101 aa, Homo sapiens
FTGIFFLGFCEPNSFPTIRRFRLFQLKEFLNFYTQKTSPGLPHPFSRPNNQIPPHSDSSKPRVQTTLKTSDFHFAFQIFSKDFPYSPPNFRFVRPRNFHSQ

SEQ ID NO: 937707 - protein, 40 aa, Homo sapiens
CHTYWAVSEDCSQQRDWLMGGPKDKEGGVFGLGAFIVDLI

SEQ ID NO: 937708 - protein, 91 aa, Homo sapiens
TVCIRGTTPSHYALIQLSVIQLPQNSITLLVLIIHLHKMCILSRERSTYRFSSSDLHYVLGHLSYEQITLDNIWNRLCSSFRRAMSRNIRY

SEQ ID NO: 937709 - protein, 126 aa, Homo sapiens
VAQVPTDPGHFSVLLDVKHFSPEEIAVKVVGEHVEVHAATRSARMSTDIVAREFHQSVTACRLAWNPAAVTIRADPPRRSCPYQAAHSDRPGPTRQPQLKKGGGLAAPENAPPQAPSIKADLTPPK

SEQ ID NO: 937710 - protein, 88 aa, Homo sapiens
DADGNDTIDFPEFLTMMVRKMKDTDNEEEIREAFRAFDKDDNDYINAAELNHTMTNPEEKLINEEVDEMIKNVIDDDGKVNYPALAQM

SEQ ID NO: 937711 - protein, 87 aa, Homo sapiens
EKLAPGTINVLSFLFTQQHVGDPAADGEHTSDSGHCRVLYHFTSAAGGSTPILLISSTGPFGTVDQTQVIGSRNADHSTVSYGTSGV

SEQ ID NO: 937712 - protein, 82 aa, Homo sapiens
ATNLMFRRTLTDRYHPTDHCTLIGHFPLTGHYHLTGSPLIDQFHLTGRTCAPHLTCALLPTCVPHRTRVPHNPKTHTYSDGW

SEQ ID NO: 937713 - protein, 181 aa, Homo sapiens
LPFQPQQLLPASASSGGPGCVGTGTRTRRPHHYSTRAAFAVAPGSCIGRALHLKENATVRASRTHARCPIKWKTKTHKVDHAWERLAHQVRNGTRIRLEDKVRSRREPGLSSTAGFSGSRWPTQTEGHDPRINGCSRAAWGQGTRVLNVPCPLRTHLAWTAGTRFPLGLGASVGSTLELGR

SEQ ID NO: 937714 - protein, 79 aa, Homo sapiens
SQPCFARWALRYILVNYRESTGFGQDSILTLPGNVGHQDEKDVQFAVDKEHQEEHIDASHVDLMGGSHGGINTSHMIGQ

SEQ ID NO: 937715 - protein, 84 aa, Homo sapiens
DSVLLLHLSLDPVHVVEHFDVEAIAPAAPDAPGHNARDTQRSVLKSLTAKTPPLSPWQASCFRDGCPAQNTPKHTFTKPKQSGQ

SEQ ID NO: 937716 - protein, 157 aa, Homo sapiens
MQTGLTQHSGWVRAGTQIRAACPGPQLPHIVGSEFHTHMQRSHKVSQTEHSAAWRWQARVWHCTRQEVRAGSWQEVGQAPHLIRPVLAEAEHRPDPGAGLPAPSCWLADGITQVVTQRLLGVGEGEMLSVLEFAEMAASAVILCFSPDPEEDEGAGL

SEQ ID NO: 937717 - protein, 46 aa, Homo sapiens
MLKKTELKKKCSPQPVPTKGEKKQVAEELCGDGEWFLPGPKGCTGH

SEQ ID NO: 937718 - protein, 73 aa, Homo sapiens
DDESLKELFSQFGKTLSVKVMRDPNGNPKALALSVTKTRGCNKAVEEMNGKEIVVNHICRRAQRSRRSRVKRI

SEQ ID NO: 937719 - protein, 93 aa, Homo sapiens
STTSSIAEIYETELMDIEKAIAHYEQSADYYKDQESNNSANKCLLKTAAYVALPEQYHKTIDTYERAEPTPCTVLSLSTMSAANSGSCIHATL

SEQ ID NO: 937720 - protein, 118 aa, Homo sapiens
SRGVSSAPQQIPALPGAATHTGFQRHGVLCLLQRRRQQRERRLQPGRVSQLRARDRSEKQRRETPARRTARTLHSAHVASAPHTAAPGPLLPHDVVFIICGVENITQLPQELPQMMAA

SEQ ID NO: 937721 - protein, 64 aa, Homo sapiens
EFVSTLTEATQLLILYHESDELTIGQKKTTGIHGRQSDKVTNSQMMVISLRTSFLDSLRRREVS

SEQ ID NO: 937722 - protein, 97 aa, Homo sapiens
PSPSTSFPRGVQGAPPSPTALSFHGGHQGPWNGRGQSSRPSFNDELQSTVPSYLPAKSQGLGRLGHQIARSRMSDRLGPWDGQRTSNLGGFHSLTRS

SEQ ID NO: 937723 - protein, 40 aa, Homo sapiens
ELRVRHVVEQVEQIQKEQNYQRWREERFRQTSESNNQPVL

SEQ ID NO: 937724 - protein, 41 aa, Homo sapiens
NYSPRFLFLDFTFLVKLTDGSETLSDVLFEEHHFQDSAGLP

SEQ ID NO: 937725 - protein, 85 aa, Homo sapiens
GHGRVPVDVAAQFRRVRRGVSVKVSRPAAAANSAPGSSLAGDGRAVYGFGVGLVASKIHTSSFASEVRGNFRSLLAFATPSSRTE

SEQ ID NO: 937726 - protein, 71 aa, Homo sapiens
GRFTDAASQLAVLPRKITENYSQTSKQGIYFRKINPTEIYPNLLIQIWIKVSSDTFSSDFRIFIKICSRWI

SEQ ID NO: 937727 - protein, 105 aa, Homo sapiens
DSKAINSVLKRICSDVEVVSLIKQLTKYVFSMFAQTAQLRDDSRKSTMGTLQGRGNPLKARSPNSGLNCLLTKLGHIMYRNLVQEDPLSSITTLAQLSVVVNSNQ

SEQ ID NO: 937728 - protein, 55 aa, Homo sapiens
VGSSPTSALFEKCEANGAGAPLLSTFLREALQALSDDATIFCPTSGYYPNLQCHR

SEQ ID NO: 937729 - protein, 122 aa, Homo sapiens
MATAAQFAKARSGVGVVGATPPGRSANGGLRTAERGNGDVKPVVSSTPLVDFLMQLEDYTPTIPDAVTGYYLNRAGFEASDARMIRLISLAGQKFISDIANDALQKCKMRGKAPEAAGARAR

SEQ ID NO: 937730 - protein, 47 aa, Homo sapiens
GQAQDPDGQSLAQGPFPAVKHRLLPQLLGTGSRPEGDGVLVLQRCFD

SEQ ID NO: 937731 - protein, 58 aa, Homo sapiens
SHQCVGYAITYVHEKNGENGSMRMSVHTHTHTYTTSLHMYRGSEIPPILTNYKRNSSR

SEQ ID NO: 937732 - protein, 62 aa, Homo sapiens
MQPALNKIQPANSTSNNHKTSHTKSSHHYSIKITRIFHRTTNSNCRLLQRHPYTKNATYNTT

SEQ ID NO: 937733 - protein, 52 aa, Homo sapiens
QAPNDLFCSIKRRQASPKYHHWDILGPALKPNPHNLKLNQAKGNTVTQQQGS

SEQ ID NO: 937734 - protein, 134 aa, Homo sapiens
SCMLCVPFCSPALRACGPPIRVCSWGGSYLHVPGGGLVSLLIYLYRLLWGCPTPLWVRLAGRLFSLLLQHVFLLTSSVWLSCVCPPYLVARTRAVLGGRPAQHFPASYHVVSPSPSPVCVASSGGVLAELLCRP

SEQ ID NO: 937735 - protein, 101 aa, Homo sapiens
QIQVFEELLTKCKKKILWPQQLHVRHVAIEQLKNCSKIPCLQVGRTGMKSHLPINNCPKQTYFDALPFIGLPDMQTLKKLKKVVAFYGIKFANIGSITLLQ

SEQ ID NO: 937736 - protein, 172 aa, Homo sapiens
SGFVTTKVPFPRTLRFKPMLQQGIELLTSDPSWVSSASWYFLNVFGLRSICCLLLRNGPAGGRPRMMQEQMTGASYAMPARQRTTLSIQRREAQELAGHQWALDAAGEDAAMTNALHFEGAFKMDGRSCTVGRPARDGVCQELGLAPNLETTDRAGSALEYQWLMLELAGMQ

SEQ ID NO: 937737 - protein, 150 aa, Homo sapiens
LGWGGAVSSEVICWSVLVASTRAGSVPHPPPVPVLPMSLRPPLQRPGSPGPSTRPPPRRESLGTGKFWALSGLGRIVGLLHLQLQDPQAAPGAHPQLRERHGFNARSGWSRAASVLPKRGPGRGVGIGPQQARAPPRRYCALRARMPGGR

SEQ ID NO: 937738 - protein, 120 aa, Homo sapiens
VSLTSHPTLRFLASASRRAPGCGCGRKWGSRSGRPSSRQAGQCRETDPLRGSAERGPGGAECQPLRFHLVPPVLPQPQTPPHLGCHQGTLQAAGTARAPGSLPFPANLDQVDLVLQGLTR

SEQ ID NO: 937739 - protein, 52 aa, Homo sapiens
APGAKLLTGAERNHGGKRGLEAALAHYTAPSRVPALRLNRRPARQLLGSTAA

SEQ ID NO: 937740 - protein, 149 aa, Homo sapiens
PVPAGPLSVPPLPPLPSPRWPLAPPLSLCSSPPGLPPLPPPVALPVLCAAPGAAGAWWRAPVVASSAAPPAVTLRSVASGGSPRVPVAVLRPLRSAFVPLPFPGAAVLLARVLPLSAAAPFSPAAAAALRALPGPPALLAPVPRSRPPG

SEQ ID NO: 937741 - protein, 82 aa, Homo sapiens
PISGGRSGSHTSEDYHRGLCSLRPAERMTNIIQASPVLTLQGSEDSGRPHLNPGLQQHPPLLAPESREGAKGKQKQALVFLQ

SEQ ID NO: 937742 - protein, 101 aa, Homo sapiens
SRTDLTTRTAMTREMEKNSFKMPEILDKLKAEREHSITIDISRRKSETNNDYMTIIDAPRHKDFIKNIITGTSQADCAALIAVADVDEYEAGIYKHVQTRE

SEQ ID NO: 937743 - protein, 102 aa, Homo sapiens
TGYVMEPPVICLCHKAEFCLCVQFHHLRLLNSRAENQVMHLQWEVYPKITDLVGEWKRVRTERLNDREQMVLTGGAGPGECTAKDDVTHCQVSMTGTTVTKP

SEQ ID NO: 937744 - protein, 99 aa, Homo sapiens
CIGTATVHRCLTSSLSTSVFLVSSEPGATYTLESPRLGPGPAAYTLESPTLDPGLAVSGGSHVGSGYSPGGVSRAVLAPPLEPLTCLLSHPVLLMQKYR

SEQ ID NO: 937745 - protein, 66 aa, Homo sapiens
PHTLKGCHLSSKNSSTKAFLRRSGEKPLKQFTRNPGTLLFGLGTLTNGPKLSAGDRHPKRRIGKRG

SEQ ID NO: 937746 - protein, 151 aa, Homo sapiens
EAFQKGPQKVGLYRIKVPSGKKTRGHGPLQSGGGATSTQLGGGRKQDQSGKAEKRETEWGCAAEENDLRAVGKTSFHNGRILSPPVLTGEGAPRRPPQAGDQTPPLLWRRAQKTIMLSRPPPRQNILDNEATQQGNPLHQPGESPPRAHHS

SEQ ID NO: 937747 - protein, 101 aa, Homo sapiens
EIQAELVSDGDEELVGNYKSCSYYALTKRLAAFCPCPRDSETLNLREIIVGCLVEDISKQQSIREETEHESLENLQPDNVIEKEKPIFWGEIQASCRNLHK

SEQ ID NO: 937748 - protein, 83 aa, Homo sapiens
FQNPSKPKNRSPSPLPPPILFYPLPPSPPPHLFRNPKHPLYTGFATNLPPNYNTISPKSKPETNTSNHTPPGPRDHSFHHSVV

SEQ ID NO: 937749 - protein, 90 aa, Homo sapiens
VEAIQWDGSVSEVWIGKLHCNDQSFYCSTNPTLAYLCHPLDTKRYLPQGGKNECGWFLQGRSTLQLTGNIQEEQRTPYPDKELIVYHASR

SEQ ID NO: 937750 - protein, 85 aa, Homo sapiens
TIERLVVQGQSTGYKEPRCDTYPRELSPQLGFDVGGSVFHECMFEKVSTIADLFHLLKVHNSNFFWALDSVNPGLLKHSVCALFA

SEQ ID NO: 937751 - protein, 109 aa, Homo sapiens
VTTNAPWTHANTNRPSGVLNINTLSVHHLQKSFSAESRLWEASETSNRRAALQTKLLQKNFSDSSGLGYHKKIHTEEKPYKLSPRKVSSKDPTTADITGLALKRNFMQV

SEQ ID NO: 937752 - protein, 66 aa, Homo sapiens
MTSTQILLLNGAKALHGGGADCRKTEKLKPHEVLSKRGYEPPRATFQAYQTTQDPNNKAANEGRTI

SEQ ID NO: 937753 - protein, 71 aa, Homo sapiens
MSAKCAFQDSVRGREDVASTEMIGMRKKSSETNTCLVCYKAGPVVRYDNGCNAGAWREQTTYFNQCGDAVI

SEQ ID NO: 937754 - protein, 86 aa, Homo sapiens
MKGGKLREAGHLLFQTWSLCFEEKARTPESKHPRPKKAKKDVHQPPLNASLPRIPDQREKTNSRGKLWGLPQDNARRYLNPRKNLF

SEQ ID NO: 937755 - protein, 94 aa, Homo sapiens
AAIDRCVPTIDADKHTGKVEAGWAQCNAATRYKGWMYWKCRKAWSAHNHENALKLSANIGTPAGSLRAVDLRRLHDDLRDVLMDGAAGLKRLGE

SEQ ID NO: 937756 - protein, 178 aa, Homo sapiens
AEGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRR

SEQ ID NO: 937757 - protein, 55 aa, Homo sapiens
MFHTVQSPINHSDNIATTAKYANPLSTRALSRRRTDVAHVENIAIMGIPRESLTA

SEQ ID NO: 937758 - protein, 54 aa, Homo sapiens
GVSESHISVQGCEVLSESRREQVGVGGNTSRGQDSKTSLFVSTDSNLKTTATQS

SEQ ID NO: 937759 - protein, 42 aa, Homo sapiens
AAHHLVHDHAQPPPVHCTAVVIVFKHLGGQVLQVCRKKVLGG

SEQ ID NO: 937760 - protein, 107 aa, Homo sapiens
MGMVGSGGFPPRNSLPLACPKDSFCAGNLSSSCKQESVGLCLCLPQRGLGVPRPASWRTDEGTRAFLLSCNDPALCCRDKQLLGLPDCLMLVKRDSAVSANKKVKIS

SEQ ID NO: 937761 - protein, 105 aa, Homo sapiens
MALGVHRAQVGSNPRVCTFVWILNTDLKGRLPGYLIHQSLRAHRCFEFAVSPCRRRESSEAWEARGVNCGPLPPLRARVLSPPLPEPERVPVGLRAAHMGPGPRL

SEQ ID NO: 937762 - protein, 137 aa, Homo sapiens
PWAPGCQELERKEPPEGAFWKVPSATDPIQLRPLPKVPPHQLGLDPIPSILAWLDPEDDRPIKEQPRKTENVSRTRSPGRPTHRCAPSISGCKTKGLAGGDRASRPLSARSEPSEKGGRAPLSRKSSTPKTATRGPS

SEQ ID NO: 937763 - protein, 106 aa, Homo sapiens
YPPGLLIAFSACTTVLVAVHCLRHVSTASANIERGQRDNLNSVKESPMTHDRYMSCLGFSTVIGTLLFLAEVVLLCWVKFLPLKKQPGQPRPPASPPPVGTANVST

SEQ ID NO: 937764 - protein, 103 aa, Homo sapiens
VVPGRVRLGVIGLLLGRPRGEHRHEGYTGKRTERPARAPVPVDPESAELSGQGARERLGKHGPVPLKNVSQGAETTRDGEQAEAKGEALGETDSERTDENRPL

SEQ ID NO: 937765 - protein, 141 aa, Homo sapiens
QELETQHRQLAPKSLRGTGRWHMLEAARFRLGASWRMGPHFPVDPSAKQGMPLGRIQGKSSSRTHHPPPAHCPCTAAGTYCPAARVAAAYGFSPEGKLEAHGCGRPAAGGPGATPAAEVTVGKVERRHELLHPLQRGAPVL

SEQ ID NO: 937766 - protein, 104 aa, Homo sapiens
RGLAGVVLLELTAPGSAELWGPGISGWTGVVLRRGAAGWTGLLSPDRSRVAAPPQGSWDGGIRLSDEGFGGRAPLCRSAEGGPNVRRVALRRRYPGDEPKKKNS

SEQ ID NO: 937767 - protein, 75 aa, Homo sapiens
LGGSSRPSGAQDVPAQIEGRQIEQFAFDEVEEVEDAARSAVAIREGMNGFEFDNAEMAMRISGSDRVVLASDRPI

SEQ ID NO: 937768 - protein, 113 aa, Homo sapiens
ISEPEGTIQTYFLLGRVQPNPLHLAPQEDCLGTTPWPRLSWDLSSPSIGKGRSSYSMTTTTHESSRVITTGGPCCPPAAQSLEPRLNGTDKSDLAITAFSFCFLFSSFLLYIN

SEQ ID NO: 937769 - protein, 80 aa, Homo sapiens
MITSIVAAMEADHLGVPRLDTITFLSNFSAWSPSWHSPEVLLTQFNENLTYLASQGRLIFSPHPVISDTFDKLLTTTKSS

SEQ ID NO: 937770 - protein, 69 aa, Homo sapiens
AAVTNVCRQQGYSVFPARAKTTAFTMEVPPLWCSGFSDRFYFSIRNAFFSICIVYNSSFLTSNPYLLIY

SEQ ID NO: 937771 - protein, 74 aa, Homo sapiens
SQATGRRLLCASLLQRLGVSGSYGDTGDERTCQAGGPLKSVYSDAGSPSPSTCTDIFSVVVSECPYNKPLRFVL

SEQ ID NO: 937772 - protein, 56 aa, Homo sapiens
RDNSRVPQSVLEMSLSPHTWAAPALQMTKRRPLSTRAGGVKRQYSSFRSCCFNLND

SEQ ID NO: 937773 - protein, 116 aa, Homo sapiens
AVDPVQDAEPAGRLVKRSSRLTDSVAAPNTYSICPLTPTSKSLRHCRMGSPGRFSPIASTRFRSGAFLHVVMRPVDARDEGRACDRRAVVGVLSRPAPPSRSARCFSPSGVSATCS

SEQ ID NO: 937774 - protein, 80 aa, Homo sapiens
CAADMPPCDLGAGGTGQGSSQVDLLKDILLPPGPGVSTKPALSRTPRRRRPTEPVRLPESPAPRLDEALACDTCDGGCAC

SEQ ID NO: 937775 - protein, 73 aa, Homo sapiens
RILGQAAFDLTLVMPVADSLARIFSAACRGARVLVLDLDNTLLGGVVGDEASSLVVGEGGAAARLTGRQRVLD

SEQ ID NO: 937776 - protein, 46 aa, Homo sapiens
MAQSLSQEKMLADWLEWEAWWSQELPGKLWHSRESKDYSIPESRER

SEQ ID NO: 937777 - protein, 65 aa, Homo sapiens
AVRAGSDVLLAVQVGLRTSFVALETERSLDFETCTGRRQRWHSIPSTVRRADAATPAVRAGRASS

SEQ ID NO: 937778 - protein, 209 aa, Homo sapiens
HRMSALVQVQDRDRGQPASVQWSPGVPTTGAASPPLHMLAKGTELPYRLPRVWLNAAALVLYGPGVLRTDSNLTPGPLSFLDFLRERLLQLWEAWSSVSLMMTTSNRPGSLLLSMSAWAAAAGFTRLSSVSVLRCRAAAPARAVKAADERCEMERRSVALMFRTPCRSTSSTQMRFMACTAFSGTLLVPYRFPETRHARLSRPLLCHAA

SEQ ID NO: 937779 - protein, 120 aa, Homo sapiens
NTTRPYHSLPSEAVFANSTGMLVSAFGVLVLYILLASSWKRPEPGILTDRQLLLQLRPGSGFPCDLVSVTEQPTNPGAVSKNRACPMSHSDEYTEVAVDFLYFSLLDQGLLLPLAGLACS

SEQ ID NO: 937780 - protein, 172 aa, Homo sapiens
SALSPVPGSGSGSRATAAQDVGPPAFLPGPHVAGRLLRVARMLLPWPPLPPPWPALVVLGLFGLLAASSPRVCSSSASENQTCRDQEKEYYEPQRRSVARCPQTYVSAKCSRIRDTVCATCAENSYNEHWNYLTICQLCRPCDPVMGLDEIAPCTSKRKTQCRWQPGMFCAA

SEQ ID NO: 937781 - protein, 151 aa, Homo sapiens
SGKKQPFCDGSHFFQTRLALVSTIKFEGPSRPSMVGSSCTVQSTRREAPRSCVWQPTGSETLCRKAESGLPSSEGAAAVQPQVLGPGLCQAPPSVGKETGAEPKRLWYPLLAHEGRIIPYNLKVSSLGQAGVGPGSMFADGEDGKNKPAQP

SEQ ID NO: 937782 - protein, 91 aa, Homo sapiens
AAGIRHEAHSTYALQIPEFWMGVTGHQKRIVECVGTINLTKVWVQLRTPSTLRVCNKASIRDKFAPWACTRVRVGHVNGIPVNGQTLAHWY

SEQ ID NO: 937783 - protein, 97 aa, Homo sapiens
GHMRIVVGCVTHFIRSVRLSFAHLCAHAHRVQRIQHHRRSGCTARLEAALGVAVGVVEAIVSYERVLSSRPACGRYLGVMRALSSRHLEVSVEQSTA

SEQ ID NO: 937784 - protein, 79 aa, Homo sapiens
AGIRHEKKLSKDRMKKYMAKEGKIVAKEKPAANCLVGALGRTPFIAIDLGLQCQGNLNRVTNQPACETRSVEDVSKLLA

SEQ ID NO: 937785 - protein, 123 aa, Homo sapiens
RAGLLEVTARSRCREEDAAAALVPLAARCAQLGLIRPLCDEGATLTQLVRSLRERLLHNQWPSEWPTIDERFLSAVLPRPNRPSRQSIEVNLDSGERMGRAVPPTEHGTSQLMAAVDRGGERP

SEQ ID NO: 937786 - protein, 76 aa, Homo sapiens
CRFGTSCRSPITRSVVSLTAENTAITRPSSSGSGVRIGEVRLLQIAVASSYSDSFDQVACRAQHLQLGADECQMAH

SEQ ID NO: 937787 - protein, 62 aa, Homo sapiens
AGIRPTEETHSYYSHSREGINPPLELQPMSLIKEKPTENQIISSHPAYYTIFIVGFITLSTR

SEQ ID NO: 937788 - protein, 82 aa, Homo sapiens
PRAARIRHEHEYHNQIGTFASGWSSSGGFIATWYVPGTLDRPPVTSISSKKELNPCWEGMEWLNENCWSSDYRCEACSVLET

SEQ ID NO: 937789 - protein, 76 aa, Homo sapiens
AIPTPGGIQSETGADTIANDQDSTRRCFWAMHIKARQQLKNHTRIGFSMGASILTAKNLSKVFQREVTDYLHDSAD

SEQ ID NO: 937790 - protein, 113 aa, Homo sapiens
PELSTYACFCRQYYDGGCITPRSLLTRKHSVFSPLTGAFNNWARGHFSQNGNGGLPVQLGPGTVEDQCGAFPPKGKSCSEFHNTQGAQYRTGENAPCYAEIIVARINLGATSN

SEQ ID NO: 937791 - protein, 119 aa, Homo sapiens
MLAFHEKSCWWHLSAQLFAVTQHNEHTLANDVRTKRLHQCRVWTHCNGFCATVQHVHSLVIRRRHVTFYDGADLAGTCDPMAPAMAPCTELAEASSSFTDQASTFVSALSQAGTKGVDC

SEQ ID NO: 937792 - protein, 113 aa, Homo sapiens
VDKRHWLALDDDNGYGVSQPCRKNRLGTVAHACNPTTLGWSKPVDHLSPAVRDQTRQHSESPLSTKNLKISQGMVVCTSGTSYQEAGVGGSLDLGRLSLHAVSHDCATGLQPG

SEQ ID NO: 937793 - protein, 103 aa, Homo sapiens
MLLYSSLGDKSSLGDKSKTPSPKIYIYTHREKRYSEKRGPLQRLIPIIPAFGWLRPADHLSSGVQDQPGRHSKTLSLQKIQKLAGHGGTLVVPATGEVEVGGW

SEQ ID NO: 937794 - protein, 85 aa, Homo sapiens
AGLVKDFSDIGLRLPRPHGKKFSTLDVDEVGRGFISNCFGQQSYPTARRCIEQYSLARYHAKLQEFVWVLHRILDQLLELTYDIL

SEQ ID NO: 937795 - protein, 102 aa, Homo sapiens
MLLYSSLGDKSSLGDKSKTPSPKIYIYTHREKRYSEKRGPLQRLIPIIPAFGWLRPADHLSSGVQDQPGRHSKTLSLQKIQKLAGHGGTLVVPATGEVEVGG

SEQ ID NO: 937796 - protein, 84 aa, Homo sapiens
MKAQSIRSSGKRRSELFTDVVEKEVMSSNQSISSPVLDAAPSITSRSRKKKVCIFFRNERWFTQYLNQGVSRSVSPPAICDMTG

SEQ ID NO: 937797 - protein, 56 aa, Homo sapiens
MLRWGETRLDDWQALGQRGQLAGSQAVTSRVARATGHADVALRRCDDDRGSGTALA

SEQ ID NO: 937798 - protein, 31 aa, Homo sapiens
GRRLGTAGAAQVMEGGQVEYKPLSGIRYMWS

SEQ ID NO: 937799 - protein, 46 aa, Homo sapiens
PWGLDATAAEHERPYSLRGRSCLFEGEKEDQPLTRDNKGTQLPFYS

SEQ ID NO: 937800 - protein, 36 aa, Homo sapiens
MAEVEQKKKRTFRKVNYRGVDLDQLLDNFYGQLDAA

SEQ ID NO: 937801 - protein, 46 aa, Homo sapiens
RACTFEDVAVEFTRRSGRCWTLSQRDTVTRDVYAWRTSGTLGLTRG

SEQ ID NO: 937802 - protein, 41 aa, Homo sapiens
MLAAGPLAKLARCKGPSWLAEAFTSRFRWQRTYKYVEQARS

SEQ ID NO: 937803 - protein, 54 aa, Homo sapiens
MALVLLLSNSSSNSNSSSSSSRHRRLHSHSSSHRQALWFPHGNPRLALQQSQMR

SEQ ID NO: 937804 - protein, 117 aa, Homo sapiens
SSWLILGRDLSGGKAGAIQGRRGLNLPRGPPVCHPANFLLLALPSALLPVLGRWSKGRQLIPHGRSLRIYRVEPRGALGGWASSSDFSSPMPLPRTQTLQQGCWFRALLTSQMYERV

SEQ ID NO: 937805 - protein, 70 aa, Homo sapiens
CVENVREARWRRAGVRWRRRFEILAADEVRIRCRRKSGRMTTIGRRMFFSSGDIPQGWSRREHEQAVDAR

SEQ ID NO: 937806 - protein, 81 aa, Homo sapiens
GLLFLTVLDGQIGDSLSASTALDFLSLATLGTNFLANFVFWDRQHRFWVGSSCQPTIASRSVRNISPTVREPITAWLIVTF

SEQ ID NO: 937807 - protein, 117 aa, Homo sapiens
KQRQVGGARPQNTQEAWTHVSGEERLPARVGEGASVLEEPKAPGASQCSLGLQPAVCGFHFLPCPGLRDVLSDRPSPCQTWVSTDCFLPSFRSVAVAPSRQVSAVRQTTGLQTVASQ

SEQ ID NO: 937808 - protein, 47 aa, Homo sapiens
HLSPLRGQVQGPKKIREEALSQCQDNPGLLPRWVPQPINLFEANGRA

SEQ ID NO: 937809 - protein, 34 aa, Homo sapiens
MPVIKVNGKLLGGSYYSCVLCKVPWESPRSENFT

SEQ ID NO: 937810 - protein, 34 aa, Homo sapiens
SSEAVRRLPPFTRVPRDPAASCGENMLLEVLLIR

SEQ ID NO: 937811 - protein, 37 aa, Homo sapiens
MREAFRREKSKSALERKKRLEEIMKRTQENRRYKIRK

SEQ ID NO: 937812 - protein, 60 aa, Homo sapiens
WRPQQREVLRRCVEGIQSAGLLFLRRISLDFGARVQLKEHFFTDSAMFRRGIFTLFTRET

SEQ ID NO: 937813 - protein, 32 aa, Homo sapiens
AILDPRDKKIQCEGDVVGGPSCDNDPGSDKFY

SEQ ID NO: 937814 - protein, 75 aa, Homo sapiens
DTPPGWPAAEPADTAFLLERVFISAPFSYKPLIKDLSLKIFEGQSLLITGNTGHLQDLSCFRVLGGPLGRVHGAQ

SEQ ID NO: 937815 - protein, 67 aa, Homo sapiens
WCILALVCISVPLRYCAYFGFKKNAIEHPVRTNQSSTSEFLNSRSTRRPFLGIIMGGVLPFGCIFIQ

SEQ ID NO: 937816 - protein, 73 aa, Homo sapiens
RARRRRYNARFPAGRESQEDHADGRRDLEGRARAVPVQSIFPGALSSSLESLLKKAAKVTQSRERKDHDHIPT

SEQ ID NO: 937817 - protein, 58 aa, Homo sapiens
EGLGGSQQGEGILLPQLPKQSPHPWGFSFSLHPFGRVLGLSKLAFDLFGFLLGLEGRP

SEQ ID NO: 937818 - protein, 45 aa, Homo sapiens
LACCKCRFFFRGLICILLELVEGSGWGVLLEHWYSLGGMEVVPFC

SEQ ID NO: 937819 - protein, 57 aa, Homo sapiens
LAGSAEAARCLELLKKDVNPAGVRQSSWAAFLKKSRGSLKGPRMGWIPSKLAKQQKS

SEQ ID NO: 937820 - protein, 69 aa, Homo sapiens
ADGEEPEKKRRRIEELLAEKIAVDGWGVWDTLRLWKVAWNHVKKFLGDLGPLHKTLNFEPRHLISSSSF

SEQ ID NO: 937821 - protein, 51 aa, Homo sapiens
LVTVWSSATRFVFQFALADRVPAREEGFDSGFRLPSSNGCPYPEEELCICL

SEQ ID NO: 937822 - protein, 68 aa, Homo sapiens
AAAPAPEEEMDECEQALAAEPKAKGPLSAHLPPRVTLCVWMNFKRQSTPLRDTTSLVGTSIFSWGALL

SEQ ID NO: 937823 - protein, 42 aa, Homo sapiens
MAASSVLLHTGQKMPLIGLGTPEEEPRSGKTTFKYALSVGYP

SEQ ID NO: 937824 - protein, 54 aa, Homo sapiens
RRGEHANKALGTPRENKEVLPPTPKIHTPPPYPASRKLFRPYKSAKSPFLCILY

SEQ ID NO: 937825 - protein, 42 aa, Homo sapiens
VKIKKCCLATGSLLQLQPGVIPAALTRSPKIHYGEIAFNTPT

SEQ ID NO: 937826 - protein, 38 aa, Homo sapiens
EDCRAEGDLSQWSWVISGWILELLAAMCFPKVLFYDMK

SEQ ID NO: 937827 - protein, 34 aa, Homo sapiens
RRRRPQLVAQEDTELRDLSVQTLENSGVLNRNQG

SEQ ID NO: 937828 - protein, 33 aa, Homo sapiens
MNDIVWLTKKSRSLIVLYSVSLTRRNFKFPFCQ

SEQ ID NO: 937829 - protein, 53 aa, Homo sapiens
MRLLLLLLVAASSNWSRAEGLGQILGGGSPAKGLKVPDTATGAPSSKFQIFVF

SEQ ID NO: 937830 - protein, 48 aa, Homo sapiens
SRANSTTEELHKYQKMLGTPPSDQGPSPLDVDKRFRRRGHKEYMGSCR

SEQ ID NO: 937831 - protein, 59 aa, Homo sapiens
MHEDWCWKNKSLEVEVLEDDASSVAFRQTGYMSDMFPDLTPSLWNFISNGNGPESVEIY

SEQ ID NO: 937832 - protein, 67 aa, Homo sapiens
RRSAAEESAGRDEFSAGERNGTDARSSLGQSASENLGDTVSVSKKEKNRKRRDRKRKKKPQRVPRGV

SEQ ID NO: 937833 - protein, 80 aa, Homo sapiens
EKSRRQPEIEDVGSDEERKKDGDKKKKKKIKEKYIDQEELNKTKPIWTRNPDDITIEEYGEFYKSFTTDWETLCSEAIFS

SEQ ID NO: 937834 - protein, 66 aa, Homo sapiens
MRSGARTVLLLLLGAVALTETAGLPLHEVISYTAMSRPGRGGGPAFIAVGYVDDTQLREVRQTRRE

SEQ ID NO: 937835 - protein, 43 aa, Homo sapiens
PLTDGETEAQAKKYLTRGSRISWKNLGLGLNGRSFSSSAELPK

SEQ ID NO: 937836 - protein, 72 aa, Homo sapiens
ETPESRVLRFTRWGLLRVKPGRGDRTRSMSCSDKMARLDLSWDAKGHCDALSWRAIYLSSCCHLEFHTAKEA

SEQ ID NO: 937837 - protein, 350 aa, Homo sapiens
VGGKRIEKRCRFWFPGAGGPPAVDPARRRRRRGAREESKKRGWRREGGAAARGRGEGWAEGPGGAGEEEQGAVTERGGRVVGEEGARDGEETGWAVRGEEGGRRQRGEKRGLWDETEKEETRERSRGEERSTWRVPPEETRPVSGGVGRVPVTYGRQTSDALERSPVAPPRERTGDVRRTTQGVPAKTAKKDSVERRGRGEGGVMGGRKAWGAKAQGAGGVAALGEGWPPWGPPGPRGIASEPPVVAQQKGPKSPGGPPPGDYRCSSGAPCPNGTFLGALRSTKPPVGDKGPVWGLGTRECKFFSLGSQDPRKEKGKWKAGPSYARGYNQKPGPRGRPRPVGKGGAPWPG

SEQ ID NO: 937838 - protein, 46 aa, Homo sapiens
SAQASLHPKHVYRVLQWCRLLLALTETCDLGDRVVLLFHPVFDDAD

SEQ ID NO: 937839 - protein, 33 aa, Homo sapiens
REKALQESSGNTPLCKGFVCDREEVSIKQQQAK

SEQ ID NO: 937840 - protein, 125 aa, Homo sapiens
AALRIASRDQEHTFLTNQQPQYMMPKMSQKGQVRWLPPVIPALWEATVGGLLEARSSRPAWATQTLSRQKSRKKLATRGGAHLWSQLLWKLRWEDCLSPEVQGCASCDGATALQTGQQNEILSLK

SEQ ID NO: 937841 - protein, 90 aa, Homo sapiens
YIDPLQLRLLNVVQRGGQAHQPPVSSSTGLHHLHVNCRLQAPMRPGWLRQVPRARMLRSTTCQGLSCGPGLRTRPPAHIMKWLEGAPTVR

SEQ ID NO: 937842 - protein, 88 aa, Homo sapiens
QLLPGDKERSVVLTQVLSHPLLCPVAPGVEATGKENEVGGFRHVTSFHVSAVAEVLTEAPWRRWAFVLSSAVRAMSRKPSTCLIGSVC

SEQ ID NO: 937843 - protein, 72 aa, Homo sapiens
WKNRYVVLKGDQLYISEKEVGASVPLTLRFLITPTPGTPQGGARTGHPRKVPKARTVVASLNPTHLQRKATL

SEQ ID NO: 937844 - protein, 81 aa, Homo sapiens
IRTEEQVVFAAQTDHPQRIFSDVIVRLSPAIICIVRQRRPLVQGRMQNAFASSECRDRVFIFSRSQLSRDLAAVSFSTELR

SEQ ID NO: 937845 - protein, 95 aa, Homo sapiens
RPTTTTTPPPAASTLDLLCGKTRATSGSIQFDGQELTKMREYNIVRAGVGRKFQNPSIYENLTVFENLEMSYPAGRKVWGALFFKRNAQVVARVE

SEQ ID NO: 937846 - protein, 67 aa, Homo sapiens
RRRTEWNGMEWNGMEWNAMEWDQPECRGMEWNGMQSNGINQPECNRMQWNGMEWNGKYPNGMECNGV

SEQ ID NO: 937847 - protein, 77 aa, Homo sapiens
MRRERFIWPAKNSNTVIRHNLQIQKTPPEAFLQLIQQLSANEVDVLQLRFVRATLYVLSFNFDFFTVHAWSELRCRI

SEQ ID NO: 937848 - protein, 103 aa, Homo sapiens
ESLERELDRHSRNVSDIFNRIFGNTEARNAENPTISSQNSPDPQHPYVFQQSGSTDYGIESLRAISPRLAEAVSTHPELGKILSDLPLRPQKRDFHSILSEAV

SEQ ID NO: 937849 - protein, 95 aa, Homo sapiens
RPLAKRALKYTDEKETEGSKPTKTPTTTPPETQQSPHLSLKDITNVSLYPVVKIRRLSLSPKKNKAKPSSGSAKRRCTASVNYKEPTLASKLRRG

SEQ ID NO: 937850 - protein, 40 aa, Homo sapiens
GRPQHLLEDLAFFFLALTQGRGGQFQAEEPAALKVSEALG

SEQ ID NO: 937851 - protein, 120 aa, Homo sapiens
HSGMVLRLHMPATNGGHATMLPRTGDTRQCLPCIVATQQCLPRVGATQQCLPRMGDTRRCLPCMGTRDTHIHTRASQDMNVCNPSTHPAHSGTGSLGGSQLHTLSYSVCQALHPRSRPRC

SEQ ID NO: 937852 - protein, 54 aa, Homo sapiens
SERLCHIIFFIFIFIIIFFLFFLKYSLFSTSLAARRAALAAGGGPGLSPRGREA

SEQ ID NO: 937853 - protein, 30 aa, Homo sapiens
CQSLSRSQSSGQAEEEKEEAEALKEKEKPK

SEQ ID NO: 937854 - protein, 163 aa, Homo sapiens
MSWDLGKMSSELLLSVVAEELEGNVNNGKEVKSFEKKLDEWITIITKAEKSLKDLMELKTKARELCDKRTSLSSQCDQLEERVSVMEDKMNEMKQEEKFREKRIKRNEQSLQEIWDYVKRQIYVLIDVPEGDGENGTKLENTLQDIIQENFSNLARKANIQIQ

SEQ ID NO: 937855 - protein, 52 aa, Homo sapiens
PAGPWRVLFHSPGVVRSGPPRSREGGLDNARGPLQALYFLFLQSLNPKALLH

SEQ ID NO: 937856 - protein, 119 aa, Homo sapiens
IDPEYPSVSGWISCVTDTPCSPSFTSARTVIAISRLRRHSTGSSSSYAHLCTSDNGTTVAAGVEVDVLQRVEAQAFSRHGAGDDVDQVLVLAQLRQGRIHHGLGGQRYVSRRESQRAGL

SEQ ID NO: 937857 - protein, 66 aa, Homo sapiens
GNPAMLCLCAVPLLRAPPHDQAWQGVLLGLCLRPLLCGSWLPLVGNSVRDRDLDTRCARCHGVPEL

SEQ ID NO: 937858 - protein, 57 aa, Homo sapiens
TLRLWAVVPVGNVCGTLLVAYVMLHLPIFDTKTDLAFLEIGRKVMENDAYQMFAKGI

SEQ ID NO: 937859 - protein, 116 aa, Homo sapiens
YSFYFKFIFLRWSFALSPRLECNGTISAHCNLHLLGSRDSPASASRVAETTGMHHHTWPNVFVFLIDMGFPMLARLLLNSWPQVIHLPQPSKVLGYRCEPPPQLLTDFNVGIWSTR

SEQ ID NO: 937860 - protein, 122 aa, Homo sapiens
RQKIRVFKAGPSRLEWHGMEWNGMEWNGMEWNGMKWNQPDWNAMQWNAMEWNGMEGMELNGTEWNGMELDGMKKNGMEWNGMDGINPSGTEWNGMEWNGTERNGMDRNGVQWNGMESTRVST

SEQ ID NO: 937861 - protein, 256 aa, Homo sapiens
MASTSRDVIAGRGIHSKVKSAKLLEVLNAMEEEESNNNREEIFIAPPDNAAGEFTDEDSGDEDSQRGAHLPGSVLHASVLCEDSGTGEDNHDLELQPAKKRQKAVVKPQRIWTKRDIRPDFGSWTASDPHIEDLKSQELSPVGLFELFFDEGTINFIVNETNRYAWQKNVNLSLTAQELKCVLGILILSGYISYPRRRMFWETSPDSHHHLVADAIRRDRFELIFSYLHFADNNELDASDRFARSDLLIIRMNCNF

SEQ ID NO: 937862 - protein, 89 aa, Homo sapiens
DGKDSNGNHWNRMQFNKIGTNVMEWNGKESEMKGMEWNGMEWNRMEWNGMVRNRMEWKELNGMELNGMEWNGMESTRVQGNVMERNAMS

SEQ ID NO: 937863 - protein, 106 aa, Homo sapiens
MLRCITGWLHPQGHIGEVIDASVEVGHFHAHTVVCEHRSSLSTLNPTSHAVTSRASSGVGQDRFRTTAMGPAADEGFGDRRRRQPLPYVANSCSQSTPGLIDRPKS

SEQ ID NO: 937864 - protein, 49 aa, Homo sapiens
MAALAAGAPASEDRCFLAGLNSLLNSTNRIDQRNINAAANRCTVGARRV

SEQ ID NO: 937865 - protein, 107 aa, Homo sapiens
LDGISFYIFESNSYIIDVYRGDTPATRNLIDFAAFVAIFPHLIAGPVLLLSDLADQFNNRTHTLDKFSEGCTRFMQGFIKKVFIADTLAVVADIASPCKTLRRVTPG

SEQ ID NO: 937866 - protein, 89 aa, Homo sapiens
VTFFTGIGTVDSKFIWEFQGPRLGQAFLKREFNPKPHGILLSTCQGGYNKETINNVLVKVEKLEPSYTADGNVKWNSCFETQSASFSKG

SEQ ID NO: 937867 - protein, 102 aa, Homo sapiens
MAATTPWHAVMIIREFRGLSVIQGSSQIEGDKNQAGDNRIRGLFQCHGTLPWVGSVQVGVVTHNPGQGAQQQARQQCTPHVGKSMPASSPPSVVAIIWMSIV

SEQ ID NO: 937868 - protein, 52 aa, Homo sapiens
LDGERQLFDSRCPEFTGVTRESCTLMPASSSDRLRHRITGWQKTLQLRSQDS

SEQ ID NO: 937869 - protein, 105 aa, Homo sapiens
STLVRETRINRMLISRTGPDSGTSVASPPFFHIRQPGMTNAGSVTVSITLVNHHNPAAIGATRRLQLNGTYPDATDPDAAKLRFIANTQNATLDYFDAEHCDGQT

SEQ ID NO: 937870 - protein, 122 aa, Homo sapiens
LDNPNTKRLALGKHYQSRLKRRLVKIKDSTGTFIGYYSTRGPFQMFRITRVFIVLRGTPEKCSAFSLGLPQPFLVDGVVHFLFVLRRDVKAIFCSNNKAATYYSGLKRNIRIQGKWNGQVHR

SEQ ID NO: 937871 - protein, 85 aa, Homo sapiens
LDAAARIRRSFIAGECPKASKILTSGLATDRSTFSGVCATDSDLPVDVGCKIITETNASQLLLCRWKDTAQDGENILGDSATGSR

SEQ ID NO: 937872 - protein, 197 aa, Homo sapiens
ARPFRRIRALLLWITQHTTQRTDRQIRLLRQEQITLGRQTNVAMAVWHKLPMALSKVDLPLPERPLSIQALTFGNRQLFEQMTTIRQIQAEVVHLQTAALAWQLDAHVAAFVFFHRLAEAQQTITGRTPAGQHGVRVDKPTEAALHTAISLGHLHQYAQFDLAGKVTRRCHHKREDDRDLRVTAGKEIQGFLSCMML

SEQ ID NO: 937873 - protein, 178 aa, Homo sapiens
MAAGSREHDPWLYWRCKAVGKVIPERSGKLSGMAFRVPTANVSVVDLRGGLEKRARYDDIKKVVKQASEGRLKGILGYSERQVGSSDFNSETHSSTCDGAGGIGLNDQVLKLISRYDNEFWLPKQGGGTHGPHGLQGVRRLDNEPKQEHKRKRENLTAGESCNSHSGPHWISLLRVFM

SEQ ID NO: 937874 - protein, 76 aa, Homo sapiens
ARRGRQGERTASSTSDSLETDTKALALHQLGPGILEALTGGVGGGTRAVALVHVREGEIRKKMKSVGAGTGPFETG

SEQ ID NO: 937875 - protein, 76 aa, Homo sapiens
LDGLASAYRILALSWVLLVSWVHILSTTRPDFFLSKGKQLGCIEQKLEPGHWRDEADRKQCRLHAVALVLKGKSSG

SEQ ID NO: 937876 - protein, 114 aa, Homo sapiens
MLKNFVNIFLVVKFASDSQTQSAYTTSRLRSWICIPMECEHIGADWNMIYSLFGMAFVGGPVITPPSRPPVAPQMEKGRCDEAHRVQPVEHATMAFDQYGPQSLTQRSPLIADM

SEQ ID NO: 937877 - protein, 73 aa, Homo sapiens
RRRFRAPSVWSVHAHPRGEGFKECIICAFAEGLRSRPLTTFGNVKTDVLKDKDATFKPMNFVEVIRRSLGLNK

SEQ ID NO: 937878 - protein, 95 aa, Homo sapiens
GSGTETGRGAQPHREREADLGKEWDRSRDDRNRERAGPERDRTVRAESGRDKARDRERATQDRSKTKKLGPEPEARGSTLAPLAGLDAPAGRDPF

SEQ ID NO: 937879 - protein, 116 aa, Homo sapiens
PSQEWDMSPEKTSTRSLHYTESELVTSTGQSFKEARTERSPAGLTEKLLRLRSRLRLRRDPETGGRAPQLKSDSHGPKEDGGFRHSEAFEHSSKEQGLDSAHSEMGPHQVLSRNRT

SEQ ID NO: 937880 - protein, 146 aa, Homo sapiens
GSVTFNGKVIAPACTLVAATKDSVVTLPDVSATKLQTNGQVSGVQIDVPIELKDCDTTVTKNATFTFNGTADTTQITAFANQASSDAATNVALQMYMNDGTTAITPDTETGNILLQDGDQTLTFKVDYIATGKATSGNVNAVTNFH

SEQ ID NO: 937881 - protein, 89 aa, Homo sapiens
STLVVIPPHTNITTLGALPTTAGVNFLMHVGVGTPPAPASKVQKLMAVIVLFEVIQPQAATVISFEAPKADATYPYLSERFSQRHVAKT

SEQ ID NO: 937882 - protein, 115 aa, Homo sapiens
STVGINLMLIAGGAVGAVACARGYWLFEKPAMIMVATAYLVHLVWVLFDLDGDGIVEQGKFVRILIVLVFLYTRFERIRGSLVDPQKGKVTGMSEQDILSIIVALFGTGGVGFTA

SEQ ID NO: 937883 - protein, 117 aa, Homo sapiens
VDVRSSRSRTENSQGKRAVKQPCGYWVIFRLVVTGGVESVGKRSNMRAQACRIFSSGGKTVRRMHEFPPRKWVKPEDLNPNGTLFGGTCAWIDEEAAIYAIVQLGNQRVVTKYISEI

SEQ ID NO: 937884 - protein, 94 aa, Homo sapiens
LDHGSSKAFGSARVGSQDFETCRLECFHGSSLVATGRFQQCTIDLMALQHSTILEKSLMSLGKTAPIPCGSSSICRVSLETSMPAQVNMAKSSY

SEQ ID NO: 937885 - protein, 30 aa, Homo sapiens
AKDVYKEHFQDDVFNEKGWNYILEKYDGHL

SEQ ID NO: 937886 - protein, 128 aa, Homo sapiens
PNRAVKIDSNADLPGGGTIPAPEFPDLFNGTTVGPNELKEYPNVGPGRYNPIRVLLPQGLANVGLNDTIEVTFKGFRNVDGSDGASPVELPLADICFATTLDNTEDLDLEYYEVFVPERNHYAICTRG

SEQ ID NO: 937887 - protein, 97 aa, Homo sapiens
ARPPSDYRYTCHLNLTCHGNLVPICAGSFKKRGLTPISHQYLSSRERGTDAPQVTREPDAGHFADHILIGHLSHEAAVIAHIAVVAQEVHMAWLDAQ

SEQ ID NO: 937888 - protein, 128 aa, Homo sapiens
GSTRSWHRPAYGLGHSRSTQGCCRMDADRPVIVGPQRQIGVTALQVRQRESALCAVDKFAHEQLFELVSVELQLQLLQVEPIAPAGDRIQDRDDLAPLAIRASGTGCNLLRARPRILGAFMLAVSELL

SEQ ID NO: 937889 - protein, 143 aa, Homo sapiens
ARLGGIDVADYVSGLVHRGTHVRIVIGRYAKLAAKRISANKLIKPDRLVESDMLISHFLHGPVSAYPRDYVDGAHQELHVHQEAQLLYAVCGVMRLVTARWYHPANPRRVDSALGEHEIFMSGEVRMRSLFIAAEYSPANLHG

SEQ ID NO: 937890 - protein, 171 aa, Homo sapiens
RPTTTKFTAARPGSSFVACQAIAIRKHSDGQTPRRDERPAAIAVRNADTSLITSNECPPREKKFCSMLSRSTPNNCAMPSANKVCNAVLGATQTCAASSDSGAGSKTVQLAIGQTGQMLQGKEMRRYHGARKARIELLTHVEPTFGRRPLRLDIRHQLHIGLITFARTPGS

SEQ ID NO: 937891 - protein, 144 aa, Homo sapiens
MSVLSRSPVTCSFFPFILGLKSNCTKGSGHQILPHFLRMVTLITTLGQIAGGCLEVPDLLHRPEFHRSDDALEYLVCDLLPEARAQEHVKGPEKTSGKRNSFHGCLIQSFSSLFNYRTLFCGFRSLFLAQYSDVGKALTESQRF

SEQ ID NO: 937892 - protein, 143 aa, Homo sapiens
RSGVGAHHQLQLAPPATPPTSGPRQGSARPDSDPAACSHPRVPGAATPTAKQRGPYHTSLQPRPAASARGSSAARVQGLSRAQVRVVPKAQNAGGRSQVAARAKATCGHPTSRIEAAGTRGGRQHHPPYHQQHHQGPRRRPRR

SEQ ID NO: 937893 - protein, 49 aa, Homo sapiens
RAAAWEESGAAGARFSLSLPGGKRLVQPGPGCTRPRSNAPSHPGKAPEP

SEQ ID NO: 937894 - protein, 110 aa, Homo sapiens
RVPGGTRPGLSPGSRGATASARPRAPCHGWSAGARARPGMLPGPSVNRRKFTFECSDGTSFAEDVEQPTKCGCASAHHVGVDRPVTAGKGPTRCSSADSRQQLRWGPGHH

SEQ ID NO: 937895 - protein, 167 aa, Homo sapiens
GRLRPLEIIGVVPLISQYLSVVILAQPDQRAVIPRGDNKWPFINQASPPNMAFSDNPSTMESWSRISSSSPGSRAMSRTFLCPRASCRNEMMLRAESGKWLLPSSLSLDRKFRYGAGFCRGRAFAIQEMINSTKSSSEPGLINGLIMEPLVPEIRACSSNRSTTCCG

SEQ ID NO: 937896 - protein, 82 aa, Homo sapiens
MSQEIETILANMVKPVSTKNIKISRAWWRVPVVPATQEAEAGEWREPGRRTLQGVEIAPLHSSLGDRAKLRLKKKIGEKKST

SEQ ID NO: 937897 - protein, 80 aa, Homo sapiens
GRKSMEREGYESSGNDDYRGSYNTVLSQPLFEKQDREGPALPRESKLHPFQDIWYPRAFITLKQLAWVPKTPIGIGIWSA

SEQ ID NO: 937898 - protein, 107 aa, Homo sapiens
CPLQTPPGLVVGAQETVLVGIEGGGFVEIQVAHVIDRQLVVETQAVGVSNFMGLGSVRGFAINSGILRKYQQKSRTHRHPPATQETQGTAHCRQPAQYIEHRGGRST

SEQ ID NO: 937899 - protein, 32 aa, Homo sapiens
ETLYLEYSCKTCEQAFILIKLIFRFITKMKVD

SEQ ID NO: 937900 - protein, 221 aa, Homo sapiens
MPLPAFPELAACTLPASPEPMNALASRAAPAMQSSGSINYARPKQFIAAQNLGPASGKARRPPSQLVQPPIAPGAVAEAVREKKRVALRAPFGAEPRPRGLLLALPPPKKKRRSAQGPSRAHVFRCRATTTLRARTGVHCSSLPPLPPRPDARCLLSALLPSHRRRGVQPPGPAQYFDPADFKEGNKILNSSDEELRQKDDVIKTGRNSLKRTSDMAASYI

SEQ ID NO: 937901 - protein, 131 aa, Homo sapiens
DRVWFCHPGWSAVVRSQLTALQPLPPGLKQSSHLSLLSSRCMPPYQATLCIFCRDRVSPCCPGWSRTPELKQSACLGLPKCWDYRNEPPCLASFYLILNCGDPTQPKKNSIDSTFKCSSRFPVPLDLDSEF

SEQ ID NO: 937902 - protein, 30 aa, Homo sapiens
DARDHVEAAGRACRSWVPLSDSWALLPASA

SEQ ID NO: 937903 - protein, 59 aa, Homo sapiens
VDMEEKKEEERVKRKEGQKEKRRRREEEEKDRGKEEDKRKRRRRKKLEKMEEEEEGENE

SEQ ID NO: 937904 - protein, 141 aa, Homo sapiens
ESITMKNQVQVHGEHAQLAVDALLIASGRQTATASIIPENAGIAVERGANIVDKRLHTTADNIGAMGDVTGGMQITYISLDEYRIVRDEILGEGKRSTDDRKNVPYSVFMTPPLYRVGMTEEQARESGADIQVVTLPVAAI

SEQ ID NO: 937905 - protein, 160 aa, Homo sapiens
KTLVHDAQQHTDFVRAIQRKNEVVNFLRNKNFHNLADMPNIDVIDGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREDRDIADNIATILRD

SEQ ID NO: 937906 - protein, 138 aa, Homo sapiens
KWPGCSGGAPPSTDTGFGGDSPCRCSGQEPPPCPTTGHQNASRVGHQARGVRSGLMSCSFCVTLNSTSLSDNWMQLQNQAFASTPILQAASHLSGAAASGSLSLTPNRLGACRGGKSRDHPSEQSGCYAQVGQAGPGS

SEQ ID NO: 937907 - protein, 59 aa, Homo sapiens
STRVLLCSPRLYHCGTTLARCNLQLPGSGDSLASASRVAGTIGALEFEASLGNMVKPVS

SEQ ID NO: 937908 - protein, 102 aa, Homo sapiens
QAAFNKCSPSPGRAWGLATDIFHFPSFNNEHLSKDPGLQLNELLGVVGKLETCPAQKESVQMSSHTVTPQRRRPAQRPRNRSDREVENWDLNPRHPSPEPHA

SEQ ID NO: 937909 - protein, 142 aa, Homo sapiens
IQLPNSPLHLIPFGLFHSIPFHSTAFHCTRVDSIPFHSIPEDSIPLHSITFHSPALALIPFHSIPFHSIPFCSVPFHSIPFHSIPFRSVPFHSIPFHSIRVNSIPFHSIAIELIPFHSIPFHSIPFPCTRVDSIPFHSNPCH

SEQ ID NO: 937910 - protein, 122 aa, Homo sapiens
LDGAAANDPSINLLDVVNPGAGYRWALKACCPRGKSRIQRRNPKRAIAFKGAAESLVILRLMTILVRSGSGRKRGGKDSQVRRPMMTGLPMVTVLKCARSSGGTQGHGAVAPNNTRIGLRPN

SEQ ID NO: 937911 - protein, 86 aa, Homo sapiens
DGTEVIGEALVNVLLVYGNNDVPGNMLAGAVSTYVRRYGVAPGKKLVLSTNNDHAYRVALDWFDAGLACVAEADARHNPRGALVEE

SEQ ID NO: 937912 - protein, 79 aa, Homo sapiens
PFGSQKQSGDNLNDTLRKAKEVLQCHESLQNPLLSTSKSTRYAKASRNEESEKGSLKIEFQVHALEDESDGETSTGKHG

SEQ ID NO: 937913 - protein, 91 aa, Homo sapiens
GSAASQTSDLIMHPHAAACRGYVLDSGLSYMLLPKAVLRLACAVLVLSYRRMPGAWFACDFARSGAAAALAANPRLTAAERDIGIAAGLRI

SEQ ID NO: 937914 - protein, 71 aa, Homo sapiens
VFSHLVLRLRDTGPVQRGCLPCPASSEAETHWACAEGDTCPAQPWPPRAQGCKARPEVEAAQSPLRALAEV

SEQ ID NO: 937915 - protein, 70 aa, Homo sapiens
LQFVHGALHRLSCIHYLALPSEMNPGTSDGMQKSPVFCVLTLGAVDGSCSYSAILAPPILMFLRGEHIQT

SEQ ID NO: 937916 - protein, 32 aa, Homo sapiens
YLYGPWDKPGEVMRAIEVIGFISCVLLGAYPN

SEQ ID NO: 937917 - protein, 110 aa, Homo sapiens
VHLLVGQGGMDFELVFRVTDPTYVLCGKGFNDKPNKGGPPSGAPRLSHRAPPPVGGGWGGGGVVGGGGRGGVRSPPPNGWESYIIYWYFLKIETKVMVVLAKLILKLNKS

SEQ ID NO: 937918 - protein, 112 aa, Homo sapiens
RRQSPIDWSLINRLSIEQDPRRKRDKALLSEMTVLTSGHRRSTLASQSDGYQQHRQQHEYQHHQPGIDKHPGITQLPHIDEVIRVGTNQVSAHQKVNAVDQQIDQPRQRIPP

SEQ ID NO: 937919 - protein, 128 aa, Homo sapiens
MVGRPTACVRVGFAAGVLRDAGIAFEKGSRGTVIGMGIVMVEGVDWGAVFIQWVGGVVVYFPACSASRGIMGDVALGCGLQRFKGIARCQVVANSRVIEKVTTVIFSQLSDANGGIVLLSLGGGTEHL

SEQ ID NO: 937920 - protein, 133 aa, Homo sapiens
SGGRGASYQLKSDNLLEPRISPPLRVFRTSAIKMGRIFRGWGVAGVVAKAAGAGARCCRGGGGGGGGGGGGGGGGGGGGGGGGGGGGFACANCDTILTNRSELISTRFTGATGRAFLFNKVVNLQYSEVQDRV

SEQ ID NO: 937921 - protein, 67 aa, Homo sapiens
VVYNHLITIIRVDVVAHACNPSTLGGRGGRIMRQEIVTILANTVKPISSKNTKISRAQRHTPVIPGR

SEQ ID NO: 937922 - protein, 42 aa, Homo sapiens
VKKCVIMLEFPPTTYTELIAVCGRFSIESKTDLLRNVIPSSG

SEQ ID NO: 937923 - protein, 103 aa, Homo sapiens
NFQEHFIYEDIVFMRTWYPVSIPAFYNPVTSLLKPVGEKDTWSGMWTTGHLGLAHGVRLKTNKDSLYKVLVVCVLVEMKPVPYRQGVTQTLFYNFLRTLNVQV

SEQ ID NO: 937924 - protein, 68 aa, Homo sapiens
NLISGFDVPEGSDKVAEDEFDPIPVLITKNPQGGHSRNSSGSSESSLPNLSQVFTAGGSAHRPVAVTQ

SEQ ID NO: 937925 - protein, 80 aa, Homo sapiens
NPQLVESTDEEPKDTQGQLYVEILKIFFWLGTVAHARNSRTLGGKGEQITPGQEFKTSLVNMMKPRPYEKYKNQLGVVVY

SEQ ID NO: 937926 - protein, 109 aa, Homo sapiens
VDMILNKEKLKVLSLRSGTRPGCPLSPLLFNIVLEVLARAIKQEKERKGIRVRKESVTLSLFAKDIILYIENSKSSTKKLLELINEFSKVAEYKINIQKSVVFLYIISR

SEQ ID NO: 937927 - protein, 115 aa, Homo sapiens
PRAYRGPGFWPSPRGLYSSSQQVPHLHLRPPQPGLCCPYCYQHLGGTGQQSVALPPFFPREPPEPSKLFQPLPVTQFQSHFHILGISSAGPNYWYQFTVLVRFHAADKDIPETGK

SEQ ID NO: 937928 - protein, 118 aa, Homo sapiens
PLIPACLLHPGSSTGRHVGWSPNVSPRWAQNGEEAGKPSWPNGGLEKIPWTVLPVPCSGGTYEPEQAAGYLLEVAWEVMGPWAVTGDLQPCSAPSLRPPCRGGREGARTHARCLTHPP

SEQ ID NO: 937929 - protein, 152 aa, Homo sapiens
MQKVSDNGRQMNYSPQSRSSIWWFVTLVQPVHRKDEFSTGEIFSRTFVGNFLLMRRFEPWFLQQHIWGKAQRPFFRKLGSPNDPLIAADCFCTPYRVLALNVLTAKGVHPSGCLGNGETFPVVVMNFPRAPICEAAILLVPLQPLLGKCSHE

SEQ ID NO: 937930 - protein, 73 aa, Homo sapiens
LPPGQARDCLSPGQGRTPLPDPYPTLPWNPEGVDGLANHRQTALAPAITSPNFSGPLTRPLAARGQGLVPRIY

SEQ ID NO: 937931 - protein, 105 aa, Homo sapiens
MSFLLVDDTHEAVRVDHRDIAGLEPALGIQHLFRGLDLLPVALHDLRPLDTQLATLAQRLLDPVVVNDLQGRTGHWQTHRAQLALVAIGVGAGDRRRLGQPVAFG

SEQ ID NO: 937932 - protein, 98 aa, Homo sapiens
GLYEPDWCNCTSGERGAQKGDGSQAQNLESRTIIRGKRTRKWIQAEPVVDEERGEASGPMGGVFLAWVGDQTPAWKTVKDKPRTQGDQWLVGQAVTTD

SEQ ID NO: 937933 - protein, 73 aa, Homo sapiens
VDLGKDICTRTPEDQLSPSGCGYTAHNTENSCGYLSESEDEVEDVRAQKWEEPESLLTSLSCFINQPWSSPFL

SEQ ID NO: 937934 - protein, 76 aa, Homo sapiens
ATGSNDILELVARAYLAPGLNAVFSEHAFAIYPIVTQAVNAEARVAPAKDFGHDLAAMLAAIDENTRVVFVANPNN

SEQ ID NO: 937935 - protein, 119 aa, Homo sapiens
EATLEKNLTGVKSVGKAFGRSLNLRHHQRVHRGERPDICEECGKAFSVASNLRVDVGVHRREKVCRCEECGKGFSQSARLEAHQRVHTGEKPYECDICDKDFRHRSRLTYHQKVHTGKK

SEQ ID NO: 937936 - protein, 130 aa, Homo sapiens
FHKDWQRAWPRGSTSRPVRSADRKAAAEPKAQPHSASRATASRSHPAHRALPHGSVPHEGARRPGFQLEELRVAGIHKKVARTIGISVDPRRRNKSTESLQANVQRLKEYRSKLILFPRKPSAPKKGDSS

SEQ ID NO: 937937 - protein, 292 aa, Homo sapiens
VFPPFLLSFLPSFLSFFSVSALRPAPPSRPSVSVVVFCNYQLCGGSSSSWVLGLFCLLLSCWVRWRCSGGATPLSIRDVFFVVAPTPRTDFSLAVRACCFYFGVLVLSVGFVCCEYYSLLLSPPGAHTFWHQWVCLCSVSPHAPCGLSILCSLCWSCVTSPCSFWFFFSHPRRARVVLPRLGSSTTTPPLLVSLSLVFLLGDFIVLFRWRRLLDTVSCRYLGPPPCCPPPHPPPLPRWRPPLRALARKSVALSLSHPTGGFSPREFPPPPPPPFSPFFPPPIWEPQKIFFPT

SEQ ID NO: 937938 - protein, 114 aa, Homo sapiens
LDHISTVPAWLFMCFDPLQCGTDANPQEVRRHQQPQAQGQAIGVREIDHQQQAAQQPDSGHCDIERHEALDPERCRNFIGVTVNSARTITVSKVIQAIRLDDVDAQRDHVPGGV

SEQ ID NO: 937939 - protein, 72 aa, Homo sapiens
LTWAAGRTRKDAESPSPSGSEIYDVLPYVFTLLFLSTLKGGFPQMPASLEAGFQGCKRKVILIQEDSKKQRQ

SEQ ID NO: 937940 - protein, 113 aa, Homo sapiens
ARLTLQELDFNGNAFVTGATGLLGNNLVHALLKRNIKVKALVRSVEKAKKQFGNLPVEFVQGDMLNVDAFSHALRGCDALFHTAAYFRDSYKGGKHWQKLHDTNVTGTERLLQ

SEQ ID NO: 937941 - protein, 150 aa, Homo sapiens
LDVQAEPKSVCSDAMVGRPKKPAAAKKTTRKSSTALPDQLTPQLATLVDRAPDGDWVYEIKFDGYRILTRIRDGEVRLFTRNGHDWTDRLPRQVKALEALKLKDSWLDGEVVSLNADGLPDFQALQNAFDIGRSLDIVYYLFDAPFLEGR

SEQ ID NO: 937942 - protein, 100 aa, Homo sapiens
MGEPQIISEKGKAPELPASCLACLTNALCRFSPDSSEVSLGKDELHMGSSHLSLASAQHLTPEPPLPWPLFPAVPPPLLFLSSWSKQGEVGWGPAVGQPT

SEQ ID NO: 937943 - protein, 51 aa, Homo sapiens
KVSGMVIADRAWHGWIAPAARRHEVNAPRVLNCSERMIPLPNNTSITSQKV

SEQ ID NO: 937944 - protein, 96 aa, Homo sapiens
NLGVVCCSCTRAVAETLSPSNAPATHTLNNPLEIITRLHSQIKNTVTRDSFANTSVKTVNTGNNLAAADGYSDMPGMSPGCYRQNFYISRFMISAA

SEQ ID NO: 937945 - protein, 228 aa, Homo sapiens
MAVLTTNMAVGYPFSLGNLSPLYGPAHYWGVRTTHRAFFSLAYPTAPLFFWVAPPYTPVCAIYGLSASHPGPPHQLRPYLLVNWNPSLQSPHAGRFQNRCYVTIAGDNHGVCISPLWGVSSYTHQCYTHTQSKIQAPVAEKRFPALFRPQFATLCTRLFKQSLRVAPLPVMLFPPQVLPRHSCAPPRGINLERFFTKGAASSMLRFPLEAQSNQAIRAARNGVMSIII

SEQ ID NO: 937946 - protein, 105 aa, Homo sapiens
LDPLRWQAGSYRSVVSAKPVSERRVLNQIGQVTPCRESRKAFGVLRQVLLVIGLGIEEGRRFVDFRGDSAMAGLAQFGLVQLLALQCRFQLIRAGGVDHRAVLAA

SEQ ID NO: 937947 - protein, 39 aa, Homo sapiens
CPYYYYIRGRVDVYKGQGLRSKGNSPVWTRTYWEFLVHG

SEQ ID NO: 937948 - protein, 44 aa, Homo sapiens
ARPGWVRWLPCLACVPALWEAGGSPKVHGRSSTRPGPYMGSNPG

SEQ ID NO: 937949 - protein, 39 aa, Homo sapiens
GRPASTQASKALCQCRICMRNFSRSELTCTTQHSGTPRQ

SEQ ID NO: 937950 - protein, 76 aa, Homo sapiens
ASTFKLHSEFDWIKHTQLTLDDLKGKLNLKADELPAWETWSSGVLADAKEQLKKDNGEGEKDAAAPKALVDQTTPE

SEQ ID NO: 937951 - protein, 69 aa, Homo sapiens
YQAKHDTSLTLGTVTHTCNPNTSGGQGKRIETSLGKIDPISGKTTTKLSAWWLMPIINRTLGGRGGRIA

SEQ ID NO: 937952 - protein, 55 aa, Homo sapiens
PLVGVRVVHLYDARDVVETPVVAPDDVDLPLQQAGPASDWPARMGVTLVHCPSPA

SEQ ID NO: 937953 - protein, 33 aa, Homo sapiens
FVEVLACAGGCLNGRAKPRLQTDMRIRPAAADG

SEQ ID NO: 937954 - protein, 143 aa, Homo sapiens
STVVTQVATVFDLQADAVPRPCTGGGGRSPCRLPGSRRTCRSGTGNGTGGLARVLALVERLQGHEHDTGVRAVGETLIDRPGKAPRFPRQAVSGPGRTCAGSRLRYGPGSRIRQLGEGTRYCLSWAGTKPVGVLAKPNQVRTS

SEQ ID NO: 937955 - protein, 101 aa, Homo sapiens
KETHRITTLVAQAGVQWRDLGSLQPPPPRFNRFFCLSLLSSWDYRHAPPRPSNFVFLVETGFLHVGQAGLELLTSGDPPPRPLCFLCFLALSTEKASVWWT

SEQ ID NO: 937956 - protein, 42 aa, Homo sapiens
VDLQRGTDAQALFVVDFIRTEAWACDSVMVTAFGSKPKITSA

SEQ ID NO: 937957 - protein, 34 aa, Homo sapiens
KLFGEQGTDLFYIESPIRADGGSGDRLQDGDQRE

SEQ ID NO: 937958 - protein, 174 aa, Homo sapiens
DLLLLNSLPVDHYHFPKLDALMNILILLPFAVRLVVSSVGLLQLYGSGPFAMVGTPWILIGCYFTVALQFMYRAITNNLQAINLRDLMDAAHLLGASTWQAAFLVVLPNLRKGLMVALLLSFSFLFGEFVFANILVGTRYETLQVYLNNMRNSSGHFTSALVISYFLFVLVLTG

SEQ ID NO: 937959 - protein, 109 aa, Homo sapiens
RLQITDLSTSHLILYTLLFTSNITLLFLYMFPNLFLLVTFGPQENRESQCWFATKKPGAGWAIVTPIIPALWEAEAGGSLESPGVRDQPGQHGETQSLQKLARCGGMCL

SEQ ID NO: 937960 - protein, 121 aa, Homo sapiens
LDRLLQGINRRNINAVRRQTRDLAGLDITRQQIGLAQRWERSGDVLRSGTVPFFGAGKPRFCATRWPVRGDVGEDLVHLPSPDEFTLHLAQLEAVSRDDVLLLVLAHAAEKQARLGEVITE

SEQ ID NO: 937961 - protein, 117 aa, Homo sapiens
ARPGGFETTDFLHFAIPFFHKLPDAFVFVARVDFEAALLPDHLVAPAIVVCSQLTTCKKGIVRVCRRRMVGAAAGRSTSESAKIVALSRSRRFLLVCSARASALNREGLAGFGADTV

SEQ ID NO: 937962 - protein, 51 aa, Homo sapiens
LDPPHSLHPQRISTAEADITPPLSLTVTPFHSFPAATKISNTVSLMSASVC

SEQ ID NO: 937963 - protein, 70 aa, Homo sapiens
IAILLSVRGDYGKPLHFFKALLDNQWEGDHREVITDIAGKYQLRKLMEYLLPVRGLFDKLEAVVKVKSAY

SEQ ID NO: 937964 - protein, 72 aa, Homo sapiens
PGLVANFRRCSTTVGNHQGLFTSLQKMFPKGGGTTLCEARPLFEGEVGTPRWWYTHARGEMDAGDPPPDVCL

SEQ ID NO: 937965 - protein, 57 aa, Homo sapiens
MFALEGVYSRSSALLALTVVTPTTTACEKPSTQETLYTTHNRRAFSNRPTSAAKTKK

SEQ ID NO: 937966 - protein, 106 aa, Homo sapiens
LVQMKQTGKITESRPTPVPTATTVPSSLQATDGPSYARTVIPPVSTSGHPNAVGTFTEIPGSNIRRVIATRLTESKSTVPHAYATADCDLGAVLKVRQDLVKDVIK

SEQ ID NO: 937967 - protein, 144 aa, Homo sapiens
LDLEIDNCTRLGYDAVIVARTIPPCLTVPITTLSMQKTRRWPGQRLRFRTVHSRPGSAAYAARPTRQALHLTQLKDKDLWTYFSAVIQMFGFNFAPNGWALCNGQLLNIQQYNALFALLGTTYGGNGQQSFGLPNLQSRLPIAQ

SEQ ID NO: 937968 - protein, 152 aa, Homo sapiens
LDLKVKLSDYRVIGRCRVGHGPTSLRTGYCWFGRSAKKHSRVRPTVLNASSDQGICVLRTAVLPGFLRRRKFQVHQFGTVEHMYLVDMRHVDQRIDAQVAHLGASLFQGFPASGLFHGLAVFHKTGGQGPVTPARLDGTAAEQDLGAPDRQQ

SEQ ID NO: 937969 - protein, 145 aa, Homo sapiens
DGQQSQGALAWREPMRTHSLSPLAMAALEQARSQLGLAPVHKHHVWSEAEERSLIARYPNEPTQVLAAELGLSVYQVYAKAKRLGLSKSAEFLRSSLCGRLDELGAEFRFPKGSVPWNKGLKGLPSSGRMTQTQFKAGNKPGNWL

SEQ ID NO: 937970 - protein, 121 aa, Homo sapiens
GRPEFRRLYPDMQLELNSNDLIIDLLEQSTDIAIRIGNLAEFDPARAFPGQQPLNILASPAYLEKHGLQASVRGLSGHTLLGFTQTESLNHWPLRHAQGDRWQIQPGICASRARHCASWPW

SEQ ID NO: 937971 - protein, 51 aa, Homo sapiens
MLDAVVIPDIGQRRTQAAEVDQAHHLLRTQGFDDRKTRLPAQPGGQPEHGR

SEQ ID NO: 937972 - protein, 81 aa, Homo sapiens
MEVMQTAAGEEAFAGVGRVLPAEGRVEHFRQGAVAVLRQVVHRPEGDRVLGVIRHFFQFGGGLVAITVVQFGNDLQVAGQH

SEQ ID NO: 937973 - protein, 74 aa, Homo sapiens
MSPVMITSFGYMLLVVGRERRTANRHTRLDVVGDDLNLAALVSEEVGDRHAGELADGVVDRHVLARCDLAIEHV

SEQ ID NO: 937974 - protein, 101 aa, Homo sapiens
TQQERMKFSIGSKALVPDVSLIDPETTASMDPFLSACTGIDALVHAIEAFVSTGHALLTDPHALEDMRLINGNLVQMIANPGDIALGRKIMLGSMQAGLAF

SEQ ID NO: 937975 - protein, 135 aa, Homo sapiens
LDNKKLSVASTCIAAIFVLSSNVVLQATTMVEFPAPISLCAITSLIGVTITAAIQLIQDHKIETGWPLVSVGNLVGYSLLAGAVSGSCLSFNNWAMKKRGPVLVSTFSPVSTVCTIIFSVVTLGETVNIGSIAGM

SEQ ID NO: 937976 - protein, 73 aa, Homo sapiens
VDRAQGVFAAGGVGHLHVDVHRVRRPGKNTTASLRRRIHRREHGRFTGFHQLELAQAELVLGDHFLDLGVGAR

SEQ ID NO: 937977 - protein, 120 aa, Homo sapiens
PAVGSTVAAGWANVALTAIATGAASNATISFINNGGNLGAVLKDVTAKGALRDYVVSGVTAGLTAGLFDKMTGTTTAVEGALPNAGKVLAEGGLSSLEGIGRFGANQLLQNGTSTLLDRA

SEQ ID NO: 937978 - protein, 78 aa, Homo sapiens
RLQYTTTNTIHYRPFTTTNTIHHHTFTTTNTILHHTFTTTNTIHHNKYMGSVCSHSNTNTWDQYVPNAIQTHEISMFP

SEQ ID NO: 937979 - protein, 121 aa, Homo sapiens
VDLGGKPLPSIPGGLSSDPWLYRASEVLLQTLDCPIDPLQEQDAMFDLAQALNNASGTVNRKTFDYRAAERARNFIHSALGRPITLDEMAEYANRDRWALSRNFRLLFGTSPYRYLTMRRL

SEQ ID NO: 937980 - protein, 99 aa, Homo sapiens
ARHKIVGLLNYCGSWLPGQQKHRTSVMNATCLRHDVVSYAIQKPVGLECPLFCPRSLRTAMFSRDLTIAKYDADLFAAMEQEAQRQEEHIELIASENCR

SEQ ID NO: 937981 - protein, 111 aa, Homo sapiens
STVNLCNTAAAAGASGAGVQMWRCAQWREELEVMIALHACDIATDYAIHTGIRSGAAIIMCSPCCHKQIRLQIQSPVLLKPMLQYGLHLGQQAEMVTDSLRALFLEACAYG

SEQ ID NO: 937982 - protein, 76 aa, Homo sapiens
VDPGAIEFCPAVRSKSLITLKPRCSNSPSVRPFNGLPLDNDNGFCEEFIVRKLTQLVLLATVLVATPAFAEMKIAV

SEQ ID NO: 937983 - protein, 120 aa, Homo sapiens
LDKQHRSAAVFLREITAEDVLEVTDKIAAEGAEMEPSFVLAQSLGENFAHAATSGPLVLGMLAAAAADLVSFASPCVVPLVPGYISYLASIVGGEVTHDVKRGAVVGKRPSGLWWVPRCC

SEQ ID NO: 937984 - protein, 54 aa, Homo sapiens
MRPRVAWALLVPRPWGLGPRGARRGGPCRLLPVAAELRDAVTPKQDDGGSGLRA

SEQ ID NO: 937985 - protein, 104 aa, Homo sapiens
LDVSATGGHATGGLELWKQAGLGHVRLLNTYGPTETTITASYLECDAYVQRRIAQAVVDADRSAAGWRRMYILDSDFTPAVQGATGELLIGGACWPGVITAVDA

SEQ ID NO: 937986 - protein, 113 aa, Homo sapiens
GYRVLGVLLCHPGWSAVADLGSLQPPLPRFKQFSCLSLPSSWDYRRTQPCLANFCIFSRDGVSPCWPGWSGTPDHNDPPTLASQSTGITGVTTALSWFSKLLDFSSSSNATGV

SEQ ID NO: 937987 - protein, 137 aa, Homo sapiens
RPDKLCILPSEHQSGWVINGSIRLAHLYFSPEQFALGCVTLLDREPRELQLQEHTFLDDPQQALRISQLISLDWDEPGERLLSSSLAHELLGHTLLNQVGMRQGLRLKGGLAAISTAVGGGIDSRLDQPLSLGELAG

SEQ ID NO: 937988 - protein, 124 aa, Homo sapiens
SREFSSLLSRGCLSTSRIDMDALEDYVCRGQTSELILLPVTGLECVGDRLLAGEAWLEARLVERGKETAPPRAVPQGQKGCPEEKDGQQVEADRRWEGSPGDGGDEGQPEERGPRDKADVARGA

SEQ ID NO: 937989 - protein, 170 aa, Homo sapiens
PRLAKNAGAEFSDKGYSTIVARAEGDDELVEILGLRIDIPAKLLRDLLARQGYRYAPAVALASPRAREEISQVLNDIAQDEARSRAATQRIAEELVKLMKQLNELDDAAVYKFAESGKFDEVTVSAVLNDMPIAMIERLMLGLRSDLLLIPCRSARLNWPTVETIHGKRP

SEQ ID NO: 937990 - protein, 102 aa, Homo sapiens
MDEENESRHRLGFSLEGRKFHSQVTSLFPTLSTVWDKVPADIRILAIKSTTLRVDQSILTGLLAWVGRCMGVGRGEEEANKGEVSGKTENPHCLSNIKRPCL

SEQ ID NO: 937991 - protein, 91 aa, Homo sapiens
STPRAFKSWKHPVHDFYGFRGCYLHSQQFSVAVVVDTCSHQHTGFDHTPPFANFHRQCVTRQVVIGPESSGRVRKSSTMASSSLAMSDTST

SEQ ID NO: 937992 - protein, 122 aa, Homo sapiens
FFEMEFCSSLLRMECSGAISAHRNLRLPGSSDSPASASLVAGITGMHHHARLIFFVFLVDTGFLHIGQAGLELPTSGDPPTSASQSAGITGVTTTAWLDLVSCKRVPKTAQRGHPRKLLVCA

SEQ ID NO: 937993 - protein, 39 aa, Homo sapiens
TSWSVCDLTRLEISSLNCWTELFSGTANSSLFFGVFTVT

SEQ ID NO: 937994 - protein, 79 aa, Homo sapiens
LRHGPVLAVLEHGSDEESSDVCDRRVRVRVRVRAEKDSERTLPAGVIMAQASLDVSALRLTAQKMQLIFTAFALVIWGR

SEQ ID NO: 937995 - protein, 83 aa, Homo sapiens
STPEPLAGGKWMWHLMSAEMPPERPESPRMHVPGSTKQHEGKIMFLTEEKTSALQRVDRFLFPPPRSPRDLKECGFLSTAFRC

SEQ ID NO: 937996 - protein, 99 aa, Homo sapiens
ARPSSLTVKSGEHTTTAALCTRGAGAPVRVELESPGKSSVLVVGIVIGVLLLSGSGCRMSSVVEKMRNGPASPWNFRPGKDNRGPPRTPGEGQIPILRD

SEQ ID NO: 937997 - protein, 84 aa, Homo sapiens
QGQQTDLCCLLSAASEENSPHPTRQSCLLWVCCSQVQCWAGEERMKLNYNQCGGCPSICLIPYKRDIIHLFYKRGGIENAALCF

SEQ ID NO: 937998 - protein, 54 aa, Homo sapiens
EDIRAVAQVSINRNSGNQIVDYPYIGVSYSTESNGSTLLVHGTPQIRSWETSSV

SEQ ID NO: 937999 - protein, 55 aa, Homo sapiens
MVKPYLYELKTQPGAVVHTCSPSCSGGRSRIEAPMNRDRATALQPKEQTRRRRGR

SEQ ID NO: 938000 - protein, 159 aa, Homo sapiens
QLHGQELNGGFPSASSFSSAPGATYRGVSSHTSPVSGPDSFLGSRGTTAGSSGDPSAKHWLRSTPRITQAITSRPALLPPWAPPRAWQERHSGLEQEPPVPYLPSYDGGLHGLQSKIEDHLDEAIQRSAARRGTAGDMHTLLPGHGALASVSPVPCRWV

SEQ ID NO: 938001 - protein, 278 aa, Homo sapiens
STNETINNHSEDKVIILISDGITTSDRVLRNQYWDRYMTKWLSHSKLATGRTHSVLSEEIQSSESQRSVKNLHPVLQTASQLSSWRTHQSLGTGLQQLRVAPSFPPEFFLLHITAATTAPMTQLARTARPATMPTMGRWTVKTAPISWVRLRSPYMLYMACVSLLFSRRHHHSCPLLEGSISCWSGLHKLSVLSLVLAIPLPGQCDLRRVETQGPAPQGGLMVRDGVVGHVCLWGVSALQLVLPVLQVSAEPLHALALQVGSPSVRSRAASHLRWVIL

SEQ ID NO: 938002 - protein, 120 aa, Homo sapiens
MGQTGATGPDSTAPQSTCPGACGGSPCSSITAASPPGPPKKQARAVPGLGTLGQDVQHQPRLTPPGPALHPKAAHSSRDKLTDEDLVMALSKGFLEGSSPDSALHSDDESCDSKEVGDIR

SEQ ID NO: 938003 - protein, 51 aa, Homo sapiens
ASNTAPAHAVNGAGLVYGRPGTPRQTPPPRPRPPSMEQHAAARGASTGSMD

SEQ ID NO: 938004 - protein, 200 aa, Homo sapiens
RATEKQPAVYGIITPPVGILILPLPPASPPPRAPARFPPRPPAPPAASRPRPPPPARPPPPVPPRPPAPPRPRPPPPPAAPPPRRPPPRPPPAPTPAPPPPPPPRPPPPPPAPPPRPPPPPPPPPPPPPPRRPAPRRPPPRPPPPPRPPPPPPSPPRPPPPPSPPPRRPPLSPPPAAPPPPPHTRAPPRLRPRPRPPPLF

SEQ ID NO: 938005 - protein, 235 aa, Homo sapiens
PPLWVVAPARLGVSLVGSSQFRPLLTAVFCAFVRVSSHDPVGFPPVLSLSPSRRVPCAASVPGEVIRVHALYVSYLPTSLPLSHAGFLPSSGAPNSSLRVGPPCVDVLNEVVVGAPCRFLQKDCSPVSSAAGDFGIISLSYMGIMCVSMIATTVRQRSCHRGGDSSNRPKRRHATPPRAPRLMRAHTRHHRRGDDVVAHDPPQGTTIAARRRGGPSPAAHLKNNCVGFAPQMNRE

SEQ ID NO: 938006 - protein, 166 aa, Homo sapiens
FFFVVRSFLRFFRPFAPPFVRLPSLRPRPPRSPVALALRPRFAFWSPLCVPRFLLPLALLRPLLFLFFCVAALPFLVLGFRRFFFLPSASVRCFGLFPLLLSLLVAVALPPFWCVLRRGPRLRPRVTVPRSPTLARCFRATSPRPPFRRRSRPGLTGRPRRVPLPY

SEQ ID NO: 938007 - protein, 75 aa, Homo sapiens
LNRLQDLAYEEVCAKHQGKEASALPMSNVSTQLPINDRGFPNLNLGLVAALGLRFKPNLFLLPLGLGNGFKGPQG

SEQ ID NO: 938008 - protein, 192 aa, Homo sapiens
MLCTHLLKFKLLSKLALTAAERLTSRTFLPLLSSGSESMLVLPLWSFNLAMTQQRHVLLTPLSHDSGKGGSGRLSDLSRVTELDPSPESDSKVGALNRFASGEWEPESRSLRGAARTGVTHFSPMGAQGVRVRPVCSSSGHRLRSRLVAPGEPQPADFGLLSPTLATRPLPVAGLARPPGPSHRSAAAASHA

SEQ ID NO: 938009 - protein, 80 aa, Homo sapiens
TPGAVNIPRGILEFRLSSTPELAIRDLKIILYCKTSGRAALSALALGEMGYVNVSSIAGGFDAWVAEAKAVATPSLPAFE

SEQ ID NO: 938010 - protein, 157 aa, Homo sapiens
RRGGGGRNRGARGDPGGRAGGQGERKERGNREGRGAREAKGAAAQGNGGDRQTPPGPTKGEKGGGDRGGRGGPGEGGTPGRKGAGSRKPHSAHRPGAGEHRQKRPHPADKTQRGGGRGGEAKRRAGKAERGRESEAADGEGEEKKGGKRRRRREKGD

SEQ ID NO: 938011 - protein, 113 aa, Homo sapiens
FFFQGKSGNLIRIHKTLYFRKQLSKHGLQQAHSIRETFRATNLVVKPRITGLLSSKLKVKKTKNQPTKNPLNPTKPQNQPTYSWLSSPIFKPQFFLKSMLGGNTGNWSKRAAN

SEQ ID NO: 938012 - protein, 112 aa, Homo sapiens
PALNAALLSIIALPIFPAWAIYATIRGKGCATYLTEYHISTTPNLKADKVCARRSYVAIILVRYGRINLEQQRKRAKELLLRLKCADAADTPTLSEAQWLIAKELGFPSWPK

SEQ ID NO: 938013 - protein, 119 aa, Homo sapiens
FFLDSVGVLPRLECSGTISAHCNVCLLGSSDCRAPAPQVAGITGAHHHAWLTVFLVEMGFHHVGQPAPKLLASSNPPASASHSAGITGLSHCTKPQLQIVSFRDRLDRIQTQNCEISAA

SEQ ID NO: 938014 - protein, 70 aa, Homo sapiens
DTDEASCVEVCSKPDDLWVPGRDGLLHGCSWDLRHWVDLNRVRAGPILEFPTQELLMKQIPVGDKCQKIE

SEQ ID NO: 938015 - protein, 105 aa, Homo sapiens
VDVKPKEVIPGSKGVSRTDDLLHCHPTWNVLVPYCQGLSCAPKQGKARQGKDKQGQLHPAQSTQLQRTRPYKASSDTLHMRTEDCATPPRPGYHLHGWGLCAIVK

SEQ ID NO: 938016 - protein, 112 aa, Homo sapiens
LVYKLSCTDKAYRLISSWTHPRCGHGEPVVLGVLASDTKAPEVTQPSMGLNLLQSLQVFTELVVQTLARTWLYFHPLHLLSVQEQSGILYWRGFCIMVITRSRHLSGRRGLT

SEQ ID NO: 938017 - protein, 120 aa, Homo sapiens
ARRNQVELNRKERKRMDEMKWNGIEWKVMQWNRMERNFTEWNQTEWNGMEWNGMEGNAMDSTRLQWNGIEWNGMEWNGMVRNRMEWNELKWNGIEWNGMEWNGMNASAGECNGTECNGST

SEQ ID NO: 938018 - protein, 83 aa, Homo sapiens
STPKTSSERSTYPLADSTKREFQHCSIHRRVQLGELNAIITEKFLRRLLSRFYAKMYPFRTKATECPNIHLETLQTECFQTAE

SEQ ID NO: 938019 - protein, 114 aa, Homo sapiens
STTPISFLACTALASAVGQTAGHWVKPKNTIGIMRGELDSVLTLPAVSFSLKVRPRISSLRSLPYLYDKRLELSQPVSAPRPSRQGRNDLAAVSNSFMFCSPSYGAMSRPGVAG

SEQ ID NO: 938020 - protein, 92 aa, Homo sapiens
MCRGQGQRLRKVAHAYDVQAGLVVLELGRRAQALDDLQACIAHSCACTSDKWVRTRALRYRDGRACYVVDRAQFQAACLVVDLAQAVTKITG

SEQ ID NO: 938021 - protein, 101 aa, Homo sapiens
GRLLKIQKLAGHGGVRLWYQLLRRLRQENRSGGGCCSEARLHHCTPAWVTELDSVSKSYFFMLTKSDKQSVIHLLVHMWVSLGYIPIRKLLEYGMCVSRHL

SEQ ID NO: 938022 - protein, 73 aa, Homo sapiens
LDGREKKENGAWFDAFSKGSDFSDTSFTFLTRHLITTSIHILVHSRMENSDSSIDSSGAAQLEMLTPEDLSSG

SEQ ID NO: 938023 - protein, 101 aa, Homo sapiens
STWSGMECNTMERNGMEQSVVEWIRVEKSGTECSWSGVECNGVEWSGLEWSAIKWNGMGWHRMEWKRKNVTERNGMEWRGDKLSGEDQDAVEWNGMEWSEV

SEQ ID NO: 938024 - protein, 137 aa, Homo sapiens
RPLDIGIGEHEESIVGRSFEGHVKAFSDVAAGTVRTRHPATGKGFIAALCMMKCHPHGSWLVFYIDQFGIPLDLYPQRVQSFKQDLLCLRLWQAEEQGIGRIQVGEVVVQHPFAVRLHRKLVDREPVTDDLIGNTQV

SEQ ID NO: 938025 - protein, 78 aa, Homo sapiens
VDVLRRARAEVCEPPLPVRELAGGIGPNIRTVGFLSSRHEHLHRCLIGLNNLLPENHVAQHQPAAGTEPQSRPSGSRR

SEQ ID NO: 938026 - protein, 40 aa, Homo sapiens
VDAKEKEKTKEKVRIPSSVPFEPNLREDRSLSQPQKVNVD

SEQ ID NO: 938027 - protein, 59 aa, Homo sapiens
VDAEKQIRPLTKKVVATCVLTPIVPALWEAEAGGSRGQEIETILAEYGETPSLLNIQKK

SEQ ID NO: 938028 - protein, 42 aa, Homo sapiens
MSDLVVWLQSHTLNDNAVLTLANASMPFVMENCQVHYWLFVD

SEQ ID NO: 938029 - protein, 101 aa, Homo sapiens
STGTISTGTLTRVEGTRPTTTTDIVERLERDGLVARQRDPHDARSRLVEITDAGREYCRNCEPVGGGVRRAGAKHVERSGSKSSDENFARLSPGCPSSFRE

SEQ ID NO: 938030 - protein, 107 aa, Homo sapiens
VDPEDLRGTYVGHAHPSDDRHLKRLGITTVELLPVQASASEPYVVQRGMTNYWGYNTLDSSPLTFHMQLRPTRSRRGEFKGMVKLLHAEGIEVVLDVVYNHTCEQST

SEQ ID NO: 938031 - protein, 100 aa, Homo sapiens
STPGAALCNQGLRYGFDQKGDRTFAWHNAVSVLAERLHPGPGGKGGQLREPQEQRRWSTVFNAMTIDVIRLSTVDQGLSISIAYGNELQAVSTDSAGPPS

SEQ ID NO: 938032 - protein, 111 aa, Homo sapiens
KLLLLNDTSMGWSILTAVAIIWLLISFGLAQPRYLSSLVLSLPENRQTDEWTSQLLSIHGIEEVVVMPEQQVAYVKVDKQQINDTARQQLTHLLGKEEPFKHNSYKVKCRR

SEQ ID NO: 938033 - protein, 180 aa, Homo sapiens
ASTKVSRSRIARQIAVTYVAGEDVASAVDKAADQVSKGLDVSLHPLDPDPADLAQARRAMVRLCGVIERLGADPSFNGHAEVSISLAALGLKISDDLARDHARQVCQVARDDHVSCDRDDESPDIHDRSHRIVVDLLSRYENVDAQEILLKFNENSERELRRTVSRNGAGEDGGKREEVL

SEQ ID NO: 938034 - protein, 97 aa, Homo sapiens
GRRAFDLKFEAAFARWQRTGQSFVLALIDIDHFKSFNDSYGHAAGDEALSQVAALFQRHSRNYDFFARYGGEEFVLILPGTDTASANKTLEKLRLVV

SEQ ID NO: 938035 - protein, 162 aa, Homo sapiens
ASTGGAHIILIETIFDTLNAKAASLRLRGAFRGQGIRLPVMISGTITDLSGRTLSGQTPSAFWNSVRHANPFTIGLNCALGGSAMRPHLQELSDVADTFVCAYPNAGLPNEFGQYYETPEIMARQVHRVCPPRAFLKIFGGFVSARTRESSSGGFSKAVIRI

SEQ ID NO: 938036 - protein, 132 aa, Homo sapiens
VDVQVHEHHPQGLLLPLGRADGLLKMMAHDVAVDQAGERVGLAWNSSSASERFIEVMSESAATKCVTTLLSSRTGAMVEIVPQLGAILVIVAQYNIVFALFAMGSRQSRTFRMLSGPPGNECSCHRFTLCSH

SEQ ID NO: 938037 - protein, 175 aa, Homo sapiens
GRPWDRTGNTGAAPSANRADEHEAAIMLGIDQFVRRRRRFHQHAEPAEGIDALVILALALRNGRTRDAMEAVATGNEIRLQRVLLALVHEAHRLVGLDAFDGGAADTEQQLPLRGQTRATRSLITSCWAETVMALAVSSVRSMRWRRHRRPARSRDAGGLAVSRRGAILKSSIIA

SEQ ID NO: 938038 - protein, 141 aa, Homo sapiens
MRGGYGAGVEQLLHHLVAGRGARVVGGAGGAHDLVNLVPIHIRLLPETLGHGDKRAGDGGTGGGVLAEQAELGDRLLALHIPGKRLRIRLNSGEAHELGTATLIEPLPRLPIDEVSAKRFVVKLNLAQIIPMVWEIFPEET

SEQ ID NO: 938039 - protein, 153 aa, Homo sapiens
MGHFGEVLDQRYERAANTFCLIGHAFGIPGQPFKSIRVQHLSAFQDLKVDLTDTRFGADTRPIDGYRLQLLFDDLQCLCFFEYKLFPCGKANGESTLVIVAQYQHGLCGLGSRTHLWADIVGRRQLISFSIKNAAMIYAMIVGMLHRMFKTVV

SEQ ID NO: 938040 - protein, 204 aa, Homo sapiens
AQAERFQPPQPVLPPEDLRSASTLSKIPCQLPSRLERVMGKPSVDMPQSEDCLLLDITLPAGNVENRAVMVWFHGGGYFSGGGGMPWYGAEKLAQEGNVIVVNVSYRLGVFGYLMLDGVCQGNLGLLDQIEAVRWVNRHIAKLGGNQTTSHYSGSLRALILIAYMMAMGKDRPLFAHAFCKSTMDPTDQNCQASYVSSIWQDAR

SEQ ID NO: 938041 - protein, 152 aa, Homo sapiens
PGQFDIEARGTQASVPHWPRTSAAADGRIAHTALQDQTDPQLVVLVEPLALLAGQDNPLPMGSRRRAGNQGKTQTADNPQAAKPYHSTLTHRQMLTNSLGFQDDSCLGKFRCFFSTALAIGRGGAWPLVTNLVPGPGNWAANVRIGPQILGS

SEQ ID NO: 938042 - protein, 164 aa, Homo sapiens
NFFAVNFSLFNFRFKLKNIILESCSFKIFTVSKIIIADTPRAMLTLFWHDVCGTGNKPEVRLPITVSSSNSAALPSGNTSSKPLIIHIVQQTADIFGCDVYFQCPRCIDIANNQRHIRNITHHHAAIQHMFGGIMGLHQIEAASTQNLNINPVLIGIWHQRLPI

SEQ ID NO: 938043 - protein, 280 aa, Homo sapiens
MFLILGNVTLLGEYSSPCLNHTVLKALNNVWFLSFYPRFFLWSGKKFFTNTTIVCIWGAPPVVPRLGVSRGVPGSWHLQALIVTLVYPPWNCGETLTAPHEKEFLPLRFRDFPRATCSTLERVVGETPPIWQIFVCLQYAPRPTPSCGECGLYEGLPYRISTIPSGRSPTAPLTVAPTTTTPFPLNALTTFEGTHTCGHSFPGGPRSHDPVPAPRARTGTSTEENHGWNTRGTLVSGEGLAYTRHPTLKPSRPQLRAGVGHSATEPRRVPRGKPAPGAHS

SEQ ID NO: 938044 - protein, 84 aa, Homo sapiens
EKNSGSQAWNPGIASGGMGGGLGVITFINSGSGTTERDCFIEWEVTKEKVQFSIVWRQVDTLYLRFRIGGLLPLQSPAVSCVRK

SEQ ID NO: 938045 - protein, 66 aa, Homo sapiens
LDCMRHGPSHEANLTASAEDTLNEQDGPGTVAHACNPSTLGGRGRWITLRSGVGASLANMVKPHLH

SEQ ID NO: 938046 - protein, 165 aa, Homo sapiens
RRLCFACQVVVLPSKVKRHSRGYVERIPHIEVGRVLALGVVRGVGGRAYVLLVRLLRIDKHLPLLARGLVAHLGPPQGIGRRTQGVGKIHVIAGRRPGIDLRVETAALAILQLRLVDLTRQAGNWLLPEHTIIAVVEVVEGVSLAQRTGVAIGAVQSCDSSGLDA

SEQ ID NO: 938047 - protein, 83 aa, Homo sapiens
HEAHFRSGHLSPLAKDCVLRKSFIDLTGQADGWFALFLADENQGSPAAPGSRLVTMREPKRRTKMWSRTLDQTSPESRLWASQ

SEQ ID NO: 938048 - protein, 95 aa, Homo sapiens
GALSGVLLCPFSSSAGRLGSLGALQVQTPPPRGCSSDGETGWVTKAPGGSPCCLASSLGKAFRSLMEEDRGKRPVFPDATGQPLPGEEEAEIHSN

SEQ ID NO: 938049 - protein, 175 aa, Homo sapiens
GLNPIQMVVLELDPSGHPSSKHTPYMFGPESTWEGLCQRGRLASRPYVSSRPLKRASRAHLCTSSCHSLNRRRQQLAGRPAHGKILRRLRQGLQAATLAPRPATATRALPRSVRAAESTAGLRRGALGLRPGCTNPGSSSPRPPGREIEGTAGPAATGTGRQGESLRGSLTGHPH

SEQ ID NO: 938050 - protein, 121 aa, Homo sapiens
STTAIGVGDVAIDCLRRTHVVIGVQSAGRCATVNHDIDLLKTLGVQVLAQQRLQVLPVCADHKAQLAMRNSGGGMALTGLAGLPAVNARISTVFQPKSRSPRVKSGSPSAHPKDGPGNSDV

SEQ ID NO: 938051 - protein, 49 aa, Homo sapiens
MGLETGGADERRTDSDGCQYAGALNPNRLWVRKLLKGKAVKAGKSALAV

SEQ ID NO: 938052 - protein, 147 aa, Homo sapiens
FFQLLILVGIGLSFFVPFAPKSWPAAIDWHTIITLSGLMLLTKGVLSGYFDVLGRKMVRRFATERRLAMFMVLAAALLSTFLTNVSLFIVVPLTITLKRLCIPVNRLIIFEALAVNAGSLLTQLATAKYSYLGTSGLSLPDYCPNAP

SEQ ID NO: 938053 - protein, 71 aa, Homo sapiens
MDARLTAPVNTLSALTLSSDGNACVNEQLSSCFSRLRHKFDCGKLTPVPVRETPVCRCPVNQQLTSCPAED

SEQ ID NO: 938054 - protein, 124 aa, Homo sapiens
VRLHLQFLRTGSHAHVALAGHLQQLLLLVAEPCDGLEGHVSFAALAIVVQGPQQQCRRQRVVALLVEALAKFIQQACRHIVEHFREVTGEQMQVLCVVHQRVVIQAVAVPFIRQESHGTLRNSV

SEQ ID NO: 938055 - protein, 68 aa, Homo sapiens
MGVLCPVGLMTLPERCQPLKGANAFDRLRGQQPENSRLNHRPMLNRRPKQPAVQPNCPMTTRSNGGSS

SEQ ID NO: 938056 - protein, 85 aa, Homo sapiens
MPPTTTKLKAGTTPDLRSYRRDLHRALRQCQPAGRAGSQDYITLILLLTFLAGVFQWLLGMLRFGALVNFVSHSVVLGFTLGAAS

SEQ ID NO: 938057 - protein, 83 aa, Homo sapiens
LDNMLTQYPELYGAIVSQVPLLDMQRYHLLLAGASWMGEYGNPDEPEEWAYIQTFSPYHLFDSGEGYPPVFFLTSTRDDRVQS

SEQ ID NO: 938058 - protein, 83 aa, Homo sapiens
RRRRGFKPQPVDKQHQPGDADGQGVVGDHADCAALFLGNHVAQGMHDRGGQDCQHPEELGMVQVQALALDDHVQAAETDGDVD

SEQ ID NO: 938059 - protein, 55 aa, Homo sapiens
AYEGRQEERCIPALQEASGLVWKEDFTVGYSPERINPGDRTHTLCTIVKVVSGDG

SEQ ID NO: 938060 - protein, 73 aa, Homo sapiens
GRLPLVWFVRNSGGLDGMGRPLARGGRLEYRGEASTRRGLSGAQVPDFSSSAPLQVVLGAQIGEFSGQSLLST

SEQ ID NO: 938061 - protein, 129 aa, Homo sapiens
VDRGLLFKLYELWVSIAAIDVDLLEQRETDTEVQFAKFRNGALVAGLLLAELVAGKAQHHQPLVLVMLPEFLKPFVLRGEAALAGSVDHKNRLAGEIGQGHLLTLDGGAWDAQQVVAHGSARKRGEELN

SEQ ID NO: 938062 - protein, 117 aa, Homo sapiens
LDVGLSLDGLYVPGRLLPVVLPGDCGESASGQGRAGDGQWRYLGWLLLFSVISEVPYRMFIDDADTLNVLPTLALGLLVARGWQQKAVIDRGLALIALVLAGLFSAQLMFGFFGVLV

SEQ ID NO: 938063 - protein, 46 aa, Homo sapiens
MVVPTVVVAAVGMTVRPGLQAADVLVGFRVPVDPDRGVFDAELLVD

SEQ ID NO: 938064 - protein, 104 aa, Homo sapiens
MPALIAFAQVAHEGLFVGLGVVNQTAQLTQFTLLQAMEHHIQCRALFAHEQHPQAATGIVSDQVGDGLGLAEYPRPLNDEIAARYRQADGGILRRIAGHHVPLF

SEQ ID NO: 938065 - protein, 92 aa, Homo sapiens
GRHRTDSCLLTFATLTGNGAVTNVRAVEAAFPVDLRRQLVSLLLGGIYATAHGGCAQYATTGGDDLAILERGARVEHLAFQRTSRIQTFNQS

SEQ ID NO: 938066 - protein, 73 aa, Homo sapiens
MTEAMELLGISKEAENFERYPVRKSPPWFRPMPVPVRGKCRRPPQRDVRQDDVPDHFPGSAAQRVGRLFEWRG

SEQ ID NO: 938067 - protein, 93 aa, Homo sapiens
CSFIPQLFLFKILASSKYCEFNPSRLRIRDKPLKSWDLNTKRFDGFGGVRTASRKDRPNCRSCPYSKIVVIRLIFDSECGHCFSPDVKKPPLG

SEQ ID NO: 938068 - protein, 115 aa, Homo sapiens
VDWTVSPENAPDKPQYLELTYRNGDIVALDGVEMTPATVLATLNRIGGEHGIGRLDIVENRYVGMKSRGCYETPGGTIMLRAHRAIESITLDREVAHLKDELMPKYASLIYTGST

SEQ ID NO: 938069 - protein, 74 aa, Homo sapiens
GRYYYYIGGRQTDYAKAIADELGVKLQLQPTNPANRVPLLVANKVDLVLANFTITPERAEQVNFSIPYFSSGST

SEQ ID NO: 938070 - protein, 91 aa, Homo sapiens
RVRVKPLLEQPKQAKTKLLFDLVQLRGQPCTVKLDCSAAADNEPVCTMRIRLRKILLSMADASKVSWRLSRTLRSIGRHLKQRLTAHLPEK

SEQ ID NO: 938071 - protein, 169 aa, Homo sapiens
KLGGPSTSAPRAKKFRKQSKKIQVAMGDVTTSPRKTIQGYRVVRIFGGEVYEQKRFLKASLSNTNKQLRMTRTGAIYTPALQLVIYSAMLVLMFLVLYLRGDASAGDMVAYITLAGLLPKPIRQLSEVSSTIQKGVRAESIFEQLDEDVEIDRGTIERDKVSGRLEVRT

SEQ ID NO: 938072 - protein, 88 aa, Homo sapiens
STRTIIPLENHGFGDRPFLPFEVGQCTRKCHDNFNLLEINHMIRMRVTVNEPIFAVLNQLANLNGLKGQLINLASILRRTYPSTIGCR

SEQ ID NO: 938073 - protein, 68 aa, Homo sapiens
APGLYKHEKRITVPLLVSSILLFYTGMAFAYFLVFPLIFKFFAAATPAGVVDDDQSSRSRGELVMSGR

SEQ ID NO: 938074 - protein, 129 aa, Homo sapiens
VDAFHLEHFQVTTVADQQLALAITHIDRVRRCVDQDSHELNLIAQRLLGLLALAVNIRRYAIQPRAVTSNTAAIPKPWIIALRLRTSSCRLPPLRCATDWSTRPFPGGDAEQRIVQDREQFQRAAAVAK

SEQ ID NO: 938075 - protein, 129 aa, Homo sapiens
MQGTVRPMNCLARLLFKGAERRVGRLALIARPSTADRLGIDRVFQGHAHRLMVLIQVVACHRRLTLAALDHRLFEVDLVQVFLLLSSGFARSIAGRPGGRGVGDHFPGRRLFERVFKGIGGRAGGSTGV

SEQ ID NO: 938076 - protein, 94 aa, Homo sapiens
CTGSIALLVACCHRLVMRRLESLVEPDDDNLSEETGHGFAKQQQQPDSGDSSLPAEIGLRDYRAQGREVPITEEMIQDACRELEQRLVKPAEQD

SEQ ID NO: 938077 - protein, 66 aa, Homo sapiens
ARRLHRPVLALLFQSGDRGMVKQLPAQPDCGIAKPAGVGHRVQGTGTSVEQGGTNLFGTDGLLAGR

SEQ ID NO: 938078 - protein, 116 aa, Homo sapiens
MTRKPVPGIDLATNSASSLETTARIAFPSPDSAQRISTGVLAGVSLNPTMQNQSIKTQGGFQAAGVKRGIELQAQGIGTSMGEERIKFYGPCKFASRRMPQAEAGLNNLYSVLAGI

SEQ ID NO: 938079 - protein, 81 aa, Homo sapiens
RLKAMLAKHGIRHDTTVILYGRDVYAAARVAEIMLYAGVKDVRLLDGGWQTWSDAGLPVERRNPPKVKAEPDFGVKIPGRR

SEQ ID NO: 938080 - protein, 78 aa, Homo sapiens
DLLFENVLMLLLKPVLPAALPPASLWSWLWALGTMTVISLLVGLRPYRLLLARSLYAYYVMMWYERLAAEVLSADCQC

SEQ ID NO: 938081 - protein, 99 aa, Homo sapiens
VDVADACNTSRWRGRGVGDRLVREFETSLVSTVKTVSIKDDKDEPDVVARACNPSYWGGWGMRIAGTWEAEVAVSQDHVTALQPGQQNETVSQKKKKSR

SEQ ID NO: 938082 - protein, 131 aa, Homo sapiens
MSANDEMYELSEHPKENRVSMAGMEKRNDARKLMTGENQRAPKLDRTAYYASSSPRTGSSSQYSGGVREFANSVLVKPFSDGSSTPFTIAQYGMVTELRPAGLMTVVYGSIVRKKPFETISGVNGSESNGT

SEQ ID NO: 938083 - protein, 83 aa, Homo sapiens
RRHAGRFLGIPDEIEDAAYIDGAGEVRRFFTIFLPQVKGSLVVGLTAFIFAWQDYLWPLLITQSSSNYTMMIGNAQCQPHSER

SEQ ID NO: 938084 - protein, 133 aa, Homo sapiens
AAATTTKFTPRRRFGLQVHHAGWTVTAAGTPGAGLAVRGDETAGLQVLGAVETPALVLEVLQQLIQTFAPILLAQHQQEIIAADMPDEIPARVDAVVQALRQAQQHLIPTPIAVDIVERLEAVDIHIASTRPE

SEQ ID NO: 938085 - protein, 108 aa, Homo sapiens
SHIDCAHLRLRCLVGFLRHPVLPPTPAEVTKRQHHQGKAGVLLAQRFVRAVLFRLILQQVFELQALDGHLVVQHEGQLVLPGQGQLGHDFAGGQVQLDLFAGQVLALA

SEQ ID NO: 938086 - protein, 107 aa, Homo sapiens
RSRRIDMSARLVVGEEQIIENARGLAVAVMLIKHAQSGTAHLADKTQFCGVWFGRVRVTARYAAASQNQYKSHGAQCTARKKTTHDGVSSLTLKVRNASIIMGESHF

SEQ ID NO: 938087 - protein, 98 aa, Homo sapiens
MQQLTTGVLEGIGHQGQVVVGGLHHPILVIKQVAYLEQGLAVTPQRTQFAALVIDAIGPYAQRRIAFNNAGLVAEPTDHPKVNLATRNLAVVAVIKVL

SEQ ID NO: 938088 - protein, 85 aa, Homo sapiens
STARENPNGRFLFPGSRCINWRDVVRTPWGSPPCGARRLSSGHWAFELAFSVGYPNPITDFHSSQVLPQRRYLFNTVQLLKLSLS

SEQ ID NO: 938089 - protein, 61 aa, Homo sapiens
KPKRLAIDVISLLAYGAPAVTVSLSGRPRSSTDKRSDEDLGCDRQRLIFLSANAVVAAGRS

SEQ ID NO: 938090 - protein, 99 aa, Homo sapiens
ASTWTVSNLQAQSITGLFTSNGIQFFTTSTNAVTYPTQKGWYLPLIYNNVAAGERVIYPAQITLGRIIFTTAAVDTTDPCVSFGTGKVVELDAFTGKST

SEQ ID NO: 938091 - protein, 110 aa, Homo sapiens
PDSRVTRIEGYWKSDFPTDPSLRPAPSSNLMPGALVSTSDMNETVQPMVMTTHAGDVSGDNRAARDQRNDLWFKRSMFGAAMLVIAVIGQRCCLNALGRRLAFKTFGFGV

SEQ ID NO: 938092 - protein, 124 aa, Homo sapiens
ASTPGDQQALLLARGQLHAHGSEQGIEAIAQFQDAFQQPGLLDTALQTRAVQRVAVHQDVLDHRPGDDLVVGRDIGHALAVRAQTEMPHRLAVDPEAPGVQGIEPGEHFQEGALAAARRGDIGD

SEQ ID NO: 938093 - protein, 86 aa, Homo sapiens
MTDAMELLGISNEAENCCALPSTKVTAMVSPGRAEAKKDPADHGRAGVGQHDVPHHFPGSTTECVGRLLQLSRNTAENLMHHRRDE

SEQ ID NO: 938094 - protein, 113 aa, Homo sapiens
MYGVWVFIGDTGAEALATTLFQQARGWAEEDGARFKSTLAQQRAGNDRDLIAFMEDLERMERGARQLSRIHDRVSAGLLAKRSETLKSFAGKPCSYRLGGIFEIPFPELTGTG

SEQ ID NO: 938095 - protein, 68 aa, Homo sapiens
RRRERPAKSNSSFEPESNQRPKDVCLFNYSPPLYQLSYQKVVTLVGPRDEVKSGRMDVYEKQGKDTSE

SEQ ID NO: 938096 - protein, 68 aa, Homo sapiens
MDSPLLSFRVDEVLVEQLDQLSAATDHDRQDHLNRALIRYLEPESRHLNAIAEGIADAEAGNLTDLQS

SEQ ID NO: 938097 - protein, 102 aa, Homo sapiens
RAPSTLAKGLLTDSFPDLLSLAAEDCCCLIALEAPWTITDAELWITLTVEDSQLYEDTLAGRSVLIKNLTPQTLQPRWTGPYLVIYSTPTAVRLQDPPHWVH

SEQ ID NO: 938098 - protein, 115 aa, Homo sapiens
MTGLGQPPIAVDAGIVGGHQHMGGITRTVVNARHLQHDQADTALGGPGDRRSTVQLTRLSVGMEVSCPLDMMRFFRRLHAAARVRTNDERRAATSTWQGFQAARDRTRAVVIIVP

SEQ ID NO: 938099 - protein, 105 aa, Homo sapiens
MQSVLSCCDGRVRMTPLSRMKYWKLAVLDNGITATESKKQPLEHHRQMMISLVPAFFQGQAQCRSRQCIISFETQIKAHFEPSFVTYNAHSPNEMVSYSTTTSDR

SEQ ID NO: 938100 - protein, 102 aa, Homo sapiens
RRASDHFGHPLPTPYAQLSSPGAPGDHPGLQGVDGVDTFWPFSTSSLSSCSAATPRNAAKITTLMIDVGLARASANWVRARTTAATAVDIQVGDLAGRNHVD

SEQ ID NO: 938101 - protein, 65 aa, Homo sapiens
HRLAADHVVLVGDHVDVLPVDQRRLVGVAAGVGVFFQDGFSVKADKYISNSDMFKRPYLVVGQST

SEQ ID NO: 938102 - protein, 150 aa, Homo sapiens
GRYYYYAYYYKFAAARRYVTHSPLRSVLIPGLYVAVMNLPGVRTAHEFTTSCPCRTTRGTVRAPTPRYPLPFSRMDLALYRELMSAYYGFYQPLEQPWRRGVKSSLTWNGGGVLKTPYLQADLRALGLENSQIDALPLCSELPAITNVAQ

SEQ ID NO: 938103 - protein, 133 aa, Homo sapiens
PEGEENGQAYVVLYKAIDQVRQCVDTIIKDPGSRGFCSMAGTVRTWMKWRCAVSFAVSVPSNVETKEISLTLYIRSNDLGLGTPFNLTEARQLLSLIGRLTGYTPRWFTYFIGDAMCDENHLDMLNEQLTREP

SEQ ID NO: 938104 - protein, 100 aa, Homo sapiens
LKYYDVLCTAHVFFALVQMGPYFDRPNFMLHHSMLLYTRSHLANPIVPGNTVVSPIFGVITSHECPAVPPNVSPRVKSKSSARAWELTPALFHRRLGSII

SEQ ID NO: 938105 - protein, 108 aa, Homo sapiens
MSADIAGNPMALLRVPKLSCGDKPNCSSPSTVAGRKPGKFPVISQRISQRFGRFCGIQRTVSTVVNAINQQDATRSHPVSPKHLTDHRLHCAIPVINGEYAAQAVQFD

SEQ ID NO: 938106 - protein, 120 aa, Homo sapiens
VARTYLQTVMADAYPHLHVTAEKLFVSGLCVKLAAPDLPDYCMLLYPELRTIEGVLKSKMSGLGMPVQQPAGFGTYFDKPAAHYILKPQFAATLRPEQINIISTAYTFFNVERHSLFHME

SEQ ID NO: 938107 - protein, 163 aa, Homo sapiens
NGERIVVPVTADFYRQIHGSSVKKNNILAYSATTVCGVDNIFVIVNKFNLRLPFCDSQQKIHASGIFPTSIYHDSDIDNLNDLSDLPYSRWYHTRREADDFLEVFMADFTLSKSLFSGKYRNASSTPGNIAYALFVLFCFWAGAQLLNLLVHAPGVYERLMQV

SEQ ID NO: 938108 - protein, 130 aa, Homo sapiens
RPLLLLNSRPVDVDRVDFFFLETDLAVAQAGVQWCDLGSQQPLSPGFKRFSCLSLLSRWDYRHTPPRPANFLYFSRDGVSPCRPGWSELLSSGNPPVSASQSARTTGMSTAAGQEFTFGMSTRRNIGRRG

SEQ ID NO: 938109 - protein, 54 aa, Homo sapiens
RRDNRQARQLIGLYVHLGDEVVTAIRRRGLLIYIVSAFDADLVALQVLEVVRVA

SEQ ID NO: 938110 - protein, 98 aa, Homo sapiens
LDMVLLQGGVSLSDNQHTCIHRSEEGLSCMNKDHGCSHICKEAPRRAVACECRPGFELAKNQRDCILYLRMAAALWAIASIVTGVLAPTVPMVTGQVD

SEQ ID NO: 938111 - protein, 35 aa, Homo sapiens
RGRPGAPHRRSDNTAVPARKVGQRLLRSGRAYGGR

SEQ ID NO: 938112 - protein, 115 aa, Homo sapiens
SSDLLYGQKYANCCNQQPQNFSALTQHTLTVCLYNSVWVSWGWLSAGLKDPDSLPLVIPASLKTLESFLFLKEIRKRKCSTNTFLMGQSWEWHTSSGPETRVSLISRKVSKYGLI

SEQ ID NO: 938113 - protein, 53 aa, Homo sapiens
NIFHSGKIYNTWLGVVLTLVIPAIWQIDARALLEIRTSRPAWVTPQDLIFNHH

SEQ ID NO: 938114 - protein, 145 aa, Homo sapiens
DILAVLRISTTWYCSMVIFGVFTIYAILSYSTNYLTEMYGMSLVAASYMGIVINRIFLRLCGRLGGIITTYSKVKSRTRVIQILSVRGLLTLTALLVTKANAQSVAMAIGLIRLVRFTCCSVTRAVLGLPWRSENAVLHYVHRVR

SEQ ID NO: 938115 - protein, 115 aa, Homo sapiens
MNRRMDGMAAKGLEWKGMMECSRMNEWTRMESMEWNGLEWNGMEWTRMECNGMEWNGKEKNGMEWNGMSLEWTAMEWNGMGPTGMEWNGMEKKEMEENRLECNEFGMECNGMEWS

SEQ ID NO: 938116 - protein, 113 aa, Homo sapiens
RPSPTIKLLKYAVIIVPWRMHGVFVRFLAADKDIPETGSKKRFNWTFRTSSEIYGGGPKLQFLTSVHPQAQHHMEASKAWGFHTLKPQPKLYAGLFQPWLSSWDGRHQVSSRR

SEQ ID NO: 938117 - protein, 186 aa, Homo sapiens
AAVVDNVVKLLGDQYYKNAMEQCHNYNPLLFAERIRLLPFLDSETGVAQSNCYIWMEKPDRGPGLASGQLYSYPARRWRKKRRTHPPEDPRLSFPSIKPNKNQTLKKEGLISQDGSSLKALLRTDPLEKRSAPDPRVDDDNLGNFPVTKNLNAKAILKPHDFLDDLDDEKYEKHTPKRRGKGKSKG

SEQ ID NO: 938118 - protein, 132 aa, Homo sapiens
FKHSSTLTNTEKSALLAGNLVVKQWRLALSPKLECSGTISADCNLYLLGSSDSPVSASRVSGITCVCLHAWPIFVFLVETGFRHVAQAGVELLNSSDLPASASQSAGITGVWPHRLPFNNFPNNRIIFLASE

SEQ ID NO: 938119 - protein, 85 aa, Homo sapiens
MRRSRLPATGCFHFSVRSRLPATGCFHFSEQVSIFCAAPSPPQAQGLWKEGPPQTPGLSSSLLQTPGPGGGHPPPPVPTHTRFFQ

SEQ ID NO: 938120 - protein, 100 aa, Homo sapiens
LPPTTTKFATARLMLYRALGGCTRPHVILREGLHGREITCVKRVGTITLGPEYGVPSFMQPDDLEPGSEGPDLTDIVITCSEDTTVCVLALPTNSCECVG

SEQ ID NO: 938121 - protein, 102 aa, Homo sapiens
VDRRSPRVEPSGMELRILRASLAGVGHTALGTAHRDLTDLNAVLGGSSSGSAIRSSKTLTTSTSSSVLARPAVPAIPGRSKGRRKVFQKVSVVPYPFEILGV

SEQ ID NO: 938122 - protein, 117 aa, Homo sapiens
FETEFRSIAQLECSGAVLAYCNLCLLGSRDSPALASQVAGITGTCHRARLIFVFLVETGFHHVGQAGLELLTSGDPPASASQSAGITGLSHRAQPEILIKPQIPRDFFVFHNVAQST

SEQ ID NO: 938123 - protein, 134 aa, Homo sapiens
MQPVDTDRIDAVESIRERSWNDRSEVRGPFDIIGDVHGCASVIATLLSKLGWQIQYDGADAIDATHPEGRQAVFVGDLVDRGPDTPGVLRLVMGMVASGNAAVCVRQPRSETRPRSQGLQGDRLPRSGRIPCSA

SEQ ID NO: 938124 - protein, 126 aa, Homo sapiens
GRTARCWTRKSVGGVWMARTPSVFWATKEVTTTIAYPPAATIDLVSAAVPAPPDGSVPAIDRTRGIVPRSASASLVVISDIPSPVRTRSGSTGVISAPPRRPVSKDQYVTPPQLALPPLKTDRTPA

SEQ ID NO: 938125 - protein, 84 aa, Homo sapiens
RRQRRIQILCTTRNCRSRACRDRGPEARRYAPGLALMLLLQVLDLVLQGGDIARDLPTESIELRRVASRLSTRGLTVVLLALGR

SEQ ID NO: 938126 - protein, 72 aa, Homo sapiens
DRPPVERVLSLHWPAWNRPFAMCSRRWLNTAHVGAGFSKVGQLIHQVTDTPRSSNAQACSHIGFAPLVTLRL

SEQ ID NO: 938127 - protein, 89 aa, Homo sapiens
RRRGRARTHWKRTRHHWHPSWLLTMTTFRDNGYCCKCAFHVPDTFPFCQLQPETTQGGGFWKTANVDMKTFYRKTSWALKIKRFPCRAQ

SEQ ID NO: 938128 - protein, 50 aa, Homo sapiens
DRPDLPRFHGRGFLYFLLTGQSRAGRRRLAIADRAFKGYSDRSGLQWNHR

SEQ ID NO: 938129 - protein, 82 aa, Homo sapiens
VDGRSRSNDMTRPLAWLLLCIVPLLATAEEAPLLLAWKTADGYELVQLNTTQVLNREPLPADLQTPLGSLWKLFVYAWLVDT

SEQ ID NO: 938130 - protein, 37 aa, Homo sapiens
STQGRGLGGIVAAKGIPERDALAHGQPPHDKDMFRGP

SEQ ID NO: 938131 - protein, 128 aa, Homo sapiens
VDQLGGTSTSSERLQGDPEFAVVVEHIRVLADVLHRGFMPGPGFGQGVIPGFGKGAFGYAKEHMGEGQLSDHERRQAKGVLNGPGSRSNSDSSTRTRSKLALRCRSGAANVVPVIVQGDAAASAGDGG

SEQ ID NO: 938132 - protein, 119 aa, Homo sapiens
STWHAEPSAPEWWGKDLLVTFGAFAKVTRCKSHPFQGLGLKSPNQSSQDDETMWEKVLERFEKQAPASVMTKLILEQAVDAAWVDKVFDDHRQRQYSRELLFSTVVELMSLVSLGLRVD

SEQ ID NO: 938133 - protein, 107 aa, Homo sapiens
TSLLHTREVISQLLRQYAITGASPCQSHSILAHGPTRSHCHVVRYLHTKSADSNDAASSQGPAYLLIATLGAHLHFEGTAPDVLTTPRDGDDIRFQGTMGVILESHT

SEQ ID NO: 938134 - protein, 97 aa, Homo sapiens
WVNSAADLPDHLLRNPRIIRASRNDLVTGFGDCDEGLNERSTDTDVPRHGDLRGKKVQVMTALRYCSVESCTKRNTIIRPSSVCCFNPKTACSALST

SEQ ID NO: 938135 - protein, 101 aa, Homo sapiens
YIPPLQRLFQTENLGALDLLFKTDIPHTRLHFERAPNYVKNTVCSPKRVQIHPEDMLVDRIRGTFPNHLELVLNFAPLPCLFVRENFKRAEAFHHRISFSS

SEQ ID NO: 938136 - protein, 116 aa, Homo sapiens
MEVAATVGGGGGAKAPDEVIAKHCNACHGTGLLGSPKIGTPQPRKDRADHQGGLSGLLAMAITGLNAMPPKGTCADCSDDELKGAIDEMSGLKYRPIVSEKTAYERFWFDAAGNFS

SEQ ID NO: 938137 - protein, 39 aa, Homo sapiens
FGHCFSLTVVVGLYQTQVGLLDRNHKIFTASREDRADIA

SEQ ID NO: 938138 - protein, 83 aa, Homo sapiens
GRPKGDELARDQGYVLEAGVEATTFLGRHLAEVSGGGAVFAPDRQPLQEAGEYQQDRRTDTNGFITRAQGNQQRAEAVDAAST

SEQ ID NO: 938139 - protein, 52 aa, Homo sapiens
IAGVSVSQYEEQFVTLFTLTMKFCSSSFPFEYASRILVFKGSICFSCIIGRR

SEQ ID NO: 938140 - protein, 120 aa, Homo sapiens
STNGMEWNGTECNVMNGMEKTRVQGNGMEWNAMEWNHPEWNGMECNGMEWNGINPSAMEWSEMEWNGMETTRMDWNIMECKGIEENQSECNEMEWNGMEWNGMEWNGMQWNGINPSAIVD

SEQ ID NO: 938141 - protein, 101 aa, Homo sapiens
VDVVAGGVYAHQGPVATKHSTPSLLLKSTSTPKFHKGQCKFPGVENVANCLQPHGLHLDLTSYTWVLALTLKPSSGFAEDGGIYAEQEVVRLIGVYRLQST

SEQ ID NO: 938142 - protein, 127 aa, Homo sapiens
QVRRGALLLGWWDRPPGHRGCVRGRAGGRGVCCGLTAPPSCSPLSAPLPWQQQELTAHPEGVPETPCHLVAAYPQHTGLTGSREPRGDRHQERRWQESSWPATPPSTPGKLLHIPSRAMRAGQPLWQ

SEQ ID NO: 938143 - protein, 89 aa, Homo sapiens
GRSLILCGSRSSSPTRRTGTGRTATRAESAGSSPRPAVRAPVLQAVVGEEPRLEQGATGNHDPGDTSLHGAVGISNDKMSHFRTGAWGW

SEQ ID NO: 938144 - protein, 40 aa, Homo sapiens
STASKKIVRKRDYHQIGSGKCEIKVAQPKEVYRQQQQQQK

SEQ ID NO: 938145 - protein, 123 aa, Homo sapiens
RLSKGLSIKAILVDYSKRLTCIGFYARCAVSTDTTRRPTGHSAIAAILKFAMPTGMPMIEIHCAMPVAMCIRHNHQPKKISQKIFNTVTASIQQHIFASRVQFIDMNSFIAIRHQRQFSDLPA

SEQ ID NO: 938146 - protein, 102 aa, Homo sapiens
MQIPVKTCPHQCQVKSARAGQVPLILEAEGGEDEREELREEEKREEEEKRVQVLVVQEVDDLEEERREKRECRSCTTVKLTWHFVNLSGSPRDKKSFSDAEY

SEQ ID NO: 938147 - protein, 109 aa, Homo sapiens
VVRSAGGLQAGWLAEDRRNAATDRRSSIFPRPTRDQGQGFTGIDAQAQAVDSKTIRARRIGETQILDFQAAADPLRQLDDVCLGRLDLVARLQQLADPLCCTGRSLQVD

SEQ ID NO: 938148 - protein, 104 aa, Homo sapiens
SDHSDCISVWVRWQLSRKLASSVKTNDFSPLVAMEGEKARCARAIRTTTVRTAQRRCDYTVRPPHGNDYRHCVVHWSVICFRNLSHACAQSFPRCPERPRLPVD

SEQ ID NO: 938149 - protein, 52 aa, Homo sapiens
GRRSQMEGNAVEWNETEWVGMESSEMEWSRMEWKGMERNETDGTEWSGVEVD

SEQ ID NO: 938150 - protein, 92 aa, Homo sapiens
STALHRDESQEDLAAHTSACAARSSICRASTEAALTHINNCLPEERHNNGTLPKLFPPYQGRPTMRAWLSNISLKYKFWAVNAVACVTTLLS

SEQ ID NO: 938151 - protein, 35 aa, Homo sapiens
NAMELNQPEYNGMEWNGMEWNGMESNGMEWNDTEK

SEQ ID NO: 938152 - protein, 72 aa, Homo sapiens
MSLSQGCKVLFQTRGLGIDDIGYPTRQRQTVPGDGFGGQQRYTDTTQSHRHHQDHRQLQRMGPGSTDCPIRQ

SEQ ID NO: 938153 - protein, 72 aa, Homo sapiens
AARSKAVEDAGGSGCMTVSAGHAALLLAQGRGRLIRRADDRGVVAVLDPRLVTARYGNFLRASMPPFWTTTD

SEQ ID NO: 938154 - protein, 34 aa, Homo sapiens
MAKRPLPGHLLWTAPARLGTYFAAGPPPPNNPQR

SEQ ID NO: 938155 - protein, 133 aa, Homo sapiens
MAQFTQFDEELYKVIGKGSEKSDDSTYDQEPSKKQKKQHEGSKKKAKEVTLENQLQNMEVTEAWTLPPPSLPDLLAACWDPRSALEQRGRVPLLTLSHLTAQHLGPSAGYCAGVPIISNGPRVSSLMTGEATQ

SEQ ID NO: 938156 - protein, 38 aa, Homo sapiens
STKVKLLRSLPQRFKMDVHITPGTHASEHAVNKQLADK

SEQ ID NO: 938157 - protein, 35 aa, Homo sapiens
MTRFYSKGLRETYVITTAQTSARDPQKPSHQYLDY

SEQ ID NO: 938158 - protein, 148 aa, Homo sapiens
MYSSARPYTREYLSGPLVASCTSLRPPQLVHLGDSLLELDVLAFLVAMSLILFNPSSVSMVFYGYWHRYLGNDRLFVGLKLGWAELGVAADLGFLGLKLWKKVIDLPSTSKGRTKYPSALVERNQEVSAAVSVGQREFGIAHAPSRVA

SEQ ID NO: 938159 - protein, 199 aa, Homo sapiens
WEWCFRRSPVTILLNAIAAPLPLSQWPVYLKGWGAADHSQGPQIPSAGPPGSSPVYTSSVLYLGRAINNELCLMELSPEDGPAHEPPSQGHLLTDAVATHAAFSPVTLVTVELVLRGLGQQADAEADSMVVGVGISPDLRRPLHLLHATQEYPCPQGAFQTTGRLSEALSLPILQRAPLRTPPSSLVPSTLEHLLACTT

SEQ ID NO: 938160 - protein, 92 aa, Homo sapiens
GPLNSEKPCLCGCQPPSGCGLLCHPRTVTPLAVFLSVALIYSLSSSFLMGFPCRKYTYCYVTRCKRMLMLCPLAPFGIFLGPQGLEMRPGGL

SEQ ID NO: 938161 - protein, 89 aa, Homo sapiens
MVSTKPQPAAATEDFLTDCTVHFPRIPFGMLFGKSNADLHRPTGAHRIERTKQRLPHWHHVDQIVKNLRSIAFLYAPNLTVRYNFCRLA

SEQ ID NO: 938162 - protein, 50 aa, Homo sapiens
MVVLFDRARSYGRDAHGAVREEGDTRLASQISRINPGDQWGDRCRSQIGR

SEQ ID NO: 938163 - protein, 71 aa, Homo sapiens
AAAYYYYLLLLNSRPLDVDTVTLCKNSLQINGEKNKYSSINMDEYGFSLRTGDLQKELQIADKPMKKPQVL

SEQ ID NO: 938164 - protein, 80 aa, Homo sapiens
STFNSVIFDGARFDQSIYTWMEIGGLKMEVGFLIDSITAMMMCVVTFVSLMVHIYTIGYMQEDDGYNRFFSYISLFTFSM

SEQ ID NO: 938165 - protein, 126 aa, Homo sapiens
RRLDQQQLQPQVLVDRLMQLQQVAALQWLVKALHQQLRAVAVDRQAASAFLAAVEQAIHIGTLCMQLSEQVLAMIEGGATGFKEDIVRALEVIGAREFNSYGSSRPIRLWARCTEPLRMAQRNNGA

SEQ ID NO: 938166 - protein, 31 aa, Homo sapiens
VDLKTDGWYGWGSMAHACNPSTLGGVDAAVD

SEQ ID NO: 938167 - protein, 121 aa, Homo sapiens
PTTTKFAAGRHSSLFQDLDSLESCLPSEVVIISESPNNSSAAPLISLTQARPGPGLRTKDSATFISRARVRPTYRRRLFSANASACMAWPVTLASALSAAWGWDRLPQLFNQQWTKRLASR

SEQ ID NO: 938168 - protein, 70 aa, Homo sapiens
GRPKRSKCPLPGYYKKTVSNLIMKGNIQLCDLNANITEMFLRMILSTFYMKIFPFPTKSSKLSKYALADS

SEQ ID NO: 938169 - protein, 37 aa, Homo sapiens
RRQILLHVLCEVDITALPITTQEMTCDSKRVTAIPHL

SEQ ID NO: 938170 - protein, 58 aa, Homo sapiens
GLPEGLLSPPVWIRSWEKPYACGDCGKAFSQNMHLIVHQRTHTGEKPYVVPRVRASLQ

SEQ ID NO: 938171 - protein, 102 aa, Homo sapiens
ETLPHFVDGIAAGKRRSSLPRWDGGRAETLLTFQTGQPGRGAPHIPDDGRSGRDAPHFPDGVAAGQRLQSRHFEEAKAGGWEVEVVAAEITPLHSSLGTIEH

SEQ ID NO: 938172 - protein, 33 aa, Homo sapiens
MTAGPPTWLKDMAHTAEAPTCRTWGGPSSHHCW

SEQ ID NO: 938173 - protein, 109 aa, Homo sapiens
DSSGAFASIKEEDALRMQQLLQRKLQPRLSITEERIVFVNQMWLSKYFLIAIGIRNQVTPCKFRNGQKLMFFSLLSKPRLYVTGTTAHVESTDNTPGMGVKAHRMEILF

SEQ ID NO: 938174 - protein, 69 aa, Homo sapiens
VTSLSPAPGVKDLPCLISSQQWPWRRVAGGGVVREWSLPMEARLVVTVNLLLYIPKALVLNASVPLTRL

SEQ ID NO: 938175 - protein, 71 aa, Homo sapiens
LDNVLDKCQQVISWLDANTQAEKDEFEHVRKALDQVCNPIISGLYHSAGGHWPPGFGAQASKGGSGSGPTI

SEQ ID NO: 938176 - protein, 121 aa, Homo sapiens
GGDLTLPLPAPFCLSPQAPPAAVGAAAVPLLEVVSWHPRGRRKEEEEQPDLWRLSETDRPFGIWRRATGPAAPRRQHHRLPGGVEGETREDARQAEPPGPATGGGSTTPLGPGGALGTPRS

SEQ ID NO: 938177 - protein, 123 aa, Homo sapiens
STKANGSRGQEIKTILANMVKPISTEYTKIGWTWWRMSVIPATVISATWEAEAGELPQPGGGGCSEPRSHHCTPAWQQSETLSQKKKTKTSLGWVWWLTSTYGRLRQVDLLEVGSLRPAWPTW

SEQ ID NO: 938178 - protein, 106 aa, Homo sapiens
FLVVVVWIGLFVFLRQGLTLSPRLECSGEILAHCNLHLLGSSDFPALAPQVAGTTDVRHHSRLFFVFLVEIGFHHIAQAGLELLDSSDPPASASQSAGIAGRSHCN

SEQ ID NO: 938179 - protein, 125 aa, Homo sapiens
GRLEYSGAVSTHFNLCLLGSSDSPASASRVAGITGAHHHAQLISVFLVEMGFHHVGQAGLKLLTYGDLPASASQSVGITGMNHPSELFLCLCFVFSFETSSRPEAGVQWRNHSSLRPPIPGLRDR

SEQ ID NO: 938180 - protein, 145 aa, Homo sapiens
LDVGVLWLRPLSGCAIPFCLLVFLLTVRPLCCRSAGVCWRSTPDPVSLGITSGGCKTAKNAACSFLWKLRPSRAPARCLQKLSHTRCLSAPTGRCLPVRIHGGQGPLEEAVLPLAELECCARRSACLFRVVRLGRLSLLNCTHSC

SEQ ID NO: 938181 - protein, 219 aa, Homo sapiens
MADTNPFGDNKPIDCCIPCDDDKLCQELPGDLDWLPPYHISLTTSIAGSVMERERFVVPFHNVGKKNCVACIAPLVHRLGGSRVVEQRHLRWHCRALPCRGCHRGRMLGHSLSPRLSPEWPPSSDCGAGVPRILVVAGEPHVRPLVRGASTPDVVCRPGVWHFRIDFSPVKIIPEGVRPRSLPWIGHTTLASIDHLRGLFPKGPPPQELSEAFRALGRS

SEQ ID NO: 938182 - protein, 67 aa, Homo sapiens
GRRMCLESWKLCYPTFSYKWTLRACLEVLAGERSTSYTLDRRPVFLYRGWSSSSTERAVLGGTHMER

SEQ ID NO: 938183 - protein, 64 aa, Homo sapiens
SPMTVVESVGGGFQTSWEGRDRIGRKFQGVWASKLPGKDGTELDESFKEFGKNREVMGLCREGA

SEQ ID NO: 938184 - protein, 67 aa, Homo sapiens
SFCTTLNQTFSRQTKQVGDQHTDQRRNQRGKQKRTDGQKTDFAYTEMRYADGQPLLRIEAKTNGITI

SEQ ID NO: 938185 - protein, 42 aa, Homo sapiens
QAKPQASNASTVVSGEFQPIASVLLIISICVEPAISANTSSE

SEQ ID NO: 938186 - protein, 107 aa, Homo sapiens
RRLRRSLTLSPRLECSGAISAHCNLRLLGSRHSPVSGVAGTTGARASPANFFFSIFSRDEVSPRYGWFRSPDIVICPSQPQSAGITGVTTAPGPNNTFLLFSLGCQG

SEQ ID NO: 938187 - protein, 115 aa, Homo sapiens
ARRPSTVVLARMCVVGRLDVFADQLLDRGDDVEMIFALEVEGLLGGVFGQVDDGVDHRLHATGEHQRLQHGLFRQLLGFGFDHHQGVLGAGDHQVVRGRDQVDGRVQDHFTVDHV

SEQ ID NO: 938188 - protein, 94 aa, Homo sapiens
STEFLATPAANNFRLAQATLQVSGKSAQYGIAAQVAVGIVELLEVIHIQQQRGQWLGFALGFMQSLDRQQVEAPAVGQAGEDVEGCQGLDLAST

SEQ ID NO: 938189 - protein, 119 aa, Homo sapiens
DLDLGGIVCICYIMWWDDLCVLWGRLSQKGEIPEHILSPNTVSNENEFPFSFFLLTLFLTLSAVHRVGKTVICSTDRKCSRACAIAETPSSPETGQLSNQRGTQTTTWLLSLPLLVQAP

SEQ ID NO: 938190 - protein, 76 aa, Homo sapiens
GTDITEERRAQERLRILANTDSITGLPNRNAMQDLIDHAINHADNNKVGVVYLDLDNFKKVNDAMGICLVTSYYAT

SEQ ID NO: 938191 - protein, 74 aa, Homo sapiens
SCPFLKLWRTYCYVRCLMMCRRMNCARSARKSIAGIRAMASTVDGGVNQHSKTRSRSSVWWHCDVIHSVAPVEN

SEQ ID NO: 938192 - protein, 102 aa, Homo sapiens
RASYELLQREYVPTRVQTTAPSGLLIQPHSPCPYASPGLRTAGHLLMHLIGSATLAISTINLPSTLIIFINSNSTNYPRTSVALTQAYVFTLLVPFNLPDTT

SEQ ID NO: 938193 - protein, 120 aa, Homo sapiens
QGIQVSSERTWLQESTEEESGDQAISRLMLQANILQICDHHPGLVPGEPGYLFILYSNYANCLLPEYRLNDQRFSSTFPPGVHPQGLAGGPELPSNPSYPLTIWKESVHTKEHVLLFARN

SEQ ID NO: 938194 - protein, 99 aa, Homo sapiens
MLKAVGLDHRGNHRPSELWRERQRVAIARALVNNPRLVLADELPVTSMRYRRQHLPVAWGIESLAGTAFLVVTHDLQLAKPMNPQVGIPDARLTAELSL

SEQ ID NO: 938195 - protein, 48 aa, Homo sapiens
RRALDLHQRPELVHLQARLVLRVVVELVGHVRQVVADAAAHGHRDFLA

SEQ ID NO: 938196 - protein, 31 aa, Homo sapiens
IQINYYYCIATTVAQPSDQSDKERERSRNNK

SEQ ID NO: 938197 - protein, 61 aa, Homo sapiens
SPETCLLETDYTFPTCLKRSRTLTWLIHLASVCCCPEALVTASSVALHVSSESEGETRQNV

SEQ ID NO: 938198 - protein, 72 aa, Homo sapiens
GRCKPLPGSLCDPADQLTNAPQPWRNSTLLRDKCSDNSSVTNSGLQQQFSISDTSDSACVEQAAREQRLNGS

SEQ ID NO: 938199 - protein, 142 aa, Homo sapiens
MGGLGSSRGVGGGPGWFLTTGWRCAVALGTVPYTLLTLNQSPVPTLSSTSSPHGILSEGGPGPPTPWTHFCAPERPCPGHVPTYALYCPPQPCGTQWCCGESSRPAKDRMVMRGRGTRGTWFWFMMLPNFSGPPEILDTAAW

SEQ ID NO: 938200 - protein, 323 aa, Homo sapiens
LFGVSKREDRRKETEKIFEEFGLKYAKYAKNTNAESSGSMNGGPDNRLTGILGGRVVHTIEVEPQEAFLSPLELWVQVLAAGSKPGVGCIRARVMGCRVVVGDEDETIQPGGQLLKLLVRYHAQLVGGGGYGRWDDLVGQQLGLVQSLAKLVSMWMRPTRFWLSSWFQTSTTKPSKCWFFATWTTVLLSSSISSSLSKTFRKSSVSSVLKQELRHYVQALGMLSDSSHPPLVHVVEARDLKHLTATSLQLQPDGGELCELAPKDLGDIVAMAVPWSYKAQYIPSKVSLPGLCRAVAAMLKNHTLSFEVRYHQTPGLAPAYLKT

SEQ ID NO: 938201 - protein, 91 aa, Homo sapiens
MTIGKMVADDLLSSFLGLPLPPCCGGPRWGRLGGFLELVVDVVQALAQLPDRDPNAQLPGQLQPHLQGLQGWVEDDVPPLRLFLYSKKCSE

SEQ ID NO: 938202 - protein, 39 aa, Homo sapiens
AQHSLRNAHCISFSIHRRSTWFRLARSLWWHTLAGTLTL

SEQ ID NO: 938203 - protein, 40 aa, Homo sapiens
YSSMANQHCQLTYSTAYHRAPMNSKDLHAVGSVNALSLNA

SEQ ID NO: 938204 - protein, 89 aa, Homo sapiens
MGCSGAILDSSARLRLPGSRHSPASGSRVAVTTGTRHHAQLMFLYFSKDGFTVLARMVLISDLGHRCSRVWIQVAQLLLISANNSIDEL

SEQ ID NO: 938205 - protein, 73 aa, Homo sapiens
VGDSGVAAVLTIITSGCCLAVPRTAGNKVLSIMLKNQSSQALRVYETTGATIAKCHSLSGLNKSDLLSHSSGC

SEQ ID NO: 938206 - protein, 83 aa, Homo sapiens
QGTTMPVLPKHTVTFIPVPLTTPGRAEQVSDPARSPHSRRTPGRVGPEYRGAALPEQPCRPGVLRAAPLPPGRRQVAGIGEGR

SEQ ID NO: 938207 - protein, 93 aa, Homo sapiens
SVHSRAERFLCLVATPEQPILLAEEGGPRDTMMSLRSRSPGAGPAWDKTVTLPIAGVLGAVAVSRAGSRGTGRVCTMAMVAEAQVCQGLRGNL

SEQ ID NO: 938208 - protein, 134 aa, Homo sapiens
ECPTRIPRRISHSSSAVQVPVVSPHGEPLSMVIRYRQAVTLKHADQLLLHGLAPFIGTVRQAQGKTGVVVQQGERMAASTAKRKVALKISPEAVRRVVFNLAVAGMPGEAPGSRPWRAIRLWTVLKAGMVCPWS

SEQ ID NO: 938209 - protein, 95 aa, Homo sapiens
VPGGDYSSQQGGKSSPWLCLVFAAGRVGSLWEFHNLFKLFVPDEESRLFFIQMRVMPREFIRMCMVPRLELEATQEGLEMLTGGRPGLSVAPPRG

SEQ ID NO: 938210 - protein, 124 aa, Homo sapiens
AAAYYYYEIRGRSTTDVSRVASSISISVESESTAHDSRDNSMNGPGSVLSSSTGVMGVKFIGRLRMVGRSDCLHRDVGDVVNATLMGTFPSSVEPCPSNLAGALMGLNGRMVQVTGAARYGVRR

SEQ ID NO: 938211 - protein, 97 aa, Homo sapiens
GSGGTGVPNHGLEAVVCRDDEHLEGLPALEKERPRSSRPHEPCSLLLKTTSERCPGRGLKLQVRSPAPPLHSRFTWNLLALGGTKPRILSTCAMADR

SEQ ID NO: 938212 - protein, 64 aa, Homo sapiens
SSREQVHQTNPLRTQLPRPATQEAREQPPHLPHSLTAISSLNPLHQSLSPCFLAMMTIKLVDSA

SEQ ID NO: 938213 - protein, 67 aa, Homo sapiens
CLHACMYSGRPITGEHACLQGSDTPTHMHKHTLNHFPVQDLVFSNTHITAGMHHVSQATLPKGQGRT

SEQ ID NO: 938214 - protein, 118 aa, Homo sapiens
CKAAVMDSPLCKTAMTELIESVRTWATPPWMCKYYRHPRCKYYRPLPGQGIPEEEQDLREKGGKLILMFNKQVKVLHSRQWAGHLNPNPTVPYTPITTPTLQMRKLRSGDIQSLPKIT

SEQ ID NO: 938215 - protein, 107 aa, Homo sapiens
PAEAHEESVWRGRERVGEETEIIPTLEPLPHEVPGHQSVFMNEPRLSDFKQVLLREGIQAEFVGGVLVCNNQVAVRRTETGRIGLEGCLCQDFYRIRDLLYEQYAIV

SEQ ID NO: 938216 - protein, 97 aa, Homo sapiens
VIRINKMLSCAGAYYEVLDHCSSILNKYDDNVKAYFKRGKAHAAVWNAQEAQADFAKVLELDPALAPVVSRELRALETRIRQKDEEDKARFRGIFSH

SEQ ID NO: 938217 - protein, 106 aa, Homo sapiens
QCETLSEKNKITNNNQTPDIQQSQALIKYLLCARNFAENPEEAILAGGWATAWGPEVEAGGAGIPVNGLPPRKPGPGAHPSVTLPCLAHTAGSVPGSPTQRGAVGP

SEQ ID NO: 938218 - protein, 60 aa, Homo sapiens
MEYYAAMKKNNIMSFAATWMQLKDIMLSELMPGTENEILHVLNWIKQMWPFYTTEYYTVM

SEQ ID NO: 938219 - protein, 99 aa, Homo sapiens
TKNIQSNIEKNKVEESIVAEFKNQSKATEARQQGLQQQSINGSMSRTDNSGTDTHLHDDLFFNRSVNAIQMVNLPTNDTGTTGYLYTPDSVTMNHRPKG

SEQ ID NO: 938220 - protein, 145 aa, Homo sapiens
NFHLSQRNPTLKTAKGTLAAQSFNFFKEKSVYLFLKNLNLVNFASPALTGTAQALGDFASGISGPSTPGAQTLGAMPCGALCRPWGLPGGRPDHDLASLCLKKLAFLQPHTTRGVLGTQGVGGSHQREAGAWPAPAGSCSWGAAD

SEQ ID NO: 938221 - protein, 118 aa, Homo sapiens
IPATPKTSCPRPATLEEPDASQPQLAKQYFSSSMLNNIINLCRSSASPKAAEAARLLLSDMWSSKELQGVLRQQGFDRNISWNLYLGQQPSEIQLPIFRRKFSSKFRFQEDMTQLRNP

SEQ ID NO: 938222 - protein, 64 aa, Homo sapiens
EVLEGSDYQSHRNAAVQLTSCGRAALRCQDTCLSAVGRHPGRFQTTCQPSQGECRGGNLAAFLF

SEQ ID NO: 938223 - protein, 105 aa, Homo sapiens
LDLLSSLLFPGLLAHPGAPWSSFSLGTRLSNRAHAITSWAQRQVVAPWPLRTSGTHVTLIPLLPLRPSLSSEAFLSHGPCKPLAFSWGSSLSLDHLLMPFASTFP

SEQ ID NO: 938224 - protein, 46 aa, Homo sapiens
LPDDDTGSSLNQLNKAPLHNKVIRQRAAPLRVVRGQSSDSGKTVQV

SEQ ID NO: 938225 - protein, 81 aa, Homo sapiens
TSNQRSRAILLEASLHGGLAAPSSLPSEGFCLQPSVTLSSSVVDSVLLALCLFCQDRHSLWILSSGLAHAHSSGFGRTFVL

SEQ ID NO: 938226 - protein, 74 aa, Homo sapiens
RFLRHPIPQIRTTEVASPAQVHSGRTRTALCSGVFGYSHHRSERHPVRLLNEHHGIVAGGHEQGAGTVSGFRRW

SEQ ID NO: 938227 - protein, 135 aa, Homo sapiens
EFCSVTLLSPYLPQLRAGVWTGASQSASVSSSTFSKVIEKPVISSEVQYAPIKLRSDSQSRLLATCGQAVIDAVQLRKRSCAKIVNQRNHPIARLERLFGLLFFLPTALLIIPETQSAMVSAIYQQGVEHFIDGL

SEQ ID NO: 938228 - protein, 58 aa, Homo sapiens
MKQISSIPGNWTVYFGAGAEEMTPDHLPVCWLRLDPRARPPDLCGYSSRRPQVVLQDH

SEQ ID NO: 938229 - protein, 68 aa, Homo sapiens
SPPPPGRRCARSPLPPNLPRLPSPPIGPTPDASVEAQDQSTATCTFRARPTLPPTASQSGASLAGAAQ

SEQ ID NO: 938230 - protein, 76 aa, Homo sapiens
MLARHPLRAQEALSGGALVHGTNHEGVAHFLFFAGAPPSTYVPLHAPILLYGLGVFLDYDCQSEDCYNIGIKSYCS

SEQ ID NO: 938231 - protein, 28 aa, Homo sapiens
LNPPRREFSGYAQLEMRMAEMLRLSCNI

SEQ ID NO: 938232 - protein, 458 aa, Homo sapiens
AALVGPSVASVGGTARFSIPDRGPLLRVRVSVVCGRGSQGVETPPQGGAPSEGSVFLLISGLCTGGAGILVVGRRLVRRVWCGPVFFSREFAELARREFCLALPNAPCVVAGPHPTGGRLSCAGVSRSRCPPCVSVSLRVSVPCVSCLVVPRPVTGRLRPPRVRPPLGRAAGGLHASARPAAGLQGKSPRCFTVRLGLLVGDPHLSTRRGFVPAGPPWGLCNVSIWRKSTGAWRRLAPSGDSGLPRAPTVHCVPFPLGEPLNLGLGDAVLPLSRFTGSLTLAVPIGVPFGPACVISENPLAPTQFPIDRSVSPWATTPSCLLVHVAHANYGNADAFSSYLSLRLMVTEINQPVVPTGVEEQVDLDGCPRTGTSFIGPRLAKRDAQHVHYMTLEVVEDGHRDLVEAVWGQQPGRVPWWVLLGAMLRKGRHLILSSPGCKVWHCFSLPSSAAINARDGAR

SEQ ID NO: 938233 - protein, 48 aa, Homo sapiens
ELKAELERKKQRLAQIREEKKRKEEERKKKETDQKKEAVAPVQEESDL

SEQ ID NO: 938234 - protein, 106 aa, Homo sapiens
RADMSRKEGRSPECRCIGRVRGRVVPPGVLIQASNGTSGWGLSCSLVVHTDMTIDTRLKGKMFQERKLRETVRCGTGFTVVEKLQWDFIHAKGEGLTVMRAGKCSK

SEQ ID NO: 938235 - protein, 76 aa, Homo sapiens
PVCGKTFKNEGRARSSRLSSQHFRRPGRADHLRSGVRNQPDRHGEAPSPLKIRNQPDVAAHARNPGYSGGRCRRIA

SEQ ID NO: 938236 - protein, 68 aa, Homo sapiens
PRRCIYCRWVHWREGRSGGRSHCLVGHRDGVDLGPPGSPRRTAASSMLGFYAAAGGRGGGLLGGCLMV

SEQ ID NO: 938237 - protein, 123 aa, Homo sapiens
FAQATAVKAPDVLVKDVTEEVLTTLRTDPAIKAGDANKTAELVETPRVPHFNFTRMNRWQLGKEWRATTPEQKKQLTDEFRTLLVRTYSNALTRYKSQTIEYKPFKMAMPDTDMTVRTQINQP

SEQ ID NO: 938238 - protein, 45 aa, Homo sapiens
VRVQSPLRVPCRSDSLDRQFPSVSSAPYYYVLYYQSVKGTLDTET

SEQ ID NO: 938239 - protein, 53 aa, Homo sapiens
GAGEEVRKKSHQRSRRDMPQKELRRSRDCGFPSGSGMRTQAQPGTYADAHPPK

SEQ ID NO: 938240 - protein, 51 aa, Homo sapiens
ADLFFSPRYVSSGVPVTLVSFLTTRVLDQPKALARLPELLGSVDWIATASH

SEQ ID NO: 938241 - protein, 61 aa, Homo sapiens
GLDGLREEVAERPSRITLTVLEDLHGEQFLKAIDIVLVAVSEHIERFAALAREMAATETRE

SEQ ID NO: 938242 - protein, 68 aa, Homo sapiens
KRRNTVTSHTLPPELRELNDYAGACTLRVICGNLGEVERPMGRVLAGVAAVSRGEGRISSEVWISSWS

SEQ ID NO: 938243 - protein, 77 aa, Homo sapiens
RKRKKTEDSSSGKSVASDVPEGKVKMTFFSYPYEDLKVGRARWLKPVIPALREAEAGGSLGQEIETILANTVKPRQY

SEQ ID NO: 938244 - protein, 187 aa, Homo sapiens
GITAEYLMLTYANDAKLYVPVSSLHLISRYAGGAEENAPLHKLGGDAWSRARQKAAEKVRDVAAELLDILTQRAAKEAFAFKHDREQYQLFCDSFPFETTPDQAQAINAVLSDMCPLAMDRLVCGDVGFGKTEVAMRAAFLAVDNHKQVAVLVPTTLLAQQHYDNFRDRFANWPVRIEMISRFRSAK

SEQ ID NO: 938245 - protein, 137 aa, Homo sapiens
MQLVALRTGFHLNVIARIHQNVRTFTANHHKPDPVEIPRCGCLFCREERSTASSCCALSQLRSEASNVIWIFLLTGYRLKFAFTEHHQTQEHHHQRSYDCPQRDPRHIDAQVSDQRHAQIADSGNHCTAPSQTAAVE

SEQ ID NO: 938246 - protein, 41 aa, Homo sapiens
LQAKTHLIGCCSSINSDSEPIPSTRGAATDTQATGKFAAPA

SEQ ID NO: 938247 - protein, 147 aa, Homo sapiens
PTPAFLYSSGSVSLQPTSFTKSSLITRLEGSPEMLGLGVNPDICDMHEEKEVLTSQTSGCPFGAWGRVQKTRDPIPSQPFVIMRSDPAGFSAAPLCLLGNWNSGACLPTYPCHLALKSFQLPVTHSLGALHLLFPLWDVPLPHLFPK

SEQ ID NO: 938248 - protein, 131 aa, Homo sapiens
VSSAAAPANGATLVAARDCAQGSSGPRRLRSNENDKMKIEKCGWSEGLTSIKGNCHNFYTAISKDVTYKELKNLLNSKNIMLIDVREIWEILEYQKIPESINVPLDEVGEALQMNPRDFKEKYNVKSKSDS

SEQ ID NO: 938249 - protein, 141 aa, Homo sapiens
EGIPLDSERVFLQNNRIGLLQPGHFSPAMVTLWIYSNNITYIHPSTFEGFVHLEELDLGDNRQLRTLGPETFQGLGEASRPLPLTSVGLSALPAGVFGRPCTALQLPLTLQGQPHSELPPGTDIFSWELGSNFKATCFFTG

SEQ ID NO: 938250 - protein, 107 aa, Homo sapiens
LGRVPRVLGSFCPPVLQRSRYQPGGSRKGEENKKNKKYPKLARNESSGKEKEQEPASQASEANAQEPTAKETRKKEQPAKNQKKAKNKKEAAATQSDEAASPEAQQH

SEQ ID NO: 938251 - protein, 267 aa, Homo sapiens
PRVLGSFCPAVLQKSRFQPGCHRMGQFKEKKKKCGTVCLKYLLFTYNCCFWLAGLAVMAVGIWTLAINSDYISLMASGTYLATAYIMVVAGTVEKVNGVLGRCATFKERRNLLRQYKKNALKKKPAGEDRWYPRLRLLPAAEHGAQREPEEKQKPSATTKKAMSCDKTFGPAEAGEQMLRQKQITETGETVSGSAHRRPVAVVPDSCCKTVVALCGQRDHASNIYKVEGGCITKLETFIQEHLRVIGAVGIGIACVQVFGMIFTCCL

SEQ ID NO: 938252 - protein, 106 aa, Homo sapiens [sequence omitted]

SEQ ID NO: 938253 - protein, 114 aa, Homo sapiens
MKGPAPPASPCPWHLALRRWVVLSQLPQELQVALLLLQLGHGLLAGPKPPLRLLQFLPQPHVLLGQPPGLRAQPLLLCLQCTHMCRQGQQHLPGVGVPSRGWFLPCQTAPDPAQ

SEQ ID NO: 938254 - protein, 122 aa, Homo sapiens
HCTIMDDAATHLDSDCGGDDGIPKYAEIEWQHLTLQKVCHAEWAVGMSGQQTAAGHRDLWQWLTGYYGVLKNEVDGQPNKCCFIYLMAETPPGLGSQRCHREQSQPHPNPGPNQFSDWKPLD

SEQ ID NO: 938255 - protein, 48 aa, Homo sapiens
MHWGRVQPGLQDPKTLQSTGSRAGTARPTGPEDAAEPGNEGPAAGAPG

SEQ ID NO: 938256 - protein, 48 aa, Homo sapiens
DTQSLDALGLLIFLLSLMTLTLFSPDLIGDPDNYTLANPLNTPPQIKP

SEQ ID NO: 938257 - protein, 92 aa, Homo sapiens
KVKSRVRMPSKAKKSVAEYVAIRACKEFNLGGWGRDTGGTACERGQGVLRPGTEAASSGSVEEDWYRRLLGSDLYLDRINQKKMSARFRGDW

SEQ ID NO: 938258 - protein, 112 aa, Homo sapiens
AVRGFLGRGGRDQVPILQIGRLRLRPSARSLGRVMSWAGVFAPVLSICPSSSPRSGSFEALALQKWKLSHGELAMGKRQWHLTLMSIYYVPSASRAFSHSSVLGVKCCYEPV

SEQ ID NO: 938259 - protein, 106 aa, Homo sapiens
AEGYPAVFVRRGRFLVSKALHTQLFGARYVWLVSPISLPRERGMVFNYASPTYSISSGRYLSTGAIYKMALNAERTLISLVALAVYGRPPVNIYSLRGATYIETPP

SEQ ID NO: 938260 - protein, 125 aa, Homo sapiens
MCRLKNYTGECRHDLFKKYWTKWSLICDCRLKNNLQSTPCWPGTVVAPVVPALWEAEVCGSHEVRSSRPASPMWRNPLSTEGAESWLGVVVHVCGPGCSGGWGMGIAWAWEVEVAVGRDHATALQ

SEQ ID NO: 938261 - protein, 94 aa, Homo sapiens
LANRKCGEWWEDDVKIARRVGRKAGRQYRSTYDPHRPAMPENQKENHHTTSTSINPAVTPKAYNKRRALLSSGRCEDVCECECAMTSHPLIILT

SEQ ID NO: 938262 - protein, 74 aa, Homo sapiens
QAFGRNEELEMSSEQEIMSDEGFRRVAKGPRCLEMPEKDRKVRIDKRFRAMFHDKKFELNYAVDKRGRPLAIAL

SEQ ID NO: 938263 - protein, 93 aa, Homo sapiens
MYQRCFDNASETLFVAGKTPRLSRFAFSDDPKWESGHHVHDNETELIYVKKGVARFTIDSSLYVAHADDIVVIERGRLHAVASDVNDPATTCT

SEQ ID NO: 938264 - protein, 83 aa, Homo sapiens
EQGRLPLGTSSLNYLDPRISIAWCKRFRVPVEKIYTPTQRERFASVSPWQEKTLNSNDEPLETSFACVCVFLTIKAVLGNFVQ

SEQ ID NO: 938265 - protein, 42 aa, Homo sapiens
MQDPSRGSFQLMLVLQACRRQELRFGNLCLDFGGCIEMPGCA

SEQ ID NO: 938266 - protein, 104 aa, Homo sapiens
ELCVDGMEFCSFPSAGVMWYDFSSLHSPPLLGSSNSPASASQVAGITGARHHTRQIFVFVVELRFPHVGQAGLELLTSGDLPASASQSARIIGVRHHAQPHILY

SEQ ID NO: 938267 - protein, 102 aa, Homo sapiens
MEWNGMQWNGVEWNKHQWNGMEWNGMEWNGMEWNGMERTGMEWKGMEWNGMEWNLMEWNGMESTRVESNGIERKLIEWNGMECNGMNGMEYNEPEWNGMEGK

SEQ ID NO: 938268 - protein, 109 aa, Homo sapiens
GDDVAGSNSCRGAPPELAGSTGAHDDACNPSTLGRPWRADDEVKVIKSDRGQHGEGPSLLKMQELAGPGGALWSQLLGRLRQEDHFNLEAEVAVSRDRTTALQHGDKVR

SEQ ID NO: 938269 - protein, 99 aa, Homo sapiens
DGALYCGLHAYAGHHRGAIQKNSQCGPVELNGWDLNSFTETKRTLRAKQGGTASLKGASLHRVKSEGIIMAKKIYPKVDMTGGSTLPDMEEEVQKYWVD

SEQ ID NO: 938270 - protein, 52 aa, Homo sapiens
ARRRQHLSPHCTPGLIRLIWLARRVSPSFLTAPCASLPKLRLGRRGRPSPVD

SEQ ID NO: 938271 - protein, 90 aa, Homo sapiens
MRIYQKGHIVDIKGMRTVQKRLPHQCHPGQTRRVYNVTPHAVRIVVNNQVTAKIPAKTEFMSVLSTLSTLRADDSFLNRLKQNDQQNERS

SEQ ID NO: 938272 - protein, 70 aa, Homo sapiens
PHEEAIWKGRSLVQPSPPRSQAYERANLDSLVLLSPQMPTVSVDDMWSRRTAQMSPANPVNHENKEMVFA

SEQ ID NO: 938273 - protein, 78 aa, Homo sapiens
MANALLRDPGRPVSSMRCDCALAWSPLWAALHTAWPRLSEIVQGPREGRQGRILIFGCGFMNGKSFGPVRFPVPLFFC

SEQ ID NO: 938274 - protein, 64 aa, Homo sapiens
PCPAKNYEEGEGSQDRELGFVVRAALSLLVVFVWSEGCSPVSKAALALGLLGIYLPGRPSGVSG

SEQ ID NO: 938275 - protein, 158 aa, Homo sapiens
YGFYLALESFPHLAELIDQPRLYSVIKLGENGPDHVPVLPHQINGADCSSHPASGTSTGDRATTSPARAGMAPAVMTETERMALATGTMTGRKRPAQRPRRRCRSPPDLHRRHPTDDRDPLQSFRADLGELIDKVPKAVTIVCDEFQNARLRDRDGEG

SEQ ID NO: 938276 - protein, 147 aa, Homo sapiens
HCPEEVLVPVQYHGNSVHDKKVMNARQLIAGRLAHQVHSHGITAQRKEPVRARGTTSRHNPTPGPSPGRRWRSTESCPPTSGYRRKRAADFPVTTARTTQRQQQDQHHCTDRDGHLGAAFCAAVSINGWFISRSPVLSVRRVLRRFW

SEQ ID NO: 938277 - protein, 83 aa, Homo sapiens
TVVHLAAWLVLLALGAAILGGMGGGRGSQEHWVLLENTGHKSTGLFYHWHCPSHLLGGPNVSRCKTRRRYYFLTTAFPVNHHS

SEQ ID NO: 938278 - protein, 79 aa, Homo sapiens
IATCFFQDLPIFTDHGLSKFFFASFEQMSSLEDDLCAMGSRSCFPCRKSLVGSIYCCFDIVGSGEREKAYHFIVLGRIV

SEQ ID NO: 938279 - protein, 113 aa, Homo sapiens
MAHTYPPALRTPRVTPVWYHLFQLHMYASAHVMIKSPSYHSHPKEPKPRTRAPTTKQEQGDQTLWAEPDDLNAPADTHIHTLAPPANLIFATRICTDSNTTQQHVAATHHTPF

SEQ ID NO: 938280 - protein, 89 aa, Homo sapiens
PILQLPVEKLSRAGAFLMDAGSVLMLRVGTICTQTFLTQVLGVQNYASIPQPITDLPELATPDSARILPFISWLRAAEPILPNTLCNKG

SEQ ID NO: 938281 - protein, 77 aa, Homo sapiens
EEWLDDKSSEKVTREGSQVYAHDSPDVSPENWLKTYGLLATKLTLMDALSLAAVPHSSTYVPVLDKHVMSTLFDEAN

SEQ ID NO: 938282 - protein, 191 aa, Homo sapiens
TCDHSFLLQELPSLVTESPGHRLSRPEPHSHLLTQGLHTRRQGIWVFNKRLTKHSSIIPPESWLGALSLQHTHPPAAQKRPRLHPNRAAINIHLKLLGSTWTTNPLAILIPNKLQTPDPTTLRYKRRALPCWLTTPAALALHPSACRTAGCDHALSTTLVPTARHSCDWVTCEIPERALAVVFKIITDLYS

SEQ ID NO: 938283 - protein, 66 aa, Homo sapiens
FEYRGQDIRVMMQAETGVMPPHAAMLPQELGQAGGILPYTPQSNLGPSDVLTLDFWSPERDENLSL

SEQ ID NO: 938284 - protein, 78 aa, Homo sapiens
STSKAALNSMASTFLSEIEAPTFTVLSMHPGWVKTDMGGEDGSIDVATSVSRLIDQVNAYSGRGGHHFINYKGETIPW

SEQ ID NO: 938285 - protein, 75 aa, Homo sapiens
IGKLHAHSPMELWKKVYEKLFPPKSINTLKDIKDTARDPQYAENEVDEMRIQKDLELEQYKRSSSKSWKQIELDS

SEQ ID NO: 938286 - protein, 130 aa, Homo sapiens
TVLGIRTWTSSHYGGSQEGPQADRYLSACFHSSPHNSFLPLALFFLFFFSFVSFSFLFFFLFFFLSFSFFSFLSFLLSLIFTQCFLPFFLSFFLSLSFFLSLSLFLSFFLSFSLSLSIFLFHFLERLLSR

SEQ ID NO: 938287 - protein, 180 aa, Homo sapiens
AAAYYYYYYNTRPVDQALVDQEGATLLTNAFEAIAAQQRVRQVARPLHLGSARCGLGNTWVLISEPITSHGVLPRPSQGHGQAVGFFARGAGRAPHPEGLSRRGAGNTCWRRKSKCLGSRKKKVSLVVNRSRATAATSVLLAHDQFEIGIITVQFVMLEALEQTHGDQGPFRGRQADPRR

SEQ ID NO: 938288 - protein, 132 aa, Homo sapiens
NGGPVEVTQIVLSTQHLDESLDSADVRAIVEPYILKALPEGWVNEGTVWHVNPTGKFVIGGLMAYRLTGRKIIVDTTAVRAPRRGAFSGKDLTKVDSLRTPPGIWPRTSSPRSPAAPRSSSPSHRRAKPLSI

SEQ ID NO: 938289 - protein, 135 aa, Homo sapiens
ETIDRKKTLQSETSSKIADDSILPSDAGVRRRASTSLRIVAWWSTRELRDDVVDLAEDLAEGLLFARCSPVAWLDRPQLLKELSDIYAGSYGVNFRRTGTPRRRREPSGQRPGAHHECASPLPSDDWIRRTSCRS

SEQ ID NO: 938290 - protein, 52 aa, Homo sapiens
LPRCPLHSSLNPAKDLQHVGNAAAGCGAASMSTEIIGHSNGDGTFPLLYQRC

SEQ ID NO: 938291 - protein, 130 aa, Homo sapiens
KTINWTLLEKRRLEPPFRPKVKSPRDYSNFDQEFLDEKGGLFQKDKNLIDSMDQSAFAGFSLVNPNSGNFWKIEGPGKIRVALASTQTCPLPTISTIGTVVTWCWPRPGPKKFLGGVWAGSQGKFPVRSV

SEQ ID NO: 938292 - protein, 110 aa, Homo sapiens
AQAQEGNGGAGNPKEPGRRAAGREEGEGAGGKESCAEGLRSDRDGGQRKDAPENGREDGTSPGEDQEEQPGPAGNGAHGAADGGRRAEPQKGGPAPPGTGGRQERATDTA

SEQ ID NO: 938293 - protein, 81 aa, Homo sapiens
AAPAPAATSELNSVGCGRKTEGHGNIQRPTGKTAMGQGRQSLELRCLQSRNAKDSWKPPEAKKEILPESLSKKSIILTPPF

SEQ ID NO: 938294 - protein, 81 aa, Homo sapiens
CRSLVRFQASISTPLPHAPQLKHTRAPLNATTPSCQSAASVGKENGDPSIENRQRLNRHSQWPQTNGKKSRPPKTKEMQIH

SEQ ID NO: 938295 - protein, 75 aa, Homo sapiens
FRVCGEGIPGEVMTEKRPGGSEEQALQLPEGRAFQAEGTASATALEQGKHLVGLGSQGCVMVKKGSSKVLTCGTH

SEQ ID NO: 938296 - protein, 122 aa, Homo sapiens
GELCAAATSETIMQVAATHFPMTEWAVADMLGCIIHSEFYRAKVQARCPGPVHKLSLAYPAPDVRQDLRSAVDDHSRLLDQRVGVVNPNKCVDKVVRALMRDPGLAARTEYRVLGGVSEQER

SEQ ID NO: 938297 - protein, 37 aa, Homo sapiens
MATPGSVIPEVPFEPSKPPVIDELSPTVYMNPESFMD

SEQ ID NO: 938298 - protein, 46 aa, Homo sapiens
GSTQRDGSHLQAKRRSLTMNPPPTLLAPYSSTSSPQTVRNKFLLVQ

SEQ ID NO: 938299 - protein, 74 aa, Homo sapiens
TILGFGYRLALNVYQHGLNCFLGQVTRFVVDFILHQCISRWISKRGGWVATLKLGNCPILNVLVVLGFDFIGTT

SEQ ID NO: 938300 - protein, 96 aa, Homo sapiens
AKAGGTASGCTEAQHFCDIPPMMRNSLLVRKRETNPNGEDILQSDQRFKSVKFMNDTQIEGLQQIGGDKEDSSAKCSVRSWNKRPGMEKLVMFKLG

SEQ ID NO: 938301 - protein, 61 aa, Homo sapiens
MPIDSFTISSNGTCNGQRGKAWIRPVLSPMHCCICCTVSEGWGLRSAFHSPRNYSSKLTFL

SEQ ID NO: 938302 - protein, 39 aa, Homo sapiens
LSLEAFYGDKVNIGLKILQAEGRVRKPDEGSSNDELNVD

SEQ ID NO: 938303 - protein, 114 aa, Homo sapiens
PLQPQFPPLQDFGSEGNYPDSYVYSCRLLGLAMVPVSPQTPDKCLRGCGTQPTPTNFCPAAAWRAGWTGEPQPLPSGSSHSEGSSPAKVAAAGKACVCRRGSDPVQGRGIGCPK

SEQ ID NO: 938304 - protein, 102 aa, Homo sapiens
GLAPAALNPAPTLLQGPSTIILHVCDGASIRMPGLWVPSSSRLLNTSTGQEGVPPTPRTQKLLGWDPFRPCPVPRPTWLPICGLSHLLFLRSVIILCCTLDI

SEQ ID NO: 938305 - protein, 272 aa, Homo sapiens
EAPWDRVGAAAEPSRDRDRAAPPSPAGPGPREPSARPRRPPGRGWMRRGPRGGDPRPRAPGAPRGGVRGPGTPRPVVRRGAPRDSRGPAPQPPPALSPGPARGPPPGGSSQAELSTCSAPQTQRIFQEAVRGNTQELQWLLQNMTNCEFNVNSFGPEGQTALHQSVIVGNLVLVKLLVKFGADIRLANRDGWSALQIAAFGGHQDIVLYLITKAKYAASAGVCPPGPRTPALRPRRLCCTFPPTTSVRARLAGPAKKARGNGEYGACVTAPG

SEQ ID NO: 938306 - protein, 76 aa, Homo sapiens
LINTYISVPKENSTLNCASFTAGIVEALLTHSGFPAKVTAHWHKGTTLMIKFEEAVIARDRWRAADLPEIKDTESP

SEQ ID NO: 938307 - protein, 138 aa, Homo sapiens
REAAPLHFAKCIIVLVFLSLVGQRTLPLAVGVGQVTLARSLQSRPVAMSADVTSSLAAFGEGWGVRELSDHSSPRPLLGLARRAPRVDPPATGVFSPLLPPSALMRSAGAAGPVWDEQSSPLVSLILLIHGIPGYIQT

SEQ ID NO: 938308 - protein, 114 aa, Homo sapiens
MVITRHGVLFDPYWAPSEYMLSTYIGEVTHTTNKCEKERRRLRFGGSESPQGLTTTWRAIKGVLLELFSAGGKICAGKSNERYFLGEILATRGLIFQGATCKALTWGWGAPTPH

SEQ ID NO: 938309 - protein, 134 aa, Homo sapiens
MSESLKKRIFVAYTVVVLPCIAGIVFFILFLVQASSVKKYKKRCDIMQQNLTSIRTAQMYSGDQTVARQKNTEFISHVDGLLEEYACMTPARSALIDDNVLVVYQHGMGSSALEPFVSPKNKTIYQAISEKQPE

SEQ ID NO: 938310 - protein, 133 aa, Homo sapiens
TQQAAAKRMGIPQPKVSGMMRGDFTNLSERKLMDCLNRLGYDIEIKVTASSRADRASNACNRLIGALLMAARITDDEWDELTPENFDTTALLRAVDAVDVLRGDLNDTADGAPPQLRTDLLKLHQLAMAAFNE

SEQ ID NO: 938311 - protein, 76 aa, Homo sapiens
HQGCELVRGVDGLDVLQGADDGLADAFQVFVQRIADGLRVGEEEAGMAVISIAITVSSALRKRLSTGLCRWVTGPG

SEQ ID NO: 938312 - protein, 45 aa, Homo sapiens
VQQARVKALLAGLPFGRRLKKAQTRFDEADGLLKSSHDPTAHANL

SEQ ID NO: 938313 - protein, 106 aa, Homo sapiens
MESHSVAQAGVLWYDFSSMQALPPGFKQFSCVSLPSRWDYGCATQHPANFCIFRRDRVSHVGQAGLKLLTSVDPPAWASQSAGITGISHCAQLHCCCFLLLVKRGR

SEQ ID NO: 938314 - protein, 66 aa, Homo sapiens
KSLSSKAILNKKNKGGGITLPNFKLQGYHDQNSMVLVQKQTHRPVGQNREPKNKATNLQPSDLQQS

SEQ ID NO: 938315 - protein, 115 aa, Homo sapiens
DETQLVTRVIALHHIVNAELGRDRLPGEQALEHLPVALILIDQFRAQDIGFQNADANDIKIPDNKKIKNETRACLETCFQGKHRTRARKLRFSLPANRRKGGRTVLLTLGRTVVC

SEQ ID NO: 938316 - protein, 131 aa, Homo sapiens
FFFFAMESRSCGPCDLGSLPLSLLGPSDSPPPASRVAGITGMHHQPWPILPPLVETGLHHAGQAGLELLASSDLPTSDSQSAGSSMSHPFLIEMGSRHVAQAGHELLGSGYPPISASQSARTTDATTPSLH

SEQ ID NO: 938317 - protein, 57 aa, Homo sapiens
LTPAELLHWKAGSDNPLLLPVFARLAGTGSPERVRFPLFDLSASCHQARFVTTISGQ

SEQ ID NO: 938318 - protein, 79 aa, Homo sapiens
KQRLALLLRLEYSGPILARCNLGLLGSSDSIASASQIAWIAGVCHHVQLVFVFLVEKEFHRVGQEFNNRPGQCGETLLY

SEQ ID NO: 938319 - protein, 100 aa, Homo sapiens
ASTPVADASDVQVDNVGRTIPVELIANVDECLHDVEINVVDSAEVENDGLDGRQILFSSVEVDVACCCFLELTLGGARIVPRPVTRVEVGCEVCASGLAE

SEQ ID NO: 938320 - protein, 70 aa, Homo sapiens
MVERRLEVRPGFVDGLGVESLVHLHHREAIEVGFFGDDPCFTRRGGEIGPGAGTHENREARNSRRVGVRI

SEQ ID NO: 938321 - protein, 114 aa, Homo sapiens
TDVSSKVLRTKNALLGYRPNRNAHLWLGAVAHACNPSTLGGQGGRITRSGDRDHGETPSLLKIQKISQVRWRAHVVPATWEAEAGKWRGPGGGACSELRSRHYTPAWATERDSI

SEQ ID NO: 938322 - protein, 148 aa, Homo sapiens
ANLFQEKVDLSKPLVATVALASQPGHVALGPYLCDKPDVPIYDGSWVEWYMRARPEDVISEGLGKDPLKLGRTQASSGDAGHQQCLAWYVRFCFHQESVSSLNSGGIWGDISKARNSVDLLAASEGREERRRRALEEGGHNSELPNWC

SEQ ID NO: 938323 - protein, 72 aa, Homo sapiens
GLPALHFDPWKKEFYRNFKSISKALVERGGVVTSNPLGFCILPARACPSYVPSLKPKPKPLSLRALVCHEGA

SEQ ID NO: 938324 - protein, 50 aa, Homo sapiens
LSLHPPSFSACRALGGPGAVGDFGLRAVDEFQQLIHISVVRTPQGSRPGP

SEQ ID NO: 938325 - protein, 159 aa, Homo sapiens
ALSGGAEPSATAAHLRSEVLCQWSRSAGCPRGGEEEKPGEDHPRNVPPPLTHILFLCFLPGAEISSDLAEEVSGSLGQQGPGGGLGRSSRLCPEKEQASGAKALGIPGLPSRGLLWVPTTPGLPLPLVPQGLQPNPFSPQQPQQGCHFTDGEGEAETGR

SEQ ID NO: 938326 - protein, 71 aa, Homo sapiens
GRRVDEVINQIGHGGVRTAIQVPVGVFFIVNVLKLVQAQRNQAISSTLNAVIAINSINTVLQLQSFRGKVD

SEQ ID NO: 938327 - protein, 129 aa, Homo sapiens
STAWQQGAVQVERAVLGGGQQLFAQQVAVVEREDVVRAQLGNALDPQRMVGIFRGVHSNALASTELRYGTVEGVLLRVVGMGEHCGDVVTCGEQDSMPGNQYRDRRRRQLSDSWCDLIGGSSRRGITSS

SEQ ID NO: 938328 - protein, 99 aa, Homo sapiens
GRRADVATGDIMYLRRAAIRSLCTRPRGVLNGLAESSLHTETKVRSRVHALFVLSLVVILDRHRCGSRRHRAGDVVARDPTPGLWYQDSLTSHESFLST

SEQ ID NO: 938329 - protein, 141 aa, Homo sapiens
LKPQPYRPARTFSTNYYAGLRKTFELIPDPPLFGDIFRRFKDVEVARTVMVLAVVLFETVNTWVRLSSTGHQGVWSSIGKNLRLSLTFAPEAQLEEEPEEEPEDTSEDAEDSEQDEGEEMDAGTEEEEEETEKESTEKDEL

SEQ ID NO: 938330 - protein, 42 aa, Homo sapiens
TELWGLDTHTVPLNTFSSSESPGMCHGTQLSACAVGRESSGV

SEQ ID NO: 938331 - protein, 170 aa, Homo sapiens
VHSGRDELSSEDGEAKAVTKDQEPIGEMKEEEEDTFEYPDTTIDLSHLQSQRPLQKLAPREESLNSNDSKSQGRRHLSAKERREMKKKKLPCESGDLEVIEEKDKERESAVHTEAYQNTSKNVAAGQPMKRGQKSKMKKMKEKYKDQDDEDRELIMKLLASAGSNKEEKK

SEQ ID NO: 938332 - protein, 175 aa, Homo sapiens
EGLGHVSGVQGGGRCLPTPKCHTPPLYRMRIFAPNHVVAKSRFWYFVSQLKKMKKSSGEIVYCGQVFEKSPLRVKNFGICVRYDSRSGTHNMYREYRDLTTAGAVTQCYRDMGARHRARAHSIQIMKVEEIAAGKLRRPAVKQFHDSKIKFPLPHRVLRRQHKPRFTTKRPNTFF

SEQ ID NO: 938333 - protein, 259 aa, Homo sapiens
METTQFGELLLHIGGTWLRVHQEDLTEIRDMLLANEGARCCSAGAIAPCEVTVPAQNTGLDPEKTSFFQALGITTKISRGTIEILSDVQLIKTGDKVGASEATLLNMLNISPFSFGLIIQQVFDNGSIYNPEVLDITEQALHSRFLEGVRKLASVCLQIGYPTVASVPHSIINGYKRVLALSVETEYTFPLAEKVKAFLADPSAFAALPLQLLPPLLPLRLLQPLPKLKQRKSRRNQMRIWDSVSSTNPAKATKSACLI

SEQ ID NO: 938334 - protein, 191 aa, Homo sapiens
KNIPVTKDMVRVKRFQNNTACGRSCSECNVEPSFGLAGIMYTILEHTFHVREGDEQRTFFSFPAVVAPFKCSVLPLSQNQEFMPFVKELSEALTRNGVSHKVDDSSGSIGRRYARTDEIGVAFGITMDFDTVNKTPHTATLRDRDSMRQIRAEVSELPNVVRDLPTATLPGLMWRPGTHSLKGKRLARRRQ

SEQ ID NO: 938335 - protein, 73 aa, Homo sapiens
LDDIEEFESIRKDLEARKKQKEDVEGVGTSDGEGAAGLSSDPKSREQMINDRIGYKPQLKSNNRTSQFGNFEF

SEQ ID NO: 938336 - protein, 228 aa, Homo sapiens
MGVEKELGVAFDADEGLDVPVARHKVHDGLDLHFRVGKLATEVSEQGLLLAPGIPKAASQFLLGPPRRRGSPRCVIEFCATWIRFVGVDKTIRVSYNLQEDVHVVKNGREGGFLAIVLRDLFCKPDPTGLSDPLPGMDASVNPDCWAIGPSSAELQHIDGTTFKGAADLDLAYKLWVLCNQQVHEFIDLIQSMVGGIIESIGGQSPGWKADICCFSSSSRDCTSSIMI

SEQ ID NO: 938337 - protein, 68 aa, Homo sapiens
PVPTLPEGITVAYTVPKKTEDSASEVTVEDSGESLEDLMARMKNMYTVAGFCLIFSAYASPLELNNRN

SEQ ID NO: 938338 - protein, 182 aa, Homo sapiens
FKTLSWGTAFVIFKKLGFSHKCFETVPRIPFLGKPLGIQYAKPDSDIISKMRGTFADKERKRERRKPKTMEQAPAAANKKPGQGTPNAANTQGTAAPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 938339 - protein, 100 aa, Homo sapiens
NGYHIQGKLTRRLVNSQCEFERRKPDGTTTLGLLQWDPQDGEPGYCPVRLGTTGRLQSGVNTLQGFKEDKRNKVTPVLYLNYGPYSSYAPHYDSTFANIS

SEQ ID NO: 938340 - protein, 126 aa, Homo sapiens
MEGPAAFLYLNSFLNLAHVSDPKIGVDGFDGERNIQAVVPSCLLSCLVQVCMYLNRHLADRSEERERPFSRLPVQTASACSRTGNRHTLCTQSVSSNPILETLSCTQSRSNYAIHCGINLPGWSVQ

SEQ ID NO: 938341 - protein, 119 aa, Homo sapiens
DGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFCYRAALEYLGSFDHYAT

SEQ ID NO: 938342 - protein, 54 aa, Homo sapiens
MLPQVQSNWNRTEVVFHSLVVLRKGGESSRDLGGVRRPAPKMTRCGANRKGLVG

SEQ ID NO: 938343 - protein, 82 aa, Homo sapiens
EFIPDTWHAVLAVPTVGDGVEVGWGQVGAEPRAPARLLAVSDLLVLDELGALAKAFAGATSESFTPERERRYRKKRKRPQAK

SEQ ID NO: 938344 - protein, 70 aa, Homo sapiens
MGIAARRMLDLLLSKTAAACTCPVCVAGLSPFPAPGKAQALHTGGGDPQLGPFSSALGCSVYLPSFKQQE

SEQ ID NO: 938345 - protein, 88 aa, Homo sapiens
GPGRNEKQRRRSVLPPKSAASNAGECEVGCGRTDLETALGKPWLRRSVVWTPLRGARTGHAEHEPDWAPGAGCMGGGAARAGVSFSGE

SEQ ID NO: 938346 - protein, 88 aa, Homo sapiens
FLHFLDHYPHAINPEDPSKEILLAILMADKEKKGYVMASRLRSKLTSLGEKLTHQEVDDLLREADIEPNGKLKYDEFIHKITLPGRHY

SEQ ID NO: 938347 - protein, 145 aa, Homo sapiens
QVSGLKYTYDATKPPLKQGGTGGERIVDLQIADANGVFQKVDPNGTYTIATRFHPVDKWHKFGIFGDGKTIDDVYKAIDARPLQYSQVDMIGEYIKGKTLDPSTMSRVEGRITDLTPKVNDDVLRPAQSMAVAPTLSGFDAVGKA

SEQ ID NO: 938348 - protein, 76 aa, Homo sapiens
NCGPERMRKGPSRLRAMEPRAVAEAVETGEDVIMEALRSYNQEHSQSLTFDDAQQEDRKRLALLVSVLEQACHPPT

SEQ ID NO: 938349 - protein, 105 aa, Homo sapiens
IARNFNTPPSHLFPAEFAKRAKTLATTEGIEVEVLDEKELAKAGYAAIIGVGKGSSRPPRLVRLTYRGAKGKKAKKVALVGKGITFDTGGISIKPAGGMENMTSD

SEQ ID NO: 938350 - protein, 161 aa, Homo sapiens
MSKIVCGERRMRMRSCCTRLAKVCMSKLTLIPPAHNFHHDLAGVGQDDGPVRQRMRGNRHEHDAAQGRMQQGAPADSEYAVEPVGVEMINAIRTLVVHEVAVDFDAQFGHRRTAAARDDDIVDGHAHVNRLAVAEQLRFEQGAAFGLEAATENLRQRGHVR

SEQ ID NO: 938351 - protein, 77 aa, Homo sapiens
PLSLLPPLLSGRRQPHLNAVLSPSLGSGPCGQTLPGPRRAAYQFALHRLSRRRARSLPCGCVEDAWHCVADSVGRLI

SEQ ID NO: 938352 - protein, 33 aa, Homo sapiens
NQQDMGGDNKGIKAGERGTPPESALTLWELCSL

SEQ ID NO: 938353 - protein, 158 aa, Homo sapiens
ALVTFEDPKVVDRLLQQKEHRVNLEDCRLRVQVQPLELPVVTNIQVSSQPDNHRVLVSGFPAGLRLSEEELLDKLEIFFGKARMEVGMKKTREMLQGTVMLGFADEEVAQHLCQIGQFRVPLDRQQVLLRVSPYVSGEQKAEIKFQQAPHSVLVTNIP

SEQ ID NO: 938354 - protein, 147 aa, Homo sapiens
SHSQKPAKCSISDLHSALSYFRRCVSRSNQSCGNLAAMPAEELVAKAQMNDVRWNATIRCPAGHGRSFVPESDQGPPISSLEYKDLRGICTRLRSYKDAGQRWSDADKQELYAGNCEEKAYAGLRNGLFTGFGGAIIPSFLLAADVA

SEQ ID NO: 938355 - protein, 138 aa, Homo sapiens
RYSQTSLTGWWVIQKRRRYRVLSRPIYLQKVRAKTFPRPNTRIKAGGPPRRCSIRKGQKIHQRCGSALTRKPIAQKRPFFADSEPARGGRDPRAPGAPLRRSGRPAFYTAAGVPPRPSADLILKPCRESTKRKLAFSV

SEQ ID NO: 938356 - protein, 51 aa, Homo sapiens
ASSEQYAAVCAAGHVEYKTLNLGCFGPRFLTFIIYGLACNILADIIFFREI

SEQ ID NO: 938357 - protein, 70 aa, Homo sapiens
PEPMPDCKHRQPQLMSRLSLHTSLEQRESAPASASPRKGTPQRSGGLKGSSSTARADAESEEAPRASKGC

SEQ ID NO: 938358 - protein, 90 aa, Homo sapiens
MTQSVQSTFFKVTVSAKNNSFSKVGKIYLVSCCKEPETLEESVLLPLSRGLLAPSLVPPPNMCRRSPPLGDIFHLKLAFPTARDRPPSLR

SEQ ID NO: 938359 - protein, 102 aa, Homo sapiens
LDATRPPDWRPCASLLGRAPHCRHDPSNFLLMNKSAPHFRPRWAFTPPPMPPAPLSPFINTFTQIIIKINMCQVLGCVLGWAQYPVTLGDIYLFSLSLYLHL

SEQ ID NO: 938360 - protein, 33 aa, Homo sapiens
VQHSGENNGGIDIYNFGGEDGKSSLKSIRSLNK

SEQ ID NO: 938361 - protein, 104 aa, Homo sapiens
RHYWSHLADDEDKYRLWFSDVVARTASLIAQWQTVGFAHGVMNTDNMSLLGLTLDYGPFGFLDDYEPGFICNHSDHQGRYSFDNQPAVALWNLQRLAQTLSPFV

SEQ ID NO: 938362 - protein, 80 aa, Homo sapiens
ISLSLARWSRHVRAPLTQCYAIPFSCVHSETEAISDPPSSSLALQSTGFTDKRLHQRTHLTAFMDSGILSHLSKEMWKVP

SEQ ID NO: 938363 - protein, 71 aa, Homo sapiens
MESRCVAQTGVERSGVSLSHCNLCLLLPGSSDSHASASRVAGTTGVHHHARLIFCIFNRDGASPHRPGWSR

SEQ ID NO: 938364 - protein, 119 aa, Homo sapiens
MLGEQGFRIQSVKTESEELFGETMEMMVRMKDIELDLLRGTEAIMLRSAVLIGLENRVEQIRDHINVRVLYYATCKCCYSFHPVAPLICRFCFCVGGRLGLNSFHLHETFMQPKVQPGP

SEQ ID NO: 938365 - protein, 81 aa, Homo sapiens
EKVVVGIVVWKMFKGMGIGRKMIKEGEEDEDVNEVGKVLKIDEDVKGESGIGKGSGGGDEEVEWVKEDFFIEESLCVYECE

SEQ ID NO: 938366 - protein, 110 aa, Homo sapiens
YVYVVSVMENSLNWTFKSSVIDSVISGTLKFSFDCIVEDFEDELIEFFSRVCFTILYDNLCLYANRFFVTMPCIYRMMSYDPLELPTLACIYFSQEGKLVAMPFIYYVFF

SEQ ID NO: 938367 - protein, 72 aa, Homo sapiens
DDHMRTQGEDAVCQPQRETPEETSPASTLILDFWPPELWESKFLLLKLVVLCCRPGLTDQHTSDNTWLDRTV

SEQ ID NO: 938368 - protein, 129 aa, Homo sapiens
TCSAKQAVANTGKMESPAWMPNFPASMRNPPIQTKGLTTLETFMDTLPDVKTTCITLLVLWTLSREPDDRRPLGHFPDIHFVEEAPRRSNRRFRQRLNQISHDIRQRNKCLPIPYYYLDPVLIENSISI

SEQ ID NO: 938369 - protein, 67 aa, Homo sapiens
STEKPFIKLSPGASVRSLTPVIPALWEAEVGGSRGQEIEIILANTVKPISTKKKKYKKISRTWWRVL

SEQ ID NO: 938370 - protein, 83 aa, Homo sapiens
RFDCKIEGYPDPEFVCFKDDQSIRDSPHFQIDYDEDGNFSLIISNFCGDDDAKYTCKAFNSLGEATCTPELILETMEEVQFKF

SEQ ID NO: 938371 - protein, 74 aa, Homo sapiens
GLGEPSLVALVVFGALTAAPGYWPTVLMTLKGLAPGCLSPLNPVANPTQNYVPACQEPECSVSNAVKGAPPPTR

SEQ ID NO: 938372 - protein, 105 aa, Homo sapiens
LDLFGTTDRDKYERELLNARKLAEALLQEKTATEVALQQAQAELSSAYEIAQRLGIAEQMVAIVSHDLKNPLTAIKMASEFLARGQPPRSANSWGISACPPNGRR

SEQ ID NO: 938373 - protein, 92 aa, Homo sapiens
MRPCIKSRADLQCLCVERSAQKLGEEHAEIFDAHLLMLDDPELLDQVAAGLQWWPERRNGPGPYPDTFIAVFETMEDEYMREADLRDVRRGR

SEQ ID NO: 938374 - protein, 116 aa, Homo sapiens
QTRRLEGRRRSNLSQREPMAFPGKVGEQLNLREIEQLVDQLNRLPSKQAQMELTPGSQVGGSEVQVKNVPKSPGVAAVSRNNDGQKSTGEQQWGAGLEWDSPLRWPTSLCCAAATM

SEQ ID NO: 938375 - protein, 63 aa, Homo sapiens
QVLRQLVGEAFDRRLLLHQTEQLQQAATDIQQALHRALDQGLEGGDKAFLGRYPGQLVEVLLG

SEQ ID NO: 938376 - protein, 35 aa, Homo sapiens
VVSSGRDLIVKFVEGFALPGKHIGGAGYVNVVGRR

SEQ ID NO: 938377 - protein, 100 aa, Homo sapiens
GTPAGNQTLKLAAVSYGIICFPLESNPGTREQPDFGAGVRPEERGTVTARTGGPGRKTEATLGPQPRGVHKSSARAEGRCEACPRDRPADESANEWIKKM

SEQ ID NO: 938378 - protein, 34 aa, Homo sapiens
GPYPYPQQVSKDKRALKFIKKRVGTHIRAKRKRE

SEQ ID NO: 938379 - protein, 111 aa, Homo sapiens
STGPALSTIDDRVSEDGESGERRDVGPQLTCERMIACDKLTPREGYNLTVLPQRFLRSNRPLSLTPVFYQPGIVIVCQGSSAGFFGDQVYLYDEQHYLAVSVPVPFTMQTQ

SEQ ID NO: 938380 - protein, 68 aa, Homo sapiens
GTREGNKLSSGPLNCPPMSPGPSQLDTGTCFTQIDLTGYSTTTERHDTTRDGKNTISNTLKTQHQYFK

SEQ ID NO: 938381 - protein, 60 aa, Homo sapiens
ARQGMYADWWQELDAKGDEAEAEPKPELHEKGTATPLKLGKPGADEPTLTSLGSSKNYLL

SEQ ID NO: 938382 - protein, 40 aa, Homo sapiens
STDPPTLRDACELRSARSKIRLTLAVRIRASPRIVSRRGR

SEQ ID NO: 938383 - protein, 69 aa, Homo sapiens
DMESHSVAQAGVLWYDFSSMQALPPGFKQFSCVSSPVGGTTGVQHNIRLIFVFFVETGFHMLARLVLNS

SEQ ID NO: 938384 - protein, 106 aa, Homo sapiens
MESHSVAQAGVLWYDFSSMQALPPGFKQFSCVSLPSRWDYGCATQHPANFWIFRRDRVSHVGQAGLKLLTSVDPPAWASQSAGITGISHCAQLHCCCFLLLVKRGR

SEQ ID NO: 938385 - protein, 58 aa, Homo sapiens
ALQALQEREVSAIPLPEFRPGVRQFVVLRRPRSPAAVDGRSQSGTGQLQEQKKGLLIA

SEQ ID NO: 938386 - protein, 34 aa, Homo sapiens
RWHTATSAQPWKGDPWNSWSAFPIETGPKGEDQG

SEQ ID NO: 938387 - protein, 115 aa, Homo sapiens
EGGQVAHRLALNFSAQIRTHCAEPFTEYWTCLDSPNMQLFRHSRQQQAKFDQCVLDKLGWVSPDLGQLSKVTKVKTDRPLPENPYHSRARPEPNPVIEGDLKPAKHGTRFFFWTV

SEQ ID NO: 938388 - protein, 104 aa, Homo sapiens
ARLFEMEFRSCCLGWSARCDLGSPQPPPPGFKRVSCLSLLSNWDYRHVPPHLADFVFLVETVFLHVGQADLKLPTSGDPPTSASQSSGITGMSHRTWLTFSLFA

SEQ ID NO: 938389 - protein, 82 aa, Homo sapiens
VSMGLSPKPQCPEPRTPARAEEMSRLQTRVLKNWVESSSVSRDDSARESRGRELLSKKILVPSPGQILVFIFLFELTNHVIK

SEQ ID NO: 938390 - protein, 206 aa, Homo sapiens
GTQNHGWTFNGGLVLGRTSRTTNWSIHRNRIVCQLTPYQRSHLRWPVQAQPLIPQAVADVVTYQLGFHSIELNEPPLVHTAASLFKEMCYRYREDLMQESSLQLDPQEGGRVYSVPMGGMMVRQSFAIGGSGSSYIYGYVDATYREGMTKDECLQFTANCLALAMERDGSSGGVIRLAAIQESGVERQVLLGDQIPKFTIATLPPP

SEQ ID NO: 938391 - protein, 75 aa, Homo sapiens
RLPTQLRSLGSNRISAENARKHPFFLSLGERIHKLPDTTSIFALKGVQLQKEANIRSTSMPDSGRPAFRVVDTEF

SEQ ID NO: 938392 - protein, 99 aa, Homo sapiens
GRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 938393 - protein, 138 aa, Homo sapiens
AVLGTVTFLAGNRMLAQQQLREQHISSRRSLKTLKAEMNIEQGVGTVHGVKGRTGDTTGGRRCLFVKKRKAELCLHVYLFLTFCFTEQTCLGPDCLSLCLDAWQDAVNIPGYPDVVFEKLKSVIHHQLWNKENGGLPE

SEQ ID NO: 938394 - protein, 157 aa, Homo sapiens
ISPTGAAGPEKRMEKKTEQQRRREKAARKLRVQQAALRAARLQHQELFRLRGINAQVARRLAELARRREQRRIRRLAEADKPRRLGRLKYQAPDIDVQLSSELSGSLRTLKPEGHILRDRFKSFQKRNMIEPRERAKFKRKYKVKLVEKRAYREIQL

SEQ ID NO: 938395 - protein, 37 aa, Homo sapiens
THNGKEEGLREKNQKPKLDRKKKKKAAALLLRRRWMN

SEQ ID NO: 938396 - protein, 32 aa, Homo sapiens
MATGQGKGCYTVDNEVQPSGPETIVVIIYLSR

SEQ ID NO: 938397 - protein, 56 aa, Homo sapiens
MGQTALFIFGSLCWCCQVSELQRWPLGQIYCYRKRHSVSQMAAQQAQRCLSEDGYG

SEQ ID NO: 938398 - protein, 140 aa, Homo sapiens
RPRRCARGKRLNENNISLRIIGDRSRFHPELQRRCARRNGDGGSNRFILQIAANYGGQWDIAQAAQRLAREVQAGHLRPDDITPELLQTCLATGDLPLPDLCIRTGGEHRISNFLLWQLAYAELYFSDLFWPDFKHEAMR

SEQ ID NO: 938399 - protein, 75 aa, Homo sapiens
DILTINITVITITIITTNTTTIIIIITTTIIIIILTIKMAEQMNLFVNAPHGSTVLRALICYISSLSLMLLPSDL

SEQ ID NO: 938400 - protein, 129 aa, Homo sapiens
PLTAFHTHIALIAFRTHLTPSTPTSHSRPSTPTSHLPHPPHTPSTPTSHSPPSTPTSHSSFHTHHTLLLPHPPLTLTSFHIHLTPPHPPLTLTSFHTHFIPPSTPLSPPSTRTSHLPHSSLTLTFHIHR

SEQ ID NO: 938401 - protein, 130 aa, Homo sapiens
GHFVDMVLVLLVVLVPWTRINLIDFYAIHKGKYDIGSIFRVDGGIYGRYNPQALVAYAVGIVVQIPFMNTPLYVGPISDTSRGGFVVVGGVGGDVAVVIPVGQFGTVRISAGWRGGSWWVGFNRARLSVD

SEQ ID NO: 938402 - protein, 50 aa, Homo sapiens
ASGPAWRRGIRIYVVPASHVSELMAFMWKLWDLQQVKAQTDEILSKQKIA

SEQ ID NO: 938403 - protein, 117 aa, Homo sapiens
LNEHGPRGGDEINIPQKGKNYGCRWQPGESTIQALRYRKRKGEIVAGTEQPVFYWKDSPAVSGMAFYNSDKFPQWQQKLFIGALKDKDVIVMSVNGDKVTEDGRILTDRGQRIRDVR

SEQ ID NO: 938404 - protein, 110 aa, Homo sapiens
FPPQLSVREHAAWLLVKQEMGKQSLSLGRDDIVQLKTYKWITHPLFSEELGVPIDGKSLFEVSVVFAHPETVEDCHFLAAICPDCFKPAIKEEDFLKQFPCPPLTGCCAV

SEQ ID NO: 938405 - protein, 104 aa, Homo sapiens
DPVNNPGASQEEEVLKDKVRDRLIILVLSDKATYDKLCKEVPNYKLITPAVVSERLKIRGSLARAALQELLSKGLIKLVSKHRAQVIYTRNTKGGDAPAAGEDA

SEQ ID NO: 938406 - protein, 103 aa, Homo sapiens
APASPPDPEEDDELMTREVQTNDLKEVVNKLIPDSIGKDIEKACQSIYPLHDVFVRKVKMLKKPKFELGNSWSCMGKAAALAKQLETRRVLRLSELTDMNRQS

SEQ ID NO: 938407 - protein, 118 aa, Homo sapiens
PPKYPGPCSSAKRQTRAQLWNSYALEPFPDALESIPMALSENSGMNPIQTMTEVRARQVTESNPALGIDCLHKGSNDMQYQHVIETLIGKKQQISLATQMVRMILKIDDIRKPGESEE

SEQ ID NO: 938408 - protein, 98 aa, Homo sapiens
TMELILPSGARVGHRSLMRYYKQRFGLPRAVTVARNQKAVGRVLQQYRALGWMGSTGAALMRERDMQYVQRMKSKWMLKIGMKNNATKQMHFRAQVRF

SEQ ID NO: 938409 - protein, 136 aa, Homo sapiens
KLQATRLTLLTSRLPGSIIMDLTGDLDALNNQVFACQEGIEYTVKITSKVNKEIVSGLKCLHHTYRRGLRVDKAIFMVGSYGPRAQEYEFVTSVEEAPRGALARGLYVVRSLFTDDDRLNHLSWEWHLHVCQDWKD

SEQ ID NO: 938410 - protein, 124 aa, Homo sapiens
RRLVAISTGSYFSKKKFFFLRWSLTLSPRLECSGVILVHCNLHSLGLSDSPALASRVAGTTGARHHAQLIFVFLVKTGFHHVGQVGLKLLTSSDPPASASRSAGITGMSTLPGPASIDSYFQVD

SEQ ID NO: 938411 - protein, 81 aa, Homo sapiens
MTEPSRYPKAGPNTEMANKMEMYRGELLGSEKLIHIGDPKWLNRHCPDASQQLGNHHQAPHAAGLLLGVLGGAVALTGRQV

SEQ ID NO: 938412 - protein, 134 aa, Homo sapiens
VDPQNVPNDSREAMPISLQCFLDLDESCEFSVSLSCPVWRHICIAAGEQFCFMQAWAGPPPSRTLSLLMEALSPPGPPSGFPCTCPWGELHETHTSSAGRRVRTRIGPAPGSEMESWFFFQNCFPLLGCGGSRL

SEQ ID NO: 938413 - protein, 110 aa, Homo sapiens
FFLDMESHSVAQAGVLWYDFSSMQALPPGFKQFSCVTLPSRWDYGCATQHPANFCIFRRDRVSHVGQAGLKLLTSVDPPAWASQSAGITGISHCAQLHCCCFLLLVKRGR

SEQ ID NO: 938414 - protein, 130 aa, Homo sapiens
VDFLSDTVHEELGGFITQDPPWNMKRKVRFKVCTKAVTGSNSKAVLQAGRRQCLRMAIVGDFDEEASRKNPPHVRSEEGTPMGSEVEEFEDWVQWLTPVVPALWEAEEVGLIEAQKFETSLGNMVRPCLY

SEQ ID NO: 938415 - protein, 66 aa, Homo sapiens
GFFKVPRTQVGFLLEMERGWPHPIGPVAPPGSPPGYVLPAGGIALQVGAFLETVDARAGTFICRDT

SEQ ID NO: 938416 - protein, 73 aa, Homo sapiens
MKFVYSVNRKRLNRNARRKAARGFECSHIRHAWDHAKSVRQNRAEMGLAVDPNRAVRSVKEEVKAVEVDIEER

SEQ ID NO: 938417 - protein, 80 aa, Homo sapiens
RGDPVLPARLETKVTEEHRASRSEIPRPPERNYPLGVPLNFCIQGHNSEGNVFLNSSDKPGMVMRACGPSYLGGSLETRK

SEQ ID NO: 938418 - protein, 64 aa, Homo sapiens
CCDTIDAALSRRERHNAPDTQSKDRAENVTHSVLQRLGSLEKAVSKEAGSSFGMDGDEVRRGTG

SEQ ID NO: 938419 - protein, 88 aa, Homo sapiens
MAHCSLELLASIDLLWAPQNAGITCMSHFTPPTSGLWTWAVPPSPSCSWGILAPSPASSAQEMSFACVLSAVGLWLYVEPSHHVFLVD

SEQ ID NO: 938420 - protein, 54 aa, Homo sapiens
RKDAGPGKRGSSGFRESFWPPHGCVGRRALSGSGTFGRRREPALAWLTSASSLS

SEQ ID NO: 938421 - protein, 84 aa, Homo sapiens
DDAGMRRESTDDLPHGSYVSSLMSHKQVVTRFVSPEPFALKSPSPRITGRESQLNVIHGPLIFQGRPLSKLRILRKHYFFGTQQ

SEQ ID NO: 938422 - protein, 37 aa, Homo sapiens
MTRFLTSPIDLVWSNPAPPGVQVARVEAVGGRGPEFS

SEQ ID NO: 938423 - protein, 80 aa, Homo sapiens
LLEAGVRDHPFPQVRCPREMRVFFYKPVSGAAASLSEMPCPERRNLERQSGYNVFAELWWALLVQISQWLCLHCEGNTTY

SEQ ID NO: 938424 - protein, 67 aa, Homo sapiens
LFLFMAWLHSDLGWSHIKPTAHWLSVWPTPRLPTTVMKQRLQMYNSQTTVSNQLHTDGVEDRGVGGL

SEQ ID NO: 938425 - protein, 86 aa, Homo sapiens
LEGVARPWSVAKRLFLEFCVLPHVGGGASTFVCLMPLRFLRGPARHYMFGRRGLAFMDNGSRGGVSSCPRSVAAVRVMRLAATPCI

SEQ ID NO: 938426 - protein, 153 aa, Homo sapiens
KRFIVPIKKAHGMNGRARSPEPERLFSRTQMQGGWGSGKGIGGLSSPRACARPTQRSSAVGMRVLRHALGASNHDDRRCQGRDPIEALPGLFQKPKANNEKRYIVGGGERLRGPGAPPEAQTSSSPADTLTCALGHFGDAGVAAFFTFSPRRP

SEQ ID NO: 938427 - protein, 41 aa, Homo sapiens
ILLSTRCPPRLAEWWCHGVGQGLNRTSTGKIVHTKISNQGA

SEQ ID NO: 938428 - protein, 88 aa, Homo sapiens
PPSAAYLRFTICDPGALGCRARRPLRLLLGIARGLYPWQEAPQPPGVDRQRRLATIPGISAVPGAPFPGLVFRIRKAGSRMSPGGGGS

SEQ ID NO: 938429 - protein, 71 aa, Homo sapiens
LLPTLRHAASGARHRGSRHTVTCKDVLCPSKGFVFFIPNFQRPFGVPHFTWTEETLHEDEIIGSFSFLPPF

SEQ ID NO: 938430 - protein, 82 aa, Homo sapiens
PSRPGSRAGSKAGSRASSRRGSDASDFDISEIQSVCSDVETVPQTHRPTPRAGSRPSTAKPSKIPTPQRKPPASKLDKSSKS

SEQ ID NO: 938431 - protein, 118 aa, Homo sapiens
PGLLRMMETAYGSTAADGHWSLRDAYDVLELAQVLHLATLDLALQPADVVAALTALTASLPTHSVRSEEQIARQQFSTPAAIGYIAALAARITAADTVLEPSAGTGLLAVFAARVGAK

SEQ ID NO: 938432 - protein, 70 aa, Homo sapiens
QALTRQTTRSYPAPPGVLAPGPFLVLHSRDSRRVPAAPEPLPGSQTPGALTAERAGLLESARPVHSPEDA

SEQ ID NO: 938433 - protein, 137 aa, Homo sapiens
RPPTTTKFAAAIDGVWRRRAEMGPRKGKEKQEEQDISLGPQVAYRENVFGVYNIFATFNDTNVHVNDLSGKRTICRSDWWDEGKGITDGSSPDDAMMATKDVTQEVQELGINGVNIKYRAEEEKDETPGPEEQTAIR

SEQ ID NO: 938434 - protein, 106 aa, Homo sapiens
STTCTSLSNASADPVMEGLRSAVRYDKTYFDKIVASLLPLLEKLTTGRIADCYAPDYMDLEDPRPIFDWMQIIRKRAVVYVGLDALSDTEVAAAVGNSMFSGRPAA

SEQ ID NO: 938435 - protein, 149 aa, Homo sapiens
MGARVSRRLNDRYGPMNASSPPRQQLLLVDDEEDALLELAELLEGEGFCCFTATSVKLALSHLTHHPDIALVITDLRMPEESGMSLNQRLREHTSRQTLPVIVTSGHADMDDVSDMLRLQVLDLFRKPIYHVRLLETLNNLFPQPRMHL

SEQ ID NO: 938436 - protein, 72 aa, Homo sapiens
RRERYLENGEPFRIEGFHDGVRVPGKATATLTISEKGGHRIYTGSMHDEVVYHQRRNAFRAALKLAQLVDAA

SEQ ID NO: 938437 - protein, 36 aa, Homo sapiens
LSTDKFKTDFYDQCNDVGLMAYLGTITKTCNTMNQF

SEQ ID NO: 938438 - protein, 68 aa, Homo sapiens
SSSSIIVPIFLLLDKDDSKPAMRKIITYEGLNIDPEQPYEYIVTLRPGQVKWSVVEHPGPGVRPRSPQ

SEQ ID NO: 938439 - protein, 115 aa, Homo sapiens
PPHYFFTYRIRIEMSSDALPEKACQLDSRYWRITNAKGDVEEVQGPGVVGEFPIISPGRIYEYTSCTTFSTTSGYMEGYYTFHFLYFKDKVFNVAIPRFHMACPTFRVSIARLVS

SEQ ID NO: 938440 - protein, 97 aa, Homo sapiens
KLLEPVLLLGKERFAGVDIRVRVKGGGHVAQIYAIRQSISKALVAYYQKYVDEASKKEIKDILIQYDRTLLVADPRRCESKKFGGPGARARYQKSYR

SEQ ID NO: 938441 - protein, 68 aa, Homo sapiens
KDVLLLISINSLSRAETYVFLFQRAGEAKGILIMMRYTTDIYQLCQSYRSQVDTAGTLTGIKQVYKKH

SEQ ID NO: 938442 - protein, 41 aa, Homo sapiens
TYNGTLEEVRAIQEIKPGEEVFTYIDLYPTEDRNDRLRDSY

SEQ ID NO: 938443 - protein, 102 aa, Homo sapiens
CKLQDMQEIIPPFGEELDALRPELGRPNMKSQCCWASKTHLEKEITPSRRLLGGESEGTREESKSGLKVSATPKIKAITQETLNGRFVLFQVNEIPKPAWDQ

SEQ ID NO: 938444 - protein, 116 aa, Homo sapiens
TQRQRRSKALDDFYKMLQHEPDRAFYGLKQVERPTKLAIDTLLISDELFRHQDVATRSRYVRLVDSVKENAGTVRIFSSLHVSGEQLGQLTGVAAILRFPVPELSDQEDDSSSEED

SEQ ID NO: 938445 - protein, 108 aa, Homo sapiens
AGRPVRGAAQRLVTPWRGGAARTPPDAGGAGRWAGAAVAASLLCALRVGLYMGQLELHVDLVPEDDAPPPRNAPTERVGRHPSARSRAAPRPVHSARALGPQPRPPLL

SEQ ID NO: 938446 - protein, 136 aa, Homo sapiens
VPPRKTGGRPAKAKSRPSRRPPVPSGRVHRLLRKGHYAEPLAAAYLGVLEYLTAEILELARNAARSNKKTRIIPRHLQLAIRNDEELNKLLGGVTIARDAVLANIQAVLLPRRPPAPSGRTPSCRQRRATQASPGV

SEQ ID NO: 938447 - protein, 67 aa, Homo sapiens
SGWRGLGVRPVPEDAGFGTEALASEATPRLLPTVGALGDQPFVGLLPKNLSREELVALRAAVVVRKG

SEQ ID NO: 938448 - protein, 151 aa, Homo sapiens
KVLAYNVVPATMSASFDFRVAPDVDMKAFEKQLQRWCQEAGEGVTFEFAQKFTEPRMTPTDDSDPWWAAFSRSFKAMNLTLEPEIFPAATDSRFIRAVVDPSSGFSPMNRTPVLLHDHNERLHEDIFLRGVDIYTGLLSALASVPTLPSES

SEQ ID NO: 938449 - protein, 107 aa, Homo sapiens
MMCISKLPAVLLILSVALNHLRATPVRSGSNPQMDKPKFQHGHVCHTTPGKLFGSFQQQPWSSPPTNQRGIEYIMARGMRQGIQIGNPWISYSFKVNVLLQHLILYV

SEQ ID NO: 938450 - protein, 150 aa, Homo sapiens
EFPGRLLLLNSRPLDKNIKISQTWWHAPVVPATREAEAGESVEPRRQRLQRAEIMPLRSSLGDRTRFCLRKKKKISLAWWRVPVIPATREAEAGEFLEPRRRRLQWAEIKQLGSRLARTRLGSLGYPNHVRPKWDYPVVVNHLIKTKTPP

SEQ ID NO: 938451 - protein, 47 aa, Homo sapiens
RYSALFPRVAYGPTRYNYLTPRPEEERTLAAQEKHTPDALKRLPRDI

SEQ ID NO: 938452 - protein, 128 aa, Homo sapiens
ELRKYLSISPFCALPRLSLREFYSVFRDPLQDFTLMRFLDRFVYRNPKLHKGKENTDSVVMQPKRKHFIEDVRSLAVNSKEFLAKEESQIPVDEVFFYRYYKKVAVVKEKQKRNEDEDSIEDVDDKEF

SEQ ID NO: 938453 - protein, 101 aa, Homo sapiens
ILFKSNLQGNNSTQPFLLFQEKPQVWEDRQLSLGHRQISHTVCLDPEGLRNPQGFLVSLKVLVIPFWLPFDSFGFLPTGKQRRNQPANSYLKPIERDLGIS

SEQ ID NO: 938454 - protein, 140 aa, Homo sapiens
PTTSVTSPNAISGLIQLHQRPRPTPSAAPSNSTPAPAALLGFCCFEPRHWLPNLPKLPNIHWDLSSLLTSCFFPVTPRAERCPPSGPKMILVTAHSCGCFGEDGTLNSATLTHAFPDDRYRVGACAEGACKREILLTLEG

SEQ ID NO: 938455 - protein, 83 aa, Homo sapiens
SNTKKILNVQKSETILSSRLVFCIPCYHCRVTGRRVKGTRSAAHHSPDPSPSPHLCPSPNSHTCYTPLLLAKTVEMICKREGE

SEQ ID NO: 938456 - protein, 166 aa, Homo sapiens
LFQQPLIKSSKYKESTSNCYDNGCLNSPVRLLNHPLSHSSHNDKYAHHLPASAIITTTQKGPRTDVPVVFLLKGKFPGVRLKGTALQKGCHKSHLVLYHLQSEACSSLRQSHAANSAPGLTRIANCCPQRLPSISTPTPQQPPGGPQCPEIAATTHPPAAPNPISR

SEQ ID NO: 938457 - protein, 146 aa, Homo sapiens
KREDNSQHLGQPALMADISRKIQCGQTHENQVADTIASLKIGHKNEEQFQAALPVALGENPPLQGSLKLLPWGAEGAEGRGSECAAVVERTLEPLKRTEQALGAHRGKTRDRGDLVGWGRELRMARNKFMGTETTWKINQKEFRRH

SEQ ID NO: 938458 - protein, 76 aa, Homo sapiens
LQVGIFMSHGLVSSSALQPTAVPCGPRATVLVGSQGSFPVLEIIQFICGSWKTVELMEMETRMMEIFPEAGKGGGE

SEQ ID NO: 938459 - protein, 40 aa, Homo sapiens
QTPSGPSTGCRFLFFFAQECVFIEEGGFPEAGVSGMTGFR

SEQ ID NO: 938460 - protein, 151 aa, Homo sapiens
STESAATADAAAFVFIALTRVCWFITTTTSYGELHVQGAVRRRVGYVIGINDLDIMIQLNIGSGNHPRTLLRQGQRNFVTAVQLDSQTFKVQQDFNDVFLYTFDGAVLVEHTVNLGLDYCSSLALRTGCGEALPRGVAKTTLERRGDFSPG

SEQ ID NO: 938461 - protein, 97 aa, Homo sapiens
SYCVLGSRSLVFRTSSNQDHFIIPEDSLNPFLCTFTTFPDPLCLDLAKKLVLAEICTLAKLRQLSICFPQLSISQPCRPCVNGAIQDERSLGSRVTA

SEQ ID NO: 938462 - protein, 77 aa, Homo sapiens
MIRTRSSWFAIKLVPPAIVAERSLIMPSASTVTRLITRKNDLGQSRIETQERALVVGPGEAILKVERCSLTTNNITY

SEQ ID NO: 938463 - protein, 107 aa, Homo sapiens
GRLLLLNSRPVDRRAAVARNIGRHFHALAGMVQGVASQVIQQPLHRHPPQRERLDRLQPRAYPLFALVIGRHHFAHQLAQVDLFHRLVATVADKGEELVEDRVHVVD

SEQ ID NO: 938464 - protein, 67 aa, Homo sapiens
WRKQGVECASGDCDGLRQSWFNIHTDPCPCMDSRLREDPGLCAIPSRLGGSFSVGGGLADPWPQEFM

SEQ ID NO: 938465 - protein, 121 aa, Homo sapiens
STHDHIKEVVRIQRRTPAEVEVALAFLEFVVIILSVLHFNTSLVDQAGFGDHLVAEVIEQATSGHMTFLGLTAALQLEVAVAAQDAELGNRVGGGGRHRDHRGGDHCQGRGFDEQVSQTIE

SEQ ID NO: 938466 - protein, 54 aa, Homo sapiens
MRAHTDPCTTQARTDTDTCTDTHSTCTHDTPDVHTDTQLAHTDTHRCTQAWGQH

SEQ ID NO: 938467 - protein, 34 aa, Homo sapiens
NFHVIVLQRVACLQSFGTQLRTWAWVGDVGQHPQ

SEQ ID NO: 938468 - protein, 51 aa, Homo sapiens
MSQVTCSRTWVRGESCRKGQPELNGWTGVVPTSNSHLGPTLHIRFLKALEC

SEQ ID NO: 938469 - protein, 133 aa, Homo sapiens
AGAYYYYKIRGRRRPNPEDYKKAEEKLLKVRPFVTYFHSSKYISDLANVNICVAAGFSGDVFQAKARAAAGKGVNIAYVIPKEGGNLWFDVLAIPKDATNVKEALAFINYLLKPEVIAQVSDYVGYANPNPGA

SEQ ID NO: 938470 - protein, 41 aa, Homo sapiens
KKSDQHGIVGRLLRGDSASERPRKSHGYILSFPQLSVIKNV

SEQ ID NO: 938471 - protein, 92 aa, Homo sapiens
EVESFSRLDDLIETIRGLGIKFAEIHMNYLHTTVTLRVIVVADILAQGLVAFFQGRCAFGADNPVTGPCAGRISLFIAAGPGVGFAEQSVDA

SEQ ID NO: 938472 - protein, 94 aa, Homo sapiens
IRNELFTASVAAAFLNDRRIRVSKRTQIEESLIGTGFPFRMISQIDDYLKMLRPVMEKAAGLRRSGLRADMAYTAAGRFDGFFEIGLKRGTSRR

SEQ ID NO: 938473 - protein, 104 aa, Homo sapiens
SPRLECSDTISAHCNLCLPGPSDSPASDSQVPGTTGARHHARLIFVFLVETGFHHAGQADLELLNSGDPLPRPPQSAGITGVSHHTRPSELIFEKSGQAIQWVD

SEQ ID NO: 938474 - protein, 92 aa, Homo sapiens
QEVGFDPLYPGCSCPSISVCSQERMAESWPALLTCPIPVCPLSVRLQAHDPRQACPSVPVSTETPLYRPPLPKAALVAHTPPHHGIQDVEEQ

SEQ ID NO: 938475 - protein, 68 aa, Homo sapiens
STVPAGAGDYRALPPFVTTVGLFVNASRCELGEILDAVPLDLLQFHGDEAREQCEGYHRPYIKALRVK

SEQ ID NO: 938476 - protein, 108 aa, Homo sapiens
PADWRTMFFSTGSTPPSDMSSLQTTYVVIAVLVLLVALLIARTPLPDLRAQEQALQPVAGKGLWQYPEFVGGVITQFFYVAAQVGVGAFFINYVTEHWAQMGSQHAAY

SEQ ID NO: 938477 - protein, 125 aa, Homo sapiens
SHSTAPRSSVHPFPSMVFWVGPPFFISPILFLSIVLWVSPPIFIRPFLSIVFWVDPPIFIKPTTFLMALWVASPSSSAHSTWCCFVVTVPPPPLRFASVSSQCPCGRNKDHSIDGDHIAVQTSLV

SEQ ID NO: 938478 - protein, 117 aa, Homo sapiens
GPSTRQIILYKKCNKLYDVSTIQLNDKKKVSTIMVVNMNSADREGHSGDERNLMLEYPPPLNILECKDWPGVVAHRVVQATQVAEAQEWLEPGRRRLQGAEIAPLHSSLGNTVRLLS

SEQ ID NO: 938479 - protein, 119 aa, Homo sapiens
MGLNANTSRVAGDFEVLEIEGKTRCGCAGKITAGGDGEYNVGDQPAVRKEAVFFFNQKRRIRLDPLQEPPGKQTFLPSPGDSFKAAPLRGTSVQDAGFSPYQRGVYTHSPPPARGNTRR

SEQ ID NO: 938480 - protein, 101 aa, Homo sapiens
ARPGVHPALPNLPTSCCLPWNKQKLPRECGLSPGIACGLPFPGSWPPTPPHLCFLMPLQDMHGLSSCPRAMVGFRSQSAPSRSRTAPSPGTCYFLKLSTQA

SEQ ID NO: 938481 - protein, 131 aa, Homo sapiens
DRPGPNVITHGRVIALEGDPCLFAVVQGTGGQVVLELRLERVQRRAAPHRYVIIDPVDESRLQGDRLGLAIGAKIATLEAALIIVDQTEWNIEPQAELKNPRQEVLKNRQKGTADKGTDYPCSFLWRRRGR

SEQ ID NO: 938482 - protein, 118 aa, Homo sapiens
LISSESRGGRELRVTQAHGLTGFLTQITVGTGHPALSVSGGNSGTRRLWSDVPSCFGTKPVVKVMAPSVRLARWVVSLTKGPSRSPLTKWGTQGHSVHPAPMTAHGTSAGQLSCACLA

SEQ ID NO: 938483 - protein, 81 aa, Homo sapiens
DRLPVTVANGACLALAGHDTEYGLYFMNYHSRTPTVGTTTASASTITALGSILPLTPAPFRSGLAQSIMLGRGQYYLESTR

SEQ ID NO: 938484 - protein, 86 aa, Homo sapiens
VATDQRSKWDDFGQGVLPKRFIFGVNTIISLSFHIIQQLNYVSSLHRYLTDVAHVDIYWFIGSRLDVAPSKLPRLTTPIQGSSTVP

SEQ ID NO: 938485 - protein, 34 aa, Homo sapiens
ARLNCGVDGRGAFYMFSVNTERSSREGCHARRGR

SEQ ID NO: 938486 - protein, 34 aa, Homo sapiens
RPPTTTKLAAVRRKKEKIEEREQERNQEKEKRGR

SEQ ID NO: 938487 - protein, 30 aa, Homo sapiens
MMVDFQEVFPETEPDVTTLLKQGGEFVSQF

SEQ ID NO: 938488 - protein, 50 aa, Homo sapiens
MMLPFVMFSSAQIGRRLERSFAATRSLARERSNEASGMIWSTCHSDLFSQ

SEQ ID NO: 938489 - protein, 46 aa, Homo sapiens
MKLSQIEAEMGPITYPGQGQLSRLHQENEYLFHVLLCVKRDEFNTT

SEQ ID NO: 938490 - protein, 47 aa, Homo sapiens
MTSTCSPSYSGGRGGRMTRAREVAVSRNCITALQSGRQSQTSSQKKK

SEQ ID NO: 938491 - protein, 86 aa, Homo sapiens
MFDIMIRQLRSLKRMQDEAWRCLNVKVSPEKGTRGGKQDKRTVRLNISGGVVDGARETEIVGDSSSEEEKGHTSTGRSTGTIASLV

SEQ ID NO: 938492 - protein, 66 aa, Homo sapiens
RTHRRPQVAGAILSKENRAGGLTLPDLKIYCKAGRARWLMPVIPAFWEAEAGGSQGQEIETMLANM

SEQ ID NO: 938493 - protein, 86 aa, Homo sapiens
RRAKAVKTLLQSWSSRCEIMALGIDSAKEKMEREKPVEREMKSSVLPKASTLSKSSAVIEQGDCKNNALVPGPLFTSFDGCPPWPF

SEQ ID NO: 938494 - protein, 64 aa, Homo sapiens
PYDTEEELLELMNNTPYGLSATLWTNDLSKALRMVPAINAGTVWVNMHTMLDPAVRLAATSLRV

SEQ ID NO: 938495 - protein, 87 aa, Homo sapiens
SEGPGSSLGPRPPMPAHAYRRTIGRQLAKTHFPRALIQCHMARQVGGDPLVDLPLNRLGHGLSRSTANKGDLAFARPVMGLDRHPVD

SEQ ID NO: 938496 - protein, 93 aa, Homo sapiens
WKMDRFLNRFHLGEPEASTQFMTQNYQDSPTLQAHRGRPASPSTKPGGARCLLDRSFALRACGTLLNTEDTTTEPPLHTDPTLIPPHKNNKTP

SEQ ID NO: 938497 - protein, 87 aa, Homo sapiens
HKYYFLVGYSETLLSYFYKCPVRLHLHTVPSKVAYQHLYNNPLSSIKLHPAETGNARQQCYVGDNASPQRTQHQSLICSSTKTFYLD

SEQ ID NO: 938498 - protein, 112 aa, Homo sapiens
METVVVRINYQNVHKVLANSRCSIHAPMTCISPWDWQWWLTHEAMVDSLLQRRHDLPVAVSALMPVHVLRSTPSCEHQAPSLPLSLQPRSPAPRAAPGLARSVLPTRLGDRE

SEQ ID NO: 938499 - protein, 37 aa, Homo sapiens
MHLQLPRSLRFSICPGQWAGRTVLTQEQLLVQAPWLQ

SEQ ID NO: 938500 - protein, 68 aa, Homo sapiens
MNYHTISNECSDIWINYCTGEEMKIDMSHRIHNDCVASIIASVAAAQMSAVLRQQGQRLPFAVVGPLR

SEQ ID NO: 938501 - protein, 81 aa, Homo sapiens
QEGSGHPLEIPCFPLKWAVGANSSGIFAGKSTIVYAMAKAHSCWRTAAPLCSTGPLSVWLPVPPTPVSLLGRSYVGWLWRA

SEQ ID NO: 938502 - protein, 68 aa, Homo sapiens
KTLGLVKMQKESLANLQMENKTYSVMNKKADTNMDLMGGLDIVIIEQEDDSDRHLAQHLNNDRNPLFT

SEQ ID NO: 938503 - protein, 69 aa, Homo sapiens
STPTLNDQITKKSEFLDFKKSQPTYFGDCESLTKEYVDTKRINTELLIKDQKIDNYVTTGSITTDAFAR

SEQ ID NO: 938504 - protein, 70 aa, Homo sapiens
LQKCCILRRKEGVYGYNLQDTTRYKQCFTKHERFFNTFRWGKNRCSVYLQRLRDWKTVNYRRGKRTCVSS

SEQ ID NO: 938505 - protein, 117 aa, Homo sapiens
ARHRYEVRLKNGSVLVLVRDKPWHPGANRLNGNLMPCAFSCFLVQSLCVAKERLLLKVPIFPSGSRPSNKGAYPAVRKLQGREMNPPKMMSGTPLIRVLGDYKSVLFSVGCFTALVD

SEQ ID NO: 938506 - protein, 85 aa, Homo sapiens
CCLRARGRQLLKQRRPIGFHLRSPGLPFIGNIYSLAASSELPHVYMRKQSQVYGEVPADGPGQGRRQADREARDFLVGIMDALGE

SEQ ID NO: 938507 - protein, 40 aa, Homo sapiens
MRTLAFRVAKFQNAVQPMVLSSGVRWRNAVSKMRLRTSLT

SEQ ID NO: 938508 - protein, 188 aa, Homo sapiens
SPSSKLPSSASEIRERHKILLRRQLQTHNVRFTKVEMKEKMLRQPERKVSYPQRKPIRLTADLFAETLQARREWGPIFNILKEKMGKKQSRKTGNCKKQSASPPPKECSSSPAMEQSWMWNDFDELREEGFRRSNYSELQEEIQTNGKEVKNSAKKLDECITRITNTQQLLQGKHKTAEQQETSQSGR

SEQ ID NO: 938509 - protein, 113 aa, Homo sapiens
CLVVVPFPAPDDTLFYCLILAGFDVLNFLKEFYSLDQKVWLTTPLLLAFTFWVSRGNSKGWVCDVVPACLCASFFLCVYFVLFFSVYISDPDRTTCGLSIKKIKRFKKQGRTP

SEQ ID NO: 938510 - protein, 91 aa, Homo sapiens
MATVKDAFPACPLPICCERGPPCLEALALALQFSSGEKGQCPSPELGPQFFLFPRTKAFGPSDPIPLTQVSFCVWGEERMISVWFHLLFSS

SEQ ID NO: 938511 - protein, 104 aa, Homo sapiens
ALIAVSSETEEERTFTFRQLHDEVNAVASMLRSLGVQRGDRVLVYMPMIAEAAYYSAGLQRIGAIHSVVFGGFDLHSVAARIDDAKPVLIVLADAGARGGKIIP

SEQ ID NO: 938512 - protein, 121 aa, Homo sapiens
GFVSLPLLAWIAQSPIIIITGEQLSSYEYGLLQVPIFGALIAGNLLLARLTSRRTVRSLIIMGGWPIMIGLLVAAAATVISSHAYLWMTAGLSIYAFGIGLANAGLVRLTLFASDMSKGTV

SEQ ID NO: 938513 - protein, 137 aa, Homo sapiens
THTCCAITPSLSLEKGLLAIVTGSLSAATGPWEPWSLLAASPGHQPGTRSPRPTVASAVPSCGQMDDPIQTALQGTERGSETRPELPSGHHHHLEPFTGSVNCVKTGCHQETSLQLYCKQTHVFKGIRRNPPWKNTI

SEQ ID NO: 938514 - protein, 101 aa, Homo sapiens
EQSLGTGVTERAAGCCGGEIRTMREVGTKELWDKGSKKAEKKIVPVDGEEKKSEGLDTEWDRTSSCALSSLVVSNRYPRGEPYIICYPEGSGGKRLWAEVQ

SEQ ID NO: 938515 - protein, 120 aa, Homo sapiens
MVAGRFQNGGGHFQDGASLVFSDLGFLASDIPRNGILGHAVSVLALLEALGHGRELWNPVTSVQLDEDEPRHIAVQEQWQAFSLTGSGSGCLAGSGAQQTPCWIPRDGSQQRVCNGSKQQ

SEQ ID NO: 938516 - protein, 55 aa, Homo sapiens
MLPDATVLKVWSLSLAWDASASCGDSETCKFSGPTLDCLTQTLGALALSDLCVNT

SEQ ID NO: 938517 - protein, 96 aa, Homo sapiens
MPLTALSSGFLASIWPQSLPIPLEIKFLLLTECPGRAFLAAFFIHVTDASGFSQRRTSHLCAAALSIRCPQQILSPHSVSVSHILTVGIIRRGATV

SEQ ID NO: 938518 - protein, 81 aa, Homo sapiens
FPPLIRAVTWIDNPIEVYVNNSAWVPGPTDDRALPNLKKKEDDKHFHWVSLSFYLPGKNTRMLNAYNPKLVGRRTYCQCHQ

SEQ ID NO: 938519 - protein, 128 aa, Homo sapiens
MAYSGRCLLSGYINKRDPNQGTCTNACRWEYNVQEGKEDYLVDDCFLLTDMYPFAFLSCTYCGEVNACVDQPVQQIDSLSVNEHTSILLFPALLQLNQYGYFLSKMLSRINSSRRINKIYISFASASE

SEQ ID NO: 938520 - protein, 89 aa, Homo sapiens
SGRHGSTFRELHLLMASLDWGQQWAGALGTHRAWPQPPLLFLVHPLAHEPLPGPCCYPVAVLEEVMLVPGHIYSTELLRQLYTTLAAQK

SEQ ID NO: 938521 - protein, 101 aa, Homo sapiens
DIAFTFKLCTELKMCYTAYFLNVKIFLSLYEETHLGNGFVISVNCVLNDMSVLHRLVPSSATHITLHNRLRSNIFISPYPIYFYTFFHHRLSLSKVYNGTN

SEQ ID NO: 938522 - protein, 34 aa, Homo sapiens
YRFYGLLGAWVVLLNFSSNMAGWVGGGLNLALII

SEQ ID NO: 938523 - protein, 112 aa, Homo sapiens
MGTDAIIPVDQLRFALGLYQITGADIFVPGLLKCRDPFLICPVDLAPDDTNSPVVRGDLARYFLKNKRSVSSSGSGGRGNSYFGIMKGWPATGANTSLIAWLKVLLSSWEPF

SEQ ID NO: 938524 - protein, 31 aa, Homo sapiens
IGITNISSSHQGHHAIDSETFIVHTAIKTGK

SEQ ID NO: 938525 - protein, 70 aa, Homo sapiens
FGLRFGKREASPGNHGRSLGGAEGAGAGHLTSDPKGFILFLAGPGGGNLVLREVNLSFQPEAIKEMLRNS

SEQ ID NO: 938526 - protein, 134 aa, Homo sapiens
MTSRHSSSVWLRFRVIIWERGIMMLLNALVCDVHHPFEHIARIFVDKVVLPGITDQRQQFVTVFRFTVEKLAENREKNPFLLLIVSLLCELSSLMASYGFIMLVNQNAVVNHQRRGRLPVKCLANYSFSAMYGS

SEQ ID NO: 938527 - protein, 83 aa, Homo sapiens
KDNQFYERVLPRGVVTIYRVTSGLPTGVQAGTDLILAIHVPQDVPLVVGGNAAHVVMHGGEDGDGSFVTSTPAKIMGVSEMPG

SEQ ID NO: 938528 - protein, 57 aa, Homo sapiens
SIPDCFRGLVLHVCGFSSDTVQVVGRSTIQRLEDGGPLLTAPNYMLDIQETHAPNWD

SEQ ID NO: 938529 - protein, 94 aa, Homo sapiens
MPQMMRLAVLEPHDYYVGLELVLQIPHFVSLVPLWLRWEGEGGVVPPSLNFFIITPTNRCVAVVVVWGVGEFTDVAPEPIAVIMYSSPGFASAA

SEQ ID NO: 938530 - protein, 124 aa, Homo sapiens
SALALAPQVGPRLQRLGFRAIGCLSFGSVRLALVSHAFREALSNLANSPGCSKTKKLVPLEDGRVCGAATHCCPKLTQEFTPVWFLDVCWVFSSVPYSPPRQSIGFLRCCDPVLLPVIKMLSDS

SEQ ID NO: 938531 - protein, 110 aa, Homo sapiens
NVKAKTTEGPLFRVNPLSLRLFCKIAFLLLRQSLFNLDNSTYFLLALGVLVVSLSSVSTLQVYGEAVCLVSPYFMLWCSLASVLVKHHCRGLDVSVKREESLMAISFSVG

SEQ ID NO: 938532 - protein, 40 aa, Homo sapiens
WSSTQSQSGEGRSVDYSYLQPGQDAMPNMLSIHRIISSFI

SEQ ID NO: 938533 - protein, 90 aa, Homo sapiens
SPAWLRVYGTCTFKFEWRRHSVLKSGTGQASPHKCSTDSARPVVCRSAKPNRFLSVKQNWIAASENCPCVRVPLAVANQHIPLSSHTVKE

SEQ ID NO: 938534 - protein, 103 aa, Homo sapiens
PVIPALPEAGEGGSPEVGSSKPARSTWRSPVSTKNTKSARRGSACPQSRLLRRPMQEIRLKPGGRGCGVPRSRHRTAVSTTKNKTLSRGKKKPHKIEPVSVKR

SEQ ID NO: 938535 - protein, 41 aa, Homo sapiens
APAPTPNVLPPPSPCLCRPCLGRPPRPFDVCVLPPERRPVG

SEQ ID NO: 938536 - protein, 129 aa, Homo sapiens
ICPPGPKFRPGGQAEKIFGEGFKGRGFWFKKNNLPGSGKFCFWVPGNIHLGFQFGPSLWFFRPGFFLGAGGAGFHTPEKEGRAGFLGAQNRIHKGGGLRLFPPEFGGVLPPGKKIPLFFPKGNKKFSGG

SEQ ID NO: 938537 - protein, 152 aa, Homo sapiens
TVHTVTLQVRLILIVEYTPPGEDSICNDTCSVCWSMEVLSMCANHRPVCLYTPDLAVFHEQARTANRGPVCLYTPDLAVFHQQARTANRGPVCLYTPDLAVFHEQARTANRGPVCLYTPDLAVFHEQACTANRGPVCLYTPDLTIFHECACT

SEQ ID NO: 938538 - protein, 198 aa, Homo sapiens
MFAKAFRVNSNTAIKGSDRRKLPADVTTAFPTLGTDQVSDLLPEKKDLNIVKLYAHKGDAVTVYLNDDNPILFELEKNLYPTVYTLWSYPDLLPTFTTWPLLLKKLVGGTDFILPELLMPPAGLPQVHKGHLCPISLVGNRPPVAIGVAAMSTADMLTSRLKGRGFSLLHTYQDHLWRSGNKCSPPSIAPLALDSTDL

SEQ ID NO: 938539 - protein, 142 aa, Homo sapiens
GCVMIYRPVGLFQCVDRSTHPDCALRDRGSRYSKKAPRSLYRTRGGSYHSPLSGAGFQDSTVTGNCVALALLLPCSLPLQSSFVFCVSQMILLSKDAFCWENGVLRWYFNAACVQDFGRKGLVLFRGLKMLRWDWGKLFSCL

SEQ ID NO: 938540 - protein, 77 aa, Homo sapiens
YRGGPHAASLEEQAGAVPPLGLRMLHPVGFQACPDDPTGLCPGAILRPISHSNDRLFINPIKINLYSGTERRKKNIF

SEQ ID NO: 938541 - protein, 186 aa, Homo sapiens
PQGFPELKNDTFLLSTWGEETDYTPVWCMRQAGRYLPEFREPGCPGLFSTVALLSLWTASPLALLWMLHISRHPVVPGTGMEVTMVPGKGPSFPEPLREEQDLERLRDPEVVASELGYVFQAITLTRQRLAGRVPLIGLCWCPWTLMTYMVEGGGSRPWLRPRLGLSETQASHKWFESQERLGHIW

SEQ ID NO: 938542 - protein, 119 aa, Homo sapiens
SSPLCTDREIHCAKSASLAADLESTPAFRRCWGHQRSGSQAGEWLRGSVTEPPGCPSCLKRPGVFSDLICVFVLRRSRELCLHLLQLWGAAALSHLLAFGVLVPRVARFHAVSAVSGEH

SEQ ID NO: 938543 - protein, 105 aa, Homo sapiens
EAWTELGLGMAQARWWATFASYVIGLGLLLLALLCVWRLEEGPGKLPYCSGPPVYGLVLWAGAFYLFHVQEINDLYRAQAENQNVLEESTGQPESETQNLSKPKT

SEQ ID NO: 938544 - protein, 45 aa, Homo sapiens
NVVTGKTQRRYWENTTSLLGKHNVVTGKTQRRYCENTTSLLGKHN

SEQ ID NO: 938545 - protein, 109 aa, Homo sapiens
NRNLFLSVLEAGSSKIQVLVGLVSGGDPVSLPSRWCLVAASSGGDKCCILTWQKAEGQNGQMLCEASFRKALSPHSGGKSPHDPVTSLTLLHWRLSFNMNSRRTQTFNP

SEQ ID NO: 938546 - protein, 164 aa, Homo sapiens
AITQGMVDFFHEEQGHLVVGAPQDIIPQLKKKYDVDTLDMVFLNQLEDRYLPDTLLLEECGLLRKGTVLLADNVICPGAPDFLAHVRGSSCFECTHYQSFLEYREVVDGLEKAIYKGPGSEAGPDCPPALARLSHPPGMRCQLLCDFCGPGGLIKHTCRLRLTC

SEQ ID NO: 938547 - protein, 133 aa, Homo sapiens
MDMQSGRFHITKIPIPEKQMSIALGMECDPCGQLTNDLKSLTNLPTLSLNLIINAGISSALVASQDQKAVTPLDPVFSILCVSFISQPADLPGNKERALLHCKLLARSRNIVPATWDAEASVEGELPLIINQK

SEQ ID NO: 938548 - protein, 104 aa, Homo sapiens
SHNRVNARLAGAPSEDPQFPKVQWPLRELCSACHNERLDVPVWDVEATLNFLNGPPLPKQHHPGLPCSWVSCSDGMLDICFLFSIVDGSFRSRNPVFNSGPWEA

SEQ ID NO: 938549 - protein, 69 aa, Homo sapiens
CVHSLLPPAIFGEDGQLQSVRNCTRQPHSPAEPVSHPLTAQTCICIELASLWRRLRGESLSCQEDGVLV

SEQ ID NO: 938550 - protein, 104 aa, Homo sapiens
AAAKTTEVCHELTRRHNIHVQPINLPTVPRREEPYGFATLYHTPQIMNYFLEHLLATCQQLALELSPHPSAECHFCRRPLHFEVPTERETSYFPGLSKPSSPQA

SEQ ID NO: 938551 - protein, 119 aa, Homo sapiens
QWGSLQKLPRAHTCFNRLHLPPYDTFEHLREKPLMAVEPAQGFDGVDYRPSASGVLVLQARSACTFAFAYQTFPTAIQQSSCRHAPWRRAFTTHSSKFGRANLRPSLTPCLSHHKFSPG

SEQ ID NO: 938552 - protein, 74 aa, Homo sapiens
AQQPCHGFVCLLYCSLPTFRNAILYNLISELRLSLHLCNLHITTTPNTTTKTPIVVCTRLTYKMLAGNFQKKTK

SEQ ID NO: 938553 - protein, 82 aa, Homo sapiens
YALVMTPKLQYRGYAQVHSPYSSGQEFLTCSVSSLALLHLSLGNLLVPCTFTPDSQCTYLDLVPYSPAFLRLRRSLSPHPPK

SEQ ID NO: 938554 - protein, 66 aa, Homo sapiens
KHCYGEDLYCLKMQAGRGWLMPVVPALWEGEAGGSRGQEIKTILANMVKPRLYYKYKKNKISRAWW

SEQ ID NO: 938555 - protein, 73 aa, Homo sapiens
HGPQLLLGSQWHLSVASYLPGPGWGTVLRHEARPPPAPLPRGSSIPLHFWNVCPPLIFVYSTHLQIYLRYEAK

SEQ ID NO: 938556 - protein, 35 aa, Homo sapiens
VHTNPPRSISDSPSALKKQRNSQPTSHRHCHQAHT

SEQ ID NO: 938557 - protein, 131 aa, Homo sapiens
DARSRAPNRVELCRDECEVLESDLCRQEYTIARSNPLILMRLQLPKCERCPCLRAPTLPTACALALQPRGWAATISAITAQAWITEERQAPPSQATSATVALQHPHSHHLSSTDFPELGGGTPTAGTPEPN

SEQ ID NO: 938558 - protein, 137 aa, Homo sapiens
PLAPGRYWTANRNTASRPDKPAIGLLPQDTWQRRDGRVRMTETVGFAKPAVLFVGSIKDRHQVQQPNIGLDPQATLGEGTWGHRGPEGGSHLPLVMWLVGMEPQVHQALQYRHPEAREHQPGFAAGFLAHPGICTIT

SEQ ID NO: 938559 - protein, 69 aa, Homo sapiens
EQEGPAGEGPRRWKLGISPPTEQTFSPSSKILLVTRWGAKRKFFLLSDLGGVAWCDGKGCWWEGQDSRV

SEQ ID NO: 938560 - protein, 36 aa, Homo sapiens
MSYDGNRSTSSYAGVSVLTCRPDTCCVSGPAYTGPT

SEQ ID NO: 938561 - protein, 36 aa, Homo sapiens
GGPVAGAGRARSFGSSWRAVDMQSPEVRAAIKAIFS

SEQ ID NO: 938562 - protein, 152 aa, Homo sapiens
ISAESHKLPHKQNRGTMTRAMRGIQLRYLESLKDQEACARFRDGPTSAEEGYVFQDGFNKLLKVFMKARPWRLPLRNGSPSWTSPPRARRRETRSQKDPTGLPGICLVNALRCPRTWRWHRAPPIPVFVCVQLCCTGLGPPLSAKGPLSMLF

SEQ ID NO: 938563 - protein, 122 aa, Homo sapiens
NAHTPLKPPGQCAKHSGCRERVNDRVPPRRWAVRNRPRKRCSSEKTDICGMLESGFTKSSHEMYKSFARKQPRNGHLSPAAYAVRSTQAPSNHPLGEAGKDPRGKIATTATPFFRAGLVGSV

SEQ ID NO: 938564 - protein, 45 aa, Homo sapiens
DDDDQFSEGDETKTPTLQPTPKVHNGKRVTSVKKPAVNKKQGECL

SEQ ID NO: 938565 - protein, 31 aa, Homo sapiens
NNLSSARLQQMSERFLHHTWTLFNKDSPSFT

SEQ ID NO: 938566 - protein, 134 aa, Homo sapiens
QHRLDANLSCRECQVCCSPKTNQVVEPTVLLAPVVRDVSSVMRLAFGDPWVEAAGVRVCRLCQCSDSIDPNAVGNCKRVTGECLKCIYNTAGFYCDRCKDGFFGKALAPNPADRCKALQLDLYGTMKQESSCKP

SEQ ID NO: 938567 - protein, 139 aa, Homo sapiens
ILTSLARVAGLLSLRCPAQLGALRQVDGVYYNLDSKLLGPEALGDEDGVRAFLALRVAQGLCEVLLVVTKEVEEKAAGCGQTDHELTMGATRSLGIPPAAAQDCMPGKGRALHGPGGPHPLRTRALLPSGAGGLNKSAD

SEQ ID NO: 938568 - protein, 74 aa, Homo sapiens
NFRSLHRSAKNSTKAFHHAPAESMSLVWLLRAYVIWRPCYLPKSNSCHLGLTGGPYKWQTQSCLRAFALTVPTA

SEQ ID NO: 938569 - protein, 134 aa, Homo sapiens
QPPGKLMHTEVGEPLGYKVSDFQSPTQAVSSPCNCHGNSSTGCVLVIFCALPCPQHLTCVVSFGPRNSLGGSHGHYSMSQMGKLKLAQVTQQTVADHGLTPRHWAHNSKHELPGHPEVQLAAATRPKPWPISPL

SEQ ID NO: 938570 - protein, 127 aa, Homo sapiens
DGVAFSYRIPPLLNHMRNISKGHQEICQKKQFLREAEELRVLSYRSPQLPGENYCRMEGICLPQPLKSASSGREVVPAPWLLMQLCGHINVSADLLKGPFTWDGERSLFVSSASTFFRPPYQKQSYF

SEQ ID NO: 938571 - protein, 97 aa, Homo sapiens
HPVSFSHGEQFQGQESLSIWRQDKPCLLPKHTSPHWASGPAWAAQGSVSGGDVAAAPGTGVRRWPGRDIEGSTRRGQGEALVEERRRRADLLILINL

SEQ ID NO: 938572 - protein, 31 aa, Homo sapiens
HGKERVTSRQSGPQQGEAAGAGLPRKSKICL

SEQ ID NO: 938573 - protein, 149 aa, Homo sapiens
QSISFDSIAFECIPFLAVHSIPFDAIPYDSIQFETILFLSIPCGSIPFHSSPFHSIQFHSTLFRSIQFHSIRFHFFREPSITLPSIPVHSIPVSSVRFHSIRFDSFPFQPIPFHSIPFLSVSLDSIAFDSIQFNSVLFHLIHFHLIPFH

SEQ ID NO: 938574 - protein, 44 aa, Homo sapiens
APNHHHGGPPARAQRSTGWLPAARQARALIHSSVWRFVKVLGKV

SEQ ID NO: 938575 - protein, 70 aa, Homo sapiens
PYENLMPDDRKWKFHSETSPKTPSVENLSSTKPVPGGKEVGDCWFKGAGTSPSLACSDDVTGLRLLLLLC

SEQ ID NO: 938576 - protein, 132 aa, Homo sapiens
MTDIYDTATKITDIDTHSIERCCRIHQVQCADTACFIAQKRNISRYELTAIANIEVSDARNTNGGIDILIDLPHSPRGDADIPDAGFSITEWTSSVADNKPLITDIHFAVAVITKISSEISDNGVLILNSNV

SEQ ID NO: 938577 - protein, 68 aa, Homo sapiens
LLLLNSRHTRQQNGMNPGGAPRSEPRSCHCTPASASRVPAITGTRHHAQPIFCIFSRDGVSQCWPGWS

SEQ ID NO: 938578 - protein, 61 aa, Homo sapiens
MSHLSSQDYWRDDHARPIFVFLVETVFRHVGQDGIELLTSGDSARLSLPKCWDYRYEVDAA

SEQ ID NO: 938579 - protein, 32 aa, Homo sapiens
AAKLKNQPSKKDEGILEKYSNSRVYYVFFFSN

SEQ ID NO: 938580 - protein, 106 aa, Homo sapiens
LHAHTRGHLRPAPRPFHVEPRVCPNPSPGPVLYTYLQGVSWPAALFAIVSRQYTDYSCAGSVGSTRTAQSCQQPQRAEAARPIYVPHVSRFSRHPASKIYVSAPLS

SEQ ID NO: 938581 - protein, 55 aa, Homo sapiens
SSFCPSVSCCIMPGSQEASQHFLTTKPGLQIPGEIPGKHQHSSPARTTAKAHKGT

SEQ ID NO: 938582 - protein, 87 aa, Homo sapiens
MREPIYVREPLFFVIQILPASYTYISYAYECIMQSDQNFIGNSSTPLRELPGIGAAEESGAGAEADGSSAAEDVLGDRPVQGQYRQL

SEQ ID NO: 938583 - protein, 120 aa, Homo sapiens
MTALQMQKISEPSSAQPTMMSSIRGITMNGFHDIMILLPRVHSSVMHKDKTWWWSWHLRYWMELVATRTPWTCVSVASVRQWAAIGNWEAMPRRTTVESVPAMAPPAGLYGDNQSHTFLL

SEQ ID NO: 938584 - protein, 80 aa, Homo sapiens
PGVVIDGGVDVVEPDGYASWRERWFAFVPPGIRRSSAVRDAAEFLHINVDEIAGVVMLVTVVARVARITVPVIGSCHANG

SEQ ID NO: 938585 - protein, 58 aa, Homo sapiens
MGAAVAGSAGCPVMHEAGCCRGLGQRGGGRSQSSVGHKHVDFILGTWQGFLKGAAGKR

SEQ ID NO: 938586 - protein, 59 aa, Homo sapiens
MTSNKVWTKLCRELVRNADTRPGVVAHANIPRTWDAEASGSRGQEIETILANMVKPRLY

SEQ ID NO: 938587 - protein, 92 aa, Homo sapiens
MHKHLGLDNKECVLPSIVKRVLKSVVAKFNASELITQWAQVSLLIHWELPERAKDFSLILDDVAITELSFSWEYTATVEAKQVVQQEPSRPS

SEQ ID NO: 938588 - protein, 43 aa, Homo sapiens
MVFQILSFLEVKQEDFIDWLIIFEHSVDDYDFLWNRYPNPGKL

SEQ ID NO: 938589 - protein, 78 aa, Homo sapiens
DLGRGTWLTPTIPALWEAEVGRSQVQKIKTILANMVKPVSTKNTKNELSVVVCTCSPSYSGGRAEAGESLEPGRRRLQ

SEQ ID NO: 938590 - protein, 147 aa, Homo sapiens
DDLDGARLQLPLLKTMVGWPADVRWEIRQERFDGRLLFKMGDDDLPRRRVLVTLHTAIQIARFLEKTTVQRVIDSNLTPAFAGLFNQFQGQTPHKAQAPFQYVVRLSQDFTQDPVRYIGKALPEAHRQADIGHAAQTVEALEHRGAL

SEQ ID NO: 938591 - protein, 121 aa, Homo sapiens
NRLRAEFRLWREGGERHYAMFSQDDKRTPILIEEFPIASLAINQLMPQLKAACKRSAALSHKLFQVEFLTTLAGDAMITLCYHRPLDEHWHTAANQLATDLNVSIIGRSKGKRDVIGHDYV

SEQ ID NO: 938592 - protein, 33 aa, Homo sapiens
AAAAGRRRRFFVPVAKVFICAGPDRSRGPQQRN

SEQ ID NO: 938593 - protein, 103 aa, Homo sapiens
SVLALSVLDTLCPDDELVGFGFRAGPFLFPPRYLVMQRLFPRIPHMKDPIGDSFQNDKLVCCFFCLGTGLEAWWPLWEAQAARPLEARKLETSLANMEKLRVY

SEQ ID NO: 938594 - protein, 127 aa, Homo sapiens
EHKYPSSLTLEHKYPSSLTWEHKYPSSLTLEHKYPSCLTLEHKYASSLTLEHKYPSSLTLEHKYPSSLTLEHKYPSSLTLEHKYPSSLTLEHKYPSSSPLGFDSFEVRVLDCIPKLCSRVKLWYPQW

SEQ ID NO: 938595 - protein, 82 aa, Homo sapiens
GKSEFWRFPQKCTKLPYAREMKNLLPPQRLLGREGKGPPMLPKGPPSGLLPCFALNIAQEFKVDTPVLSIGIPQRNFGEIVV

SEQ ID NO: 938596 - protein, 39 aa, Homo sapiens
MLGQARLDLLTSGDPPTSASQSSGITGMSTTPGEVDAAG

SEQ ID NO: 938597 - protein, 125 aa, Homo sapiens
YYYKINGRSTPATDLGNIHAPLVHPQRFADVDPIINVLVQQQLNPFATQAHGLLPGRHPDKLAGRKDGVIRHVHAKSVTEADDVLGGLVIEADKTLELVGGLADKLGCDRHGKPRFRATRLSRRG

SEQ ID NO: 938598 - protein, 110 aa, Homo sapiens
DRMGLTLSPRLEYSGTTSAHSNLPVPTSSDSPVSASRVAGSTGTCHHTRLIFLCLVQMAFHHVGQAGHELLTSSDPPTSAFQSAGITGMSCARPASCQVKRHASSQLPMP

SEQ ID NO: 938599 - protein, 134 aa, Homo sapiens
DVKSVLDQVTDDILIGIQTEINEKLQIQEEAFNARIENSTTAYGLGTRRVMLTFTETHKTSQNNRLSGASCLHHLVVQGKPSSTFYLPTHFDKSWSPLRHLPSHTTPSLYCTNSNANISASTSLKNHISKSNYT

SEQ ID NO: 938600 - protein, 69 aa, Homo sapiens
LLLLNSRAVDVERTHDLCVEEDQKVKYGQGAVAHAFNPRGRGWWITGGQEFETSLGKMAKSCLHYKYKN

SEQ ID NO: 938601 - protein, 136 aa, Homo sapiens
MQAGSRRPASPGLLPLSLCGMESLTRGLGGEYPGLKGPKVRMLFDLLKHLVPCLMGGSNEIPETYIGIYQWVKSSFISWLKPGLLRVRQRAQARALFLPHLVDPQMWREVGNATVFIQTAFPFALRAQNLPFKPRP

SEQ ID NO: 938602 - protein, 50 aa, Homo sapiens
MFHIALFNFPQNIADLRLSNSKSCSGIGCNSLDVAGRAKRRREPHQQQTQ

SEQ ID NO: 938603 - protein, 80 aa, Homo sapiens
QVTPEFRTVGVVAAASTRHAHPPHNATAASWSRASGGTLAGSGAPGRADGQPRRPGLLRKSPDFCAGPRLDSAGTVGRLC

SEQ ID NO: 938604 - protein, 122 aa, Homo sapiens
SQTPAALDGDGSMKPLFSLPGNRDSNPALLYPTCDLGQSVDPLHASAFSPVKRVTLDLSSLVSSNPLVSLVSGEASQTLLEDSRGQSSMGLFCLWIVMSWGFPSSQPKKIMEQYVMNGGMGG

SEQ ID NO: 938605 - protein, 78 aa, Homo sapiens
FTDPDGRVGPELGQVRQVSMLGGGLRTGYVKKLQRRDKTFYYYNKRRECDDKEVHKVKMLVLYERVFVVLLVNYMLSI

SEQ ID NO: 938606 - protein, 174 aa, Homo sapiens
AHPQLNSELEHSSSQYMPLCREQQPSTQPLHPFPHHCKNLSRLAGTHQGRPFLPGPCTPTPTRRRFLPMKWMITQCRDNNHQRTLMPEQLSHKLPEAFHNQGPATQSKPDLHKMAAGQPCPGPLPLVVDSPRGAPGPLPHETVSATPTLKTTCGSRMYSFVSVAGLVRKMPQHI

SEQ ID NO: 938607 - protein, 88 aa, Homo sapiens
TRPQRGRARSVRTPSLRLLPFSSPFSLVQLLEKPCAFVQRGNKPFDVVQGAVENLGLLLYFLSKHGPGLLLRFQRGKTWLVEVHCGPT

SEQ ID NO: 938608 - protein, 112 aa, Homo sapiens
ASHLTATHSRIWICGESFLRRQHAVVTWNCKAIFLEAAALPQNNDGRPSGSWVLSGSSWVAEEMKTGCERNGFKLPEEQLQGKAAGIGLLSSLSRSAFSSVMSVGMLVAHHL

SEQ ID NO: 938609 - protein, 49 aa, Homo sapiens
MAEEGIDAGGVLPVTPALQEVLKTALIHDGLSTWKSRTFPKPLKKPNPS

SEQ ID NO: 938610 - protein, 48 aa, Homo sapiens
NVGEGAVFWRQRFPPPANPEAAFPSFGFELPPRERWEGALAMGEGPRG

SEQ ID NO: 938611 - protein, 143 aa, Homo sapiens
STPVIVGPTEEIRAPHAAIGKSPCWLGSTSSGAKKSQTPTHSHSSCGGLWFNLTAQDYVIQFAQGDVRLCLSASGPWTYVASSTCVDPRRRFLGGVCDLFDRGDMKSGARVGLARARPPERTWEAGDTQAQYTRVPPKVMHAH

SEQ ID NO: 938612 - protein, 130 aa, Homo sapiens
SYALVLWAMQSGSIAEAAALRRVSVILVVLFGMRYLKEPFGRPRSIACGLVLIGMFVMKLYPSDRTKKGMGYDSRFLVCVDRYFSAVSVHGRGQVQRWQVRARQNHDPRAFLENLEGFAKRAHSAQLNSF

SEQ ID NO: 938613 - protein, 61 aa, Homo sapiens
SWGVKILHIDDIRYYIEQKKKELYLLKKSSTSVRDGKPCSPFDVDKPSSMQKQTQVKLRIQ

SEQ ID NO: 938614 - protein, 101 aa, Homo sapiens
FFVRQSFALVAQAGVQWHDLGSSQLPPPRFKQFSCLSLRSRWDDSHAPPRLANFVFLVEMGFLHVRQTRLELPTSGDLPASASQSAGITGMSTTPGRKSIF

SEQ ID NO: 938615 - protein, 58 aa, Homo sapiens
DQTLDRHTGTQKTLMATPSLLIPRLQQAGFSGSCFCLWTQCTDIVAKAKASLARCTSL

SEQ ID NO: 938616 - protein, 53 aa, Homo sapiens
GPESCGFDAGVGATQAARSRSPVQRVPSSGPKSRSRPPRPTPRNWLGSAPRWL

SEQ ID NO: 938617 - protein, 30 aa, Homo sapiens
SFGLSRMQDSGDHIILFFILIEMKRESFLI

SEQ ID NO: 938618 - protein, 87 aa, Homo sapiens
QLFGIVDRVEFCRRNADAVQETLLLTLVLRDFEGSGRRMDRNAPGQHLGRSDRDVLEFVGHDVGGGGEFGKRRGIVIGGDDTAGWRP

SEQ ID NO: 938619 - protein, 239 aa, Homo sapiens
SGFDGLNRVTKGGTMGVTSIFSRLNLTICRVNRDSLNLFRCRLAISITKLLVSATLSQSPHQLMGYQNVEKSVQNEYKVLLRDRASANLVSLSNQQRELLATAPWSGQTSSSLDHIVSDIVNQTGPDSGLNLQNNMADSGKLGPFGRSQHVIAEQYHTVLKLQGQVFCQKAALVPTRINQQPITNEPTRDRNHVLSRMLRSPNTNLPKLQQTAAPYARILSLIGVPHLAPILGLFGKKY

SEQ ID NO: 938620 - protein, 45 aa, Homo sapiens
DNRADLLLGSSLAASAELTCGYGDARIDAGRSPRTRRPPGPENNA

SEQ ID NO: 938621 - protein, 30 aa, Homo sapiens
LLLLNSRHVDGRCWCWQKVSWRLDHSRRAK

SEQ ID NO: 938622 - protein, 90 aa, Homo sapiens
TIIARRGKFSVWIGGSNLASMSTFQQMWITKQEYEEAGHFHRYTANASRHNPHPASDFSRRRIFSMGGKLSSRHPAITIFETTSVADIVN

SEQ ID NO: 938623 - protein, 111 aa, Homo sapiens
GRDYYYYYSKFAGRDPRQDAYSSELREEACFPSLPATSSRAKQSPPAAQHFHQNNFFTDCSSRGDHHLTTHQVQDRIFQLHPSCFPMFADRWACLQEPKSPQPECNLPDPC

SEQ ID NO: 938624 - protein, 100 aa, Homo sapiens
RRRFSLAEGEGEFEIACEFDDLPAALVLDENAQTSLAHEFLLNAQGSLEIVKTFKATTGKLDRTAIRCLHPTSDKLSKLLSLKITDLKKLGEQEGISDRV

SEQ ID NO: 938625 - protein, 34 aa, Homo sapiens
RCVPSRMRKESRSNVDEYEPEKVLEAKKKKKKVD

SEQ ID NO: 938626 - protein, 40 aa, Homo sapiens
LPQKGATVNLSSGSQPQWLFETWPILLARLDEANADPLAS

SEQ ID NO: 938627 - protein, 63 aa, Homo sapiens
MWRWSRNLLISTDPPTSASQSARTTSVISHCAQPQNYLLIKKIGQAHVHACNLSTLGGRGGQI

SEQ ID NO: 938628 - protein, 103 aa, Homo sapiens
MDRVPGSGVTEPTEAALRKMVGHRGFWLTLSLEDLTNTRKTTMTKSTIALTELVEKGADADLLKQMIQFVAQRMMELDVEGLCDAGFDVKSPDRVNSRNATGI

SEQ ID NO: 938629 - protein, 108 aa, Homo sapiens
ILRRSDVFTQLGEDLTVQATGSFFADGLQAQADLAVGRISLIKPFSSLPPAELEHFVLVNQPPMLVVDDRLEAHVGGFGQGRLPGRALYWRSLVQVAIQAARGGDTVD

SEQ ID NO: 938630 - protein, 86 aa, Homo sapiens
MLGSSTVNLIENQVMGSDIGGGHRRSIGLVHDLHIRPPERQDHLADAARRSPGPGRGAADSKKTHSRLKNSTLGQQVSRQVQRRQA

SEQ ID NO: 938631 - protein, 118 aa, Homo sapiens
MPRSPRRCRSGCSACCTRCTGGIPKPASDPCSPGTSGTPVTEVGEGDDALAPDPEHFVEDLVRVVHGMQGLGHDHDIEAVAGKVAEALVQVLLDDVDALGHAGRVLRVVFQAVAVEST

SEQ ID NO: 938632 - protein, 35 aa, Homo sapiens
IFEYKYFSNDMIYDSPVHKPPLSIFTFTSHYSLLS

SEQ ID NO: 938633 - protein, 133 aa, Homo sapiens
ASPMRSCSPDHGQYVESFRPLVNHSRQHQCTQDSMHQKLPGIIGRYPHCCLTNQITGQMPSLTPVLLALRAAEAGALLAASDLRPSLGNIATSPLSQKLTKLAEQGGMHMLLHTAEVGTSPKSESPRLQSTYG

SEQ ID NO: 938634 - protein, 187 aa, Homo sapiens
NIEVLQNLVYLRELYLIHNGIEFIEVLENNIKLTMLDIASNRIKKFENISHLTELQEFWMNDNLLESCSDLDESEGSQELGDSLPVSVTPAEKDPQYWLKVMLALLFRSSDRCQFRQVLSLSWLFMWSLSSEELPSHGFLTHLLLLSLHYIISHKPNGYKGTDDILLRMPYTYFQMPLQLNLATLSK

SEQ ID NO: 938635 - protein, 97 aa, Homo sapiens
GKAHPPELNKFRTSKLSLKFTLADHVHGLLRGSDPFMNLVMQQRVETATSWTPEHYWNAGNPRNSSHHVRSLGTSIHHGCPAEKPMSSLHRARSTLP

SEQ ID NO: 938636 - protein, 98 aa, Homo sapiens
PLGMTQDQAKRLAQNSLDARLVKPYITDRSGEPGNFQLPGFTDLQRPGLIDHTDPVRLQTQLQQRDPQRTAQVLSLFAPIKTIAHDRLRQCLGKNPQR

SEQ ID NO: 938637 - protein, 90 aa, Homo sapiens
TQRQLPAYEWRFDDANPPVHAWASWRVYQQDKALNGVGDMDFLERIFHKLLLNFSWWVNRKDAEGRNLFQGGFLGLDNIALFDRSADLRR

SEQ ID NO: 938638 - protein, 74 aa, Homo sapiens
STITLALAFPQNYESLNSDEIIGMAKSDDVATPPAGKGKLKLILLIVLALFLAIGLSVGATWYFMHSAQSKPAA

SEQ ID NO: 938639 - protein, 120 aa, Homo sapiens
ARRRKACSPQLLRNAHDSATGTRVGLEFGFGSELRFAMDFDFRHKGFVTYRQLARQVVGFALDQTTHEQFDDAVFQGVEADHHQADRHFQGFQGGFEAGFQIAQLVVDVNAQALERTGVD

SEQ ID NO: 938640 - protein, 111 aa, Homo sapiens
GRRSLLFCSDLSLWQSLCPCILGVWPYQLSYPTPSDILNSARLNHKKLQSKVNTPPSSPQPQWALTNVLSVMAFLLFSPQIKALLPPLPIGKMGEKGLGKFLTLPPVIAGR

SEQ ID NO: 938641 - protein, 51 aa, Homo sapiens
GFLLVIFAIEIAAAIWGYSHKDEVIKEVQHALGLLHSPAAAQEAHQHHEGA

SEQ ID NO: 938642 - protein, 92 aa, Homo sapiens
SDNYDAIIVPLLLGREPGSYTTKKYFLQARQRWRSMCHQCVQGSAFIGFHAFAQQQLFSTEWVSGGLLLFDDVQGGVGRIVLVRLTLCQPSA

SEQ ID NO: 938643 - protein, 104 aa, Homo sapiens
SGPYSLLNWRAGSTSTLPDLIPFDSHPLHSLLLHSARFHPIPFHSIPFHFHSIPFHSVPFHSIPYHSIPFHSIPFHSTLVDSIPFHSVRFEGIPFHSMMIAFGR

SEQ ID NO: 938644 - protein, 31 aa, Homo sapiens
RRAKPNFRDVIWLQFGAHIFQANPMASMTFS

SEQ ID NO: 938645 - protein, 121 aa, Homo sapiens
GQQEPRCVPGLTRYSPAVGCTPPSRAPRCYAGRRALAALSVRPCCVLRLSAGLSLPLLTSVCLLLFAVHFAVPRPVLGTGKGWRVLRSEPGLRWLLVALTAPRHWYASPAGCRDRQWTRFV

SEQ ID NO: 938646 - protein, 120 aa, Homo sapiens
NKGSGTGSSTLEPTSLSVAPVTGLCLPLDGHVDALLILQALLLPSLADGSTPALRFVAVGDVGSLPNAPFHTARETANAKEISLTVQILGAIGQREEAKLPPKSSIFLLLMFNKRICSKA

SEQ ID NO: 938647 - protein, 78 aa, Homo sapiens
RLGRLVTHVSKKDLYLAVVQPTAFELTQMQPLDQDIYGREDVGSPKLFYADHPFIFLVRTPKAAPCYSLSPWDQAPPE

SEQ ID NO: 938648 - protein, 84 aa, Homo sapiens
LIPILLKLLKTKIFLEEKGLLPNSFYKGNITLIPKPDRMQQENDRPTSLMNTDAKILNKILTNQVQQYIKKIILGYEEGKNRLT

SEQ ID NO: 938649 - protein, 90 aa, Homo sapiens
TLWNRVEAPPRVVPWNVTLFSLLVAASCLEIVLCGIQLVNATIGVFCGIAGKNRTPLTEAPLTAGYTCSFLDAYLALLTPLLARINCFAL

SEQ ID NO: 938650 - protein, 93 aa, Homo sapiens
PLKKIMEACAGGFSSSVGYPGRQYYFNSSGSSGYQDYYPHAGQITYEEAPRNYDTYTAGLSEEEQLERALQASLWDRGRSLAPFSYFKAYLMW

SEQ ID NO: 938651 - protein, 101 aa, Homo sapiens
TFYVAAGKRACAGTLPFIKLSDLMRLIHYHGNSMGDTAPMIQLSPHCPALDTWGLLQFKVRFGWGHSQNISGLCNLITPSVLLSFNCNILTACGGLDGNPV

SEQ ID NO: 938652 - protein, 135 aa, Homo sapiens
DVTSPPPSPTTFHTSLAHATCEHHAHVFGGRRERCPARARHEAPCVLDATTLTWLQPETPRTPPSPRHGHVMVAAGTQLFIHRRLAGDRFYDDLHCLDISDMKWQKLNPTAGCSSRLCCPLSCGHGKTCVHLWWN

SEQ ID NO: 938653 - protein, 159 aa, Homo sapiens
PYNLIDPPCLSVLAIVVNGQGGCCPSVSAKSLILGQRRPSVATPKRVGVREKADSPAECRKRMRDDIDRRLGQDLAMRCLVFEGFTERRVFQRLHDFLDDAASEIDTARAMKVSSKVTGKTAEIGDEQRQGFLCLADSPERPAAVMSAGSAAWRRSGNL

SEQ ID NO: 938654 - protein, 53 aa, Homo sapiens
MMLYFLVVFLGTRTTYSVTFWLQEPRTAMGNGQWFRSGPNPDSFSLLWRSAST

SEQ ID NO: 938655 - protein, 67 aa, Homo sapiens
SAPSCARKSLPKALVLKLGSLGLRVGGSRRHVGYLQVLEEPGFRRIPELWHPFSVSPSPFPLLVCHG

SEQ ID NO: 938656 - protein, 149 aa, Homo sapiens
LRLCLEERDWLPGKTLFENLWASVYGSRKTLFVLAHTDRVSGLFDRAILLAQQRLLEDRKDVVVLVILPDGQASRLDALTSASAARVSSSGPTSPVVAQLLRPACMALTRDNHHFYNRNFCQGTHGRIAVSRNPARCHLHTHLTYACLI

SEQ ID NO: 938657 - protein, 144 aa, Homo sapiens
RRSDTIDTQDNHLVRTYLSKTQWIMVHMMSLHHLTIPYLRDEELYCNVVELKYTGNANALFILPDQDKMEEVEAMLIPETLKQWRDSLEFREIGELYLPKFSISRDYNLNDILLTLDIEEAFTRQAEPVRDHREPEPRSPPSGP

SEQ ID NO: 938658 - protein, 128 aa, Homo sapiens
LDLGAFAGLVKMMVMQMERRLDQRFALTDKDSERLREEISVERLPDMPVHYVRREDYVRGQTVIEAKLDALALKLETVQLKGIEVMNIDAAKTRRESLRWYIIKTLDASRPVDPHEAVVLSTIQGIYR

SEQ ID NO: 938659 - protein, 69 aa, Homo sapiens
QLEQAQAIDDLMPAQKLKPRPTPDTSPAASGRIVLAVRTMHPCCVPSGEPVSLGVELAVTRGRVYVFEG

SEQ ID NO: 938660 - protein, 73 aa, Homo sapiens
LYPQRMIISRHLRSACSIPFHPQRVIISRQLRSVCSLAFHPQLHAQRMIICKTPPECVCSLPVHQQRMIISRN

SEQ ID NO: 938661 - protein, 113 aa, Homo sapiens
SVALMFRTRCRSTCSTQMRFECLHGLHRHLARAIQVPRELGMLDEVAGGYVTLHHLRGYEVVIFAVLLAGRRVPRGMGHREAKDGGVLLEQPLRQVLFPAREGPLSTISLGPD

SEQ ID NO: 938662 - protein, 89 aa, Homo sapiens
VDGIGACELGQGNSRRQPGEDVHAEQGNAKHQEQLHQQRRALEQLDIGTGDVRGKALVLMRMVITSKPITPPPINATSDTSKVHCKPVS

SEQ ID NO: 938663 - protein, 169 aa, Homo sapiens
AAAYHYSISARSTRTEIPTARIGKQQLPTPMYLQNPNWRSSLRLRGINGVSPKVRQVLQLLRLRQILNGTFVKLNKGSINTLPIVERYIASGSPICTSVNELIYKRGYAKINKHGIRLTDNALPARSLGKHGLICMEDLIHEIHTVRKRFNQPHNFPVGLPIVFYTRRN

SEQ ID NO: 938664 - protein, 165 aa, Homo sapiens
GLLLPNSRPVRQEKKQEVPAGRETLTKKRRNFRRAEALQRLTKKFAQKTLRQARSKLISEKAKHHHKEPRQMYRTQIRMPRIARKAGNFYVPAEPKLAFVLRITGINAVSPQVPPVLQLLRLRQTFNGTFLQLNHASLNMLPLVQTYIASGSPKSDVSKWNYSTS

SEQ ID NO: 938665 - protein, 68 aa, Homo sapiens
SVTSPAAPVCPMCTRPSGGLVATRSKKLHVKCHYSCTRTIASVSSVSRATENRAISAVFRPSYVQKKP

SEQ ID NO: 938666 - protein, 107 aa, Homo sapiens
DGSKYNSTCYLATSQMGDSEHSLKCHTWLLSARSNLLSENVSANCCQAFLVVPRYMNKTSLDWFTESRIQQHPGARLLKTLFYILYIYGTQQCDRRVWLGLNTSSPS

SEQ ID NO: 938667 - protein, 147 aa, Homo sapiens
NIGQSHPLPPGWVLKLAWSPPRFPRGVHTSFLGQRLTHIVESRLGTFPLPTYLPFNSRNPILPRDYAYDHPCNTIMYLSVRVCVCVCSGGRAASPKISAVCAFFFHTFVHTIPCPGTTPWHYRMLGSSGRAYARSPLSFVFDIFIFA

SEQ ID NO: 938668 - protein, 66 aa, Homo sapiens
NTCCLGFIVFAYFLKSSDRKMVGYVTGLQAYVIHLLKCLIIWALILGIFMIILLIIIPVLVVLAQL

SEQ ID NO: 938669 - protein, 61 aa, Homo sapiens
CCCCGPCSHGALGHHHAQVQQLLGDAHVVARQDPGPGVRAVRTPGAHHGAHTRHNPRTDGS

SEQ ID NO: 938670 - protein, 73 aa, Homo sapiens
DKSQISLGSRIFCIGMNWSLLVEIFSRPGAARAPAQHRLRLQLLGGAGGSLFRWLRSSSGPAGQQPGPTAAEP

SEQ ID NO: 938671 - protein, 106 aa, Homo sapiens
KGGGCGEGTCGEADVGGPRPGLPGTPPPPFTQRGPGTPLVAQPSRSDLRAPFQLPLPGRVSGYGSRGGRRPPSAPDLDAGEALSRQAMATRWLLCLYAAHSLLSPR

SEQ ID NO: 938672 - protein, 100 aa, Homo sapiens
IFQDNSILNNTYLYHLLKAGVTNARGTVRSLCKMSTSWKGPGKGLLGSAERELLRLCGSGLAAVPLVAPGINARTRRSMAPSRPRLAAHPRSAAQHACSR

SEQ ID NO: 938673 - protein, 111 aa, Homo sapiens
RGAPPPLGGPRAFFPGAFLNPPGHPLGGGNPPPPPPFLDRGFRGAPPSLPPGAPFWGGEFSVLGGSKRAPPPLVFLAGLLGGGKKRFPLRRFPPPGVFFVGNKKIFFPPPL

SEQ ID NO: 938674 - protein, 38 aa, Homo sapiens
SRDITTLLQSFRIYVVPHTVEYLTWTCWSAAVSPGGDS

SEQ ID NO: 938675 - protein, 106 aa, Homo sapiens
STLQHRDSTHSHRHGDQFSQQAHPPVIGFVPLRAEKRCKHNLPNRVLGLLLEITAHHFKTLKLLKGIQSLGLRALPWAPGTQNSSSSSTGPLSTMGSGASQLAPEV

SEQ ID NO: 938676 - protein, 68 aa, Homo sapiens
TMHVYTYVTNLHVLYTYPKTKSIIKKKFSNVEILSHFSNKPCLLVQNKKRNRKAELTYILEFSDRDSH

SEQ ID NO: 938677 - protein, 110 aa, Homo sapiens
ESLAGWEYIIRAQNPKLPAVHSSLGGLVNLTPRISHPVAQGTSPLLVRFLALDIVASSTCVDPRRRFLGAYVTSSTAGHEDGARVGLARARLRSGPGKARPQAQYPVPPR

SEQ ID NO: 938678 - protein, 73 aa, Homo sapiens
SEKKEYSVAPNVSFKCKWDAVQFIEKKSVQPGAVAMDFFDNYKKQKDKQKKKRKAMAGKGQLEKSGKPPAAPS

SEQ ID NO: 938679 - protein, 141 aa, Homo sapiens
TSHVTQGLLLLCSEIRGHVEDSTCLRALRRKVQLQGSKEVCDQTEGAQMAPRRQLRSKGKMRRIEKYIVTPRRGVEATQASRSTELKTNRRERKVTVELGANRRCQSAEADSEGDHEVPEARMRNEGETAKTRQNRGTREK

SEQ ID NO: 938680 - protein, 61 aa, Homo sapiens
AGEEVACEPLLLAEKTKPRRKFKTAGDESRGGECGIRAKKDLGHCKRETEFWVNAGLLSSR

SEQ ID NO: 938681 - protein, 121 aa, Homo sapiens
NEASLDHSTRGGCVFAPVERQRGGAGWQTSSFQLCFVQRGAEASQWGVAGPAKKMSFYLKVRLIQWVQNQDADIGVDYGTGGVVACWVEMKEKPRSSHELRHVMYFFLVLLGWFFVLSPML

SEQ ID NO: 938682 - protein, 123 aa, Homo sapiens
LIKSLGAENPEELSFVICGLSLLPQERVPEMKSGDIPRPPGLRVSCGDMVGDSAMYGVVSTPEARSVADALLLGTRASGNVPKKILSGGRSCAGCRRCLCRASCGRGVPARHAQEPARHRGGQ

SEQ ID NO: 938683 - protein, 99 aa, Homo sapiens
KSRSESLCPLTCKTVHIHLFSELLYHKYECRLDLEHVTLRLSPGSARGSVPSRLVGALVLKQRPRCPSGRGAAYCGLLKYKGSTARVKHEPAAAVATQG

SEQ ID NO: 938684 - protein, 108 aa, Homo sapiens
SLGGPLIPSGVWVHPWGVCRCDGTRRSPRLKPGPCAAGLPSGCVDSGPSQQSPALGPRQPRAPAGEGYWERLGVGEVVSGIVSPLWTNVYVRSQFVWLSKNKNIFRRK

SEQ ID NO: 938685 - protein, 87 aa, Homo sapiens
GQTYQRTVGLVGHYGTAMAPPSGKWRRKLEITQHAKYTSSFCGNTKMNRRAVGIRHCRLLHEDSAWRRWTYNTTSALTVTSKQLKDQ

SEQ ID NO: 938686 - protein, 94 aa, Homo sapiens
STSSRIHADDSCAPPTQDRINMLKPMPNTQRQSTQRRLHSAATNGSAINCGTPMISITGAVCSGRSLLPEPGSWRNDGHRQQHDQHAGEHNQRE

SEQ ID NO: 938687 - protein, 143 aa, Homo sapiens
NRGWRPWLFLLSEMRFPAKLLAMLFCIPKAFEDRLGAHRGGRCGASLRTHSSYGQHHLGYLLSLGVLSCLGFVVLKLLTISSHGGVSSSASQATSGPRFGTAPVSLCVFVSDAFQQSPKISFLLREERLKPGEKLAETVDPPH

SEQ ID NO: 938688 - protein, 71 aa, Homo sapiens
RRTTFGGPSEKAMRREPGSPGRTAGLWGVPPKKKPSGPRKVTVFQRERIDYPVGAHKNSTSESSTSDPEVT

SEQ ID NO: 938689 - protein, 101 aa, Homo sapiens
CRSSCSRSTLPAWRGFLSTEAVSPGGLHMRIWLWPCSREAEGAAVSFSQEVVLGARSGPGEAVEHWAVRSGSWGQRKGACPGNAGWPFREVVQGFCSWCRS

SEQ ID NO: 938690 - protein, 66 aa, Homo sapiens
MRDEVQSYHEGQLSTRAAISRAWGGATDPIDQVGRVTAGLARKVRSPDATKPAQGGSGFALFGRGN

SEQ ID NO: 938691 - protein, 103 aa, Homo sapiens
MGGALSPPLQYHGHGLFSGRPPPPPPIFCGNFGGPGAQAPHNPGAPGAPGPGGLVGLRGPGIRAPVGPGLWGPPGDHLLTPRLTFLSWKAFTRFYIGKWMGLE

SEQ ID NO: 938692 - protein, 105 aa, Homo sapiens
KKHLPFNRFDVNTSAIQVIIEHIGNLDRAYEFAERYNEPAVWSQIATAQLQKGIVKEAIDSYITADDPSSYMEVVQAANTSGNQEELVKYLQIDRKKARESYVGD

SEQ ID NO: 938693 - protein, 45 aa, Homo sapiens
DCQTMTYSTREEAVALPLPGASVDGVSLLALMGVPPVRPSARSLC

SEQ ID NO: 938694 - protein, 89 aa, Homo sapiens
LPFFCTLAANVVLNRFKVFPMLVLLLEEVFCSSVLHDFHCRWTFVLSSVLSPDDPKFREDERCSLQVQQGNLRYISMTMILHLQLLALR

SEQ ID NO: 938695 - protein, 76 aa, Homo sapiens
NYLKVLSEHGFCPITSDIRYGQTFYYAEDYHHQYLSKNLYGYCGLGGTGLSCPVGIKKYFLRSWWAFDVSVKMLSS

SEQ ID NO: 938696 - protein, 63 aa, Homo sapiens
VPCEKAAFDVLLSLCEAVRCCFHGCCGGVTAYPDRSFLEDLDNASGIYASELELAPVRTSPYS

SEQ ID NO: 938697 - protein, 54 aa, Homo sapiens
LNEMWKCQNMLRSHVRELLDLHKQPTSEANCSAMFGKLMTIAKNLPDPGKAQDF

SEQ ID NO: 938698 - protein, 147 aa, Homo sapiens
APEFCQKYMEQASAQTAFISVCGYTPYHVTRYPKHVVLCWLQRLHTTAPAFGKPQGTVARLHTGQVIMSIRTKLQHQEHLIVALRTGQVQLSRPPEDPHLKELGLHQVQCSLTFEDTVADNRLIPDGCGVKHIPTRAPLDKCRALHP

SEQ ID NO: 938699 - protein, 96 aa, Homo sapiens
SSLSSQNYSKPADVTPLKDFSEGPKTDATDGTDYTCLSLYDILTLFHGARPIQQICSSDAYCSEVKATTLGEPQGVDHLRPGARDQPGHHGESRLH

SEQ ID NO: 938700 - protein, 130 aa, Homo sapiens
LILANNIDTVRLLNAVRCNLKLILYLSQHRRNQGSLKDYYGSHCDFGLHTSRPAWTLSVDLNNHIWCPHRPYLGIHLIPTYAYFAHIPRRPSLQKYQFRFEALLAATAETQITIEHIFWTKAHPSVAENY

SEQ ID NO: 938701 - protein, 92 aa, Homo sapiens
SPLLDLDLFNFDCQRRRGPLRLTEPRSLRAWRLCVKPVELLHGRGRPGARGSGRSMRVATACRRPTRRERRAKLQQCRAERVRIMREENARL

SEQ ID NO: 938702 - protein, 87 aa, Homo sapiens
VVPICAGLRHECLPGRAEGDAACALLKSGVVRVRVEFRKLDPRYGVGVVHTHRSPRRLDLHATAAFCCWRPPQGRGLALLAGRFGLL

SEQ ID NO: 938703 - protein, 88 aa, Homo sapiens
MEAQNQPVPAIPDSPRPSHSFSASEPLRVLLSFRTTELLSLHFYCLQLLESSQSGCLFSQGPGPSCPLVLSNQLSEHFNLVNKNLLTL

SEQ ID NO: 938704 - protein, 128 aa, Homo sapiens
NPAAPLPRPLVTAKGSLTDSFPDLPQLAAEDWCCLIALEAPWTITDAALWITLTVEVPPGLIAITSKDSQLYEDTLAGRSVLIKNLTPQTLQPRWTGPYLVIYSTPTAVRLQDPAHWVHRSRIKLCPS

SEQ ID NO: 938705 - protein, 81 aa, Homo sapiens
NHHFTGYKHPAAESVLECADGLTRHWYHPLSPPGAGAACRSALCGHSRTVTAATPWRCVGRQAALISPLLQYSSLLLRGGE

SEQ ID NO: 938706 - protein, 85 aa, Homo sapiens
VGNGSGFSTPTTLTSCTVWGLPGLSNTHLCGWELGSATSLQLLRDTAILYAKRDGGSMFPANGGAINLYRKLTFAITPLYNRFTL

SEQ ID NO: 938707 - protein, 115 aa, Homo sapiens
VWGGPFFFPLGANRGGPKKTHPGFFGGPGGKQGVFWAPEKKQGGPKGRFWGGGFCIGKKALGGPPGSPRFGEPLGGGPPGKRPPFSGFQRPFYRFRERRVFWKVPRGGKKMVPPL

SEQ ID NO: 938708 - protein, 134 aa, Homo sapiens
MLSTLRALSATEAVGVSGADRGLLGTVGAEMLVEQERGGSGGFSILTIMRHTGNTVGPGLQLTLYRKKQGQQHKALVGLSIQADELTKGMEAAHRHTLRGMHSQEIISIRQNAIRVNMLLIHGPEREATRRIAI

SEQ ID NO: 938709 - protein, 120 aa, Homo sapiens
GFLELCPVPSTCPEFGPGAPHPAEGATPGFLETQEALGLQQSHSAAEVGLGVPQRQLFYGGSAQHISGQAEKEAEAATYLLRPAKTARSHKGLTSYQEDPTPEDNRSDRRKQTMLSSTEN

SEQ ID NO: 938710 - protein, 104 aa, Homo sapiens
MDCTRPGLWGEMSDCLRCMRVNWPRILLLRLWKTAALEFAVSTPGLAPKMLVLRSRFPLSQKKGLQEGRGGCFGGEGIARWFSFCSQWYLQETLSAGGVRELSG

SEQ ID NO: 938711 - protein, 62 aa, Homo sapiens
MVVCEAVVDLSEVVSGRSFLFWCSMNESRSLRVLVQERCIRGRGLPHSPLLFSRFRWRWRKS

SEQ ID NO: 938712 - protein, 82 aa, Homo sapiens
MRKQLMIPALLALSVGLAACSSQPNANLEQARTNFSGLQANPQASKVAALETKDASDYLDKTNKAYQDHEKVETVDQLAYRR

SEQ ID NO: 938713 - protein, 66 aa, Homo sapiens
MTLAQVTRMNCEINEVIMAKKPNYNTTTKESDYKMDKEHLTKDAEDDIQIANRYMGYMRRYVASPV

SEQ ID NO: 938714 - protein, 39 aa, Homo sapiens
MHRILYHPPKSLDQITSFNTQSHLYRVPKAYTTNVRITQ

SEQ ID NO: 938715 - protein, 103 aa, Homo sapiens
HAKRKPSPFMSDRPDRIELLCFRKHVHLARSPAICCPAQNVAPGPTPLSPALLGFPFTTCYLISSQNLLLVSALDIPAFPQVCKTPHCMRYQLLSSGKLTDSS

SEQ ID NO: 938716 - protein, 77 aa, Homo sapiens
AQTARSPGREEGEARPDLAPVQDMKDPFMVAEAWVAAEPPGGGGASLKAFVPEVSLPRTSSPHTPTLTPLLGSMVPL

SEQ ID NO: 938717 - protein, 123 aa, Homo sapiens
VLPTSRRMARPRQTFFALTNGGFSCPARCAWPGPGSKQGGLQQAGAASRPGVAGRALGHLCPAPKSPPLHDLEPAPHRLCTSVSWSAPRGQERTPSRSVPGLTAQLARRLECAWRNDCVAPVE

SEQ ID NO: 938718 - protein, 31 aa, Homo sapiens
MFTWVHGPQWLLPQKGAPHTRVDDFSHGRKS

SEQ ID NO: 938719 - protein, 123 aa, Homo sapiens
TPRNFSWGGPAGTPRREPFLKPVLRELPSPIPVIFAKATPVDRQETKQTYECPVYRTKLRGPSYIWTFRLKSEEKTATSRPGFKKSSCLRLPSSLDYRCPPPRPANFCILRRDGVSPCRSGWS

SEQ ID NO: 938720 - protein, 138 aa, Homo sapiens
ALLLSRTLAAELTKMHHNQWPARGSIATPSIPHNREALSISIASDDHGVKGFIFERRLYMALVSHEMNSSRTIAVSISQKLLINHHLAENLLQILEISVVRRGTQHGTVVTRIMREIFGKPAKEPLDPSMFAANTNPP

SEQ ID NO: 938721 - protein, 62 aa, Homo sapiens
MVTIGKREKHQRSHHPILPDWQLAPHLQAHPGPKVGPYWGPTLFCPGISLPPDAICDPQLTP

SEQ ID NO: 938722 - protein, 106 aa, Homo sapiens
HAEVRAPVDGIVGLHDLQVGEYINVGQRRCLLVATSPIWVEANFKETELEKMKVAQPATIEVDSYPGVKWKAHVASIAPASGAEFSVVPPQTPTGNWVKIVHGIPV

SEQ ID NO: 938723 - protein, 108 aa, Homo sapiens
DGVCAAFLPEFLTSCDGVDANQKSVLGRNFKMDRDLRLITQNVHRLVDDLRYYRVCNDSLPPGTVSSSLLCLGTRTSLLHRRRLPATADVSQMGLGHTRWVLPPQATL

SEQ ID NO: 938724 - protein, 54 aa, Homo sapiens
TCDELLLGHEKEPAFRDYVAVARGNKDHSIRAQEPESGLSEETQVKCLRDQATD

SEQ ID NO: 938725 - protein, 37 aa, Homo sapiens
MPRSWVSVLGVFGQLTLCPRNGRVTGKWRGSHVVGLL

SEQ ID NO: 938726 - protein, 55 aa, Homo sapiens
MAGASRSGPLAPVAEEKEEAREKIMAAKRADGGAGSEGLGRDPAGEHHATQEAWR

SEQ ID NO: 938727 - protein, 61 aa, Homo sapiens
QKETNHLENDFKGDGMTELELRAQHRLQPIRRHPKELPQYGGPERTILKINYIFQCIPMEF

SEQ ID NO: 938728 - protein, 103 aa, Homo sapiens
MTGAPQRKPAQWLGSPSCRPEVYIVFPAILTTQPEPAQPRLPEVPVARTVARAVLAFFLSFFTHLGTPGWLGLGYVGGGGGGSWGPLHSRPCLPDGWPRAASL

SEQ ID NO: 938729 - protein, 99 aa, Homo sapiens
WETEARSVGQAGVAGEDLGSRRGLPPGLTPCSCRSVAGSRDHRCLRTMPGYCCLYFVVEMGFHRVSQDGLDLLTSCSARLGLPKRWDYRRDSRARPTDS

SEQ ID NO: 938730 - protein, 123 aa, Homo sapiens
KCEVTLQVPELIEDPIQKEGTLWERLQGLGLNPEASTPWRRGWTPGAGIGAELWSQGLYCSAGRVRPERLRQLRERKPPFWLIVKHRLSRPTLSCPQGQQMKTQPERTNRPPQLSVRGQSNTE

SEQ ID NO: 938731 - protein, 84 aa, Homo sapiens
QLSHANRQRETLKHLRSVQGRLKDTQLHLDDALRVREDLKEQLAIVERRANLLQAEVEELRATLEQTERARKLAEQELLDSNRG

SEQ ID NO: 938732 - protein, 142 aa, Homo sapiens
MSYRQCSKGSGLECDQRVCRTNAPGRGLDGNNQALSPRASGRQKKLDRKRSRFNWLCCRPWQIVTEDKALKRNETILIKGLMAHTIQEISSATNSQQLIQRSFMNNRQLNKKMSLYCSKERRMPLFSLEQGRWGLTKDSLLD

SEQ ID NO: 938733 - protein, 104 aa, Homo sapiens
MRPVLRPLSRLDRKHGSIYSASEGPQETYNQGGRRQGKQTCFMWLEEEEEKWGEVPTLKQPGLLRTPSQQHHEDGAKPFMKDPPPQSSHLPPGSTSNTGGYNLK

SEQ ID NO: 938734 - protein, 101 aa, Homo sapiens
ATTAGSCHLRSSGSTWTRRAPSHPAALQVPYTREGPREPQPPAGPQGFAGSFCAEGSRRGAEVGWAPLEPQGTRRTGSLGVDSSPLSETLGPAQCGSGRRR

SEQ ID NO: 938735 - protein, 37 aa, Homo sapiens
QGLHVDPPAAQGPRPDPGAVDDVQAKDVRTPFLLEAR

SEQ ID NO: 938736 - protein, 87 aa, Homo sapiens
MATDQKTGRTRKRQRKPKPPKGQERNRHNQNPNTTEGPRHPQHPWPSQSDETIPPPKNGAQPWAPVRGRGRMSPSSCVCEIVQDVLK

SEQ ID NO: 938737 - protein, 33 aa, Homo sapiens
MAPRNEARGSLDSARHRRRAGDSPSSSPGSGGG

SEQ ID NO: 938738 - protein, 147 aa, Homo sapiens
PPTYCALAAPRPQPPPPPLPPRRRPPPFFSLLSPRRTPSPGPPPNQHPPPFFINPFLAAGPFKKRQTPPFPTFPQVPKGGRGTPGLELLFFKNPAPVFPGNGGANFWDPPLFLCMFVKRALLKHGNVLVCTDLDKWVLIKIPFAPRV

SEQ ID NO: 938739 - protein, 101 aa, Homo sapiens
QNEHEKWSIIIFTNNGKTSKILCMTAQIQLPHRGLHSMMKQKEQFAALAKFKSSIYRILIATDVASRGLDTPTVQVVINHNTPGLPKIYIHRVRGRPVQQR

SEQ ID NO: 938740 - protein, 129 aa, Homo sapiens
GKLICIRSLQPELPPSVPVRLVGLWVNLRFPNGQGCDNLWGRDKGMGLGVCVVAAREVPVVGGDDRAPPPLLDVLPVPLPTAGATRIGQDNATQIPQDLCIAVPLNGGPHLLGTWSDGELGLALAAWAS

SEQ ID NO: 938741 - protein, 44 aa, Homo sapiens
GVALEVLEQKLVPAELRCTPLAIGLGPIFHEKCFGRGGAGAFAL

SEQ ID NO: 938742 - protein, 86 aa, Homo sapiens
RRGLVLMGLTGEVWLLPTRRPEESPGEGCLGCARGAFSAGKEGAPTRLDAPEEGALVPSGIQAPLRLSRGLPPPTPPEVVKRVYEA

SEQ ID NO: 938743 - protein, 31 aa, Homo sapiens
MAYFMSWANRFHITSALILPTFSSWGNWLRQ

SEQ ID NO: 938744 - protein, 96 aa, Homo sapiens
RPHELLESQMEEGPWSLARSPGPSGAQGGGEGPGVDLPAPAATMSGPLVLPSSGVTQPSDKAASHMGAARTWGSSLYEEDDLQVNSYKNSLSHTRS

SEQ ID NO: 938745 - protein, 166 aa, Homo sapiens
AIPGMNNITVILRNPELALDAIERLQRWWEENQAFETNSRFIEIPVVYGGAGGPDLAVVAAHCGLSEKQVVELHSSVEYVVWFLGFQPGFPYLGSLPEQLHHPSVLNRAYSFRQVLSGSAGRRLVFILLATPGGWQLIGHTSLSLFDPARDEPILLRPGDSVRFVP

SEQ ID NO: 938746 - protein, 113 aa, Homo sapiens
RSQSLPILTEPSLDPFTAPFLWTTLHHLLPGPCENFLPSCLYPSPCSALADDSSGFQNPLMIPSIDQSLPYSFKFLGDPGPAAFCILPTDAIVLASGLICPVSFLCVTGSFYP

SEQ ID NO: 938747 - protein, 95 aa, Homo sapiens
SQLKKTREIAKKTPLASYELIRSPQSSTTSAEQPQASSLSNPEKYTDELATQPRRLLNTLRELNPMYEGYLQHDAQEVLQCILGNIQETCQLLKK

SEQ ID NO: 938748 - protein, 67 aa, Homo sapiens
PGKSQLQFSSAIFARKHLELRKSLHVGNININLLFSFCTTSLFNMQYMLDFTQSDRYLQSTRHVCAR

SEQ ID NO: 938749 - protein, 89 aa, Homo sapiens
QQSMNRAENNFCATDPHLSCLPTVTDQRPVPCPPQVTLRPLSSPPTGNSKSAVPATGDSHDAPVPLTSDSEAAPVSPLGDSEAPPYTYG

SEQ ID NO: 938750 - protein, 74 aa, Homo sapiens
MRYVPSPCSATVLPLSSRLVNEQPCSWVCLVSSCFLPEFSPRGQLLLLSFIMILTFWVQQGGWERWSHVPYNLS

SEQ ID NO: 938751 - protein, 121 aa, Homo sapiens
EKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKKK

SEQ ID NO: 938752 - protein, 57 aa, Homo sapiens
MRRILTSSRLLPHGSDDPEKLSRRSHDLPTLLTEPGPRLPPMCPIRPSAIKAYLSLF

SEQ ID NO: 938753 - protein, 71 aa, Homo sapiens
VKVQDSKLPPYKDLGKNLPFPTYFPDGDDGELPEDLYDENVCQPGAPSNTFAYHLWTWQNLTYSVSFDEPE

SEQ ID NO: 938754 - protein, 93 aa, Homo sapiens
GETQSTRAAREERKTSALKDSRGPHAPSADIILKRCSESTKRKLRLPSEVGAQSPASVSPLPPRACIYVFYKSLRLDAEGSPDPCPSASRHPQ

SEQ ID NO: 938755 - protein, 89 aa, Homo sapiens
WEFFSLKLLSGCALLAHTCNPRTSQAAPGRLLDPQSSRPASAIYWTPSLHKIKPLSQVRSPEPVVPATWEARGDRSLDPSQASSLQSAD

SEQ ID NO: 938756 - protein, 51 aa, Homo sapiens
MRTASQMPLNDRHGSGARLEKIPTKPQTQRNHRAFGNKETRPQRANSKGRS

SEQ ID NO: 938757 - protein, 107 aa, Homo sapiens
LKETVRQALQETLLREVVRKILLLQSWFRMVLERRHFYSIFFLSLRTPEYGGQRFAYPNDQEHQRIAWQGEDPRSLLQSLSRLQKPRAFILKSKVIKQKQIIPKVKK

SEQ ID NO: 938758 - protein, 75 aa, Homo sapiens
EHGAGHQPPVREDREHRRRRPPEEAGGRGSRRTRRPGAGSLLSRMPPRWGAPTRAVAAAAPARRAGLSFRSAART

SEQ ID NO: 938759 - protein, 39 aa, Homo sapiens
ELIPLMEVTGVLEGRAKQLYSAGYKSLMHLANANPEVLV

SEQ ID NO: 938760 - protein, 157 aa, Homo sapiens
PRFVPKRRVRPAAVSPGRSSGWPEFHKKGARTIGFFLDPRGRNNSPGSLQAHVQRLKEYPSKLLLFPREPPAPQEGDSFAGELKLAPQVAGRSCPSGTFLRRGKLGSSLGEGRISKPSLVSVWPVPTPGSSAFGQKGPREPPNRVLKRKNKAPLGAW

SEQ ID NO: 938761 - protein, 95 aa, Homo sapiens
RRLQLNANQAFFLWVSGHSMVGVSAPMAEVWEMRGEDGFLYMVYGLPGDVRDEIGGVKAEGSASLWELFKRVTKEGKGVWGTEIEEVIRSESRKQ

SEQ ID NO: 938762 - protein, 116 aa, Homo sapiens
PGFASVPLRAIVILELQWALAPFFLSFRIRAYKGLSFLSISAENFLLRPKAKGTENGIPSSFPRPLGIQANPLKSTILGSSYPNRALLNTFLHFSTQHPGSQGILRGRTCLVGAWE

SEQ ID NO: 938763 - protein, 133 aa, Homo sapiens
MGLQEMAGQLQLATHQGLHFIDQHRRGFIARVTNVEWLLDALYGKVLTDEQYQAVAPSPPPKQDAEALQFHTSLELDLQGIASSGTKGVPILTFEELGTDLSFFPRKIRVNPCKSHQIILNLIFLYTIYEKPA

SEQ ID NO: 938764 - protein, 111 aa, Homo sapiens
EVGGPCTRALATLKLLSIPLVSLDIPSGWDAETGSDSEDGLRPDVLVSLRAQLRGRFSGTLTFVAGRFVPDDVRRKIPLRCRDTRAPLRRGTVTATGGHTSGTLANKQPSV

SEQ ID NO: 938765 - protein, 32 aa, Homo sapiens
AFATACGRSLQPAGPQLMPEDALDTGLQPLPT

SEQ ID NO: 938766 - protein, 132 aa, Homo sapiens
MAPYSTLGRGVPTLLRSHLQHFYTVGNYVKTNGVAKHTIHHCASGQLQVHTCSDNSIQERRFAWEGLNGPALFVNHNLYQLETQCPTNTNSACLSKQHSGHLQQLTQILTGRWGKALPCVKLLLKYIPSEKG

SEQ ID NO: 938767 - protein, 135 aa, Homo sapiens
HLLRASVLSEFPRPSPRFSCRPFLSYVSILYQMILVLGPAGAIGLLYILSNVSGLGWEGSSRCLCNNVSRGSCCHSPIPEAAQSLCPKSGTLGLGHLFLFVPHFLSTLSAHESCPCICLGKHGINESTILVLKKK

SEQ ID NO: 938768 - protein, 98 aa, Homo sapiens
GRQRRIDHKLVGHHDGRCRPVGMHLVGHFGHAAVLGHQLPEVFDLGDTDITFLFRQVGRHFLERAGQAAVSALGGGDLQDRVTIGDRERCLELGVGPA

SEQ ID NO: 938769 - protein, 104 aa, Homo sapiens
MSKREHKPSRSRLAVESPATARLRNDAAHELPCHKAQQRFMTRSTRAQEIRSTLHPLSHHGYAARHEPVSLEALSTLRIRCRVLPYWHPQIDQRRQFARTSQLR

SEQ ID NO: 938770 - protein, 68 aa, Homo sapiens
NLPCRPITWHEGVSEMQYSIYISLGGWVFTMLIGSLIPGAGVVEILVVSLVLLICAESPTKVSKVTPT

SEQ ID NO: 938771 - protein, 104 aa, Homo sapiens
MENISQFFTSISMSSQSKRFRNHGKDRIMKEIIEENFLSCRNVMNFQIERAHLVTKMHGKRSTILALLRTSDSQNYCQRERNNTDTPITKFLAARLECLKHVDQ

SEQ ID NO: 938772 - protein, 97 aa, Homo sapiens
RVLARLLIPPAPSVPLLWSSFFAQRRQCSLSARFSRSISSVRPSSSSSFCQQPPRFSCTARDAWVPKSFYRLRRLRALRVQDSSRGPHFTVLCLQTP

SEQ ID NO: 938773 - protein, 69 aa, Homo sapiens
MNHDIPLKYFDIADEYASRMRRACRRGERTPLAHYFQLLLTRLMNNEEISEEAQHEMAAEAGINPVRID

SEQ ID NO: 938774 - protein, 42 aa, Homo sapiens
FQRVHITAPSRSCKGFLGVPGLNPLPVRIFHPKTRVIFRKLH

SEQ ID NO: 938775 - protein, 67 aa, Homo sapiens
LTLVGDKEQLTQHTGFFCSQNGILQCTKSKKALDVTLVSPLFLLNIGTRNFCLITFLHSQLIIVNEK

SEQ ID NO: 938776 - protein, 78 aa, Homo sapiens
MKQYSVIKWCRACIEDRLEIIFMKSDFGTSDRRTKHHSSQKLPGVLFYPQVLSPSAGIYLSHWKGKFVPKDATVNNTQ

SEQ ID NO: 938777 - protein, 97 aa, Homo sapiens
TNKWKNIPCSWIGRINIVKMAILLQVIYRFNAIPIKLPFTFFTELGKTTLNFIRNQKRTHIAKTIISKKNKARGITLPDFKLYYKATVTKTDDTVAL

SEQ ID NO: 938778 - protein, 114 aa, Homo sapiens
GRPLSFQRLLTRPPQSCFHAWTTEQSWMTFSIHDSLIFCDPRCPCNKVQCLGPLLGLLSGRDTAVRGHHSSPHYLSTLTPRPTPGLLPRLTQRPTTLSIHSKFSHDSSTCSRVD

SEQ ID NO: 938779 - protein, 98 aa, Homo sapiens
ALEIFQHSKYKVDFIETKASQNPERIVKLHSIGDFIDVSEGPLIPRTSICFQYEVSAVHNLQPTQPSIIRRLQGESLPIHLRAHLTKWDTLLERSRKM

SEQ ID NO: 938780 - protein, 106 aa, Homo sapiens
WPPRGNSSPSAKYIKKILDSVGIEADDDRLNKVISELNGKNIEDVIAQGVGKLASVPAGGAVAVSAAPGSSAPAAGSAPAAAEEKKDEKKEESEESDDDMGFGLFD

SEQ ID NO: 938781 - protein, 114 aa, Homo sapiens
SHEVELGPLKPNPWAGNLSSEAPTGLSFAKEQPRCCVSSRGTGDGHDGGETQTSSPPPSTKMEELRLPLSWAPTGWRAEASLGVLGPPSCVRSPGRLPCPGLSTACHRLLVLNG

SEQ ID NO: 938782 - protein, 66 aa, Homo sapiens
TCAEPPSFGSGAQAADVLELLLREAEPSARMYGGRTPLRSAMLRPNPILARFSSVHNGAPEPEGED

SEQ ID NO: 938783 - protein, 30 aa, Homo sapiens
SLLGSPAAPPTPKSFRTHQRPHHFLSGGHW

SEQ ID NO: 938784 - protein, 75 aa, Homo sapiens
LTSEYISILLTPTTTTNPASAELRLICTSTNGRVDRSQISQTPSPSRKTKSACIAYEINPDICTCLMKHLWKNTF

SEQ ID NO: 938785 - protein, 96 aa, Homo sapiens
VDIKLARVTKVNERDRFSGTVHAGRVEFMDDTSRSIIRNVKGPLREGDSAHPFSQSEKPGGCAELGCSLGLGCRVRPLGRWEWSVKSALFFVRTRN

SEQ ID NO: 938786 - protein, 74 aa, Homo sapiens
RRSFRTVSETKYKHANTNCVNIVSPAFLFYTTRLNVSYAEYISKNGGHILTKLTNVTKNIRCLLMLQTSSNYMI

SEQ ID NO: 938787 - protein, 117 aa, Homo sapiens
TIEGVMNHPELNSNEALDNVLPSAQMNDGQRQWLQESSRYTEQLANMRIQDLKVSLKPLHSVNNTITTEEEITLGRGFTDKVDRLKLAEIVKQVIEEQNTSHEYTIMTASNYVFLTI

SEQ ID NO: 938788 - protein, 73 aa, Homo sapiens
HQQHCTFTECPCRKRCEDTELIQTSLPGAGDGLEAELRVIQSMVIALVLSDAILIYLYALEDSYWDDDEQNGH

SEQ ID NO: 938789 - protein, 55 aa, Homo sapiens
MGYHTISNECSDIWINYSTGEEMKIIFHRIHNNCMASIISSLAAAHDVGVLRQQV

SEQ ID NO: 938790 - protein, 103 aa, Homo sapiens
TALQGCGKVIPELTEKLTSMPPVSPLPTCQCGPDCRLEKPAKYDDIKKVVKQASEGPLKCILCLQLSTRCVSSDFNSDTHSSTFDAGAGIALNDSLCQAHFLV

SEQ ID NO: 938791 - protein, 122 aa, Homo sapiens
YLSTEAGQRGSALGDLAPFRPPGFSPCPAGDLFPGHRYDGGLDSGFHRVDSGSKRWSGNGSTGEFSGLSFRIQGLARGPRGPRGRKGGGSAGGGPVRIDFFDRLVPGGGGGRGPVGGRRPPF

SEQ ID NO: 938792 - protein, 114 aa, Homo sapiens
TSWRTPALLEWDADDFRIFCGDLGNEVNDDILARAFSRFPSFLKAKVIRDKRTGKTKGYGFVSFKDPSDYVRAMREMNGKYDVAPHQVRKSMWKDRNLDMVRKKQKEKKKLGLR

SEQ ID NO: 938793 - protein, 104 aa, Homo sapiens
PPGGGAGGAPSPPLLSKGFSPGEKKGFFPFKRGGPPRGGFFSGVFFPPPRVFGGGKKGGGGPPGLFFFFFSPGGADNFPPPPGAPKRGGGGGPLGFFFLAFKFL

SEQ ID NO: 938794 - protein, 133 aa, Homo sapiens
GLLFKYCWTILTPWDYGLEEGGWVGKHSLAVSSAFFTYLYHPAAANLGTVLSLCWFPSKAAAEKMRWFNSSPCPKYSRLDPGGVLAFYESSPLTPKLRLLPTVPLGPPVTVYSFLFSEMRAAANSFTYLTPPE

SEQ ID NO: 938795 - protein, 76 aa, Homo sapiens
QLQHIVSDEICVQVTDLYLAENNNGATGASVNTQNSRSLLESTYQRKAEQLMADENCFKVRVGQVVEDLAGDNVSC

SEQ ID NO: 938796 - protein, 71 aa, Homo sapiens
VSKNMNRRGADQNCWFNLLDRKPPVIFKISPQLAGQGNLTKDKCGGLPFGPAPAADRGCAPAPTRAEGVAV

SEQ ID NO: 938797 - protein, 34 aa, Homo sapiens
QACPGGPPRSRREHPGVGSTGGERAHPAQLRDWR

SEQ ID NO: 938798 - protein, 137 aa, Homo sapiens
GQARSRLHQPVDSYDDPNSYRSAFRDGRIDLFSESEPTTLLNQLQDDILELRPLNETRELWPSVDLKRDTSIRFHIAHSAQREVEILHDQLLQVQRRPFAYQRDVIVMVPDVDSTRRIFAVFGQLDRSDLRFIAFTL

SEQ ID NO: 938799 - protein, 106 aa, Homo sapiens
DSGLLPEVFRPWSRWRPNPQSRGARDAGEGKQLKGAGPKLSLREEEPHFRCQVAAPQPWREAAAAAAAARVLRWEAAVRGSHASSPPGPREGEPSSPGSGLRKRGE

SEQ ID NO: 938800 - protein, 75 aa, Homo sapiens
NNTAEPEFRLAARREVMINRNPGPTLPGTGGETRAQPPSEPRERQLTFSCRNSSLPELSLEVRVHVRLQKSLRSN

SEQ ID NO: 938801 - protein, 97 aa, Homo sapiens
LSALTPHPHTRGNTGSLHSTDPLLASSLTSASVPALFRPKAPPTLPIAATGRGEDMAAHRPVEWVQAVVSRFDEQLPIKTGQQNTHTKVSTENNKDV

SEQ ID NO: 938802 - protein, 67 aa, Homo sapiens
FYYFTVYSYLFNKLTIKQPQAGPSGDIPEEGIVIIDDSSIHVTDPEDLQVGQDMEVEDSGIDDPDHG

SEQ ID NO: 938803 - protein, 119 aa, Homo sapiens
FFFLRWSLVLLSRLEGNGTISTHCNLHHPGSSDSPASASQVAGITCMCHHARLTSVFLAETGFHCVGQAGLKLLTSSDLSTLASQSAGIIGMSTTPGPRFFLKKEYYFHMCTVTFKIYY

SEQ ID NO: 938804 - protein, 56 aa, Homo sapiens
GTSEPSDIIIFLIFIFIIIFFLFFLKYSLFSTSLAARRAGAGAGARSGPVPRVHKR

SEQ ID NO: 938805 - protein, 72 aa, Homo sapiens
KPPPLRRTLAPPPRHGGRAGPRGPPNSPSSARSRPPYELSAVQKIVRQRPGLEHSAELVYQPEEQAPAFSGR

SEQ ID NO: 938806 - protein, 172 aa, Homo sapiens
KNPKKTYICCGEDTVYNVPRETALPATAFSGVIEEGVARVPVTKDCLESQVVPIHWVVSEDFPQSAADKGDSAWPAGTVRGAGAEEGVCGGRFKETGMRDRRPPLGRARRIWKKSGEGNGPESRAATRGAPTHKPISCSERSEGEAQRVKAEALEGSFARAFCLRLTLLCRF

SEQ ID NO: 938807 - protein, 106 aa, Homo sapiens
MKECRCRVECSRICAKRLRGAEYERYVKLREMTCEEIESMTAFEWMLGSFACDQLECKSSFTTYLNVCCSSRGETHGIGLRASKTEEDGVYKCDCEGCDAYICNAR

SEQ ID NO: 938808 - protein, 117 aa, Homo sapiens
GGGSGSREGELVSHSISKLIHHTTASKWIERQLADYYFYFHTLCFQVPLSARSQGLTPSPPISIAPAPSQATHTHTQELSSPPSAYTSFSSTNEMQLICLTSPDLRETNGNTRHFPD

SEQ ID NO: 938809 - protein, 153 aa, Homo sapiens
PAYTPIRDDVPHQHPLSATLPMATRADDQEHTRLHMALVQANLPAVHRLVNLFHQGGPALDIYPNYGRHRSTSLRSPHYRLWSGPGDTWSQPHALAPAQCQTGRCTLAWRSHRQPRRCLRALLDSAAPGTLDLEARHIIGTLTRPARGSQHRV

SEQ ID NO: 938810 - protein, 39 aa, Homo sapiens
DRGEWPQGASPLPALYSACTAIPMLVARKNTESMGHPDF

SEQ ID NO: 938811 - protein, 66 aa, Homo sapiens
DLSTQKLPGSSAFRQQRVIRNPTKFSCQERWLTHVFPALWEAEAGESLEAKKFETSLANMEKPHLY

SEQ ID NO: 938812 - protein, 70 aa, Homo sapiens
HWFPGKPCKGSGYRCIRMNHKMDPLIDRAAQRIGLSSQELAGFSQVNSTLWVDPYEVSYRIGGDGAIGVL

SEQ ID NO: 938813 - protein, 90 aa, Homo sapiens
LLLLNSRKYDHRDRMPGHSHIAKFRPSNTDELMWYQYHQNQLHSDIFSLIFGGRAGLARNTRKELSFSKVELKVKTARDDSDSLRSSARG

SEQ ID NO: 938814 - protein, 67 aa, Homo sapiens
VDLITVSGTEVVPDFGEMVSQWPFHSIQALSFHGSTDTPLLPALFSLGNKPQHLNLSKNKEEEMAFY

SEQ ID NO: 938815 - protein, 149 aa, Homo sapiens
MVSSERRETRDSGIRKVAQAMAKGGQGLEPRPKGESGDYKATQKIAFSATRTINVPPCAGDQTIRFGHVITNMNKHYEPGVGSSPASGPVSTTSPNTASSRGNLWVELMRVLERAQKVVTFCDLCLKTRVRVTTVGMVFKLERGENVFL

SEQ ID NO: 938816 - protein, 44 aa, Homo sapiens
MDEENRGVFFYAKMGLWTSSVFPMSPRLPEVILGPLLCALSVAR

SEQ ID NO: 938817 - protein, 43 aa, Homo sapiens
SRKPHSNVLRKCSVPKRPASASVLCSLVLSRDKADRTQTGHVL

SEQ ID NO: 938818 - protein, 70 aa, Homo sapiens
VDKTSLHYPESSYSSISSKKRYAGFTWGNVRNLEGWAVPVAHAGNPSTLGGQAGGSRGQEIKTILANTVK

SEQ ID NO: 938819 - protein, 84 aa, Homo sapiens
RHSAMFGDILVVTTARKDGMLPTYWLEARMLLNIPYTLQDSLLQSQRIIWSKAVNSVRVEKFCSRSLVKFKFNYFGKVCLSLFL

SEQ ID NO: 938820 - protein, 74 aa, Homo sapiens
DNSAPPLWKHTPPPTPSPQNFYFYAAGLFLCHKTFLETHTPGAVSKFIFVGCPPQTPFFPEKGAPTPSGSPLSF

SEQ ID NO: 938821 - protein, 126 aa, Homo sapiens
ESGILNGAKFCPYEITARRRKKVSTVLFKYPLGRGRRACQSFPTGLAPADTLTNACRLQPATPTPPLSNPIRQHGYKSSKPSAIIPVPPQLKTRTEQAYLRSIWQTLQDVTRVKVCILKSWKLESA

SEQ ID NO: 938822 - protein, 42 aa, Homo sapiens
SVAADRPGMLRDPFSVKSFSGLSSTSFSCRSSSFMRISRASA

SEQ ID NO: 938823 - protein, 54 aa, Homo sapiens
MKQEKGAIKKEHGPGTVPHACNPSSFGRPEVGRSQGKEIKTILANMVKPQSLIK

SEQ ID NO: 938824 - protein, 78 aa, Homo sapiens
FINIFFPPFPGGPQYNVSGAPFAPVFRNPRKPYLFFFGKGLRYTPAVPPSFPQTPARVFVGTPSPNPPFGLGPLLTPG

SEQ ID NO: 938825 - protein, 98 aa, Homo sapiens
FLRKSLNLSPRLECSGAIPAHCNLCLQGSSDLPALASRAAGITGVCHHAQLISVFSVETGFHHVGQAGIKFLTSRDPPTSASQSAGITGMSTTPGQAL

SEQ ID NO: 938826 - protein, 107 aa, Homo sapiens
DAQHLGVFIADIGYHQAFVLDEVRVPVGRKPLLQRGLVRRCDVGEQNGQTVFVRSWALLDYPVQGQDAERGDEVPGLGALRESCANTVGSRPATHRAWSRIRRATEP

SEQ ID NO: 938827 - protein, 105 aa, Homo sapiens
MSRVKARGSRGAALRLGVIRTVGAGHGDRGGSGDPGLREAACPKETPIGPDPNASEKTPSGTPIGPRPERLGEDSQRERAPRPSQGPAANPAGRKKRRTHRTPAL

SEQ ID NO: 938828 - protein, 116 aa, Homo sapiens
MEWKGKDLNGMDWTRRNGMDWNGMQLNVIDWNGMEYHGMERMECNRKEWNGIEWNGMKWNGIEWNGRECSGTEMSGIDEVYLNGIEWNGLELNGKEWTRMEWKGLEWNGMEFNGMD

SEQ ID NO: 938829 - protein, 69 aa, Homo sapiens
RFDPQQTLLKMAVYSLSKRWLRLIGVYRSQNRPLKRDMKHRQPFEFYAVARSVLASSFLDSTLDVYGYA

SEQ ID NO: 938830 - protein, 66 aa, Homo sapiens
IVTNARVLRPFYGAAVRLQIAHQRFQQRGFTDAVGTQYRQFFTHFQQQVEIFKQRTVIKPFGQTFH

SEQ ID NO: 938831 - protein, 79 aa, Homo sapiens
VRRIIGNVKAGSMQSLDARLHFGNLAGLGAYQMSQDPKNVWDFLATSGNLAGIKGERFYHSGKFMPAEIIAGASMLMVT

SEQ ID NO: 938832 - protein, 106 aa, Homo sapiens
MGRQPTEGGKFVNQKPDKNPGGGQNVYVPPPPIHMGRPQPQGSGIRAKGKGGGPLGHCGGAHAGNPSTLEGGGGRIAWAQEFETSLGSKGGPHFYKNFFKKRKGAQ

SEQ ID NO: 938833 - protein, 130 aa, Homo sapiens
TTWHILWAGGGRNGRAWERDARVPCLQGRWVMTVLWRLRVPCRVEARGGPGGAGDPDCSACFPPQTALRSASLVLEGGAAPPQASCQAAGSPEAGRLPILSCQHPALPNIDISWPRATEQGQGGPAKPAP

SEQ ID NO: 938834 - protein, 101 aa, Homo sapiens
VFSGPPGLSSLSVTLVSTILSLTSSALYRREILVSAPQVPESSAPVVWNDAGKRLCSVFPPLHAHTSFRYPSPCIVRGPSRTGPGTQLGPIRPPAGELPPS

SEQ ID NO: 938835 - protein, 106 aa, Homo sapiens
SFVSILSLRYSSPLDKSQALQCRGLTWSGAETSSCRARLEWLSSTAGSGAGPYLSVDPARRLRSVSVGAAGGLLDESRRLRRYRGMFALRNAGGEEAPWRWPRVCT

SEQ ID NO: 938836 - protein, 107 aa, Homo sapiens
GSPSSLLFLSLVACAAFLPGPRRPQQFWGHCFPQRCGGLFLLLVRIRGFSLGLCCALRLLRSAFVASSFAAAASFSPSFSSPSLASLSGFSFVLLGLGGLRPKLIPF

SEQ ID NO: 938837 - protein, 33 aa, Homo sapiens
MFRLAVRSSGPHAHRVRILGERSLKSPIESDLD

SEQ ID NO: 938838 - protein, 89 aa, Homo sapiens
SSLEAGEADGKRCVTRIKHEVREQGGVKAEKLRAEYRGGPDAASLEGSAGGVAPLGLRMLDPVGLEACRDDAFRPLCLAGILRAEFDQQ

SEQ ID NO: 938839 - protein, 126 aa, Homo sapiens
LLCLWAVRLWQVVADLPSISFQAAVATHLCFSRSSYTWGRTATQSDSSVSSSAIDMVGVPSRRGEQHRPGPPEDMPPVRAHPAQPRRAPSAILDARRLSQLVRLSLRAPNAELLCGADREKDNKRP

SEQ ID NO: 938840 - protein, 47 aa, Homo sapiens
SEPSDIIIFIIFIFIIIFFLFSLKYSLFSTSLCCETGRWRPAAASGP

SEQ ID NO: 938841 - protein, 142 aa, Homo sapiens
TNRSEWNRRESYSSGMERNGINQSGMEGEWNGMETNRMESTRVEWNGKDWNGMEWNGINSIVMEWNGMEWNGMEWNGINPNTMEWNGMERNGMEGNGINTSAGQWNGMECNGMESSGMEWNGMESTPLQWNGMEWNGIEWNG

SEQ ID NO: 938842 - protein, 100 aa, Homo sapiens
GEPRMGASDTALLEDLGTAVAFSWRGWWPFQPTTKCLILPEKLAPSFTPRTPASPPEASCEARTPASPRPDLVDDSPTQSVLLSRCARPSLLRIKHVLLP

SEQ ID NO: 938843 - protein, 194 aa, Homo sapiens
SKGNHRHPESDVQLIKTGDKVGASEATLLNMLNISTFSFGMVIQQVYDNGSIYNHEVLDITEETLHSRFWRVSADVASVCLQIGYPTVASVHHSIINEYKRVLALSVETDYTFPLAEKDKAFLADPSAFVLIPHCCCHHRCYCAAAAPAKVEDKENRRSRKKIWDLISMTNHQKAANLPSFVCKTHDIKAYFFT

SEQ ID NO: 938844 - protein, 53 aa, Homo sapiens
PFPTTNGGNKLARDPGTQGTSSPYSSREGSICSPRRQEEKGARAAAIFPNGTS

SEQ ID NO: 938845 - protein, 70 aa, Homo sapiens
PPTRDPGNLAPTCFTLAPPTAHFSGPPSGPSPVLWTPVSPPCNAPILVPTKGRPSSPLLYLKGGGANEEA

SEQ ID NO: 938846 - protein, 133 aa, Homo sapiens
RCRLMRQRLTGPTSKRTKRQRSSRPESASEVRERVQTVAASTMRVAVTPGASTRTMAARPRGSAARRTMRVTRTREPTARCCRPSPAVAGSEWVTPASPPQLVQGRLRCPRAGPRGVPLQFSHRGPPARPRPL

SEQ ID NO: 938847 - protein, 69 aa, Homo sapiens
METVLASTVEPRLYWECRKLAGHGGGRLWFQLTGRLRREGGVGLGGGACGEPGYRRCTPAWVTGRDSIS

SEQ ID NO: 938848 - protein, 44 aa, Homo sapiens
QQAAQEATRRMQLMHAQIVNLANSATDAVSREATGSAAHSHQAQ

SEQ ID NO: 938849 - protein, 47 aa, Homo sapiens
MLARIVSISWPCDLPASASQSAGITGVTTAPCLAPPPFTLPSSSVCR

SEQ ID NO: 938850 - protein, 103 aa, Homo sapiens
MCLGPSERFFSLIIVFVIIDIIVTILFIVFGNLDRDHRQMRCRISTGLEQRDDTAVRSFSGPSGRRSGLCPCCAFSQPYLQSYTSSPPPAASPSHIHPLRRHK

SEQ ID NO: 938851 - protein, 39 aa, Homo sapiens
TRVSAYIDWINEKMQLDLLLGAAAASPCNSNKLPSPRAK

SEQ ID NO: 938852 - protein, 82 aa, Homo sapiens
LKKSGKLKVPELVDTVKLAKHKELAPFDENWFYTRAASTAPHLYPGVALCGSMTKIYGGRQRNVFMPSHFSRCSKSVAAGSS

SEQ ID NO: 938853 - protein, 114 aa, Homo sapiens
QGEKGPRLKPQREGTPKNPLPPKGKIWAPPGEFKTKKKGKGTPKREAPEGGPVKKGKKKTPPGENGKLRSAPQGRKQPGPKGAQIGRGPPPTSLLGSGKNPFPRGGGTPKPPRG

SEQ ID NO: 938854 - protein, 118 aa, Homo sapiens
MKKYTAETRDKKEKTPPTKKRADPRGPKQRRPGPTRKNPPQTQRGTPPGAPEKGRRKKPNPSLLYEGKKTTPPPPRQKRAEKRGAAYQQIEKKNKGAGPQKGPGVKKNPPNKKTPPGP

SEQ ID NO: 938855 - protein, 42 aa, Homo sapiens
QQQQQQRRRNHVDGSSKPAVLAAPSGLERYGLGAAAAAATAA

SEQ ID NO: 938856 - protein, 143 aa, Homo sapiens
MVWPRRGTRLLAAAAGSACLGLYRADPRGYPPVTAGSQLPLDPWSAPTPFVTSLGDTPAPLRRHEGGSSAAQISGPPRFPLLSLGCALSRILGPPLSSQTHPRSLTHASFPALKPAAPPFIFCTSSQAPHGSLSEGDFLRNLG

SEQ ID NO: 938857 - protein, 41 aa, Homo sapiens
MGRNKNKPQKRKGGTRKRENINGGLFHTFTHSRAPKKGEKA

SEQ ID NO: 938858 - protein, 66 aa, Homo sapiens
EGRRSRPVFMSRQDSHHPCCRLVGGRRVVGRDSGVSRCEAVRDALDALSAWGLRVAGRSPWEVGGG

SEQ ID NO: 938859 - protein, 41 aa, Homo sapiens
ADYYYYYYYYNSRPVDPDCEPDLHFIRGVVIIITFVYNNGT

SEQ ID NO: 938860 - protein, 86 aa, Homo sapiens
SQRWEVRQIKRDRPRSKCLGVCSLRRKRMEVLTADGSLQVWVLRRAQVGGEGRGKSLRSPLAAAKAQVLSNKASRFSKLYLAQSIH

SEQ ID NO: 938861 - protein, 45 aa, Homo sapiens
MRRRFRIIRRQSRLPWRAGGGGGGGGGKLRRRLAAAEVKLPQCSR

SEQ ID NO: 938862 - protein, 51 aa, Homo sapiens
MCVSICSRVDVVGAPRRTQESRTRTRPWASQHSPWRSWRPLQSPNKRSHSL

SEQ ID NO: 938863 - protein, 132 aa, Homo sapiens
MLYNCLDFLQWLVPAHHGDCLGRGPEEHYRVYFGDIWDKMLQKGMKKSCVLPVSLQFCALPWQEELCLRFMREVDRLMTPEKQSPDGSGLQRTLRLTFLHAQPSLGTAALPPQQGNVLHGAEASVSSPPIPL

SEQ ID NO: 938864 - protein, 147 aa, Homo sapiens
IKISRLVAARRGSKKCKTNPPGKCCPENQSEGLKDAFNTDSSRNPASFGTAVSQNQKTPSNISNRRIAGFSKKKGLHLKGRVTKHEGVPPAPASLSRSVRYCCLLSPPWEGAQHPVCVCAHCLPACLPGFFSGCLCLCPGSLSRPGH

SEQ ID NO: 938865 - protein, 137 aa, Homo sapiens
QETTQVTLQIKPLEKSHLLQCFQQSSRKKKQVYGLHLLESAAAELQSGCTWGGVCGPQDGDFKPGLLKCPSERPAGIQRGATGLFPLGSFVGWVGFLARRFLPPGIAQGPEAAKLNTRQAGLVFSRNSPRTPVVLAF

SEQ ID NO: 938866 - protein, 111 aa, Homo sapiens
MRNSVVVSTFMAHRLRSEEKACGSNWIDASPYRCTRLDVCDDTESPHSALAFVRNTSAKISSAASSARMLRSCRRRRSGILCSRYGNPRTAGGRGRDFTISSRPGASGTQR

SEQ ID NO: 938867 - protein, 189 aa, Homo sapiens
ASTGLPGLAGDQCEFGENGDPGIPGNPGKVGPKGPWLETVAQGPLEPQAPKVNRETTRPPRKSPSLPQEPSVAPCAGTQTIRFDHVITNMNNNYEPRSGEFTCKCPGLYYFRYHASSRGNLCVNLMGGRELTQEVVTFCDYAENTVGVSSGGMGLQLEQGENVLLQSTTRTPIWQEGATEFLPVPGFQI

SEQ ID NO: 938868 - protein, 110 aa, Homo sapiens
PCYVTGWVRLWTIGPIADKLSRPVARGGSRHVLYDCLVGLQVVENHGVAVGDGVILACNGDSGGPLNCQFENVSWELFGIFIFGSWRGCNTCKKPVVFIRVSAYIYWINE

SEQ ID NO: 938869 - protein, 88 aa, Homo sapiens
MEVECSLGRALLSRRPRTIGLHDVCYVVIRAQAGGTKGPWGQAEGLSRDVPVSLAVPRPRTVAVSGEAASGVQGAPAHRAFSFRLGRA

SEQ ID NO: 938870 - protein, 56 aa, Homo sapiens
MEHTCPGSCILCRVQLLLGTAGIISPGPWTRTGASPPPSRLCLTEPQSRPPVAVGF

SEQ ID NO: 938871 - protein, 60 aa, Homo sapiens
SFGLTGGFRNYGYHYVDEPGKDTANMQRWKIAPDWDVKLTDDLRFNGWLSMYKFANDLNT

SEQ ID NO: 938872 - protein, 112 aa, Homo sapiens
GERNPEGLYPGKMTMTPWQGVPHAQFLETLESPKKKGGRRGTKKGATKKVPPFFGRKNGFLSSPSTRGGGGGGKKKNPPPPPAALQDIVYRTMEIFQLLRNMQLPNGVTYPH

SEQ ID NO: 938873 - protein, 96 aa, Homo sapiens
TRTESALWGPGRHGSHWHSRAAARTQRAKRGGLELGDAGARQLVLTNPWNIMIKHRQREGPPLTDDNKFTDPAISMDLLRAVLQPSINEEIQTVFN

SEQ ID NO: 938874 - protein, 94 aa, Homo sapiens
HEVKLLAVVGPCRPVGGRASQRDKTAGEAELASGRQGGPGCEPLSPALPPPAFVVAMGKAVARAYGCLPGRVLSPPLALRLTPAVLPGDRAAGP

SEQ ID NO: 938875 - protein, 94 aa, Homo sapiens
TRGVQAVLRHRVCCRSTGPNPLQRAAPAYAYAVYPRALKEVHQPSPAPADRAMAQRKNAKSSGNSSSSAPAADASAGSSSPGARKRDKAWRTQE

SEQ ID NO: 938876 - protein, 33 aa, Homo sapiens
GTRGHRGFSGLDGAKGDAGPAGPKGEPGSPGEN

SEQ ID NO: 938877 - protein, 30 aa, Homo sapiens
HEVRPERLPPGAASSSPLLLGAPPRPPGQC

SEQ ID NO: 938878 - protein, 43 aa, Homo sapiens
HERVCGTVTFIFQMVIYMGVVLYAPSLALNAVTGFDLWLSVLA

SEQ ID NO: 938879 - protein, 123 aa, Homo sapiens
AAQLNQPPGEPSAVSAYGQGKAELILILAAARTQHNVDAAASLTVPEQYVSAFSKLAKDSNTILLPSNPGDVTSMVLQAMCVYGALTKAPVPGTPDSLSCGSSRDVQGTDASLDEELDRVKMS

SEQ ID NO: 938880 - protein, 104 aa, Homo sapiens
MAKTGARDSLALKKQAVMLRTAYGENYMAGNCRRLLELERSLQLTTSKKPGPSVTQPQGNEFCQQPERWPPDERPPQKKGGGVPPPPFLGKESRFEKSPVIAVL

SEQ ID NO: 938881 - protein, 99 aa, Homo sapiens
QLKGEHGGEEFLLSNKTALSSEKKLKTVAPNAAWYSTAVAESRGFYTLRMKDVHADWSMGGLLKEEPFDWLKGIRKFSLPVVDSTWNWQPGFQAFQALA

SEQ ID NO: 938882 - protein, 89 aa, Homo sapiens
LTTPTCDEKVVWTVFREPIQLHREQILAFSQKLYYDKEQTVSMQGQMSSACSSWGSDGDKRSGPGVAAATALASCWAPMACVLLAGFLR

SEQ ID NO: 938883 - protein, 138 aa, Homo sapiens
MSTIEELIEETEAGAAMEETRGGGSGYGGDRSGGYGGDRSGGGYGGDRGGGYGGDRGGGNGGDRGGYGGKMGGRNDYRNDQRNHHTDDCFECSFVSDMIHSEIARVLPAAFLVASSWVVKLSDIWIFIWVGGLGQFFF

SEQ ID NO: 938884 - protein, 113 aa, Homo sapiens
FGRAWTFGPPWGLHRTKETPQTPARTYPGYFCIVVEKNFIHDSDSVKSPPRDILLVSEQTTSFGGRTPLDTVFIITPEDALKRGSNTPPSSRARGGGFCPHPKAFGHSFWRGC

SEQ ID NO: 938885 - protein, 97 aa, Homo sapiens
FDELREEGFRRSNYSKLKEEVRTNGKEVEKLKTTLDEWITGKPNPAEVPYTGPSMAAATTHQPGSNYRACTCTTASSHTCMRSHWNNGYPVMEDKMQ

SEQ ID NO: 938886 - protein, 170 aa, Homo sapiens
SSTNRHKSLFKCAKCSFPQNSGLEFQSHIPQHQVDSSTAQCLLCGLCYTSASSLSRHLFIVHKVRDQEEEEEEEAAAAEMAVEVQQPEEGSGEEVPMETRENGLEECAGEPLSADPEARRLLARPLRTMVATMITVNHRPLRGITSFLWRGRGDRRLCSVHGQGWCRSVF

SEQ ID NO: 938887 - protein, 93 aa, Homo sapiens
KDHASRIIHKLICENPEDSSYDSTRGGIEENGSPEERRQNSVSNFPPPAGREFILRTTVPRPAPYSKALPQRMYSVLTKEDFRLAVKIIDEDV

SEQ ID NO: 938888 - protein, 74 aa, Homo sapiens
GRPISFVFSFNFNVNSQYRILGDIGVASSGKNCQPVLPSGKFRPRNPDPQEFHLLLFWDRKPGVGLEPSCFLLT

SEQ ID NO: 938889 - protein, 87 aa, Homo sapiens
VCFPKDSHEFSCDVSFKFRRILTVTGTTESMLGIGLRGLTDLQVLFFSIPSFLLSLQRGSEQVCRCKFLHDKQIEYNTSSRLSKNDG

SEQ ID NO: 938890 - protein, 173 aa, Homo sapiens
MRIAIFHFTGGLLSTFSASARSRLWAARSARPPLTCGAADSACGRVASVRRPGLIVEGSVGWALAQFIEDVVGAHQVIAAEAQVALVVSLTPTEFTHLHTDVCCTGALRSVPRGRSRVRRVHRCSTSACSFCAPSVRSFLGAHVRLEQQTLGGQRGVFDLHARAQLAASGQRS

SEQ ID NO: 938891 - protein, 54 aa, Homo sapiens
AGLGNYFLIYKTGFNSAGVGNGVPFPPKAQGPEMRPFTWRVSVLVFKSLKRYPK

SEQ ID NO: 938892 - protein, 135 aa, Homo sapiens
FGFSPPHQISPGLFHAPFPPRPGAGCSPNGFPTPRVPKTGVFRGVPNPRGGFFKTPQSPLATPFLPVVSPLEGPAPNFGTPSFPKGGGPILRGEFSPLPPLLKGVFREKKKREMWPRSIPLLKALGPPFLRGVNL

SEQ ID NO: 938893 - protein, 142 aa, Homo sapiens
GAPFPPPPPGALCGGLGVFFPPGGFPGPPPAPFERGNFFPPGGFPLTFPQGRGFSPPPPIWGGEGGPPRVWFPLQRGPLWKPRNPRRNPANFFAPSKRNFGGPLFRFREPRFLKGFPFCPNWGFREFYFPGWFFLKKGVLNL

SEQ ID NO: 938894 - protein, 158 aa, Homo sapiens
INISKKVIYTKTTSTGHQHQRPKIDKTTKMGRNQSRKAENSKNESTSSPPKGHSSSPATEQSGTENDFDELTEVGFRRSVTTNFYELKEDVQTHRKEAKNLEKRLDKWLTRINSVEKTLSDMMELKTMARELRDTCSSFKSRFNQVEERVSVIEDPIY

SEQ ID NO: 938895 - protein, 69 aa, Homo sapiens
PRPLLQPIGARTLHELKLWTGSREELLEEKIPEDGPYTLPNSSSGAAGPCPKRLPLSPKNRGSRKLPLN

SEQ ID NO: 938896 - protein, 89 aa, Homo sapiens
MLLVKAATLSRLEAEVSDLCSASLKDHLSEKTPDQKGKARASCEEASFSRSAPKFTQLSSREQIICTRQTKYIPTITREMAGYLSQWVW

SEQ ID NO: 938897 - protein, 78 aa, Homo sapiens
VPGGDLAKVQRAVCMLSNTPAIAEAWARLDHKFDLMYAKRAFFHWYLGEGMEEGEFSEAPEDMASLWKDFEEVGLDSF

SEQ ID NO: 938898 - protein, 82 aa, Homo sapiens
GVPEDDHDDLYLDGRREPQEGMKPSPAVTKTRLSGLPVRLLPSSVAAGPLWGFVPCSGAQAGVVHIHRPQQPSKMGKGVALP

SEQ ID NO: 938899 - protein, 76 aa, Homo sapiens
MTEEDLSVPILSQKLQFEQPFTRTNTFTRAKESRREITAPECSTEIREDVLKRVGRTVSHCALFVMYFRISSDFVK

SEQ ID NO: 938900 - protein, 107 aa, Homo sapiens
RPFPWVATPPPPSTMLDFPHRFPRAEVSRLASLNSLDEHGVLAQLIPALLPLLPTKAANDLGLKDITYYYVEGLCRARSRSHLPSWRRPASSLSGGRASSAGLIPHS

SEQ ID NO: 938901 - protein, 31 aa, Homo sapiens
QDEADRLGKVYDKYMCSFLFNLNNDFVVDAA

SEQ ID NO: 938902 - protein, 50 aa, Homo sapiens
MPGETEEPRPPEQQDQKGVEAAKAVEEPQYRPPEAVARRCRTTSSRVLRG

SEQ ID NO: 938903 - protein, 30 aa, Homo sapiens
SLPLLALPDGADCSLSGGGASREDRAEAVR

SEQ ID NO: 938904 - protein, 240 aa, Homo sapiens
MARVVQVSCRAFRVLRGRLRFAEPGTREVEDGLLWWDKWDAFDEYGAITIDGEEYISLKEYAGKYVLFVNVAEVLRRDEASTIELNELQEEVAAFGLVIVGFACNKFGKQEPGEEVRDRFLQSSMSDEVEVLFANFELFEKGDVNGEKEQKFYSFLKSCSERSELLGRFDRVFWETMKVYICWNFEKFLVWPDGIPIMGWHHRTTVSNVKMDILSYMRRQAALGGQEEVTEGRLHPMSTM

SEQ ID NO: 938905 - protein, 110 aa, Homo sapiens
GLFGAKGQFSLDVVVVVVVFETESRFVSQAGVQWRDLGSLQVRLLGSRHSPASASRVAGTTCACHAQHFGRLRWVDHMRRLGVRGQPGQHSENLSLLKIQKLVRHGGARL

SEQ ID NO: 938906 - protein, 47 aa, Homo sapiens
AGRQSGFPYPGALHPFHVIRITHVVLCRADSQQHAVLEASTVSVCSI

SEQ ID NO: 938907 - protein, 154 aa, Homo sapiens
AREWPFILIPLPTRFPILKRQLGQRFLMCFTPLWATPSLQYYAPASKLRGLGWETSFPPERICKGLQINTRTLGKLVPGPEISQGNLAPTHNKKALGPFRRRFFQTHIPRRITYFAPREFLRLSPSGTQGDPVPNRCSVSDAIPKKTYMRDSNR

SEQ ID NO: 938908 - protein, 43 aa, Homo sapiens
LSEGHDLLQEDGRKGAPSSKAAPPLSTESSEEEAQSLTLRGSA

SEQ ID NO: 938909 - protein, 49 aa, Homo sapiens
NGRIRTRKFMTNRLLQRKQMVLMSHRERQCLDRMETSNVQTHDVLMIDY

SEQ ID NO: 938910 - protein, 46 aa, Homo sapiens
RYKLCKVRKIFVGQKDPSSGDIMMPHIRYPILISDDTSDDETADTD

SEQ ID NO: 938911 - protein, 47 aa, Homo sapiens
HVLRINKMLSVLGLTGSKQACEVPLESPGTVAGYTWQYTVIAQLQTE

SEQ ID NO: 938912 - protein, 39 aa, Homo sapiens
ASLEEQFQHFKLLACIASRPDSVTSRCYVLEARVSLSRI

SEQ ID NO: 938913 - protein, 35 aa, Homo sapiens
TGFALLGFPKGFLGALIGGPPAGPGPGFPGEPPGT

SEQ ID NO: 938914 - protein, 148 aa, Homo sapiens
GGGRGVSRGFLPPPPSPHRGGVFGPIIGGFLKVGFPPPPFRPRGGGGVGGGFFKSLFFSPPHSPGGAPPPFFSPFGDTGGPPPPRLFLWAGGGVIFFPGDPLGPFGLFQKLFWGPLWGGPPGGPAGFSGGPPPPGEKGKKFFFWGPVL

SEQ ID NO: 938915 - protein, 47 aa, Homo sapiens
GNLCAMRASEESDAGWAKREDEAESVTLAVHVSTEQNMMQTLDLYSV

SEQ ID NO: 938916 - protein, 154 aa, Homo sapiens
TPPFFPPFPGGRFFATKGPGRVFSRGFPSSPPFRLWGFFCPQIPGPSKIFLKPPPFTQMVGGPAGPPFKQALFWTPQFPWGPPPLFFPPLGPPGPPPPPVFFLGRGGVYFFPGEPLCPFPLFQSFFLGPFWRAPPRSRPFSGPPPPPGVFVPFL

SEQ ID NO: 938917 - protein, 103 aa, Homo sapiens
RRPPQDKRGDFVGLQERAQQGIRATAFSARSNPAACQDASCSPAACPVASVGSHRQPAPGGAAPPPLAQKAVAASAGPRPSAPGSPRRASASPSRSRPQGLLL

SEQ ID NO: 938918 - protein, 141 aa, Homo sapiens
HVLTSLRSIQQTLKDGQRDRRWSFIMQCDLCCNRVLEARSSKRGVGSTMLSLKMLGRICSMPFHSLLGFPASPDIPWLVDASPQFPPPPPPPQKKIFFPPKKFSPKNQIWGPPPSLCVPLRSLYSSSKDTDTSHSGLSVHS

SEQ ID NO: 938919 - protein, 75 aa, Homo sapiens
SPSDSCWVRHDPSAAQAICRHQRQTLQGVLRFSVNAAQVIVCPERCSHVVVLRPPLKMGLYSSCNLPLTVHPALL

SEQ ID NO: 938920 - protein, 45 aa, Homo sapiens
ARQPCCACPETREARDAVIIEKGEEHCGHQFEAHKEGMRALGFKI

SEQ ID NO: 938921 - protein, 67 aa, Homo sapiens
ILNGVSNTIIVVIETHPYELFTFVPPVYNSALLEELNSRMDHFSIIEKQILSLREKVHEKEREEYSC

SEQ ID NO: 938922 - protein, 113 aa, Homo sapiens
MTSALATMRVDYEQIKIKKIEDASNPLLLKRRKKARALEAAALAQLSHRALLPTGGQAITLYRNIFFKRRDRTVHICLLSSSAAWSLFGGGGGGKKKKKTPLLGPKFPKGVWG

SEQ ID NO: 938923 - protein, 126 aa, Homo sapiens
MAYQSVTECVPNPAHTGTRCPRLSSKYYFRSHVRGPYAPNTANKITQEQGSSGVRVGSWVFRGVCGEPPGWGFGLKNYPPSFFSPFFLGLTAKVTGFGISRPGFEPCLANYELSFMRIRVKRTPKQ

SEQ ID NO: 938924 - protein, 152 aa, Homo sapiens
MITIRPHSNSMRRALVAQFLCPLKPKKWDNFLRSKDPPYEALEKTLLHLGPFSSSSIRAAYLYLKSKVSHNGLQKQNSSPPTLIADDHAVGIWRPGEDGSGCRTCCVSCIYGCTDPKTALCSLLLIYSDFEGSIEDVSCLYLVSPPSAQPPN

SEQ ID NO: 938925 - protein, 101 aa, Homo sapiens
PSQQRAVQCLVPAEKVLQATPLNTGAKGVDRGHLAPPDSMLIVSDEERSRMIMSAALEAQAASRPVQPGAEVHVLQGAQPTVPPAVTSSARGHSRTCHAQR

SEQ ID NO: 938926 - protein, 100 aa, Homo sapiens
MSALAVMLMAGLPSAAEDTPAASAEAKADAPLQADYYTRRAKSILEAEKQQYRETALAASYPGMDVVVCEAGCTTRKPEVVWAKRHAEAAKTVTQGLLVP

SEQ ID NO: 938927 - protein, 113 aa, Homo sapiens
ARHPYYSHQEYLSTEAHIVLLETTGTKYFKAWFITILWGLFFTLLQASEYFESPFTISDGIYGSTFFVATGFHGLHVIIGSTFSLSASFGTLNFHFTSKHHFGFEPPPDTGIL

SEQ ID NO: 938928 - protein, 132 aa, Homo sapiens
PRHTEARVHLCHPGRVLKQDPVAHVAWRIPGPPAHPPERGFLPPVVRGLCTPGTIPLPAELGLVYPHLQRLGPGPALPEAFEPPLGLTYPGARAPACRGRGTEDLAELPAPDPATNRGPQDSEARSARSPEN

SEQ ID NO: 938929 - protein, 119 aa, Homo sapiens
IKITTTNHLPTHNTRSLSTHSPHTPSTAGGRSRCGWGTCIPNNQGHPTLTPTTPSHHCHHPNPSHTTSFIYPSPHPPLTPRTHPFHPPPPMARARLWALTANPPSANPKAKPSRISTVV

SEQ ID NO: 938930 - protein, 103 aa, Homo sapiens
FLLPSPGPCAALCPRSRPAHGTRIPHIPFAHDYPASSSALLELRILLGAPELHGAHERARRTRGTFLVRDSSQRNCFFALSVKMASGPTSIRVHFQAGRFHLD

SEQ ID NO: 938931 - protein, 52 aa, Homo sapiens
RGRGRACGVGMSLTWLGPGSKRNNGGVVHGKKFVMAAGAGSDSDEIACQGTA

SEQ ID NO: 938932 - protein, 61 aa, Homo sapiens
GTSELPASVMQQDSRKANGKYTGRKMNAKPLSYDSDSRAPGREGVCVASPQRPSQGFSMGK

SEQ ID NO: 938933 - protein, 106 aa, Homo sapiens
RLTAPQRYEAASMREAADAPGSDEAPRGPPQEIWLQRPPHQKYVPADGHDVGASGESRGGADLPSATGVRARVRLSCAASSLNENVDQQRLLKLGTSVSELVSRFD

SEQ ID NO: 938934 - protein, 130 aa, Homo sapiens
QRTGVAEAHVPTCVDDRVHRVFIANGALIAPLAQTWGHWRLGQAHWRIGAVPPAELPRGPELHVLSKGSEQAARRALGEVGVEAGEQGSDGIPRSARISGAEDADLRDGPVQAEEHPKRSARVQAQLHAA

SEQ ID NO: 938935 - protein, 161 aa, Homo sapiens
RDSMPTSSGFSAPRRCHPIPWALSSPIIFILPVRRAYWGTQIPTPHTFLCKVTGRCGSVLVRLIPAPRGTGLVSAPVPKKLLLVAGIDACYPSARGCTAPLGNFSQATFVAFFKTYSYLPPALWEGTVFTKSPYPGFTDHLVKPPTRVSVPRTQAPAVASP

SEQ ID NO: 938936 - protein, 87 aa, Homo sapiens
DVDRKELDLRVRQFDNTTSKDIQPLPMPVVVYDDKASSYLKDANLDAEKLKKSVIISQSVDDASAANIEFDHPKTFNDELLGTPTAP

SEQ ID NO: 938937 - protein, 31 aa, Homo sapiens
AKIMRHSSKGSHQPPWSPQQALAHRGVRPRS

SEQ ID NO: 938938 - protein, 45 aa, Homo sapiens
ARGGGSWGGGGPSRLSSSVLKPFISPAPGRYLWGRVPRITTRAAR

SEQ ID NO: 938939 - protein, 67 aa, Homo sapiens
LLLFLLGPGVDTEWCPSSKSPLTLLNGEELFFSWNPYESNFFQPSAACSPVPVTDRRASPRGRHGCC

SEQ ID NO: 938940 - protein, 66 aa, Homo sapiens
REKEMEEDERDRKREKEELEEIRQRFWQKGIQIQMQSPEDGTRGWEAQQPQIKQEPESEEEEEEKQ

SEQ ID NO: 938941 - protein, 32 aa, Homo sapiens
RISHVHVPAAAPRSGLRVAGRLPGTETPLRCG

SEQ ID NO: 938942 - protein, 171 aa, Homo sapiens
ALDEKLLNIIDLQSLHGYYELPFLILLRPTRPGLGACRAAGHVLHCGHLTEHHEEVEPLILVLNSLAFELNQGFAVPKPLVGVLCFALNSLFYRNKSFPRYGLVLKKLNTGNTGFPVSHQGGVRITWDCAQATFISYDKMVISLKGGEIYVLTLITDGMRSVRAFHFDKAA

SEQ ID NO: 938943 - protein, 73 aa, Homo sapiens
VDLLNLFHPFITNWKKQPPGFYSLPINGPLWAINIDLSSTLSRRQTGTPFDLAEGRSELVSGFNIEYAAALST

SEQ ID NO: 938944 - protein, 76 aa, Homo sapiens
TVWRIEGFIALGGFPGILQKHCCILPDRNTDEDPQAQGIRSLAENSQLRRGSLGFLPGAHTRDPFVTVFKGTAAQT

SEQ ID NO: 938945 - protein, 32 aa, Homo sapiens
ANPYIPVLCIVRARDRNVRIVNCVTILMLERA

SEQ ID NO: 938946 - protein, 56 aa, Homo sapiens
SPVIVLGGPSGPPQQQQQQQSVPEPGRAATSGPRRYPSPTAELWPEIGRHGGTQQR

SEQ ID NO: 938947 - protein, 143 aa, Homo sapiens
CEVSPTTFLVWDAAFRANLLPNGTREVSKCLARQLRAVGTVTQMEGEPTPVNLTEPARLEFEFVLVLSFGTVLFLATVYENYALVYSCTCIIQLFHVDFAWILASNPNLPPETVGSLIYILSSDNIDVKKVTVTGLVSCPKLS

SEQ ID NO: 938948 - protein, 126 aa, Homo sapiens
MGAAGPFPPLFFLWAAGGGYIFPREHPCPCWLSQKSFLVTLKKGPLQERFLVPRGAPPPRDFFSFFPAGGGPPGFFPPRFFFLFSQGGGALFFRGKKNFFCKILVPPQIFFFFKKNMPKIKFVSSF

SEQ ID NO: 938949 - protein, 94 aa, Homo sapiens
EKNVRPVVRLCPGVGQRNLILQPVAELKKQTGFEHRMAKEQWWLKVRPLVRILAKKKASYEVSDSGQLEQCAALECVTESRRHVAAGTVDCVFL

SEQ ID NO: 938950 - protein, 72 aa, Homo sapiens
LPLPFLTLTLCSHMGWGAEFPPRGDLPAGAATSIATMGHLAGRGFAGLLQGPWSIPRLFIPYNVTFLFYFTL

SEQ ID NO: 938951 - protein, 67 aa, Homo sapiens
SDCTGNFCLFKSTTKDLLFSDDTKCFVKLPEGTTPEKYLGAEYMQSVGNMRKCSTSRLLEACTFHKH

SEQ ID NO: 938952 - protein, 75 aa, Homo sapiens
DTALHAAASKGYADIVQLLLAQGARTDLRTNEKKLALDMATNAACASLLKKKQQGTDGARTLSNAEDYLDDEDSD

SEQ ID NO: 938953 - protein, 90 aa, Homo sapiens
LGVRMAEDIKTIIKNYKTAPFDSRFPNQNQTKNCWQNYLYFHRCDKAMTANGGDVSVCEWYRRVYKSLCPVSCVSAWDERIAEGTFPGKI

SEQ ID NO: 938954 - protein, 101 aa, Homo sapiens
KGEKRSSEKNPVFDRRSKAFVCKPGGGPPSGLGKVLRKSRMKVNLFRGGGPPTIMMVQRCGDKVNKTRVVLPHRGVRIHRYRCLKVLLLKEDFSHSYRSEI

SEQ ID NO: 938955 - protein, 74 aa, Homo sapiens
TMKGVAVWDSVVTNLSIRSSWGYSFKFHPVRCHSRSSCCFEHLPTLLPKSFYGVGPLCFLYQSCHTVWEVISEV

SEQ ID NO: 938956 - protein, 37 aa, Homo sapiens
LGGLLRGRGGPVAFGGSWGAVAMRSPSVRAAIRAFFS

SEQ ID NO: 938957 - protein, 162 aa, Homo sapiens
SLFPRAPALALLSPFIGPPLGGFGPGGPALGRGPPFLRVPLGLSPTPLCPQARVGPGGFLGLACGPRLPFRGAPLSSLGGLVWALVSARGPPLGGGSCRVGLFPGALPGLGGAFSPPPPPSPPPPPPPFPGFPPAPAAFSVPLSVSFFWGLLVWSPFPFRFI

SEQ ID NO: 938958 - protein, 70 aa, Homo sapiens
ALLPYFVYVVSGVKSVSHDLEQLHVLLQVARSLFRNPHLCLGPISACLVGIAIYCVWEHLAASLTPLIDH

SEQ ID NO: 938959 - protein, 30 aa, Homo sapiens
MLLVRKEIIARRASIRRVSITRSNPFGTTI

SEQ ID NO: 938960 - protein, 75 aa, Homo sapiens
KGCEFKSWLFKFYQARSQVLLCGEVKNPYLLTSNKTTVKEQNACLTHPEQISYGRSAVVENSSPQRLYLSCREGS

SEQ ID NO: 938961 - protein, 97 aa, Homo sapiens
EQEIATYRRLLQGDTDAHLTQYTKEPVTTRQVRTLVQDLQDGQVISSRDQAATSPPVRTRYPGRPPSRQGAAAPSAPQSPAPPASAPCLSPFPMLPC

SEQ ID NO: 938962 - protein, 69 aa, Homo sapiens
AAQRHRTGREEQDHHAALLQGLALRVKPNHGPLRAQFTTAPQVYGHRSGSCTGQTPGRTRRSKPESSAE

SEQ ID NO: 938963 - protein, 68 aa, Homo sapiens
PFFLLLLELLFLVLVDCGHMGKYNSLSKKPKKAPKVELGTKTVDTSMDEGLQGTAYAHSLSNKSKKKK

SEQ ID NO: 938964 - protein, 99 aa, Homo sapiens
GGAHPPPPPPPGGVLGGVFPPPPQERGPLFFWGPPGGSGGGGFFFFKIPPPPPPGGGGGGGPPPGGGGAPPPLGGGGFFFFFWVPPPKKKNRVFFFYIF

SEQ ID NO: 938965 - protein, 35 aa, Homo sapiens
MATPGPVIPEVPFEPSKPPVIGGQPQWLTEFQRVS

SEQ ID NO: 938966 - protein, 51 aa, Homo sapiens
QLSSMVWNGHPLAIADSACSAPALRHHLVHYAHLQASAGGKSSPSCRARRR

SEQ ID NO: 938967 - protein, 98 aa, Homo sapiens
RTTQQKVSCMLEASSVFTAAPPPPDHCSNYRLNSPPVRSAAALDSHRSTNPIVNCARKVCRLPAPYENLTPDDLSLSPINPRWDHLVARKQAQGSHWS

SEQ ID NO: 938968 - protein, 58 aa, Homo sapiens
MEVAPWTLEAAGAAGGASGAMPAAGCRSFFAFTATSPVCQRGFRPSCGAGQGRMGLET

SEQ ID NO: 938969 - protein, 139 aa, Homo sapiens
MERQHGQRSVNMLKDSRFFEPDVTRTQVNTVVSGALIRLLTKKDPFVKYGIGRKLWIFLHRDRSEEEFGRIHQAQAAAVKPGKLFSKKPKPPFKVKFSCKGGSIKVLCSGPFEQSQMSLSEFSMPPTPVTPVTPTTPAL

SEQ ID NO: 938970 - protein, 81 aa, Homo sapiens
SMCAGQRLASEPQVPAAVSLPTSSVPETRGRNKGSAALGGALALAERSRCNYPSMLFFSHLGATRLPKGGGPGNDLSRGST

SEQ ID NO: 938971 - protein, 44 aa, Homo sapiens
SGPPVCKSSEVLYERPQPTPAFSSRTSYSWKSIQMPCSNKQEVV

SEQ ID NO: 938972 - protein, 100 aa, Homo sapiens
LTVHTIPIDQLQWGASARDCHASMQKLDFLQHLLAAFWATSGSITDSSPTPSVMTLSRAPHSACGPEAVQKLASRGRLVTVSPMPQPDFELPSSGGPPRS

SEQ ID NO: 938973 - protein, 124 aa, Homo sapiens
FTPFKQAVKETCAWFTDNYEQALEVKLKDRISCLRTIRLQEPSGHHPSNLARSSGTHQQTGACIPFALHPKAFFHGAPHSRWSSGKPGFPQARRFAPHTSPLRVSTLILHPTPWEPIKCIFTGK

SEQ ID NO: 938974 - protein, 43 aa, Homo sapiens
CVDTSSPKAGKAALETGAHVPRPRAWHALRTLRHSIREPRLPP

SEQ ID NO: 938975 - protein, 58 aa, Homo sapiens
GGRVQRARGQACACGRASSSAPSPCSPASLSSELSSSKYGNRPPCAGAAGLRVRSGPR

SEQ ID NO: 938976 - protein, 101 aa, Homo sapiens
SDLCPRVPCRRMAPAARPGPGALLACTYCSLAHLVPWAPPQVTAQPLPTPPRPHPPRVFLPCDSWNLRPPQSPGSGCPPQTMPPDDSLQPRNKCTPQNTQQ

SEQ ID NO: 938977 - protein, 63 aa, Homo sapiens
MYSSPQPIFSRFLRSLASLLAVPRARFSSGVSKAFISSSCSFRSSRSRSRSCRSAAGSGAAAV

SEQ ID NO: 938978 - protein, 112 aa, Homo sapiens
MGRLPLHPQRGRAAPRRRGALPGYSLARRCVAPGHREPRPKLHHSLSFSGFPSGHHHPPGGLESPLLLDSPHVAHAAAALLLFGLVLLLLRLLLFSPPRPPPRAPRHAAPRR

SEQ ID NO: 938979 - protein, 49 aa, Homo sapiens
SNPKKKAFVSHGAIQINTTSGVFKTVTIRQFQNLTAVSRFLSTKKSSTV

SEQ ID NO: 938980 - protein, 94 aa, Homo sapiens
ITVTNLGSKVSVPPKETSPGWDHPSSFAPSICSSRWILEWQNWQHKNIKGVIFDNPVYLKTMEEDLLMDMGRHGASGGCTCPVIPVISTDDDSA

SEQ ID NO: 938981 - protein, 49 aa, Homo sapiens
AAPVLRGGAGVGSMIKIYGGRQRNGFMPSHFSRGSKSVAAGSSKALEGL

SEQ ID NO: 938982 - protein, 163 aa, Homo sapiens
MAKFPSEGMAFNFTHINPALSTEKIALTDEEATSFSMKSGFFNLWEPCFKPMNNFGPTANQGNQGALIGTSLNHSSPFSSFLIQNSFCKFKILPKQFIIQIFKFFPLRFPPKKNPFQQLPRKAFPQALPGTNLPVGKVGEEVGAVPVRHPRHDYLLNVVDDVL

SEQ ID NO: 938983 - protein, 83 aa, Homo sapiens
KTNPSDTGNFGFPIQEHTDLGIKSDPTLGTHGLDFYVALARPGLSIADKNRRTGCIGPKHRISKEEAIRSFQPKHDGIIPPGK

SEQ ID NO: 938984 - protein, 139 aa, Homo sapiens
HQTHSSWTPPNAQYWSQFHSVEPQGPQLRPQQHKQNKQVLGYCLLLMLAGMGLHYIAFRKVKQMHLNFMDEKDRIITAFYNEARAAARANRGILQQERQRLGSAAATIRANPRPRDRAGRPEGLTWMGPAGRSAFASFP

SEQ ID NO: 938985 - protein, 60 aa, Homo sapiens
MYLSLLLLQLGNKPTFWPSSLRKIGGRWVFEKSSATKHNAEHDAGDKEELSMNVEYDWTV

SEQ ID NO: 938986 - protein, 86 aa, Homo sapiens
RMPFDFEARGSPLTLCQELSKAGELTWDSWLGRKRSPLRTSLRQADHLIHSPRRLCVLLCVFCVLSLHAPPATLVDWDQVLTPVRK

SEQ ID NO: 938987 - protein, 95 aa, Homo sapiens
MVSNGLHTPCPGGAPALTLTVRLHQQRVAHQWVGAGHRGDGPHLLPFPRVARHPLQLAQDQSGAGQGNGTRRAPQQQLLPHEPQPEPRHSPPLAA

SEQ ID NO: 938988 - protein, 119 aa, Homo sapiens
MGERPYSFQTCGRSFPATRILRRHLAILSEPGQEHAEPRSECVECVESFSCSCNLLRHLLVHTGAGPTPYCSVAAASAVTPTLRPPAHSRSRDAVLAWPAFRQFALRHLPGVLHSGCLH

SEQ ID NO: 938989 - protein, 76 aa, Homo sapiens
GLLGVGGAMVPPQAHLISTVLSPSEHQPRGKGERMCDADPPSRMVSSTSHPQCQGPLLGAFEGGRWRGFHFDVGAA

SEQ ID NO: 938990 - protein, 117 aa, Homo sapiens
KSFAFVCPWYLLFYLVKYIFAVAHRLFFPFPLPLFAYRWVARVFEISPFYAFDNNGLSVADAYYRHEIAITCLVLEDLGIQSTPLVLMAIEVLRRLRTYRCLSVEIEDVNPAKTVNI

SEQ ID NO: 938991 - protein, 69 aa, Homo sapiens
RPLLLLNSRPYDSHVQGLPDRCDHTSSRVPPYRLVASAAIQVDIPHVPSSAPTSSRPPDLCDPTSSGSP

SEQ ID NO: 938992 - protein, 109 aa, Homo sapiens
ASELSMSGAVLSLPTSCLVAKTARCTDSVIILNRCSSISMSGISSMNALCLCLVSLCHSCCEVEVRVEETFYYVKLYNTCEGNSIWFMRSVVFLQVSSKMRHRQGFGPH

SEQ ID NO: 938993 - protein, 74 aa, Homo sapiens
THPPHDKLFPVSVGFRMSDYVLEESWLSASIFLPSLQCLLISLSRERRSQSSESESTTLLSTFVTVVSTDTFYF

SEQ ID NO: 938994 - protein, 69 aa, Homo sapiens
IIPPNKNVSKVEIRPYVIDYIPDLQIALETHPALGGSHYRRAATPPGRDLSSAPSGTPLTALNTDPAGA

SEQ ID NO: 938995 - protein, 80 aa, Homo sapiens
LSYREKEIFDNQLLEERNRRLSVREQPAVLSAGLAVEAPPVCMSLSEDGGLEGARLCLEPVCAFLCVAILISILREKPIW

SEQ ID NO: 938996 - protein, 61 aa, Homo sapiens
HTENDNCSQDVRPEESCGEMSEQQVGSDEAEQLRSGLFQLSSSSAWQPSHSTGPRAARLPR

SEQ ID NO: 938997 - protein, 77 aa, Homo sapiens
PQTFAGPIIGPGGTASANFAANFGAIGFFWVEEMLDIAINRSSLSPVELSLDSSKHFEEHILIKCSDKLFLSCYAFS

SEQ ID NO: 938998 - protein, 135 aa, Homo sapiens
GTLLGVPGEQKLEKGSLVLTGAYTILRPESPAPLHGGLSQGCVIAEPSSAPLRTLLSRAPSPLRRRDSLAGRLSETQGAELCAAGSGLGRVSDPRPWFLKHGPAPLSSSSPEAQDPKKGQCLVPSSSPCCASGAA

SEQ ID NO: 938999 - protein, 31 aa, Homo sapiens
NLKILQLISVNNFMIIPVRLAKGTKVEIKRT

SEQ ID NO: 939000 - protein, 31 aa, Homo sapiens
PAHSQIVIEALALVGKRRCEPSSTSGGSQVQ

SEQ ID NO: 939001 - protein, 72 aa, Homo sapiens
MRSPLFQHFLFGGPCGASSKAAASGKFGVINETCGNNRLRSVATAEGESTGAAFCQHNGVEYHVLDLITLQP

SEQ ID NO: 939002 - protein, 75 aa, Homo sapiens
STKTKMKRRAVCGLDCGFWIETVGGGSWTFQSPFRCKGKFGIRRLEGFEGPLAALYFFRNSWAIINGVIYCKKKV

SEQ ID NO: 939003 - protein, 44 aa, Homo sapiens
GQGQARQGDESHSPPGPAAAVSGAPNPRAALPGPEIVVAEEQRP

SEQ ID NO: 939004 - protein, 135 aa, Homo sapiens
CQIQWGLSAQPWPRALALVYLPGQAKRLYTGLGKQWSEHKMPCAAARGLAHPAGFDPPKSYRTASGFCALFSSLNDIIYGLSRHSLPKWRSCAPSCPHPSQVPQIIGAQAEVKSLGPCFRRSWTLGKTCDPFLLE

SEQ ID NO: 939005 - protein, 38 aa, Homo sapiens
DFFLKLLDGAILGHGESLLSLRGLHGDFHDFGSAEQRS

SEQ ID NO: 939006 - protein, 71 aa, Homo sapiens
RVITNRERQPGSVYVVHVKDANGSSFATRLSNIFVIGKGDKPWISLPRGKGIRLTIAEERDKRLAAKQSSG

SEQ ID NO: 939007 - protein, 130 aa, Homo sapiens
MPQNTNPSVYLRRGGAGPSVLICSTGPEVFLPRPGVGRNVKSCLPGLPLNSYPKRGRRVVVPTRFFTDREINFLVSNKADPFFDGGGGVEKKNEIPLLVFPPRGDSGGTYGRGERLGGVVPPPPPPPLFF

SEQ ID NO: 939008 - protein, 37 aa, Homo sapiens
MSTQFSSRLHTLGGARRRSSSVKVTSGEGSEQQPQVS

SEQ ID NO: 939009 - protein, 90 aa, Homo sapiens
SATPAWCKYKLIERQCNYTYSQHLYVVAKPEVFKSAVSDCYVIFGEVKSEDMSAFAQAQAAQMLRPRASVSDDAGTASSAPSFNLIDLTS

SEQ ID NO: 939010 - protein, 35 aa, Homo sapiens
VWLIKPPIGLVLLLTVQKPNHLCSGGGGGPGCAGR

SEQ ID NO: 939011 - protein, 100 aa, Homo sapiens
MVPRAPRGPPRQWIAAPHRSLALALTPASRLRVAARDHVHAAVHDHDDPMGRYEEHTEEKTASPPPRDTQKLLQGTGSFQPAGAYGHHQATTQSRARMAA

SEQ ID NO: 939012 - protein, 125 aa, Homo sapiens
QNEYRYGVDIGSTGACNRWNAQSVSFSSTSSRAGIVGTEIDAFGNHGVFALYQRTTVLVRSRSTVGDAARVGRALASPAAIANPDPKQATEWEAVGDRLRFRAGQPYDAASEFVFASPHVACDPE

SEQ ID NO: 939013 - protein, 115 aa, Homo sapiens
VFKPDGPSRFRKAYKPEQPLVRLRASYIGRPLECSKMRMGTLTTMDCSQLLQDWLGSPKSITAPDWAGFGPIHLNEIQCTGNEKSIIDCKFNAESQGCNHEEDAGVRCNTPAMGL

SEQ ID NO: 939014 - protein, 79 aa, Homo sapiens
KQSKARDNPERNASCLADSQDNGKSVNEPLTIEYPLEQNASLQNSNADRPRSPGNEEEMADHEECWSGKDASEVIAAKT

SEQ ID NO: 939015 - protein, 44 aa, Homo sapiens
MFLLLLCPDIATSRPVNPEVPLNHRSLQSLSAEPHCLQESREFQ

SEQ ID NO: 939016 - protein, 100 aa, Homo sapiens
QEQGGGPATRHADSHGPFCFGFFLKNPFRFLGAILWASWGCSWVQPWGYRLGSEKAGRSLGLESKPSPSHQSGFHKTFHSDYGQLGFRQFPTEQQTEERD

SEQ ID NO: 939017 - protein, 91 aa, Homo sapiens
MKTCWQILEIESTTQIDIIRQAYLARLPLCHPETDPQGFKALRQAYEEALRLAVNPVEEADDEEKDTAVTPSWSGVALPSIIPVVVDSPSA

SEQ ID NO: 939018 - protein, 83 aa, Homo sapiens
MTNAIQLKAKAGSNKFSSYSRFPRVTWYSSVSQTVFPGTLSHRLAIGEVREEDFCVKKSWQTLGLVKLNRVLLLNRANKLTNK

SEQ ID NO: 939019 - protein, 81 aa, Homo sapiens
EAMAFEISNGSHELLSQGQKQIFIQTSDGLILSPPGTIVSQEEDIVTVTDAEGLCCRMAPLKGFLLKVLKPPPPVGQGPSH

SEQ ID NO: 939020 - protein, 97 aa, Homo sapiens
GAPRGGGAPLVPPGAVIGYKTASLTCTSTAHRAYWCRRFHDFRSSAVARARQPRPWPNTPKPGDILLPRPRPEPPAAPRPRQRRSEAAWSDRDQGAV

SEQ ID NO: 939021 - protein, 126 aa, Homo sapiens
HEVRHSNCRGAASRETFNPGDLQLTSKLRIALLQLRGARRSLRPAAAVSHAPKYAEGLLPQLPLGPAVTQRKHGAPSQRVPSPSHRRGFSSRPWAIFSSDGWQGRGGRGRDPREAVPMWVGEGGGR

SEQ ID NO: 939022 - protein, 123 aa, Homo sapiens
ETGFYSVTQAGVQWCNYSSLQPQTPGLLLPWPPKVLGFQVAPLHPADFVTGFYSVNQDECSIAFIAHCSLKLLGSSCLGILSSWDYRYVPPCLANFKIFYRDGVLLCCPAGLELLGSGGLLEP

SEQ ID NO: 939023 - protein, 100 aa, Homo sapiens
SGWRLLEGMHRFRHAPHPVLRPTAGTSTVLSPRQGSWPVMALTGTAIRRLIIQAITQAAAMAIKVATIRVICPRMVASCSAVVRDHRILSLHDRILDSRT

SEQ ID NO: 939024 - protein, 87 aa, Homo sapiens
STAYIHQVSVQKEALSFEDGQPVQLKMAAWLTYSAHPEKSMTPAPWKPSNWKLDPLPTFTSLCCAIGVHHPVRTYRVGLGGPDTTVN

SEQ ID NO: 939025 - protein, 51 aa, Homo sapiens
AAAHATLPSASWFSCLPRAVCWVKGIPTILGPFPFGAQPCALGSNRWHPLV

SEQ ID NO: 939026 - protein, 143 aa, Homo sapiens
MKKFTFIDSVSLLLSLLLGVAMGRQDLGSARSKRPAVNNYFPRRHCSLAGSLGELLDPSGGHLRLLLVVLLPSLRVVLLWGRSGLLGLLADLFVILFPGRSRVLSVLWVGAEGLTLSRWAQGPVRGRGRGPGAAGSSVSSRRP

SEQ ID NO: 939027 - protein, 46 aa, Homo sapiens
MPRSLPEIVAATVEIVDKVLEIPPPRPPIPFLTSLFHKYKPQLEDE

SEQ ID NO: 939028 - protein, 46 aa, Homo sapiens
FMADLQKTRKQKGWNRHLTEWGGRRLLAERERGLWRCRSTRLQESQ

SEQ ID NO: 939029 - protein, 42 aa, Homo sapiens
QQEPQVGPELPLGEEAAPCHERGAVVAATPAPASPPAVLRTR

SEQ ID NO: 939030 - protein, 71 aa, Homo sapiens
PPGSSSGQGTMVSLAAPDPAIWASTTWSTELRTQMSGPDHPDPSVREQQGRRVKKFHLQTQFTSPAHLCSP

SEQ ID NO: 939031 - protein, 69 aa, Homo sapiens
TGQSGKPPATWKSQTRLSAATCRSHAWLLGTWESFQNPRRQPRACRYPRLPHLQASASKMGSHQFFLPQ

SEQ ID NO: 939032 - protein, 116 aa, Homo sapiens
RRPPLHSSLTLLLRLECNGATSAHCNLRLPDSSDSPASASPVAGTTGGNHHAQLIVFVFLVETGFHHVAQASLKLLTSGDLPASASQRAGITGVSHRARPELFVKASEAVGVEKEQ

SEQ ID NO: 939033 - protein, 150 aa, Homo sapiens
MAIRLDRASAAASEGMARGARAPWTFGTERPGKSVGEMSAVPPTQLQIGRGRRSTSSCTEEPSRSGACSGSGPTLGACCRPTPAQPPAGILHQRPPLLTARAGPGLGSSHAPRPQHRKASAASTDTGPRQAVASRDSIVRAHASMQTSGR

SEQ ID NO: 939034 - protein, 171 aa, Homo sapiens
MPSDCNAACIVLAERLVLSHLHRTATASPPGRPPSSPRCCKSSETYPRQVRGFGALGGGGFSQEPRICQSPHKGRGVGKAPPCSQREDCPYFSGPHLPPPPALFPPGSPGGFPRTLRVEGAAYVGWRGASCLLDAQTPTPFTLSSRLMAMREKLRATRAHSSMLVPHLQTL

SEQ ID NO: 939035 - protein, 65 aa, Homo sapiens
IKELGDHVTNLRKLGAPEFGLAEFLFEKHPLGDSDNESSPPGYFPHSRGVISLVTKAVQACGGFL

SEQ ID NO: 939036 - protein, 63 aa, Homo sapiens
INHMPSPEGLRELVRDPVIRTPHTGQLIDGHGHESLDLLEVSPASAWSTGPVICESQIQNQEL

SEQ ID NO: 939037 - protein, 70 aa, Homo sapiens
NKWEVVGNMAVSRYYFGCCEMQGLIYVIGGISNEGIELRSFEVYDPLSKRWSPLPPMWNQESISWCGCTQ

SEQ ID NO: 939038 - protein, 145 aa, Homo sapiens
PPSHSSVAGLTAPAYRVTLQSSRAPSLKDWLRFTNTTFHCQLLSGPCLAHPPCISAHVAEKPDDPPELPSLRVCAEALTLGARTHNYGTCAAACVYFAISGLSWSKMGRLEGWEVFANTQGVSPVLPGPPALQNASRNKFCVCVK

SEQ ID NO: 939039 - protein, 126 aa, Homo sapiens
RFVEKQNVRFMHQRTGHASRCLKPNGSSSVAWERYFSAERLLMREIFSFCARPRKPYTPEKKREILFDRQVTVERKFLRHIAEMGALTGTLFQIHPQHQRLAGSRHQQTAHHLKGGRFTRPFAPAN

SEQ ID NO: 939040 - protein, 68 aa, Homo sapiens
ILLNHTFNETQIEWFRAGSALNRMKELQQLRSQAGCPDPLWTLLDVTFVTGPCASSEPNLAVQHDLLL

SEQ ID NO: 939041 - protein, 30 aa, Homo sapiens
SETKINSLAHLEKKEPGGGIYSGFKRQIIK

SEQ ID NO: 939042 - protein, 143 aa, Homo sapiens
ATLPYHLVDCPGAGDSQPVHVFPRRVPFRNIIPGNFDSGRGMGRWDGADTTTGDADFNPDHRRKELPLFLTRGGRMNGGMFSLSGGMHVERKWSSSEPNFFNPQAPPKPGPPLLGEAAPASRRSGGARSPESHNRAGSESGRP

SEQ ID NO: 939043 - protein, 67 aa, Homo sapiens
PPPFPPLLGGGGGKNPLAPGFFFSGGVFFPPPPPPGGQGGAPPPKNFFFKKNFPPPKFFFGGGVFFR

SEQ ID NO: 939044 - protein, 132 aa, Homo sapiens
NSAAFQTCLPSVIQSETNFTSSSGACLLLPSGSNRMHRRIDCQHGRPGPPTEQLREPEVAGRRDCEGAGSSPRPEVLRGREPAGPRSARGRKRRAASGGPQSLGPGETAGLKVPGEAWVPQPLGICSRSALE

SEQ ID NO: 939045 - protein, 144 aa, Homo sapiens
QPAVNDLSLRHHSKEEAKYFLTLSSWVTPPHCLQADILFHASPPCSTSHQPSKSSSPHGTRLRLRPACSGRRTAPVGGLLPHRRPRHRPLLLALEKQQRGPVNKLFPAQAHQAHACNQLGRRQCGQHAQQRRLGQLVQVSGGGR

SEQ ID NO: 939046 - protein, 85 aa, Homo sapiens
ESRILMGFQCLVQGVRIYTAWLLYCLKGNETSRTKWKPSSKNSIQTQDAGLTQKSQGNSPKLWELPPDVPLNQAPSCLNLLFTHT

SEQ ID NO: 939047 - protein, 123 aa, Homo sapiens
GPEGRGVCDPQLGGGEERNGGSHPRAGTKTPGETQIQGHWNQFSAPLPQGISPVSQHWATWALYNLVSVYPDKNSPLLIKEGGIPLLRDIIKMATARQETKEMARKVIEHCSNFKEENMDTSR

SEQ ID NO: 939048 - protein, 91 aa, Homo sapiens
HKISTAKVGNQPSEGSNLVRPTSLPLLPKHGRKPGTPQAPTAAQGAGPQTRVPGLPCPLSESLASSSPLTFLETLEYFMVPPPHLPPPSVG

SEQ ID NO: 939049 - protein, 140 aa, Homo sapiens
ARSRSWLFVDDAACAGPHWNVRSVPSWSLVPPPSRRPRPGRRPHGPRIAGPGSRKARLHQPLDPRGEGLGFSGGHGFRSPPPSPLRSHRFEIQNSVLGLLQQRHELGSEHPRLFSCLLPAARHCRCGGGCGVALRRSAAA

SEQ ID NO: 939050 - protein, 119 aa, Homo sapiens
WWAEIALPLAIRAWCLWLLATALKPDTWVHGLGTLQGPRHTVSSMVAARVCAGPGILKSEERPGGQGSYQPGSCAWCRGVAMAMLDEGGLDFPQLPKTSGSRGGTEPSPRPCGSQDALL

SEQ ID NO: 939051 - protein, 213 aa, Homo sapiens
AWSRPRYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKSCDTRSFIYSRLQYYEPGKTKIHVWEWREVV

SEQ ID NO: 939052 - protein, 249 aa, Homo sapiens
QSHRLSAKSPDEGMKQNLHAEVKSPGERPSLQAERRKQMSPEKAKSPEKAKSPEKAEAKSPEKAKSPVKAEAKSPEKAKSPVKAEAKSPEKAKSPVKEEAKSPEKAKSPVKEEAKSPAERPSPTADRTEAKTPEKAKSPVTGRRPRPLTRRSQKRTEVKVPSEGRTDHSPQEVHSHKQPPKEGHSDEKATDTTKHSNTRQTNKHARRPPSNGHQTQRPKEEGHTTATWRTATRPKKSRVQNNEANKTKE

SEQ ID NO: 939053 - protein, 105 aa, Homo sapiens
SGDKPPGGEPKNLGGTPGRGPNPRRGPRTLSKEPCKPKAEKRENPPARVLKHAALPEKAPEDKAPPGEIRQGAKEHPGQPKRTQRESPSSRIQSNTICSLGLSLM

SEQ ID NO: 939054 - protein, 78 aa, Homo sapiens
KFLSTQGSLWERLAYGITPENEHHLVAQRDIQTVPDENETREKESYQLLPDILLNRNPWSCLNSQKELPLSWEPVPAI

SEQ ID NO: 939055 - protein, 376 aa, Homo sapiens
FQNFSLPKNRSWPRINSATGQYQRMNKPLLDWERNFAAVLDGAKGHSDDDYDDPELRMEETWQSIKILPARPIKESEYADTHYFKVAMDTPLPLDTRTSISIGQPTWNTQTRLERVDKPISRDVRSQNIKGDASVRKNKIPLPPPRPLITLPKKYQPLPPEPESSRPPLSQRHTFPEVQGMPSQISLRDLSEVLEAEKVPHNQRKPESTHLLENQNTQEIPLAISSSSFTTSNHSVQNRDHRGGMQPCSPQRCQPPASCSPHENILPYKYTSWRPPFPKRSDRKDVQHNEWYIGEYSRQAVEEAFMKENKDGSFLVRDCSTKSKEEPYVLAVFYENKVYNVKIRFLERNQQFALGTGLRGDEKFDSVEDIIEHYKN

SEQ ID NO: 939056 - protein, 53 aa, Homo sapiens
NDLTYFVLAAETFFDEWIHTLNILQISPEGPLGRRSTELTDLGLDSLDNSVTC

SEQ ID NO: 939057 - protein, 32 aa, Homo sapiens
YFCASSQEAVSMNYGYTFGSGTRLTVVEDLNK

SEQ ID NO: 939058 - protein, 34 aa, Homo sapiens
YFCASSHLAQGAYPGNTIYFGEGTWLTVVEDLNK

SEQ ID NO: 939059 - protein, 116 aa, Homo sapiens
MVMQPSLTVWALSIGLQRGVVTRGDQATFLLFAFSDVSKGIFALDISREGEGKGALDLGGEATSIGLWQGVVTHWDEALAASFLPVAFSHLSNGILDISKDEGEGDGGLFSATGPS

SEQ ID NO: 939060 - protein, 189 aa, Homo sapiens
MNGMEPKWNGMEWNGKEWNGIEWNPPDCRGMEWNGMEWNGMEWIQPEWNGKEWNKPEWIGMEWNGMEWYGIEWNGKKWNGMEWNGTEWNGKEWNGMEWNRMEWTGMEWNGMEWNGINLSAMEWSGRECNERKQHEWNGMNECKGIEYNQSECNGMEWNGMEWNAMEWNGMNEMERQGMEWNQPECNGME

SEQ ID NO: 939061 - protein, 1272 aa, Homo sapiens
FIAPRNESNNLASDTFITHKKSSFIKNINQGSSSSVIESDEECAEIVKQTHIKPTKIVSLKKKVSKEIKKDQLKKENNHGIIDSLDNDRNSTVENIFQEDLPNDKRTSVSDVLLSFGRSSGKRTSDTDEIAATCTINENVIKEPCVLLTECQFTNKSTSSLAGNVLDSGYNSFNDEKSVSSNLFLPFEEELYIVRTDDQFYNCHSLTKEVLANVERFLSYSPPPLSGLSDLEYEIAKGTALENLLFLPCAEHLRSDKCTCLLSHSAVNSQQNLELNSLKCINYPSEKSCLYDIPNDNISDEPSLCDCDVHKHNQNENLVPNNRVQIHRSPAQNLVGENNHDVDNSDLPVLSTDQDESLLLFEDVNTEFDDVSLSPLNSKSESLPVSDKTAISETPLVSQFLISDELLLDNNSELQDQITRDANSFKSRDQRGVQEEKVKNHEDIFDCSRDLFSVTFDLGFCSPDSDDEILEHTSDSNRPLDDLYGRYLEIKEISDANYVSNQALIPRDHSKNFTSGTVIIPSNEDMQNPNYVHLPLSAAKNEELLSPGYSQFSLPVQKKVMSTPLSKSNTLNSFSKIRKEILKTPDSSKEKVNLQRFKEALNSTFDYSEFSLEKSKSSGPMYLHKSCHSVEDGQLLTSNESEDDEIFRRKVKRAKGNVLNSPEDQKNSEVDSPLHAVKKRRFPVNRSELSSSDESENFPKPCSQLEDFKVCNGNARRGIKVPKRQSHLKHVARKFLDDEAELSEEDAEYVSSDENDESENEQDSSLLDFLNDETQLSQAINDSEMRAIYMKSLRSPMMNNKYKMIHKTHKNINIFSQIPEQDETYLEDSFCVDEEESCKGQSSEEEVCVDFNLITDDCFANSKKYKTRRAVMLKEMMEQNCAHSKKKLSRIILPDDSSEEENNVNDKRESNIAVNPSTVKKNKQQDHCLNSVPSGSSAQSKVRSTPRVNPLAKQSKQTSLNLKDTISEVSDFKPQNHNEVQSTTPPFTTVDSQKDCRKFPVPQKDGSALEDSSTSGASCSKSRPHLAGTHTSLRLAQEGKGTCILVGGHEITSGLEVISSLRAIHGLQVEVCPLNGCDYIVSNRMVVERRSQSEMLNSVNKNKFIEQIQHLQSMFERICVIVEKDREKTGDTSRMFRRTKSYDSLLTTLIGAGIRILFSSCQEETADLLKELSLVEQRKNVGIHVPTVVNSNKSEALQFYLSIPNISYITALNMCHQFSSVKRMANSSLQEISMYAQVTHQKAEEIYRYIHYVFDIQMLPNDLNQDRLKSDI

SEQ ID NO: 939062 - protein, 85 aa, Homo sapiens
KNLTCSKHGVRVVTSKHYSLLPKPIHDFLAIIVRRRVSAFFPFYRSDLSLHGPQDVGYLVGLDHKVKVNHLQMTIRGVGRSRKEI

SEQ ID NO: 939063 - protein, 922 aa, Homo sapiens
MIDLSFLTEEEQEAIMKVLQRDAAEAIMKVLQRDAALKRAEEERVRHLPEKIKDDQQLKNMSGQWFYEAKAKRHRDKIHGADIIRASMRKKRPQIAAEQSKDRENGAKESWVNNVNKDAFLPPELAGVVEEPEEDAAPASPSSSVVNPASSVIDMSQENTRKPNVSPEKRKNPFNSSKLPEGHSSQQTKNEQSKNGRTGLFQTSKEDELSESKEKSTVADTSIQKLEKSKQTLPGLSNGSQIKAPIPKARKMIYKSTDLNKDDNQSFPRQRTDSLKARGAPRGILKRNSSSSSTDSETLRYNHNFEPKSKIVSPGLTIHERISEKEHSLEDNSSPNSLEPLKHVRFSAVKDELPQSPGLIHGREVGEFSVLESDRLKNGMEDAGDTEEFQSDPKPSQYRKPSLFHQSTSSPYVSKSETHQPMTSGSFPINGLHSHSEVLTARPQSMENSPTINEPKDKSSELTRLESVLPRSPADELSHCVEPEPSQVPGGSSRDRQQGSEEEPSPVLKTLERSAARKMPSKSLEDISSDSSNQAKVDNQPEELVRSAEDDEKPDQKPVTNECVPRISTVPTQPDNPFSHPDKLKRMSKSVPAFLQDEVSGSVMSVYSGDFGNLEVKGNIQFAIEYVESLKELHVFVAQCKDLAAADVKKQRSDPYVKAYLLPDKGKMGKKKTLVVKKTLNPVYNEILRYKIEKQILKTQKLNLSIWHRDTFKRNSFLGEVELDLETWDWDNKQNKQLRWYPLKRKTAPVALEAENRGEMKLALQYVPEPVPGKKLPTTGEVHIWVKECLDLPLLRGSHLNSFVKCTILPDTSRKSRQKTRAVGKTTNPIFNHTMVYDGFRPEDLMEVCVELTVWDHYKLTNQFLGGLRIGFGTGKSYGTEVDWMDSTSEEVALWEKMVNSPNTWIEATLPLRMLLIAKISK

SEQ ID NO: 939064 - protein, 393 aa, Homo sapiens
MAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGTPIMNLLVITLFPGQLDCTIDTQKIHFVEDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 939065 - protein, 845 aa, Homo sapiens
MILPNFFFPTQQSQWQASGQKGFSESSSGQCLTNCICRCFLGKLVPWLDMFREHWIKQELNRSPCSRTSQSFYYANSHMSLQEGNTINSSPKEHFFFFEIGSCSVTLAGVQWYGRGSLQPQPRGLGRFSRLGLRSGWDCRPNHLFFFFFLNYGDGESCYVARAGLRFLGSGDPLASASQGGVVCVSRCARLQRTFLKIGGAKDHTLRNTDLGLPTVQRNVACPILYSTPDDLQEVLLNSSQGSNLNSSQQDKEAAFRKDPGAVVLEDDPSLMANLECSREHWSLDDRAKGSDSIFLTWQEAGNKTEIRKRQAELVFSLTFELPAVLLTKNKKAGLKTTKVEKYKVTEVSSLQEDSYNLSPKFFLYKAQIFTGKCSPNDPFSVFVYSCISPMFIEHLLSVWPVVRNAHQLPGSKAILQFSDVYLKSVNPLASPLPPPLQLDTYHFPTWYTDLAQLGRRNGQVFFTTLLNLAKNLASWVRAAWEPAKPEETSLLCLGPSISAGVKNLPVLFLTSGTVRQKVLRLKSRKIQAVCGAVKTTDHRTDTPAQILALPSCSGVTVGRIGEIARTLESGGPAQIWLHYVRYILGKLPSLSQLQYFHLQSGMRRTRMITLIISDMYVYSKEVEFITCIYVYKDLKIAVNKYVAAFIFNSSEVPIFFICKVEIGVPTSMSGYESLKEIMLYKVLAYKNKSINVKILSNGYYFCSSSISISETKLLYLFGLQFPHLSSERPGSDGFSSVTAHGFPALGPTRPRGYLQQSCQWPLSLGQPKSTSNSPISLCTVHETRNGEGKMPCLCKCYLDLCCSINMAATNHRKLKRNKSKLRYAMSVKYIMDVKNLILKILRSY

SEQ ID NO: 939066 - protein, 1408 aa, Homo sapiens
GRTSLSLGLLVADFGAMVNNPHLSDVQFQTDSGEVLYAHKFVLYARCPLLIQYVNNEGFSAVEDGVLTQRVLLGDVSTEAARTFLHYLYTADTGLPPGLSSELSSLAHRFGVSELVHLCEQVPIATDSEGKPWEEKEAENCESRAENFQELLRSMWADEEEEAETLLKSKDHEEDQENVNEAEMEEIYEFAATQRKLLQEERAAGAGEDADWLEGGSPVSGQLLAGVQVQKQWDKVEEMEPLEPGRDEAATTWEKMGQCALPPPQGQHSGARGAEAPEQEAPEEMLGHSSCSSPSRDCQAERKEGSLPHSDDAGDYEQLFSSTQGEISEPSQITSEPEEQSGAVRERGLEVSHRLAPWQASPPHPCRFLLGPPQGGSPRGSHHTSGSSLSTPRSRGGTSQVGSPTLLSPAVPSKQKRDRSILTLSKEPGHQKGKERRSVLECRNKGVLMFPEKSLSIDLTQSNPDHSSSRSQKSSSKLNEEDEVILLLDSDEELELEQTKMKSISSDPLEEKKALEISPRSCELFSIIDVDADQEPSQSPPRSEAVLQQEDEGVLPENRGSLGRRGAPWLFCDRESSPSEASTTDTSWLVPATPLASRSRDCSSQTQISSLRSGLAVQAVTQHTPRASVGNREGNEVAQKFSVIRPQTPPPQTPSSCLTPVSPGTSDGRRQGHRSPSRPHPGGHPHSSPLAPHPISGDRAHFSRRFLKHSPPGPSFLNQTPAGEVVEVGDSDDEQEVASHQANRSPPLDSDPPIPIDDCCWHMEPLSPIPIDHWNLERTGPLSTSSPSRRMNEAADSRDCRSPGLLDTTPIRGSCTTQRKLQEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATSVDGSDSSLSSQSSSSCEFGAAFESAGEEEGEGEVSASQAAVQAADTDEALRCYIRSKPALYQKVLLYQPFELRELQAELRQNGLRVSSRRLLDFLDTHCITFTTAATRREKLQGRRRQPRGKKKVERKLMGPSRPHPNLPSAAPTPAICREDLGHPAWVRPPQAFLGLGTTSALRCDDDHSPIQGFLLWALLSRVALEHVTHWIYRLQPLPLSVLTVGVLAQAVGLPGHPLYHLHHCRHPQGEAPGQEAAASGQEEGGAELMGPSRPHPNLPSAAPTPAICREDLGHPAWVRPPQAFLGLGTTSALRCDDDHSPIQGFLLWALLSRVAFGACHPLDLQTPAPSSVRAHSVSPFLVFFFFFFLRQSCCVT

SEQ ID NO: 939067 - protein, 1207 aa, Homo sapiens
VPKNAKEKEVPLEEEMLIQSEKKTQLSKTESVKESESLMEFAQPEIQPQEFLNRRYMTEVDYSNKQGEEQPWEADYARKPNLPKRWDMLTEPDGQEKKQESFKSWEASGKHQEVSKPAVSLEQRKQDTSKLRSTLPEEQKKQEISKSKPSPSQWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETAPGNHHFYFLILKMTALAANYHPDGTIQVSNGSLAFYPAQTNVFPRPTQPFVNSRGSVRGCTRGGRLITNSYRSPGGYKGFDTLEDWKQDTPKSKAGYVQEEQKKQETPKLWPVQLQKEQDPKKQTPKSWTPSMQSEQNTTKSWTTPMCEEQDSKQPETPKSWENNVESQKHSLTSQSQISPKSWGVATASLIPNDQLLPRKLNTEPKDVPKPVHQPVGSSSTLPKDPVLRKEKLQDLMTQIQGTCNFMQESVLDFDKPSSAIPTSQPPSATPGSPVASKEQNLSSQSDFLQEPLQAAIPPGKQPSSLASPNPPMAKGSEQGFQSPPASSSSVTINTAPFQAMQTVFNVNAPLPPRKEQEIKESPYSPGYNQSFTTASTQTPPQCQLPSIHVEQTVHSQETAPGNHHFYFLILKMTALAANYHPDGTIQVSNGSLAFYPAQTNVFPRPTQPFVNSRGSVRGCTRGGRLITNSYRSPGGYKGFDTYRGLPSISNGNYSQLQFQAREYSGAPYSQRDNFQQCYKRGGTSGGPRANSRANCFIMRNSLLLIKQQGGVILLQVSSPERDNETFNSGDSGQGDSRSMTPVDVPVTNPAATILPVHVYPLPQQMRVAFSAARTSNLAPGTLDQPIVFDLLLNNLGETFDLQLGRFNCPVNGTYVFIFHMLKLAVNVPLYVNLMKNEEVLVSAYANDGAPDHETASNHAILQLFQGDQIWLRLHRGAIYGSSWKYSTFSGYLLYQD

SEQ ID NO: 939068 - protein, 464 aa, Homo sapiens
MAVTAGADFCYAIEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 939069 - protein, 741 aa, Homo sapiens [sequence omitted]

SEQ ID NO: 939070 - protein, 585 aa, Homo sapiens
SITSAITPTNTVTSMTTMTSPPTTTNCFTSLSSKILSSTPVPSTEAIISGTTNTIPPSTLVTTLPTPNASSMTTSETTYPNSPTGPVTNSMSKISYPASMTQTSSTATSLPPNSPWGSTTEIAKSPTTNLVTNAIKATSHTTTTYTSSTIYFTASTYTSAMTSVSLGTMVTSTSMTPSTVSTSIPTSQPKTVNSSSGGITGSLPMMTDLTSGYTVSSMSAIPTTVIPTSLTVQNTETSIFVSMTSATTPSGRPTFTSTVNTPTRSLLTSFPTTHLFSSSMSESSAGTTHTESISSPPATTSTLHTTAESTPSCTTTTSFITSTTMEPLSTIVATTGTVKTTVTSSTATFRETTTLTSTTDISTESLMTAMTSTTRLTSAITSKTTLTSLKTTASRPTANSTLSSLTSSILSSTLVPSTDMITSHTTNLTRSSPLLATLPTTITRSTPTSETTYPTSPTSTVKGSTTSIRYSTSMTGTLSMETSLPPTSSSLPTTETATTPTTNLVTTEITSHSTPSFSSSTIHSTVSTPTTVVSSGPPTSGTIVTSITVTPSSLSTDIPLTTPTTITHHSVGSTESLLTATDLTS

SEQ ID NO: 939071 - protein, 162 aa, Homo sapiens
SSWPSPVLYPWGASPSAFFFLGLFWGHSWALQGPRFFLGILCTLFAVSSLPASISFSRRSPPHLRSRRDLRPILFRVLASLSLTLRDSLETLGPEHMLLIPGPCPFLHQPPISCPANTIVVFWVPPPASRARSCLEQPLLSVASLPSFVLRCFSSMGYIISL

SEQ ID NO: 939072 - protein, 49 aa, Homo sapiens
IKQPQSGQIKWITGPRGESRTESQKLSCDYTELQYYPKQDVRYTEKKYI

SEQ ID NO: 939073 - protein, 59 aa, Homo sapiens
LLDYKKRIIQAFQGSLCLDFKVQATLCGFVTIKSSSPNMAASKGRLRMPFPHYLSNKGS

SEQ ID NO: 939074 - protein, 293 aa, Homo sapiens
IGNTASGVSSSEQKIDGLSNSGQQKKSMLPVSFTSAALRISPMMPWASMALWGSFLKSTIATKLRIKAHAAINKQGAAHHVFGGITGQPDHRIGHVFHVAYAAVGNQLEQFFFSRAFGGRTVDCRANRPWRDAIDADALFTDFLGEGAHQHLHTALGGCVIHMPGPRDDLVHRTHMDDFAGRPPKPVANALALKIRTAARAHRKLAGEVDPITVFQSSKVMSTKLASFAGPNWPPKCPGDRRAQGSGRTGAPRSVSLETSRRWQLPAPPCFNFPTKASAGPPGNFITPRPQPP

SEQ ID NO: 939075 - protein, 176 aa, Homo sapiens
DESVMVVEDDPAVRMLVLNVLDELGYTVHPAADARTALPLLESSLRIDLLVTDVGLPGMNGRQLAEVARQHRPGLKVLFMTGYAEKAAERQGFLEPGMDLIAKPFTLDALANRVRDMIGQTSCSSGIIPRPPHAPRFQGNQSMKAQARHILVKTAEEAEQLRLRIVKGEAFDVLAK

SEQ ID NO: 939076 - protein, 201 aa, Homo sapiens
PLHNGKTGPAGRAAPPVTVVEASLCRGQCRQVDEVINFVGEVVIASAGANLLARGSSNGPLQESTSVVSGLMEEILDGALHLRMIPIGDTFNRFRRVVRDVSQELGKDIEPLISGADTELDKTEVEKIGDPLMHLLTSCDGSRIESPSLREAAGKPAKGRLQLNAFQDSGSIVLEIADDGAGLNRDRILQKAVERGLVPVG

SEQ ID NO: 939077 - protein, 61 aa, Homo sapiens
DLRCPGVVSSLGSGNTDSDCSCLWVQCRTCWSLGLLPQPALRNLGRRENLKLPNSTLRLKN

SEQ ID NO: 939078 - protein, 59 aa, Homo sapiens
MKGTGTQKYNGQGIHQTSSKLQECLGQKRLLRDAGLLIGIKAEMDRATAVHALTAGCCE

SEQ ID NO: 939079 - protein, 104 aa, Homo sapiens
SFDCEWNVVACLDRMSVLCQMSCQSSSSLTRSWLPDRYPRWLDQDDRSSRSGSLDPLDCGPTTVADRSERAIQQAGRSVLVGLQQIGSIAISSVDPVSLVYLCR

SEQ ID NO: 939080 - protein, 236 aa, Homo sapiens
TPVASSAISILSTTPVDNSTPVTTSTEARSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPADSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVST

SEQ ID NO: 939081 - protein, 245 aa, Homo sapiens
LSTIPVDSNTPLTTSTEASSPPPTAEGTSMPTSTPSEGSTPLTRMPVSTTMVASSETSTLSTTPADTSTPVTTYSQASSSPTTADGTSMPTSTYSEGGTPLTSVPVSTTPVVSSEASTLSTTPVDSSSPVVTSTEGTSSLTPTEGTSIATSTPSEGTPPLTSMPVSTTTVASSETNSLSTTPADTRTAVTTYPQASSTPTTADGTSMPTSTPSEGSTPLTSMPVSTTTVASSEINSLSTTPADPS

SEQ ID NO: 939082 - protein, 73 aa, Homo sapiens
SFYRLARTSQPETGVRETQTATDERQPRYDQQHQAKKPKEQSDLTAAARSHSPEHSSTDTTTAIASHRQHPTH

SEQ ID NO: 939083 - protein, 208 aa, Homo sapiens
MIQLFFQDVLPNCCASKMEKYCCESNILFKMMIFVDNAPTHPHFIGDLHPNIKVLCLLPYTTSLIQPMNQGVVAVFKAYEKILRRIFAQAIAATEKHREDTDAILEVYNSYDCIKNLAWAWTDVTKEYVNDIKKTLKKFVHDFKESAKDEEVAEMDKAVVDMANNFNLDVDEDDIEKLLDVVPEELTNELLELEEHASKKGARRKRKL

SEQ ID NO: 939084 - protein, 67 aa, Homo sapiens
ARLLAGLSRSVRVLPPSTYGQPSRHSMRRCRLAPAAVARPGGQQRTRQAQRAAGEVGHVPFTRMRLQ

SEQ ID NO: 939085 - protein, 75 aa, Homo sapiens
MSVIVVALGGRTYLIWPDFKGHHDDYKYGRNELVDYWCSLERLLACALAYYVAPAALYAAAALKVSAQCPAKKKS

SEQ ID NO: 939086 - protein, 34 aa, Homo sapiens
KHFSQSSDVIKHQRIHTGEKPYKCDVCGKAFRIH

SEQ ID NO: 939087 - protein, 118 aa, Homo sapiens
SYGSDPSIISLQGFTAAQMGNEAVQQILSGHSEIVIIYFSLNGDLETGRFRRKSIQHVFTVNMKSTPIRTSDVDYRLLEASKAGDLETVKQLCSSQNVNCRDLEGRHSTPLHFAAGYN

SEQ ID NO: 939088 - protein, 68 aa, Homo sapiens
GCLARVQKLCTPENINCRDTQGRNSTPLHLAAGYNNLEVAEYLLEHGADVNAQDKGGLIPLHNAASYG

SEQ ID NO: 939089 - protein, 258 aa, Homo sapiens
MEFNISKENSTWRKEIDERGNNWGLLPDSRAWGGEPPRGFEKQTHPCKNRKQPFYLPEKQTSALMITQIRVNFYLFKKIIHSVPFLAQFSWRQGGDRTYVFFTSCFLLFAELQMVRRARSWFIRATRIRETMEAPRKRINTITNSPARTTTFEPRGWGGFFCWWEQRKCRPPQSGTVLIAPAASIDEVIAGVPLHVKVPAWEGCTARPSDCVGGAVFFIVEHIAGVVFRILPSGSTWDRGIRCIAAGGQVTRGILCDS

SEQ ID NO: 939090 - protein, 298 aa, Homo sapiens
MLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAVQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSQKVLYKLPGHAGSINEVAFHPDEPIILSASSDKRLYMGEIQ

SEQ ID NO: 939091 - protein, 39 aa, Homo sapiens
VDTAVYYCAKALDGSGSYGLGSAFDIWGQGTMVTVTSGS

SEQ ID NO: 939092 - protein, 68 aa, Homo sapiens
EEKKHYLMWGLSSDFWGEKPHPQLHHREGPPGLNTCLKKTDSQAEGTRKHCQDLGAFTKSMVVFGCPN

SEQ ID NO: 939093 - protein, 35 aa, Homo sapiens
VDTAVYYCAKEGGYSYGSFGAFDIWGQGTMVTVSS

SEQ ID NO: 939094 - protein, 134 aa, Homo sapiens
NRDENTPDELWILQHHDVLTQGQAGKPEHILQATQLPIVQSDRGGQVTWHGPGQLVAYFMFDLNRLGWNVRTLVTYAENLMIHLLKKYKIEAYAKADAPGVYVAERKIGSLGFKIRKGRSYHGLALNIDCDLLG

SEQ ID NO: 939095 - protein, 706 aa, Homo sapiens
NYAYPGVLLIGTDSHTPNGGGLGGISIGVGGRDRVDVMAGIPCELKCTKVIAMKLTGSLSGWTSPKDVILKVAGILTVKGGTGAIVEYHGPGVDSISCTGMATICNMGAEIGATTSVFPYNHRMKKYLSKTGRADIASLREEFKDHLVPDPGCQYDQVIEINLNELKPHINGPFTPDLAHPVAEVGTVAEKEGWPLDIRVGLIGSCTNSSYEDMGRSAAVAKQALAHGLKCKSQFTITPGSEQIRATIERDGYAQILRDVGGIVLANACGPCIGQRDRKDIKKGEKNTMVTSYNRNFTGRNDAFPETHAFVTSPEIVTALAIAGTLKFNPETDFLTGKDGKKFKLEAPDADELPRSSFDPGQDTYQQPPKDSSGQRVDVSPTSQRLQLLEPFDKWDGKDLEDLQILIKVKGKCTTDHISAAFPWLKFRGHLDNISNNLLIGAINIENGKANSVRNAVTQEFGPVPDTARYYKKHGIRWVVIGDENYGEGSSREHAALEPRHLGGRAIITKSFARIHETIKKQGLLPLTFADPSDYNKIHPVDKLTIQGLKDFAPGKPLKCIIKHPNGTQETILLNHTFNETQIEWFRAGSALNRMKELQQYRKVPASWLSCPTLDPLWTLLDVRSTGPCASSEPELVYPAWPSSEMTTRPASCSLHPQPLSDPPWRALEIKSQPLPFSLVLPSKMPCNLYLFLMTALPLKKSFHPA

SEQ ID NO: 939096 - protein, 30 aa, Homo sapiens
VDTAVYYCAKGSRDHAFDIWGQGTMATVSS

SEQ ID NO: 939097 - protein, 41 aa, Homo sapiens
NPVLRTGRHGTVSRDSTSRPAQHFGDGTRLSILEDLNKVFP

SEQ ID NO: 939098 - protein, 30 aa, Homo sapiens
VDTAVYYCGSENGFSLFDYWGQGTLVTVSS

SEQ ID NO: 939099 - protein, 36 aa, Homo sapiens
LSDSGFYLCAWVAKIYGYTFGSGTRLTGEDLNKVFP

SEQ ID NO: 939100 - protein, 31 aa, Homo sapiens
VDTAVYYCARGGEWELTVDYWGQGALVTVSS

SEQ ID NO: 939101 - protein, 37 aa, Homo sapiens
LSDSGFYLCAWDLGDNSPLHFGNGTRTVTEDLNKVFP

SEQ ID NO: 939102 - protein, 34 aa, Homo sapiens
VDTAVYYCAKGLAAGGGGGAYDIWGQGTMVTVSS

SEQ ID NO: 939103 - protein, 34 aa, Homo sapiens
LSDSGFYLCAWSGQLAGVDEQFFGPGEDLKNVFP

SEQ ID NO: 939104 - protein, 41 aa, Homo sapiens
VDTAVYYCAATSSTVPVVRQSYGPAGRFDIWGQGTMVTVSS

SEQ ID NO: 939105 - protein, 74 aa, Homo sapiens
RGGGQSLSVEGVGGVVRSGGGGHRHGGPGVEKRALGVGVVAAAESQRVVGVRSPASQAARCARGGDVHSASHGG

SEQ ID NO: 939106 - protein, 31 aa, Homo sapiens [sequence omitted]

SEQ ID NO: 939107 - protein, 37 aa, Homo sapiens
VDTAVYYCAKELQGKQQLAPPYYFDYWGQGTLVTVSS

SEQ ID NO: 939108 - protein, 540 aa, Homo sapiens
MRFSKDKGVYSAPNKRRIIMKNTTDWFIILKETSHTHSSHSRLFNTGKDLAHQTTCWHPTSYMLFGFSIGLQLVTLVTHKITLLSIVTAISVTLGVATIISISQGKSLNGWLGMFSVFGIIFVAYQLKNYLQIAEQLVYLFTLDLAVILNVDWNKSMAKKIGGLDLKSWVVTVLCWAGLWSLSAIVIGRFTDDPRPVMDALVFSSATVGGLLTFLKKPESYYAWIVTGITSLPLWYITYKQGDATYRMLLSSLVYVMNDAIGLTVSPWFSKKGRARLAEQEAQYLVNKKQSTELYNKLFFLLHKSLYIFIFNGIIIKRVLDMGFLRLLVRVQKNELAGCNVGYAYMKAAKENNKMADEVVTPEIDEKTEVPVTFTEKDLQSAKDRAYDKARNDLQATFEEKLAQAVKDAKAQALEESKMTAEQKAQKELDDKIKTLEAREAGIKQRELTADITGQLSAAGLPVDLAKSLATLGDERRLKRPVQVVAVQRRPIQPAQITVVQERLKRPVQVVAVQRRLKRPVQVVAVQRRPIQPVQITVVQ

SEQ ID NO: 939109 - protein, 568 aa, Homo sapiens
IRELLLFSPLDCEAGAQNRRGGKSSPFFLTQRTAVLPRNNFCLGVEDTVDKLKMLEGRKTSIRKAVQVAYDRAMIHLSRVRGPHSFVTSSYLKGRAGLHPLALPPSRRGQRSLFCPCQMYGRQLPPLMVGQGLGFLPTKGKGPVLTNRMVLLAGLLCAKNIPPKSSGDISLKNQLEVETAVGLGPSLEIAQMARGPGLLLEGLPGPLHPTPTNYTSGRVRFQTLIPEMPWIRQGPRGNLPKLTLSPAYRLFSHLFSVPSSAPIAQSCFLFPIFLFFFSCAKLTETVTTLVFFFNVSFPLKAAAMPGGVSAKLLRPRQKPATTYDPFPETTPPQTSFSCDTTSQLCECAPWIKAVPSCFFLCCHEVVQASGWAPIRLGVRVSICPHGCRGWFVWSCARQLGLPSSPFSPSFSSSWTFSAIAVLSFTLHHLDGMAPATKHLPGLRSALPCLPLLLPLPNSRECITFISNPLPPSFFLFNPLPTFTFSKMEGKKKKLLRLLLLQGPPPEEEALLAVLLLLLAAYTAEEEEEEELAAGPPGGSPGGVVGGSPGFLEEFWTKQSLGSLPFLHT

SEQ ID NO: 939110 - protein, 46 aa, Homo sapiens
DLGERLESAILGERLESAILGEKLESAILGEGLESAILDERLESVI

SEQ ID NO: 939111 - protein, 82 aa, Homo sapiens
IIDVARRSVEIPRLRFIVRDANGADIYAWNAVLEQPVLNPGERAWFKIRLASPPAEGREIAVRFFRKQNIADRRNLNVSRFD

SEQ ID NO: 939112 - protein, 122 aa, Homo sapiens
SKVIVRGYKWAEYHADIYDKVSGDMQKQGCDCECLGGGRISHQSQDKKIHVYGYSMAYGPALHAISTEKIKALYPDYEVSWANDGSEHSHPGALASSSHFRAPAFACTPLRGLPVLLCGSLW

SEQ ID NO: 939113 - protein, 107 aa, Homo sapiens
LGQVLQLVDEVDHVLAHGRAVDTVHKAPVLQPGILSLHLLYHLFARGAHLGGDADGHAISRAVLRADPKAPGPSWMVLLRSANTRKKGIMGPFSNSVNPPFFSGKFS

SEQ ID NO: 939114 - protein, 107 aa, Homo sapiens
TLLSQSKSAFWFGAERPLGLAFPRKARPAPWPREQTKSTAGPITLGALRPAMVMEVGTLDAGGCGRCWGSERRNCLLLDAASFFSFFHIAFSVNVRFSTIVRAGQGP

SEQ ID NO: 939115 - protein, 39 aa, Homo sapiens
DCGCREMALWKSYFSGRRATAIGKCESVTVDVVRGCPQG

SEQ ID NO: 939116 - protein, 588 aa, Homo sapiens
RQRDHHEVQRAMGRMRADAFEPAVAAGHGRRPVGGAPQDAQDHQPQHGDADRLVGVDGRAHPVVGKAVDREDQRDVDDHQQCDDPVQRDGGACVAMVRGHAGIFGGSPTQPVRRAIVRSSASDIRNRRPVPCVHLPIALAPLSVNDLLRSAFVAASPRLSPPATPLRSWLIHGGVLLLWGLLFAMAFRLGNVQAWSVGVAYVLYDTVLLLFVGWQTLAILRPRGIALASAPLPHPAVAPHRATLGVIVAAHDEAAVLPVTLAALLGQTDAPDRIVIADDGSTDGTAELLTTRYGLEAPEPGQLSAASTLHPNLHWLRLPHGGKAVALNAAVLCIDTETVLTVDGDTLLDARAIAAVRRAFSDEPALVAATGVITPVCSRTLGGRLLQWFQTYEYIRNFLSRYAWMRVDGLLLISGAFAGFRRDAVRAVGGFDTDCLVEDYELIHRLHRHAQAHGLDWRVRVLGDAQARTDAPSSVGAFLRQRRRWFGGFLQTQYWYRAMVGDRRYGWLGTAMLPVKAIDTLQPLYGLAAFGLLVMYLVRGDFGVLLPAAGVIAAKIVLDLVFHLWSVHLYRRWVGHGGEAGMLQAFAA

SEQ ID NO: 939117 - protein, 62 aa, Homo sapiens
MGFMGTQITHGCHSAQPHTQNQSTVGLTQTSWHTQTSHTDVSVHILACTDVINATAHMWASQ

SEQ ID NO: 939118 - protein, 47 aa, Homo sapiens
MRIVKWQVCGFKCLHPVRRQEQTKALPDSRLDPGPQQLHWIILRPLN

SEQ ID NO: 939119 - protein, 76 aa, Homo sapiens
RSTVRDIASLIYNSSRITYLHRITYLHRITYLHRITYLHRITYLHRITYIHRITIYIASLIYNCSRSTVRDRITYL

SEQ ID NO: 939120 - protein, 138 aa, Homo sapiens
HSGAGGRFATAAVGTIAGAVLAPITSGTASTAWSGISGSSNALQASMDDNFAQAAAVRRRASVAEAGKTGILAYSNATTPGSKVTIAVSMAFNCSVAGASADASSLQAIVAAPVNMPSGSAVTPTSFPSAPVTVLTHF

SEQ ID NO: 939121 - protein, 66 aa, Homo sapiens
MSVVWFVGDRKVFLEMHFEDLFLQVHTVFWFGADDQGNLKIPIRFQTVKVSTREPKDRFSFKSRTT

SEQ ID NO: 939122 - protein, 107 aa, Homo sapiens
LAAQDVLANGGAGVSPFWLVGSILMLTLGELCLSPIGLATTLLAPERMRGQMMGLWFCASALGNLAAGLIGGHVKADQLDMLPDLFARCSIALLICAAVLIVLIVRF

SEQ ID NO: 939123 - protein, 76 aa, Homo sapiens
KLSSLHFGVLQYYLVVVFFDADYLTPDRLKIVGRVLMLQAHRSSMKFPGLEEHLIVYILISNLTPDGRRISDHLSA

SEQ ID NO: 939124 - protein, 76 aa, Homo sapiens
VAQGYPLTHKRAHIRINGGAVEYRVYAEDPHQSFGDHLSGDCLSTKEPLHLPSVRVDSGIRPGGDIGTYDDPVFQN

SEQ ID NO: 939125 - protein, 102 aa, Homo sapiens
PPFGDFAPGPKISARGKFSNFRNPYIFTPWLGRNLFFAGTPRVEKDPSNGVSETPFFCEGFFRGVTSFGLEKKCGDPRGPGFYFLLSKKPPNWIILTIKGAV

SEQ ID NO: 939126 - protein, 137 aa, Homo sapiens
SKVCLFNWTVMLTSRSSTWYEVLDIPGDFHPLLKGKSVKTTFGLLLFNIILIWEPFKGTVDYVNREFTKFFEDLFREIMVDNPKQGEVVPQGKSVDECLMFTHNCNFLGGLGTHFIKPRRSWMPLTVRPQKLLRLRR

SEQ ID NO: 939127 - protein, 96 aa, Homo sapiens
LGFLLNLVDKTAAEFEGLTSILKNVPLWVKGYPTATHATDKSFGKEESVDVAAFLVVSFKEISRATLTFGNHHTDLSAAINSEARLSSSNKDSLKT

SEQ ID NO: 939128 - protein, 121 aa, Homo sapiens
SRPSWLTHGNLVSTKKIQKLSRVWWRVPLVPATGQADAGESLESRKQRLQSTKIVPLRSSLGNRARPCLKYKTKQKTVGRELRILFFVYTLESKKGDRQSGSQGESRKARDKSCAAGSGKR

SEQ ID NO: 939129 - protein, 50 aa, Homo sapiens
LEEEKRKVEDLQFRVEEESITKGDLEQKSHISEDPENVATVSEKSRIMEL

SEQ ID NO: 939130 - protein, 44 aa, Homo sapiens
MAINAATSRGRARNHERYFPPMPRVRVSTTTFNSSWYTGAHATD

SEQ ID NO: 939131 - protein, 125 aa, Homo sapiens
MKLSSAAGQESPGHPHPSPPAWTLKKPSESVAQRAMCSARACPVACPVGCPAACPVGCPIACPVSCPVACPVGCPVGSMATAPQGLSPQEWEADRETGSSSHAGTTQCSIHSPSSSSRHLSRTQT

SEQ ID NO: 939132 - protein, 96 aa, Homo sapiens
KLRLWPSRHVAECSVCGYYFWIATLVLASSRYSALAAEAQQVLSVSSESAVAYAPVHRSCLTLLALCKSVSRSGSVGDRYLVPAQPSISWQYASAK

SEQ ID NO: 939133 - protein, 483 aa, Homo sapiens
PSPVAWLELSGSTLSSCRTSPFSCGPGKSMPGTTSSSSDSTVEESPGWLLSALPRSPLLQPRGNWKQGAIQRMKEEEEEDGEDDEEEEEEGFFQKVLTPLLSWLLSRRLWLGPQCSKLPLPSCCRQPPPAGPPVEGDGWLKSFQRSRRMCFTSKSFRPEPDMLYAQKAKGWQLTQGSGGWEVQDQCTRIWSKENLLALNTHSRRQKGKRENKVCVSTWQKSRGDRTYSSMATTPSMTKILEGCMYRKLKFEKRMAQSQAGTRFKLQREREEKHLNISGIIQDYLRQVFCVSNNKTDFTSEYLQNWDPNDQGEMKNNLFEDCLFCLPASTERLTLLAEALIPIPWLDPGSFMLENLALLLLLLLLLLLLLLLLLLLLLLLLLLLLLLLLLLLLLLLLLLLLLLLLLLLLLLLLLLLLLLLLLLLLLLLLLLLLLLLLLLLLLLLLLLLLLHFLKIYYLILLFDVIIVIYFSILPHTAYLLLKNL

SEQ ID NO: 939134 - protein, 85 aa, Homo sapiens
KLCSEEQIVRQSSMLHCGLAVSIRVGYIVSIRVGTIMVLLSLDAGLNQLTRKVSRSGLMGLVSLYIRTHWYRRLLIVKLVAVPSW

SEQ ID NO: 939135 - protein, 95 aa, Homo sapiens
ACTICPSYSAASARLIPAVAAHGPIHARGVHRQTGLRLDGVCICACSRLTSHVRVRGRVGSPTQSSSTWIRVDVQPVYRPVQWLGYMRCVQAGQA

SEQ ID NO: 939136 - protein, 42 aa, Homo sapiens
EFRADPGVQPGGFGAGVAGFGNGRVGKPPSPEIWAYGDQVRS

SEQ ID NO: 939137 - protein, 75 aa, Homo sapiens
SFSTSKAESQLNQSRTTTVSSVDIAVSTSGLCSWSRSALISSPGLDRILGIRCDYSGLSQSVGLGSWIRPVRILC

SEQ ID NO: 939138 - protein, 53 aa, Homo sapiens
NSGMQQVEYLKVNINDNRTQMQCYSQMWLIGWKGDEGHWIYYTDTVSESSVLL

SEQ ID NO: 939139 - protein, 103 aa, Homo sapiens
AFTAADAGGGAACSVRSGGLLLACCQVPGVCLGLGQSAAWICDQDDRSSRSISRLVVRSSSWLMIVLISDLGPVWTVCRTMSDCLIGSIAMSSVDLDSLIRCR

SEQ ID NO: 939140 - protein, 182 aa, Homo sapiens
MNHSAHFHFTCCLPRVQDPRNRHPLKIRKHIPARAPPRAPPSEELALNELVTLHCLATRFSPKDVLLRWLQGSQDLPRDNYLTWASRRTQQGTTTFLLTSILRVAAEDWKKGDTFSCIGCHAGPALAFTQKTIRTLWRVNPTPCSHVLCLSMAAGGTAPASLSPPRLVPPPRAINSPMLPPT

SEQ ID NO: 939141 - protein, 114 aa, Homo sapiens
MRARYLISHSTVLYCLTYDRHRWTIQSHCPVTYQDLGSACDYDPRIRQLCGKTTGYDRLIMRSLGYYYDVEIPVSDKTTSCDVSSLHVCLSVSLRHRYGTAVSTIYGVQDLITV

SEQ ID NO: 939142 - protein, 117 aa, Homo sapiens
QFLSYTIPKHTEVFLILSTALRDPHYFEKPDAFNPDHFLDANGPLKKNEAFDPPSPLGKRICLAEALPVRNCSSSSPPSSRTSPVASPVAPEDIDLTPQECGLGKIPPTYQICFLPR

SEQ ID NO: 939143 - protein, 30 aa, Homo sapiens
TTATLGFGAPQAPVADNLSDTLKKLKITAV

SEQ ID NO: 939144 - protein, 196 aa, Homo sapiens
MAVGARDSGQSASYHGVGVSQGLSPADRDGRCVSTLRALRYSRIRALRGTPGKTPLAGCLRPLLAYRLVLSSSRPYQYRVKPPDAAEPGPLCTSKRPWAPASHSRPRTVELDPGLLRGHAWPKTWPSVTEGQSCACKVQDCVKAITYTLNQGSSTLTWEAGYLGSCARIQGSQGIPREFPFRGIPGPRFPKGSKFR

SEQ ID NO: 939145 - protein, 73 aa, Homo sapiens
TSRFGEELLAYQERWKAETGTRMSPPSSHLHHHLAASMPPKPVRPRHWAQLCPPYHQSSGQHCKPATFINTPG

SEQ ID NO: 939146 - protein, 57 aa, Homo sapiens
IIITSCLFCPVIFLHSCPFRSEPKLKNMHFSLGLWVFISERSHVMENFDERNVVLGE

SEQ ID NO: 939147 - protein, 75 aa, Homo sapiens
NSASPDVNRSCQGFLQNLLPLELTSARNLATGPRNAHSPGFLLSCVPSVQDPTENRTVQLTWPLPEPLELWPKAL

SEQ ID NO: 939148 - protein, 130 aa, Homo sapiens
ITLLPASCVFFWQPDCEPCLPVHTVRLFTAILRPFSQLPLPNHHQQQKAWLRHRYPPGFSSSSESCSCNHPVVLPACCTDKTNALRPWHYHRESLIGGLALCLTPVIPATGEAGVGGLLEPRYFRPAWAT

SEQ ID NO: 939149 - protein, 72 aa, Homo sapiens
GVAARAAIAGIRQTEAGESGREVAVSRDGSSTVQLRLRMRGRPWGDGDGDGDGDGDGDGEGDFLKKLPFVLI

SEQ ID NO: 939150 - protein, 88 aa, Homo sapiens
EIFKSLVIELDKDLYGPATTCGVASDTHDPGDGFQVKALPGDRRCCSDLLLSLDYQPPQFKLGSALARLLGLHTQSRSAIVQALLTDL

SEQ ID NO: 939151 - protein, 107 aa, Homo sapiens
HLSLPILFLICIVTHLGPKVSEIVSFNKRMKLWKKKKKKKRFAPRRTAASAPGGSPRRASGCRPWRRPAAVGTARGGQRRLPGPASGSSAAGDPGHRAGPCSSAGRS

SEQ ID NO: 939152 - protein, 70 aa, Homo sapiens
EISSNITKTRKTRILSSSQPNQGLELTRRASDCVHSEEDNQQGAEGTASRVQTWTDVTKEDRKQTGTVQL

SEQ ID NO: 939153 - protein, 70 aa, Homo sapiens
EEMPATWTARLPDGPSHPAPAVPLSPATESALSILPSRRELTRRLAHAADSRRDARQAGAVQPLPLRGRT

SEQ ID NO: 939154 - protein, 137 aa, Homo sapiens
TNLTLLFSFAQARACAEAGVFLISPFVGRIYDWYQAKQPAADYDADQDPGVKSVRNIYEYYKQHRYQTVIMGASFRKVEQILALAGCDRLTIAPNLLEQLKHSDQPVERKLTPSTEAFHQPAPLAEAEFRWQHNQDA

SEQ ID NO: 939155 - protein, 73 aa, Homo sapiens
QKVCGRYLQQQLDATNCLGICEFGEQQGLLGVAAKAWAFLRENFEAVAQEDEFLQLARDRLATCLASDLLQVP

SEQ ID NO: 939156 - protein, 87 aa, Homo sapiens
PTISSRVLDNGEQSNNMQDRRRQQQLPTRAQDAVSLVVCLSPVPWAPSGWGEAGRYAWGRTILRWDPAKEPQEVGERAGAWLSGRHP

SEQ ID NO: 939157 - protein, 39 aa, Homo sapiens
SGNAPLCCTRNPARQRCAAHVSIDPENPPFFAISPPSNG

SEQ ID NO: 939158 - protein, 71 aa, Homo sapiens
ISRDPHCRSPQVDDYLLVQTPWGHGTEGDLAYHKPVGHVNVENGDENQKAQLSTWTKVFDWFGNVPASGSR

SEQ ID NO: 939159 - protein, 33 aa, Homo sapiens
ASTNQTSMYLCASSMGQGASTEAFFGQGTRLTV

SEQ ID NO: 939160 - protein, 31 aa, Homo sapiens
SPNQTSLYFCASSGLGNNEQFFGPGTRLTVL

SEQ ID NO: 939161 - protein, 104 aa, Homo sapiens [sequence omitted]

SEQ ID NO: 939162 - protein, 1012 aa, Homo sapiens
AVRADLPRPEVAPLRGLPRPKFSAPRGLRAPRSPRPEVSARTMRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGEFAVGSSRFWGAQGRLGCQLSFRVSKNFQKAKVPCLEQLLFLETQRSPRWCARHFLQPPLGMGWHPGVHFVTLRWDFPNMHRSRETSARPPRSPVPSPDQGVQGGSRHRRPAPMGCPEWVQAPAPSPRGVSRAGPGTGAQPPWGVQGGSRHRRPAPMGCPEWVQAPAPSPRGVSRAGPGTGAQPLWGVWSGSGHRQLLSVAATPAALVCPSVPGATEMWIPVQFGKNVHTRSPTWQVPLAARGAGLRRQASRAPRHGPGSPPSPVCRPGEGVPRGQWAQGVRSHHAVVSPVDPGELMADRRNALPRPGRPIQMMQEHSLLKTRPACSRRSQSKFPEQAAVSEALNPVFATKLSPEKTGVCLQKGKGCFMFLSLLHLPSKATFDRQLTAQSVDRASVRRHRERPGGSLSMDSQTAGEHLGQPPEGPLLDPRENLLALAVILEGGPFKSVIHTKGKCPQVSGLPAVTASHPQEGTGDGLSLPGACGIQHQALPSTPDPLWVFPWDAEILRPKGVWFKKKTGRPLFQDGVCAAGVTRGCLQGTRSQELFCPERSQPASRPEATGPTHVCAHKCSYAVHTEEPPEVPTGLQCPLPHSLGGTMSLGCSGEKLSHLWKTHGWSLPEERLCQGRVWLQGLPGLLALQRERHSPAGLETPMSSRRRPGNTVPRVLSSS

SEQ ID NO: 939163 - protein, 48 aa, Homo sapiens
MGLVSWTDLIQRLLGSAVQMTLWTYFPAMFQDDGEESSPTASMLSLFR

SEQ ID NO: 939164 - protein, 273 aa, Homo sapiens
VTLSDEWTEHKAFSQKSFFQFLTEDIPFFTIALYWLPNITLQIPQSILSESFRETALCSLNSSHGIVAFPSRSRSLRLFLWNSQIDIWKPIEVYGAKGNILREKLKRIFLGNCFVFCGFISQSYSFLLKKPFAKAVSCGICKVVFGSPSRARVKKEISSVKTWKEASENLLCVLLIHLTELQLSPQEAVYYGCSCGICKVIFGSPERAMVKKETSYDKNWKEAFCETALCSVNSSHRITAFPSRSLCLRLLLWNFQSDILKPLESYGEKGNIL

SEQ ID NO: 939165 - protein, 305 aa, Homo sapiens
EKEEQLIPQDIPDGHRAPPPLAQRSSSTRSIDTQTPGGADKGSNNSSRSQSVSPTSFLTISNEGSEESPCSADDLLADPRDKENGNNSPLPKYATSPKPNNSYMFKREPPEGCEGSKSLRNARQNNFMRFQPFTVLDKNKVNFIPKSGSAFCLVSILKPLLPTPDLTLKGSGHSLTVTTGMTTTLLQPISMASLSTNTEQERVSRGTSTVLPSASLLHHQNPLRKLKDRAQLKQWVLGAKNPADHVTVVSCGILSSRLAVKCFGFPVRCDSKAPGRTSGPLSVLPLRMKATDVLHLLGLEALAET

SEQ ID NO: 939166 - protein, 34 aa, Homo sapiens
SSGRPGRYWMSGLRNFLDFDLSPYNHTITSAATT

SEQ ID NO: 939167 - protein, 108 aa, Homo sapiens
MHIIRSTEMADSVPDSPRSKDWVGTSIYGLMIYSSSRCLFNRAIGFLHRTERIEAEMTQIKSPGFLISNTNILMELTFQGTNVSRNSFNLTLGFHQWNQVNIWQKIAI

SEQ ID NO: 939168 - protein, 30 aa, Homo sapiens
TSAPSFGTTSGGLFADNLSDTLKKLKITAV

SEQ ID NO: 939169 - protein, 31 aa, Homo sapiens
PRVLKVGGNEVTELSTGSSGHDSSLFEDKND

SEQ ID NO: 939170 - protein, 211 aa, Homo sapiens
DGLSQGPLNPVHNETAKHLKFPISKSLGLPGFDLEELLGNTLSRALFQNVFCLKLTQACLPFCGPYKCSFSQMMAPAGSAPSAQHRARHTVVHRERLLDAHPKANQGARGLGPGPHILFQHLALLGAGTPAEGALLQLLDATAVAGRELLEATTLQEVQLLGPAPLLQDLLLGLQFRAELGLQGCLGRGAGMHLGHGLASHLFATGPRRSD

SEQ ID NO: 939171 - protein, 77 aa, Homo sapiens
MTLILGYTLTKKCPDLKKYFDSCNGDLDPEIVKSFLFQLLKGWILHSRNVLTQGPEAPEPLINRNGELKLADFGQDL

SEQ ID NO: 939172 - protein, 47 aa, Homo sapiens
ANVRERRRMQSINDAFEGLRSHIPTLPYEKRLSKVDTLRLAIGYINF

SEQ ID NO: 939173 - protein, 134 aa, Homo sapiens
TPQDTNRASETDTHSIGEKNSSQSEEDDIERRKELKAFEEKLRLDMGLVKSAGNIPPRSSSLTPEAHGHLSMRNTSVMKKGGVSLQNFCKFPSSLLLSHLLAIGLGILYWKRSDTSTSTFDEEWSLTWFVSGYF

SEQ ID NO: 939174 - protein, 128 aa, Homo sapiens
YQITAYNHTITYAERRRKQYNDAQRCYRIVEKKLPFRIAFSVIGTEEWKTEFHLCIGVCFHFFLKSLKPSNHATIQSIVRAVGVVPGIPEPCCVPEKMSSLSILFLDENRNVVLKVYPNMTVDTCACR

SEQ ID NO: 939175 - protein, 30 aa, Homo sapiens
SEDTAVYYCARGLPWNYGNYYYGMDVWGQG

SEQ ID NO: 939176 - protein, 37 aa, Homo sapiens
SEDTAVYYCARDDNPPGVDGRLWFGEWHYIMDVWGQG

SEQ ID NO: 939177 - protein, 30 aa, Homo sapiens
VDTATYYCARRHRVFGYFDSVPLFDYWGQG

SEQ ID NO: 939178 - protein, 30 aa, Homo sapiens
VDTATYYCARNWNYLGGLYYSYGMDVWGQG

SEQ ID NO: 939179 - protein, 32 aa, Homo sapiens
VDTATYYCAHIGLFGSPAGPPYYYYMDVWGKG

SEQ ID NO: 939180 - protein, 30 aa, Homo sapiens
VDTATYYCAHKRVTTMVGGTVTRFDYWGQG

SEQ ID NO: 939181 - protein, 37 aa, Homo sapiens
AADTAVYYCARDRPTYYGSGTSKVSSHKWDFDLWGHG

SEQ ID NO: 939182 - protein, 30 aa, Homo sapiens
AADTAMYYCARAPVVLPVVMPYAFDIWGQG

SEQ ID NO: 939183 - protein, 34 aa, Homo sapiens
AADTAVYYCAREVHVHTVLLTAIGESRYDIWGQG

SEQ ID NO: 939184 - protein, 34 aa, Homo sapiens
AADTAVYYCARRGYGILTTYRASGDDDMDVWGQG

SEQ ID NO: 939185 - protein, 34 aa, Homo sapiens
ASDTAIYYCARQTSVVVVTFLVPPSYFFDPWGQG

SEQ ID NO: 939186 - protein, 34 aa, Homo sapiens
ASDTAMYYCARDLSGPTHIVMLVSHHYFDYWGQG

SEQ ID NO: 939187 - protein, 32 aa, Homo sapiens
PEDTAVYYCTRARIVSGYDYQDLGYFDNWGQG

SEQ ID NO: 939188 - protein, 32 aa, Homo sapiens
PEDTAVYYCVRYNSTWFPGGGRYDWFDPWGQG

SEQ ID NO: 939189 - protein, 30 aa, Homo sapiens
TDDTAVYYCVREGEGLTTVTTRGIDHWGQG

SEQ ID NO: 939190 - protein, 30 aa, Homo sapiens
AEDTAVYYCARDAAVLPVGWAEYFHHWGQG

SEQ ID NO: 939191 - protein, 32 aa, Homo sapiens
PEDTAVYYCARDQVLSCTSSTCLEGMDVWGQG

SEQ ID NO: 939192 - protein, 35 aa, Homo sapiens
AEDTAIYYCAREGEWFGNSHERDYFYFGVDVWGQG

SEQ ID NO: 939193 - protein, 31 aa, Homo sapiens
SEDTAVYFCARDGNYANCHESLPHYDYWGQG

SEQ ID NO: 939194 - protein, 30 aa, Homo sapiens
SEDTAVYYCARGPQEIWYDVADQFDHWGQG

SEQ ID NO: 939195 - protein, 30 aa, Homo sapiens
VDTATYYCAHIRPSTTVTTSAEYFQHWGQG

SEQ ID NO: 939196 - protein, 42 aa, Homo sapiens
PEDTAVYYCAKEGGEVFSSSSSYLRVPHTAGGYLYFDLWGRG

SEQ ID NO: 939197 - protein, 36 aa, Homo sapiens
AADTAVYYCARDAGIRDTAMIINGIKYYGMDVWGQG

SEQ ID NO: 939198 - protein, 36 aa, Homo sapiens
AADTAVYYSARDAGIRDTAMIINGIQYYGMDVWGQG

SEQ ID NO: 939199 - protein, 34 aa, Homo sapiens
AADTAVYYSARDSSGSGGYYSSEYYYGMDVWGQG

SEQ ID NO: 939200 - protein, 31 aa, Homo sapiens
ASDTAMYYCARVFLPHGREEAEAPFDYWGQG

SEQ ID NO: 939201 - protein, 30 aa, Homo sapiens
TEDTAVYYCARDKLYCGVPPVILGDYWGQG

SEQ ID NO: 939202 - protein, 82 aa, Homo sapiens [sequence omitted]

SEQ ID NO: 939203 - protein, 249 aa, Homo sapiens
KFVIPDFEEFTGHVDRIFEDAKELTGGKVAAYIPHLAKSNPDLWGVSPCTVDGQRHSVGHTKIPFCLQSCVKPLTYAISVSTLGTDYVHKFVGKEPSGLRYNKLSLNEEGIPHNPMVNAGAIVVSSLIKMDCNKAEKFDFVLQYLNKMAGNEFMGFSNATFQSEKETGDRNYAIGYYLKEKKCFPKGVDMMATLDLYFQLCSVEVTCESGSVMAATLANGGISPITRESVLSAEAVRNTLSLMHSCGMY

SEQ ID NO: 939204 - protein, 112 aa, Homo sapiens
RGAPFFKPVGKAQYAGGSDPIFQVPSVTPFFDSERELPDPLRFPSEAMPHPASARARCAHPLTCAHCLALPSEMNPVPQMEMQKSPSSASLALGAVDRSCSYSAILAPPQNN

SEQ ID NO: 939205 - protein, 30 aa, Homo sapiens
VDTGTYYCAHRTVSYGPYKADWYFDLWGRG

SEQ ID NO: 939206 - protein, 30 aa, Homo sapiens
VDTATYYCAHRTVSYGPYKADWYFDIWGRG

SEQ ID NO: 939207 - protein, 30 aa, Homo sapiens
VDTGTYYCAHRTVSYGAYKADHYFDLWGRG

SEQ ID NO: 939208 - protein, 30 aa, Homo sapiens
VDTATYFCAHRGNNYYDNSAYGDFDYWGQG

SEQ ID NO: 939209 - protein, 137 aa, Homo sapiens
CHLHHLPNSIASNVIRADPGLGLCPEQLEEALCGFQVVGSFSFANLIAGSDTAGFTLEYDCCSWSHSRLDNYWRQGFALDALSGTGGRIPGATTEPTFESGGRLEQRSAVALGWFTRQNSPSSSEEKKRPIYEGANC

SEQ ID NO: 939210 - protein, 446 aa, Homo sapiens [sequence omitted]

SEQ ID NO: 939211 - protein, 475 aa, Homo sapiens
MEMASSAGSWLSGCLIPLVFLRLSVHVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 939212 - protein, 30 aa, Homo sapiens
LEDSAKYFCALGELYKTYWGIRTLYTDKLT

SEQ ID NO: 939213 - protein, 31 aa, Homo sapiens
LEDSAKYFCALGGPPGLLRWGIRLTYTDKLT

SEQ ID NO: 939214 - protein, 31 aa, Homo sapiens
LEDSAKYFCALGELPNSFLRYWGFLYTDKLT

SEQ ID NO: 939215 - protein, 30 aa, Homo sapiens
ERDEGSYYCACDTPPDWGIRHSSWDTRQMF

SEQ ID NO: 939216 - protein, 615 aa, Homo sapiens
MRVRGRAEDSDQDRQRPWAARIQDIDGSEIIRRMEMGQVAVVAGFQGIGPDNRVATLGCGGSDTSVVAIAAGVKADRCDIYTDVDGVYTTDPRVEPKDASFEDFLRGNAGNGIAWCQGSAGALGRTCHGAQGAHFRASSFTDPDAPGMGDPINPPGTLICDEDEIVEQQVVTGIAFAKDEAQISLRRVADRPGVSAAIFGPLAEEHINVDMIVQNVSEDGSKTDMTFTIPTGDVDKALKVLDKVEGEIGFDNIQSETGLAKISVIGIGMRTCRRCRTAFKALAEKGINIRAITTSEIKISILIDGPMRNWPSYLHAVYGLDKKAASSDSILKHNCMQGRAAERVRGPATFCEQRLFVLDAGVKNAHKGIGVTSRAGIGNRLAERTSAILKEPPTIMRELTTGPRVLLKRLRELMAEPLEPQARLDRIVREIAQNMVAEVCSFYILRADGVLELYATEGLNPQAVHLAHFASVRVWSARLAASARPLNLTDAQSHTAFAYLPETGEEAYNSFLGVPVLRAGRTLGVLVVQNKTKRAYREDEVEALETTAMVLAEIIATGDGLRRARPGIELDLGRPMSVTGQAFNDGIGLGHVVLHEPRIVVTNLFNEDSQAELNR

SEQ ID NO: 939217 - protein, 231 aa, Homo sapiens [sequence omitted]

SEQ ID NO: 939218 - protein, 311 aa, Homo sapiens
MASKDFAIGMILLSQIMVGFLGNFFLLYHYSFLCFTRGMLQSTDLILKHLTIANSLVILSKGIPQTMAAFGLKDSLSDIGCKFVFYVHRVGRAVCVGNACLLSVFQVITISPSEFRWAELKLHAHKYIRSFILVLCWILNTLVNITVLLHVTGKWNSINSTKTNDYGYCSGGSRSRIPHSLHIVLLSSLDVLCLGLMTLASGSMVFILHRHKQQVQHIHGTNLSARSSPESRVTQSILVLVSTLCYFTRSPPSLHMSLFPNPSWWLLNTSALITACFPMVSPFVLMSRHPRIPRLGSACCGRNPQFPKLVR

SEQ ID NO: 939219 - protein, 221 aa, Homo sapiens
MAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 939220 - protein, 113 aa, Homo sapiens
MPEPGSNSSSGIKQTSSRHQADIKQTSSRHQADIKQTSSRHQADIKQTSSRHQADIKQTSSRHQADIKQTSSRHQADIKQTSSRHQADIKQTSSRHQADIMRTSSRHQADIKQ

SEQ ID NO: 939221 - protein, 105 aa, Homo sapiens
MTDPDVPGPSDPYMKEHLHWMVTDIPGTTDSTFGKELTSYEKPKPNIGIHRYVFVLFKQKRGNKYSITCPFSRDYFNTRNYQNDLGVPVAAAYFNARRATAPRRR

SEQ ID NO: 939222 - protein, 409 aa, Homo sapiens [sequence omitted]

SEQ ID NO: 939223 - protein, 144 aa, Homo sapiens
GNCAIRGSNALRAPHERILTCHISRSSTVGAHHTCTPLAYIAVRSSGIMFSQHTAPLTRPTAVSITGKVEPSPLPQIKRSVPVGISLRCLTTRPPDGSKYSTVQYRVLPLRSITPRTRLAPVRADNPASASVLVPGLPWIAQLP

SEQ ID NO: 939224 - protein, 420 aa, Homo sapiens [sequence omitted]

SEQ ID NO: 939225 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 939226 - protein, 207 aa, Homo sapiens
MFSVVDENLSWYLEDNIKTFCSEPEKVDKDNEDFQESNRMYSINGYTFGSLPGLSMCAEDRVKWYLFGMGNEVDCIQRSFMVQALTSKNYHTEIINLFPATLIDVSMVAQNPGVWMLSCQNLNHLKAGLQAFFQVRDCNKPSPDDDIQDRHVRHYYIAAEETIWDYAPSGTDTFTGENLTSLGSDSRVFFEQGATRIGGSYKKIGLS

SEQ ID NO: 939227 - protein, 97 aa, Homo sapiens
SCKASGDFFRTNVFAWLRHVPGQGFEWMGEIRPVFDVIRVAERFQGRVTLIADVSASTAYMELHRLSLEDTSVYFCATRTPGDGWPFEFWGQGTLVT

SEQ ID NO: 939228 - protein, 193 aa, Homo sapiens
MKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIGLNPLPDVQVNDLRGALDAQLRQAAGGALQVVHSRQLRQAPGPPEES

SEQ ID NO: 939229 - protein, 220 aa, Homo sapiens
CFEYWVKDRPGTSYNGSCGGGEYQSLRPKISRYHIRQSFDPTMNQFSSFSFSCYTSESSPFEPLGYSLNVLYSRSVSFCNPIFSDWFSLGYSTFKITYLERDFRLFYSRAVPEYQWWAVDFRCVAAVSSVPKIVDWMDNFKLVGLLNNYRYASLTSNFFGRLSTFQDGCLIRMRYRLARRVSQNYSTTISGTTKLIVQPNARKYESLFQPCSWRSDCVSL

SEQ ID NO: 939230 - protein, 138 aa, Homo sapiens
AWTRPEVSQSATGVGPAKTDRRRIGSSFNGVDDPLPETCHGGPARNRPRDPGTGGALMNARPDTDGRTIARYLGQLRLRCSTSPIYYRQALRTFQEVVIRDQRTPGQLGREVLETWMRECAMHWPMATLLHRARIGNR

SEQ ID NO: 939231 - protein, 162 aa, Homo sapiens
MSTRVTRSLRTNCGSDVWAYGAMSTRVSADPMCGHMGRCRLESVRIRRVGVRLRIDLAMSTRVRLRIRCVGIRADPMSTRVSADPMFGPMGRCRLESVRIRCVGVWGDVDSSQCEFDVWAYGAMSTRVRLRIRRLGVRGDVDSSQCEFDVWAFGLGLTWRCR

SEQ ID NO: 939232 - protein, 34 aa, Homo sapiens
VGVRKTGQIWPNDGEGAFHGDAGKSPGLRLNHNG

SEQ ID NO: 939233 - protein, 602 aa, Homo sapiens
MAAEEEAAAGGKVLREENQCIAPVVSSRVSPGTRPTAMGSFSSHMTEFPRKRKGSDSDPSQVEDGEHQVKMKAFREAHSQTEKRRRDKMNNLIEELSAMIPQCNPMARKLDKLTVLRMAVQHLRSLKGLTNSYVGSNYRPSFLQDNELRHLILKTAEGFLFVVGCERGKILFVSKSVSKILNYDQASLTGQSLFDFLHPKDVAKVKEQLSSFDISPREKLIDAKTGLQVHSNLHAGRTRVYSGSRRSFFCRIKSCKISVKEEHGCLPNSKKKEHRKFYTIHCTGYLRSWPPNIVGMEEERNSKKDNSNFTCLVAIGRLQPYIVPQNSGEINVKPTEFITRFAVNGKFVYVDQRATAILGYLPQELLGTSCYEYFHQDDHNNLTDKHKAVLQSKEKILTDSYKFRAKDGSFVTLKSQWFSFTNPWTKELEYIVSVNTLVLGHSEPGEASFLPCSSQSSEESSRQSCMSVPGMSTGTVLGAGSIGTDIANEILDLQRLQSSSYLDDSSPTGLMKDTHTVNCRSMSNKELFPPSPSEMGELEATRQNQSTVAVHSHEPLLSDGAQLDFDALCDNDDTAMAAFMNYLEAEGGLGDPGDFSDIQWTL

SEQ ID NO: 939234 - protein, 59 aa, Homo sapiens
MLTDRKNQYRENGNTTQSDLKIQCYSHQTTINILHRIRKKNYFKIHMEPKKSPYSQDNP

SEQ ID NO: 939235 - protein, 31 aa, Homo sapiens
SEDTAVYYCALRPYYDFWSGINYNMDVWGRG

SEQ ID NO: 939236 - protein, 30 aa, Homo sapiens
LRTRPYITVRDRRHIVVLNALCALLNTGAR

SEQ ID NO: 939237 - protein, 30 aa, Homo sapiens
LRTRPSITVRDRRHIVVLNASNALLSTGAR

SEQ ID NO: 939238 - protein, 31 aa, Homo sapiens
SDDTAIYYCARDSGKIAVVGYNFGMDDWGQG

SEQ ID NO: 939239 - protein, 31 aa, Homo sapiens
SEDTAVYYCAIRGRQQLGGNYYYAMDVWGQG

SEQ ID NO: 939240 - protein, 31 aa, Homo sapiens
SEDTAVYFCARVIGTTIFQGVIGSFDYWGQG

SEQ ID NO: 939241 - protein, 67 aa, Homo sapiens
WNEKRGDFLGENETYELMRCLEDLTSKKTLCMENLIRERARGMMTIETREGGNAETFVWREILLGEL

SEQ ID NO: 939242 - protein, 181 aa, Homo sapiens
PPCQWRPRIKWTHRKSAGLIAPGFSGRMSSSSMSSDSYLGLPPGRGVTRGSGPGNLKGKVSAVQEVPGARSALRSNATEISVSTINNGGTEKLPRERGRSAWLKSRSTSPEHRSDRPTAPEINSVSRAGHGSPLQRTSKGSSIERTAMATHSSQGHDPDHSGLLPYLGNRAFGKLVLDHGG

SEQ ID NO: 939243 - protein, 91 aa, Homo sapiens
LNTFHNIALVTVMSTVESAMAPPASLTHWRILLSGLPALHLHDFLCQLSGYSRSSGRRSHSPVGRGTGQTPRPTQTTIHELCSPALPPVSD

SEQ ID NO: 939244 - protein, 99 aa, Homo sapiens
MASDTQASGTATWHPPRCLLPLHHDSGASPTSAHAHHKLALSLETRPSSRGASGGPPDLPVSLSEHLVSVYKEDVYSGSLGTETYLREWSLCSAHPPEE

SEQ ID NO: 939245 - protein, 70 aa, Homo sapiens
QQILRCGVRKDDRTGTGTLSVIRTTKKRKKVKKRIPFADKEKSVLEGSFGGIDVVYEGIQNDKKLSSKGS

SEQ ID NO: 939246 - protein, 134 aa, Homo sapiens
EIESHSVASLQYSGAISAHCNLRLPGSSDSPAWEAEGAVSRDCTTAFQPGRLSGTLPQKKERERKREREREKGKERERKKEREREKELQEQFLYFIFTLEISQICFSLKEHAYVKLNDCWASCTFSFQTGKALK

SEQ ID NO: 939247 - protein, 146 aa, Homo sapiens
ATMGSTVVQINYHSAVTHQKKDFLLSRDKYKSIVEIWLQNVERTVKGIAKRRRYRCRSTASYQRIFKAQSPNERALGPPFRTLSGGHPYQKKRSPCSMAGVMPFPYCFFRMRAIDSAAAGCHTPFPEIEYPFYYSDDPGCPIPSWW

SEQ ID NO: 939248 - protein, 87 aa, Homo sapiens
AASSPAKEEEIRTKTHNRGKTMGRHSRWPRRDPSEEINLGGAWCFTPVIPALWEVEVGRSPEPEEFETSLGNMVKFHLYKKISRVWC

SEQ ID NO: 939249 - protein, 111 aa, Homo sapiens
GPPPPVRGGCGGGGEFPPPFGPTLLPGHSPPPKKGAGVFLGGGGPFFPLKPIFPPLFFFWERGGKGGGGPPLSPPPPLGGGGGPKFFSFPPPWGLFWGEGDPPGKLFFFTP

SEQ ID NO: 939250 - protein, 107 aa, Homo sapiens
MYWFLGVLLWVGGAYPTRTEKAGEVIPVLLRDVIPRFRPPLWIGSDNGPAFLAALVQKNGKGIGDRTETTCTSRPQSSGKVERMNRTIKNSTTVFPAGYLKQQHKGH

SEQ ID NO: 939251 - protein, 101 aa, Homo sapiens
KMYAKCQKKLAPDWLIFFIGGYDKKDNTCSMFVYGGCQGNNNNFQSKANCLNTCKNKRFPCLDKDALEELTECGSCSEYMFLYMTDAKDWIHSLTLRIQRS

SEQ ID NO: 939252 - protein, 83 aa, Homo sapiens
KRKIRDESLCPPTPGALSLFCYEDQEAVCLICAISHTHRAHTVVPLDDATQEYKVGNAHHPPISLWVNRQNRQRMTYSLAHTS

SEQ ID NO: 939253 - protein, 117 aa, Homo sapiens
TTINKQPPQKNNYNSISSILIMLLLTSMSLAIIIIVLCKFLIKPFLNDQNCSFISPFAYLETPYICMDNIRENEISTKRTSIISLTPWKPSKSTLLADDLEIKLFESSENIEDSNNP

SEQ ID NO: 939254 - protein, 87 aa, Homo sapiens
KNSSLCWISVPREPRVLVEKRWTCSQHHSRQQQMAIEHFKMRLSVDASPEKSPVKLRKIVGGILGGHLDQHSSLPQIYRSKKQSPEK

SEQ ID NO: 939255 - protein, 72 aa, Homo sapiens
PVVEVILAGDQDFQRMDSLLLSSLVNTAEIIPKVWVSPRSYQNLHHTVVSVDGSHHERCPAQFVPCIDICAF

SEQ ID NO: 939256 - protein, 46 aa, Homo sapiens
MDQPRACPRSMGIVWLCRSFEVKSFQGGIVSVENQVFTGKLTPRGR

SEQ ID NO: 939257 - protein, 67 aa, Homo sapiens
RALSLTKTPAIVCAPWPPHACPPLCMVSWEKRDNVPLPAPAPFFCWFSTNTYPHSTPRTSRLHPQSM

SEQ ID NO: 939258 - protein, 74 aa, Homo sapiens
TQAPSLELPDPAYPVRANKGESRGFAAEFQGSPWRDQASVWLLSGLLQLLTLDTFEHSDQEKPAQPSLHGERLC

SEQ ID NO: 939259 - protein, 38 aa, Homo sapiens
RQCGQGCWGMGVAGGSTPLIRPLLLLAPSPGDLAAAST

SEQ ID NO: 939260 - protein, 88 aa, Homo sapiens
NTSHPNIRAFTPRLTVRNTNSERRYRFSTEKHDYANRERSRRASAPRATLISHLSLLSFSTVQKSITHRISLRNYFDNLISLNISQPP

SEQ ID NO: 939261 - protein, 67 aa, Homo sapiens
PTAPPYDSIQIYGYEGRGSVAGSLSSLESATTDSDLDYDYLQNWGPRFKKLADLYGSKDTFDDDSEQ

SEQ ID NO: 939262 - protein, 118 aa, Homo sapiens
LRLLLAWESRIRCRHSGPFLQRRPPFRRGSLQPTSHNQVPPFSGMEIAIPQFPRFPPSPRPFFPRVEVLKPPSPPLFQLPPSLLRMEIHYSLPLSRVDSLGPAIWSITALLGSEDQAL

SEQ ID NO: 939263 - protein, 183 aa, Homo sapiens
HRADEVSHGVWNVNGKREMCGCTAFTGDSDASCFSLFSLNRAVIVILMFVLGNLNVHTLRQLQRRRPAPLKHAVHEYPVLAQAAQVEVAAGVGPGLRGRQLRSGPAMAAAARGREDLEVAPGDEARVAHAHVHRALRRVAAVVTERFFIRYSNSRPSRRATAQPPGGDPPPPAPTPPAPPPAG

SEQ ID NO: 939264 - protein, 140 aa, Homo sapiens
VCVCVAINVQPSGNTKRKHMRITGSLPTGVVRRGPQSSRPQNGRSTDSLHCIPGKASDVQRQPVKAARSGAVPCKATEAEPPKAMGAHLLPQRDLNHFSFLPLCEEGYVCFPFCHDCKFPEAFPPTQNCESIKPLSFKIK

SEQ ID NO: 939265 - protein, 107 aa, Homo sapiens
FRSKYASEWSIIFLGIQLNLSMKSKYVLSQGSWQLKAPSFCPDAPTLNPQERNTRWRVHACVVSPAFHLPCRDRGPWAELRVPVSVFLREMELTSTGGGVPSDSATG

SEQ ID NO: 939266 - protein, 106 aa, Homo sapiens
LNAKKRVGINPFLFALWVPPFTFPSIKFPLGHLVKPLSGQEAHFWIVVPTNPGALWVFPPLPPQNPVFIWCFWKQGLPHFRPSGKLPIFPPVTWPPTHKFRFKNKF

SEQ ID NO: 939267 - protein, 146 aa, Homo sapiens
TYDFGSSDQPAQGTSHEFQIGTPLEIGLSNPAATPRAPRTLAKGSLTDSFPDLLSLAAEDCCCLIALEAPWTITDAELWITLTVEDSQLYEDTLAGRSVLIKNLTPQTLQPRWTGPYLVIYSTPTAVRLQDPPHWVHRSRIKLCPS

SEQ ID NO: 939268 - protein, 165 aa, Homo sapiens
SSTISSPFSARIDFNPPSALIACSEIPQKFRFFVLPFVDINQLRNCRTAGFNLEDYNGLFGAVAVNVKVFDINQAGTYTAFGLGGSFFVGAHVVAYVFHFRLYFAVSQRNLISVAVLPSARKRISKISEIEMSQRRVGRYLACSQFTLKIQVIQVKVRQRMLLIP

SEQ ID NO: 939269 - protein, 117 aa, Homo sapiens
LPPPPFLKPKRGRLWAFFFPGSNPEGVLPNPPPKSQGLGGPRVPPVLARVFGGHFFPLSQENPPQFGFFLPPLRPVGPPKMAFPGIFPGFPFLGTPPGFPPFSRVWGGGFPPPPHFF

SEQ ID NO: 939270 - protein, 88 aa, Homo sapiens
MQRLSGQIQSPSREGGFRMRFLLPSDLRSEQDPTDEVSAGCGPALVTILALPRGRSRGRPALGAGWLGAAVAMYVARCSAIRSNSAEA

SEQ ID NO: 939271 - protein, 69 aa, Homo sapiens
NRYCLAQPATMCTGRQHSSSPCRELQRSLSQMGQWNDTVHRLALLLVLPFIGIEEKQLVLFDRTANRPP

SEQ ID NO: 939272 - protein, 84 aa, Homo sapiens
NVLVESGEKSLGEGEKADVNVFRKRNGGENENGYCRSSGVDGVGRRIRAAVIRRRIKISRVRNISDITKYDVIACVGDDNGNFN

SEQ ID NO: 939273 - protein, 107 aa, Homo sapiens
QQEHAFKTQIAHAFVCGLRMPLSSFPPWAGQVFLALIPVNPQPSSLGIRAIMDISQCCRDFVYGQFWGQFMARFWGACSQQSIAPKKVLNIREIQIKTTVRYHSTPI

SEQ ID NO: 939274 - protein, 107 aa, Homo sapiens
QAFFLVAEAIMDSSLTRRGQICWYQNPGVGLDPINDATLLEACISPLLKLYCREQPYYLNLIELFLQSSYQTEIGQPLALLPAPQGNVDLVRFPEKRSKFIVKSKTP

SEQ ID NO: 939275 - protein, 81 aa, Homo sapiens
NACSEIYIHGLGLAINRAINIALQLQAGSFGSLQVAANTSTVELVDELEPETDTREPLTRNFPPPPKPTQIHIRVFRVTPK

SEQ ID NO: 939276 - protein, 66 aa, Homo sapiens
LNKSSAWGVLQELRTLSQCWEEGYLVSPVKPMKPMRPATWGGVVGRLFASTSRKACERSSQDFRTT

SEQ ID NO: 939277 - protein, 102 aa, Homo sapiens
MLTPEIQYLMDLGANLWVTKLLEVHSRFPAVVTSHRPAACLPFWGPPGLPCRGAEQDAAGAGRPQPPPGATSDPGVRGGSLGEAASQDWAHEHREGLTEISI

SEQ ID NO: 939278 - protein, 89 aa, Homo sapiens
GEYSCEARNSVGYRRCPGKRMQVDDLNISGIIATVVVVALVISVCGLGVCYAQRKGYFSKETSFQKSNFSSKAPPMSENDFKPPKSFII

SEQ ID NO: 939279 - protein, 69 aa, Homo sapiens
SPTGKIVRPASSTARRRRYTMESRSVTRLECNGAISAHCNLCLPVRGEASWTSWVQWGLGELFCLAKDL

SEQ ID NO: 939280 - protein, 43 aa, Homo sapiens
ERKKGRKDKEKRKKRKKGKEKGKEEKREKEERKKEKEKDRKKG

SEQ ID NO: 939281 - protein, 72 aa, Homo sapiens
MARGYVKAWESSKEAGPPYYSNTGCGRKTTRKGERGDGEKETHILEIRRVFYDKEIQEFSLRILDEKLPTPT

SEQ ID NO: 939282 - protein, 100 aa, Homo sapiens
KRNGLTLTVIKVIRRPGMVADASNPSTLEGGGGQITRGQEPETSLANMMKPRIHQTHKNQPGVVAGTYNPSHSGGWGRRTARTRNVEVAVSQDRATALQL

SEQ ID NO: 939283 - protein, 42 aa, Homo sapiens
DKKKKDKKKKKGEKEEKEKERKKGPSKATVKAMQETLAKLKE

SEQ ID NO: 939284 - protein, 50 aa, Homo sapiens
TPEKKMTLAGRGGSRLQSQHFEEAETGGSRGQEIETILVYAVTPCEYYKS

SEQ ID NO: 939285 - protein, 49 aa, Homo sapiens
MRELDTRGQKQVNPNKKKGEKEEKEKKNQKGPSQSPVQAMREALVKLTQ

SEQ ID NO: 939286 - protein, 62 aa, Homo sapiens
KEEESKKKEKTVTKEEEGEGRRRRTKKKKGGGEERTKEKKMKEEEEKERGRRKKKEEELRRR

SEQ ID NO: 939287 - protein, 44 aa, Homo sapiens
KEEESKKKEKTVTKEEEGEGRRRRTKKRKGGGEERTKEKKKKEG

SEQ ID NO: 939288 - protein, 36 aa, Homo sapiens
FLSGCEKPTEGQEKEASRKDRRAGKEIDISKGESYV

SEQ ID NO: 939289 - protein, 58 aa, Homo sapiens
MLFAVCGSGTSGISNTGDTVKMTNSRALTPNLQNQKLWSEASYLNFNQRVILIKFENH

SEQ ID NO: 939290 - protein, 210 aa, Homo sapiens
FSLGSLCHELKSAFQRHKYDRISYQKMSSSIEVFCKGYPSNFSTYLNMCGYCEFVVYSGYSYIRQLFSNLFRRQGFSYDYVFDWYMLKFGAARNPEYVHRDRLEPELEDRMGHYQGSATRALLPGPPSVANANRLSSAAEPVACTPASCIQPAGNTSPRAILRVARDSKVSMSLHRGAPANVSSSDLTGRQKVSRIPASQTSVPFGHLGK

SEQ ID NO: 939291 - protein, 96 aa, Homo sapiens
LPQQNALQGTDTQHGLVSPPNSATLNLRPSSAPERAKGLKSSSCQSSLLRSCPSRTRIPPGGSASHCVSHPFQPPPTSKKKSQSRGNSPAAAILDG

SEQ ID NO: 939292 - protein, 34 aa, Homo sapiens
MVSGIYILGLNYNRVGCFSVSESIILLPCLCWLY

SEQ ID NO: 939293 - protein, 113 aa, Homo sapiens
PSRLVHTGLGWTELKPTWCLALLNRENKVEETLWSQFLGMDLKKLTTSMSYLLGCSCSQPLCCEEDHVVTHRGRMPGSCSQPSLAHEWAVLGWPNSHHARRAGGSSHRALPNL

SEQ ID NO: 939294 - protein, 72 aa, Homo sapiens
IPSLQRWSLIYLTPPCSKTMDEDIVIQQADEIRLKIVGTRVDKNDIFAIGSLMDDYLGLVTEPGGLPPLVLL

SEQ ID NO: 939295 - protein, 106 aa, Homo sapiens
MQREDMKSAEFRYKTSSSHLSREHIPIQFLDQTGICHSFQLGDLVYVKKFQKEGLTPAWKGPHTVILTMPKALKVDSIPAWIHHPHIKKTNKAQQETWVPKPGQAP

SEQ ID NO: 939296 - protein, 83 aa, Homo sapiens
MGFGDRFGYPRGSAELLANGKRNAGDFQEVTSQGLKLLLTVDCDEMPAEAHALGAKWLLHLTAMKTGVGMVLLDALQQGPNPL

SEQ ID NO: 939297 - protein, 75 aa, Homo sapiens
SVPIIWGPLVLYLSWSYYRTFAQGNVRLFTSFTPGNASFFPDFALRILEGGDLSAFPGPEFLKAQNPQLHPRHFW

SEQ ID NO: 939298 - protein, 77 aa, Homo sapiens
MCNILGCSLALSFRLECGGLILAHCNHCLPSSSNSHVPATQEAEAGELLEPRKQRLWGAKIAPFHSSLGNQSKTPSK

SEQ ID NO: 939299 - protein, 114 aa, Homo sapiens
MSRQPDIPKITANTTERFLDTGDTSRDFFHLSMAETVFPIIIMTHISEELEAWKEETTCPFPLRAIICIHHLLKRTFRPGAVAHACNPSTLGGRGGQITRSDQDHPGNTPNPVS

SEQ ID NO: 939300 - protein, 112 aa, Homo sapiens
TRICGGWEWKVVQSLWWRFLKKLQIEWPYDPAVPRLGIYPKERESVHQRDTCTPMVLAALFTIAKIWNQPQCPTTDEWLKNEIVFHCGCWYIYTMKYYSAIKQNEILSFAAT

SEQ ID NO: 939301 - protein, 113 aa, Homo sapiens
MLTSSQPQLVPCFSSHSPQITHSSSCHFLSRLLCMTLHLSCPVALAAHLLSLLAIFTKGFAFGEVPYQLLLTAATTIHFHTPNFFLSLSIPPHHFPILLQPFPLFFSTPSRFI

SEQ ID NO: 939302 - protein, 107 aa, Homo sapiens
HTQTHSTHKRTAHTHTQHTHEHTAHKRTAHAHTCTHSTHTSTQHTHKDTAHTCTHSTHTRTQHTRTQHTQHTHKHSTHMHTAQHTQHTHEHSTQHHMARTHTHTHTG

SEQ ID NO: 939303 - protein, 69 aa, Homo sapiens
EDILFKGFRSTVPLNDKVQDVAVGCSGRRILVVLTTLELRRFLTTVICDITHSNSSTWDGEDMNPVLKP

SEQ ID NO: 939304 - protein, 66 aa, Homo sapiens
RPSVRAKNRQVDGGGRSPREPNGRGRSRQTRFSPYPIPAVEPDFLKSVLQQRLIALGGVIAARISV

SEQ ID NO: 939305 - protein, 103 aa, Homo sapiens
ALVESLPPPTLRIGTAPAEPGLVGGSGCAFFMAYSGPLRFQVLCGGDLEGVGYRTRDAIQLLILNGFVLTRLNYPCSCGRHGGFAFTYAGHVAVKKNGVSDKI

SEQ ID NO: 939306 - protein, 188 aa, Homo sapiens
LNQYTKTFGYPPTDEDALPSFFGSMLGQEIDPLRNVLVTVAGYGALFTTFQALVDEGDEVIIIEPFVDCYEPMTMMAGGRPVFVSLKPGPIQNGELGSSSNWQLDPMELAGKFTSRTKALVLNTPNNPLGKVFSREELELVASLCQQHDVVCITSTMYRSHPSSAWPLLRLRYNLTFPGSSWPWGVAF

SEQ ID NO: 939307 - protein, 151 aa, Homo sapiens
QIRRAEDVGFHCGVNSGARIKFLVCDKLPGTLSLSSSCQCHVVRLQELGKVVTREIGMLAFAPMRQRVEVDQDVVDEAGMAHDEPVLRQSGDEPLHQRAKIGSAREIIGAGEIGIEGEIGLARTAAELGAEDIEHQRLRRTQSLRERLVAA

SEQ ID NO: 939308 - protein, 143 aa, Homo sapiens
LAAVYLFSRFPHASMSTKDNKMTCVQATHTKWQVPHSAPHGAKTYVHDSLWFCFVLLILCGVKILLQMPKRPADTLMGNSNKKNEAFVFIYNRESQAAGETGQWCKCEMSYKRIGCWDHYIYDLKKQKHELLKFYVERIKRSQ

SEQ ID NO: 939309 - protein, 168 aa, Homo sapiens
NVKISDFGFAKMVPSNHPVGCSPSYRQVNCFSHLSQTYCGSFAYACPEILRGLPYNPFLFDTWSMGVILYTLVVAPLPFDDTNLKKLLRKTQKEVPFPANHTISQECKNLILQMVRQAPKGAPLLDIIKDFWGVKFQPEQPPHEIRLLEAMCQLPNPPKQPQSLQISP

SEQ ID NO: 939310 - protein, 113 aa, Homo sapiens
LSSRSNSALTLTDSEENKSDSENEQPASNQGQFTLQPLPPSHKQHFAQHHPSITFFNRNSLTNKRNQSPAPPGALPAELQTTPESVQLQDNWVLGSNVPLESRHFLFKTGTGT

SEQ ID NO: 939311 - protein, 105 aa, Homo sapiens
MGPRGPFFQFLPPLRAERINPPPPGGFLNRAPRTPPPPGNPGPLGSVLGGRIFKVFPNLELGERVFPKKGDPPQKPGGPPGFFCFPPPPSPFYPRFSPPFSPFPV

SEQ ID NO: 939312 - protein, 116 aa, Homo sapiens
GQGGAPPNGLRKPQGALREKPSLSVAKSCIRGMRQGTQGFGSPWGLGAAPGRGKPGQGWCWARSSIFRCYPPLPPLTAQAKSSGLQFSPFPTPFLFGVFTFAWVCSLANKPSLCGS

SEQ ID NO: 939313 - protein, 119 aa, Homo sapiens
FGFGGWVGFFLPGSPKLGSKKLWVNPKKSMWKRKVVLMKALQMSAIDSLGNSKRLLNQGWPVKAAMESMAKLPGPALKARYPVKEKIFFKGLKVKIIPLTLCDGIFRVPFFKGNQFFPM

SEQ ID NO: 939314 - protein, 38 aa, Homo sapiens
PSVGVDISREERLHKCRLCYKQLKSISGLVKSKSSERP

SEQ ID NO: 939315 - protein, 95 aa, Homo sapiens
KPNPPQKKLFKPPPCSPPFWAPRVWGDFRGFPPPPPPRVLQGPPFFLVWGWGGVGGPLFPPPGPGGPKGPPRPKKPPLGPPPGFPPPLFPNPLFF

SEQ ID NO: 939316 - protein, 111 aa, Homo sapiens
GHKLASVRRSGYQQPEHQQRSPAPPPQQPAPRWARSRGGMKAPRRSRVKAQRRPGRLQLAGSARRHHRRRRLLRPPPPPQTRAPAGRQPGPIGTGGLRSSDPGCVPWFRLF

SEQ ID NO: 939317 - protein, 71 aa, Homo sapiens
KATCTSSVSQQDSRSRKRAGQKTPTLAGRHVPLKIEKQAIWVPHSSYIRLGQFLFTEDYKTLPPTHLVTPF

SEQ ID NO: 939318 - protein, 41 aa, Homo sapiens
HPARQHHRLYARRKPASQGSMAAMQSLACAMAIGRSRHCAA

SEQ ID NO: 939319 - protein, 78 aa, Homo sapiens
NPALVAKLKGFQQENEELKAGMAKHMAISRQLSPEQAVLQKSLEKESKVTKRLFMENEELLWKLPNGDLCSPKRSPPL

SEQ ID NO: 939320 - protein, 87 aa, Homo sapiens
KLAKKRKETMSSTRQEMTVMVNSMDKSYAEQGTNCDEAFSFMDTHNLNGRSVSSPSSFTMKTNTLSTSVPNSYYPDPFVPTAILATL

SEQ ID NO: 939321 - protein, 144 aa, Homo sapiens
GGGPLGVALSPIRELGPRFPVSGRALKNCPFPLCPRAPGGPGGVKGGPFLKKNRVPRGAPPPGGIFLGRPKNWDLKTGPWGQQPPSPPKGGPPPWRVFFFGGGGKIFPKGAPVAGSQGPPVWVLGPGLSPRAPCFFFFGKRGPL

SEQ ID NO: 939322 - protein, 104 aa, Homo sapiens
MTVLKEAIPLGRVTGETTKQLAKAVQVHQDTLRTMYFAGHVLMFNDCVPSGILETSYTQTHKWAALPVQAALDIKLAFVLIKFPVFQNPFRPRFQTWILNCSPD

SEQ ID NO: 939323 - protein, 148 aa, Homo sapiens
IRAKYEQRLFLAPFKNAQEVPLAKQLFKSVQEKNLPNVLLLLAYSNKEQINSPTGDRDRRTALHVACELPNVVMTQLLVWYGIDVKAKDVNGHTALFYARKSANQECVDILLQHGCPNEPSSSMSTPIQRRKSSCSSILRTDSRTALV

SEQ ID NO: 939324 - protein, 55 aa, Homo sapiens
RRGTPVRVHRDGPALTPAARPAGALVLSDRRHSPPPLPFRARSAAAAIKLLCREK

SEQ ID NO: 939325 - protein, 82 aa, Homo sapiens
CTSSAPEEKVLLCHKTHTDIALKGGELDLSHMRDAHTAQPGSFPWFSGMTTELTLVGFFEFKEEFVPCYLCSFVMTVSWIIQ

SEQ ID NO: 939326 - protein, 156 aa, Homo sapiens
VHSVQHDGKSLLQFTWSGIGSFKALVRPEIGLLRIHAPWLPMSAARRGGGCSGPLGARRKSEQLPAVAAPRRDLPAPRPPPRPGGCAAAPLPSSAPSSPPRPPSCSHPPARPGLFSSGGVVGVGAYVHGSAAHRPLPEIAPPARGPSYTALLPAAA

SEQ ID NO: 939327 - protein, 69 aa, Homo sapiens
TSPLPLQNKFRDFQKQAFNGMGEQFSYSTLASFFFPGIGRGGSPSLVMVFIFTYGLQGTGVKSFPLPAA

SEQ ID NO: 939328 - protein, 121 aa, Homo sapiens
GPPFGFGVTPPLPFWLPPVFPGDWPLLARGHFGGKKMVPRDCPIFNFGFGGFILKVGFDPFFPFFFWGFQRPRLFVSREVLPPPPPPSWSPFFFPVWGKVLGPAFFLGWGFSSKRKKVFLN

SEQ ID NO: 939329 - protein, 123 aa, Homo sapiens
MGEGPLNYAQLWGGPLKCPILWGFQKWNPRCTGVGWGLQDSPPKPPYVKDRGTGVASPSPQAPLCLVVCWGAIAGPAPRKGPRPFSPFLYPSGPASSPFLTDQWGFLPAARSFPFPGGFCAPE

SEQ ID NO: 939330 - protein, 234 aa, Homo sapiens
GRVNFFNVDMLLLEEAICVTFLGGSKPPQRVIFIEDLKLAATFVARELMDTVSHHLRDQRPWLLWLLLCFLGCVSLLCPDLLPFLFACQRCAVFFFFCLFMLWQHVWGTAVMVAILLKLGTSGQEKAWFLVASMNPMKGADRTPSLPVSTTSTAPGPHARGEGDTPKCSKICEPGYSPTYKQDKHYGYNSYSVSNSEKDIMAEIYKNGPVEGAFSVYSDFLLYKSGVYQHVTER

SEQ ID NO: 939331 - protein, 113 aa, Homo sapiens
IYRCFMIRNRIILFKKVLNFFPNEMRDSTKSFTTCGSGAPGLTCPHRRRVNTKRLTVDERTYVDVKNRRVNRCTTLYGEENCYYVAMHYIAEAMALQLYDVAKLHTEGYIPRK

SEQ ID NO: 939332 - protein, 123 aa, Homo sapiens
QDLQLVKGTMVATYLALNRSKAPPQVKPIELSILGQRGVRKFPSPPLLGPRAFGPQGGASFTQSACFPKGAGRNPRAKGSWNPRGRGNCQPQTPLIRVLKVPFPSPGWAFFGSGFGGGKRFPV

SEQ ID NO: 939333 - protein, 99 aa, Homo sapiens
PGIAGANPALRFNWGEPMPWPLNMFNRNRVDTSPPPVFWHVMCMQLFGFLAFMIFMCWVGDGYPVYQPVGPNQYPSNNLYLERGGDPSKEPERGVPYEI

SEQ ID NO: 939334 - protein, 124 aa, Homo sapiens
PPGGAPLKPGVFSKFIQPIGRSNPGAKKILGEVFLLLPLGGGREQGSPPRRVLAPVPPGALMAKNFPWGGGSGAGVGSKDLGSPKSFVFLKKLNSCFLKNFWGYMFGFLKPLRGPPPFHKNPAW

SEQ ID NO: 939335 - protein, 104 aa, Homo sapiens
FSAPFSPHSTAKRPKRFPLVASGVFKPNPPNKQVHFQSLGFFVLGKRLTNLKMLSAPCLFISSGHAHPCCFGWRRCHACSLFVSHPPRAIPCEVGRPGWTPFPE

SEQ ID NO: 939336 - protein, 128 aa, Homo sapiens
GTGDRAPFFKGFPQLCNLGFWPVNQEYLLGLLTSLKVDFYQLKLINPLKYPEGVPPPQKKLFPSAGTPKFSRERVFNEWGIFSLFFFFFLIKKKKAWGSWGYPVFLGLGWEYKGEIPLLPSLLFHFFQ

SEQ ID NO: 939337 - protein, 100 aa, Homo sapiens
KLLGGPFARGKIPCPSRVPHQDSKSWKRAGWKTYPLGGKPLPLKIENQAFWVPHTGYVRVGPFLFTGDYETPAPSSLGAAPILGPSPPPPGGSLKRHVAP

SEQ ID NO: 939338 - protein, 86 aa, Homo sapiens
GGGGTRKGPPEGARGKGKGAGRNLKQQLLAKELDAQLGAYNARMGPRLTAQQIRVRNRTPGFPFAPWLGGGGWGCAAQDGFVFFMF

SEQ ID NO: 939339 - protein, 106 aa, Homo sapiens
GFPLGKGGGGPPPFFLGCSPLWGPPGFPFCLPAVFLGGMGGGYPFPPGTPFSWFGVFFGPPLGVLAPGAQIWARGVVPLVANPFAPFSPRPKTVFWGGGGVFLIGF

SEQ ID NO: 939340 - protein, 208 aa, Homo sapiens; identical to SEQ ID NO: 939083

SEQ ID NO: 939341 - protein, 107 aa, Homo sapiens
ARADALIPRLRPTPCTKWALSGSPVPSSPLTAAESPERERARRGGEGCEPRGPAGPHSGASPREAGWPLAPRCPSRALAGPRARASPGMAPASRGAQGRPPGSPGAA

SEQ ID NO: 939342 - protein, 156 aa, Homo sapiens
TCPKRPQTERRRPAQGPTIRQLLRASSALGAEVLAESVNTRLTLVHSSGRKACPKVGAGRRRPGGRTSLPGHREGSLTMGSRFTRRTLAPCRPCRQRRSPHTSLPTRMVGKVVSVGVAALQISSKAAPEAWPGARLAATLSGARGGVARHSSSAAA

SEQ ID NO: 939343 - protein, 68 aa, Homo sapiens
RSEIDLLNIRREFIEEYDKSLHQAIEGDTSEDFLKALLALCGGEDKGHSFGGHFCQEMVISTSRHGQA

SEQ ID NO: 939344 - protein, 95 aa, Homo sapiens
GPPVFMATSVPVATSVLVATHGCRLCSTCSSRTGSLSAFGGALEQTFLPVHFPSHQGPDLMSGKANGSEWARINMPKSSYYKLRGLLPWAGSVLP

SEQ ID NO: 939345 - protein, 103 aa, Homo sapiens
VPPVFGMWPFNWGGSLGGLKNWPSCKPLSFLRGCPKWSLALGGFSTLAPPVPKGPQEPFLLLDRVGGGGRGPPNLAFFALFFFFKFQVIGGGPPFAQMVLCSF

SEQ ID NO: 939346 - protein, 74 aa, Homo sapiens
KDLASHHDVVGFLVAGTLLKALFMDIVDENKYAPAMFPALLERHGVICPSVQYVPFPCISFKWGHSSFLGGYSS

SEQ ID NO: 939347 - protein, 108 aa, Homo sapiens
QWLILLYRRPMGMFQPAVLSTAVWQDFLPSRLFQFMSGFDFFTTATERYTFLRCFLAISAFIVLCQDRHQTTLARYVDISSVQAHGVSFSIHDLGNAVFWGLCRFTLY

SEQ ID NO: 939348 - protein, 146 aa, Homo sapiens
KNFNTVCFRQGLHSSQRAIMVSLHTSGNAFSFVSESRVSFRASSLFFLASSKTLSSVLLLFVRFLYQSLDLLHALDGILNFPIDVLTPLSGHFLQLIVGDQLVSQDLPTLPAQQQPHTQQQSLHLASSSSDTGAQECLGLRRRRSC

SEQ ID NO: 939349 - protein, 148 aa, Homo sapiens
HNLMVLSRDPEDNLTVIREEGNTQYILGMAYKSSCGGARCEIPEAKGSSQDPERANWPSEDDDHITNEVGVTPKSSLRDAIVGLIPSQLPHDDGLVSRGGQYHVRELRGGSDLGNPAIVALEGATKGHLLSHGGSGCECRRSDEDGTG

SEQ ID NO: 939350 - protein, 72 aa, Homo sapiens
RMSGAINILNLRDNFLVVGEWDPLLVQSGDGMKGFGRELDGYKRKNFIPAGDDSGFTKQTFPVQTEYFGFAW

SEQ ID NO: 939351 - protein, 148 aa, Homo sapiens
DQELKALRTETRFSVLQEEAAWGQVEALQEALSRAQAVLQEKERHLLEQTELSHSLEASTATLQATLNTCQTHARQLEEALRTREGEIQDQGLRHREDMQQLQQALARRDEELRLQKEQGQLLEKLLAQRDQEDVLQERQNPGQQKKE

SEQ ID NO: 939352 - protein, 65 aa, Homo sapiens
KPYELEPREIARGPPHMFPPACAGPQPPPHTTGSHRQRQRGKVQQWPTAGSCTGRESPALQESAP

SEQ ID NO: 939353 - protein, 134 aa, Homo sapiens
QQGALDAVKDLPSVHVEEALVVAEGPESGLRLLLQERCLVAPLLLRLLLFLGAVAAARAHGHCHVPLGGHLVTLARGGGIGGLGQEIGGFLELVEGQLVGRCHGRRALLTASRSEDGAPFPGPVPRLQALRSEL

SEQ ID NO: 939354 - protein, 141 aa, Homo sapiens
HGGQTESPEDFPRLPVGEDHTGPLEDGVRDGNRPPARESLCLLHQGLPHRLVATQDDHRPGAQVHREDVPVFLPQPLEGVEKALVMDLQDVPQEGQRPRSGRKVARGGGAAPGPEQQEASEAQEEREGGQHHGPLSACREL

SEQ ID NO: 939355 - protein, 88 aa, Homo sapiens
MHHDSEVGQSLIALAEEALLELLYSCFGLLSVDEPLKICFVFLHRNRWIDGLFHDALQKNATRTCIAVKGEGSKQEDHNHLHVEAAVF

SEQ ID NO: 939356 - protein, 178 aa, Homo sapiens
PHLPQRQQAHLRVRQHADDMAVLLHAAEVLVQLPLASVVLPLLAVLGEGLLLRLVPVLVEAPLALVTDVLGEHRLEGAEAPRGLHVAHDAHDHHGRGLHDGHGLHHFLLVHLGARPVHLPHDVRHAGLVAQEGGEVHGLARVVLGEALHLAAVPAAALPGQEAQGPVPGRRELPVRHR

SEQ ID NO: 939357 - protein, 154 aa, Homo sapiens
PNALGCAGVHPSCGLTDASSGVHLVIWLMAVVLDPSLVGVHSLGGGVMEVPVGQASGLPAVFDLAPGHGAMPRAVILADSREGGQRLVPLHELVAFLAADNEVVTELVLRLQVLDDGELIERLGLGALDDLGGVVQLPAPAVPRLVREKQQIHL

SEQ ID NO: 939358 - protein, 68 aa, Homo sapiens
AVGGFDGTTYLKTIEVFDPDANTWRLYGGMNYRRLGGGVGVIKMNIVNPIYGDHVEDSLVYALYSGEL

SEQ ID NO: 939359 - protein, 89 aa, Homo sapiens
DQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 939360 - protein, 117 aa, Homo sapiens
GQPPGKAKIPAPVSSVCSQTNGALGPTPRTAPPAPEPAALRAHPVVQLEASPGGPATNLWDPNQAPPPLRVLWPHGQQDPDPLWDLASNSPNLLMVFKTLMGRVSGTPGQNKKVLFF

SEQ ID NO: 939361 - protein, 114 aa, Homo sapiens
CSMKSNVILWELNTSLTKEFLRMLLFTFYVRMFPFPKKSSQSSTYPFADASKREFQNCSIKRNVQLCELHAIITEKFLRRLLSRFYVKIWPFRTKATKRSQYPLAGPPKRVFQT

SEQ ID NO: 939362 - protein, 82 aa, Homo sapiens
KKKKFLAERRKVLAIDHLNEDQLREKAKELWQSIYNLEAKKFDLQEKFKQQKYEINVLRNRINDNQKVSKTRGKAKVTGRWK

SEQ ID NO: 939363 - protein, 72 aa, Homo sapiens
KGGEKASFGKPLGVWNPQALGALGGFFTRGFPIPRGKLGGPFTVLGLAHVDFFLTYLSKPSVGGVILILSFS

SEQ ID NO: 939364 - protein, 71 aa, Homo sapiens
EPGKEAVHPVDVEPRGFSKKFPLRFVFQGGPGRGGLDLFLVNIAIEIQLDTPTCPYFKSVITRTEFCLYDF

SEQ ID NO: 939365 - protein, 36 aa, Homo sapiens
VLLLLPSPSSSFVTVFSFFLLSSSFSSLLSSSRNSI

SEQ ID NO: 939366 - protein, 78 aa, Homo sapiens
KLLEVKLGELPNWILMRDFSPSGILGGFQKGYPRSSNKYINLKKGSISGITMVVACYGLFRNSFSYKHFKREGVRKYH

SEQ ID NO: 939367 - protein, 108 aa, Homo sapiens
QGQWMRLCTSSTDSKVARVNTNLRNAMVSHLDGTTHSVEDIGRSLLTYGHRIPLSEWESRIAKVDASVVCEICSKYIYVQCPAVAGYGPIEQLPDYNRISTGMFWMRF

SEQ ID NO: 939368 - protein, 121 aa, Homo sapiens
RSKRESPTFPLPKQVSESPPHPLFWFPAPQGLCRPLFWGGPSQAYRLPLAGGKSPGGPLLGVFELGKRGPPPPPRGVFFNPKFPPPPMGGGRAGGTPPPFFFPLPSPGGKNGGAFPLFKKT

SEQ ID NO: 939369 - protein, 111 aa, Homo sapiens
TGSQTNRTCTWATHTHTHTGEATGSQMNRTHTWARAHHTHPHTGEATGSQTNRTCTWATHTHTGKATGSNTRSRQCLLRVASVSPRGNGTMGYFVFKITCFPEYEKYMNYL

SEQ ID NO: 939370 - protein, 72 aa, Homo sapiens
GQAGLELLTSGDLPSLAPDMLGLQVGATTPGHSLMSFEKVIYACNHHHHNQDLEHFHHPKIPWYSSLVTSKP

SEQ ID NO: 939371 - protein, 139 aa, Homo sapiens
MPGPLAASEMVRVPGPTSREGEGADWNRWEVAVAGLRPPRSQLHNLRLEFFPISASVSFSHKMANAADCGTLGDLSPPCAVTVPWPGALSGPLCTRMAASLRDCAGTTGGASGENPDSGCGFMNGKSFGPVRFPVPLFF

SEQ ID NO: 939372 - protein, 36 aa, Homo sapiens
MKYVAFLYDMKVREMLQHQKKIKTKKEVLSFCIKCR

SEQ ID NO: 939373 - protein, 104 aa, Homo sapiens
PPPPPGFGFWGGEFAPPQIFEPPLPGGPPKGGPRKVFWFLGPEGGPPPKARGLGLAPARGGQKRAKGGGGAGPCPPPALSPPPRFSPLGFEFLFFGHKPKIPPW

SEQ ID NO: 939374 - protein, 68 aa, Homo sapiens
VLCSEECPQDLCSYSSGHTTLWALNFFTHFGLWGDGSRCFVTRAWEWTGLSGKVESTLKVLEESYTGA

SEQ ID NO: 939375 - protein, 140 aa, Homo sapiens
RVKVFFFNINGCFPPLKEVGAPLPPPQGEQRWRFLRKSLVSPRGLQCELYSEFQIGAPGGRGVPVRGPLSPLTAKLRPFRPRRPGFLRTIAFCVVLGPPPRAGGPPPFRGPKEFCALWVSPHAPRRVLRKTKPIGGPWAL

SEQ ID NO: 939376 - protein, 98 aa, Homo sapiens
RCRLSLKDQVLREEPPERGETLGTERLERDWVPPICCDKFGFPNTSASVSLNHRAIGVLVGKTDPADQMQAAAGGKKEKKETLSRSLASTEGPNTRPR

SEQ ID NO: 939377 - protein, 134 aa, Homo sapiens
AKFAQALVRVWVAGEAIKVGSTKGRIEKLSDPPPGLGSVESSRIQGCFTTVGEKVRVKCNRIYLGALRSDSAQMVPVEQDCPKKWYTIFKDHVSLGDYKPDGITWSFITINRILIFLPRFPLPSSSPTWDRACL

SEQ ID NO: 939378 - protein, 32 aa, Homo sapiens
SEHERAAILSVPAAQNPEDLRMFARLLHYFRG

SEQ ID NO: 939379 - protein, 49 aa, Homo sapiens
RKLAVGGVNDGGGERQHCEAQDSHYLDRNGCFMDVRRCRLPIHRTRLDG

SEQ ID NO: 939380 - protein, 108 aa, Homo sapiens
MYMGGDYVYFENSSSNPYLIRRIMELNQTAYGNVEAKRGVLLPDGWDISKQPSIVPGRQSTQWAGVSWLRFPRGLVNEVLVTPPGSGLSLTWQSSASVVMVWLGVGSH

SEQ ID NO: 939381 - protein, 118 aa, Homo sapiens
KIFFWGAPPPPPPPALGGCFLKAPPPHKRGGGGGGGPPGVWPPPRPGPFGGGCRAPFGPGGPPPPPPGGPGGGVPPPPPPPPKGGGGVFFFFGVPRFGGAPPVWVVFGGGFFNPRTLF

SEQ ID NO: 939382 - protein, 114 aa, Homo sapiens
TAGQTSKLARQASIELPSMAASSYKSWWKPGGYRLSLRPRLRPARLFGSCTGYWLSSGKQECEQSAADLLVQEHLRTGMTLHPLSFCNDLVSRWQTRRDECAWIPESPGGGNSH

SEQ ID NO: 939383 - protein, 66 aa, Homo sapiens
GSIASVGAISAEFFNDSAFLNHVGGQHSFPGSLGMDGFGQSVGILARPATAYGFRRDEPYYYGYGS

SEQ ID NO: 939384 - protein, 103 aa, Homo sapiens
AGAPVWEPRMTLDTQAKVRPPQAQPCAGQARAVTAAWGPQHCCLVSPVASLAGFQPPGCPFLSQAGWGPVQDPAMYPKKRVPSSFLFSFFWKLLFRAPCPNQE

SEQ ID NO: 939385 - protein, 84 aa, Homo sapiens
APKAKTFFASFKREGEGKYRAECKLDPKTGFRPDPRPDPKLGAKTQPRLLVVPQNENRMEDRLAEPSRAKDPPISGVEVGKASP

SEQ ID NO: 939386 - protein, 152 aa, Homo sapiens
ASQNGRCNGSQDDGARRPSGRRREAASARSPSPRPTPTAAPVERPAHQDGANRFEPSSVDHAAAPLSRRAPRLPRAVKERAVDACACSGANSPEEGPVKTSGARSRGSGRVIIDPQGTRRPLKKSPTTLWKVPCTDPFPGARSAKQHGRAVI

SEQ ID NO: 939387 - protein, 135 aa, Homo sapiens
RSRPLRWQEDPEPEDENLYEKNPDSHGYDKDPVLDVWNMRLVFFFGVSIILVLGSTFVAYLPDYRCTGCPRAWDGMKEWSLREAERLVKFREANGLPIMESNCFDPSKIQLPEDECPVAKWGSRSPAFPTPCLPF

SEQ ID NO: 939388 - protein, 107 aa, Homo sapiens
GGGGVFFSKKPRGGGPPSPPPPPFFWGPPRGGPPPFFFFGGRFFPPPPPPPPPWGGGGGPFGGGGVPGVGAGGPPPPPPPPPPGGGPRGGGGGVFGAFFFSPKKKIF

SEQ ID NO: 939389 - protein, 142 aa, Homo sapiens
GQVLTAYQPPSPPVHSGFHRYQFFVYLQEGRAISLLPKENKTRASWKMDIFLNRYHLNEPEASTQFMTQNYQDSPRFQAPGSDKAKDRRNQRGLPACLPARPPGSPNSRESTPPTPTTYGLAVGAPLGYGTLLLLIKNNENP

SEQ ID NO: 939390 - protein, 107 aa, Homo sapiens
YPVGPGQALGRLLVWEERVNWGSGRPLLTTHPQIRRKSNLCAAEEFGVCGERGGRELESMDVISGPELHSWPRAKTPSPPPAPQVVIQNGFRRFQHQQFGDFVSGLL

SEQ ID NO: 939391 - protein, 67 aa, Homo sapiens
VMKMTLFLYYLPPKTHNPNLIMRKTSDKFQEGGILQHRAQNILKTVKVIKIKESLKNCHSQEKLEEI

SEQ ID NO: 939392 - protein, 128 aa, Homo sapiens
TSHTANTPPGPVSGMERERKVSMRLHRGAPVTSPSSDLTGRQDTSRMSTSQRSRDMASLRLHAARQGTRCRPQRPRRTYSGPRRPLTGLPATQATAGHEGRWVLGVQDKPKRWAGLDGGQGAKTSPGH

SEQ ID NO: 939393 - protein, 105 aa, Homo sapiens
SGREAAVLDNHVATQRELLSVLKTKILAQFTERSPCIERKKSVLAPLYPILSIFSLRNQAQALGTCPGTRGMGRDLRMALQFLPGVRASALPPPAPGAHLLLPGC

SEQ ID NO: 939394 - protein, 71 aa, Homo sapiens
CDQGALAARPAPAPGLLPRAGRGLTRKSSWQYTFSPTLEKAFPRSRRPQESQVKQSVWYRLPMAWHACLAP

SEQ ID NO: 939395 - protein, 47 aa, Homo sapiens
GFGIPFRFCQALPNQSFSVNDAALQPLHGTLAPWVRGFDKNIWKKMP

SEQ ID NO: 939396 - protein, 92 aa, Homo sapiens
WRLSLTSSRSIEQGRADQDSPSPLIPGQHISLAPTSGDPRANCTLNSDIIQGPEAHTPAPDQRLAFVHARPMPGPIRALTQPGQEPTAAPKL

SEQ ID NO: 939397 - protein, 125 aa, Homo sapiens
FLNRALDIFNTSLVFPIYYVFFTTVVVTSSIILFKEWNSMSAVDIMGTLAGFVTIILGVFMLHAFKDLAISWANLPHMHKNPTPPTPSPEPTVIRLEDKNVLVDNIELSSTPSPEEKPKVFIIHS

SEQ ID NO: 939398 - protein, 47 aa, Homo sapiens
MKPHTNFISGWLFISFLYTSRSPIFSATAALLSVTKMDENPEVSIFF

SEQ ID NO: 939399 - protein, 121 aa, Homo sapiens
CRSFHLCGRAAPPATFPTSAGEWHTAGRLSRGLLRCYPDVPFRCSSCMLSLSSFIVLFTNPNSATHTLSTLLSSNQEQDQLLQVITQVGERQLRRSCLLPSQRHIVGEQMHRISLNSSNLV

SEQ ID NO: 939400 - protein, 129 aa, Homo sapiens
NPLRKRFSNSLASRFHSLGCKTDEVFLHPIQHAPEFLKFSETQCARHILYPALRPQVDKSPVERFVASGNAGLLQTPLELVRIYLPILSSYGKVPSKEDPEFVQETRVLREPLRTRLRSTRRQRQGARG

SEQ ID NO: 939401 - protein, 119 aa, Homo sapiens
GQTGLGTVRVIVMDRSTDIVKAIARLIEFYKHESCGQCTPREGVDWMNKVMARFVRGDARPAEIDSLWEISKQIKGHTICVLGDGAAWPVQGLIPPFRPELKERMQRFAQQHQARQVAF

SEQ ID NO: 939402 - protein, 59 aa, Homo sapiens
EGSMREEKEPNDKREGIIGSSHILTPTRFLDDLKMLDQKLEDVPLAMTMTLTLTLSLSR

SEQ ID NO: 939403 - protein, 77 aa, Homo sapiens
ENVGVAILVKVLCDFPRAKQYFSQFKHMEDPLEMERSPQLRKHACRVMGALNPVVENLHDPDKVSSVLALVGKAPFF

SEQ ID NO: 939404 - protein, 135 aa, Homo sapiens
CRGRKAKPQQNKELHPFNVFSLNIMDFTHTTDRKRQSFIQNTEECQLHTEQKPSSRDTHLAFQNAVARCQQLLLHLPTSTVPRHSDPPRVEKRQGAAHTGVCADAQNTACTVSGGAQMPPASKTNPYFNYVINPF

SEQ ID NO: 939405 - protein, 51 aa, Homo sapiens
AAPAWYTPRRFCRSSASRRHRYAVAQVGGERTRSSSVSAEHGLTRRGMHRG

SEQ ID NO: 939406 - protein, 151 aa, Homo sapiens
ACGPALAQVHQVHQKQEDGHGHGQGHQDVSHQEPHGCPVDLWLLWSQLLPLVPKALGTRQDALSTPSVLPGADRFFNKGANCCVVHVFSGCTQWPVWSGSQAATEVLAPPVLLMGVPLAWCCCQCVLRRSTVGAIGADSPHRHRELSEREL

SEQ ID NO: 939407 - protein, 100 aa, Homo sapiens
RALPGEKALGRYKDFEMSSSWSICVGPKCNDKCPYTGKERRDTGEQGEATVRLEASRGYTATGQGGPEPPEAEKDEEAPSPGALRERGPAAPLISDFCPL

SEQ ID NO: 939408 - protein, 71 aa, Homo sapiens
AVCIGILPGMGAYSGNSDSESSSDSEGTINAAGKIVSSMFRNNTFVEAPHPLRPYKRELLPKGRSDRSCCP

SEQ ID NO: 939409 - protein, 152 aa, Homo sapiens
PVKAEERFPFGKAIEKGSCEDIGVEEASELSKLNVSSVEAAPRAAKVLCVSKHSNICVDRLLCYLAPQFLSPDVVSRGHFSPNLCVEHSYSGFISTHFGFPLLAFLEAFSWKPAPSPARGSSQQRGGIQVPSGSGLASGAEATGGIMALGII

SEQ ID NO: 939410 - protein, 118 aa, Homo sapiens
EKWKALPVRTRTRQGCLFSPLLFNIVLEVLARTFRQGKERKGIQTGKEEVKLSLFADNMIVYLENPKASSRKLLELIKEFSKVSGYKINVHKSEALLYTNSDQAENQIKNSTPFPPAA

SEQ ID NO: 939411 - protein, 139 aa, Homo sapiens
WTNPGFGVHSARLTFKPAPLSPGTGRPAGLPKIRSSPCPHATGFGWGWFKTRTRQFFVKNLRDPPVLGGPRRQPFPSPGSSEGPSPPCKNGVGLQLGVAWTFLSKIRFLKKGIPNGFFFFSNDLEKPFYGGKLFWPPPQ

SEQ ID NO: 939412 - protein, 102 aa, Homo sapiens
GWGPPGPFKTPPAFWVPFGPSTRPEQVLPTWAFPYIIIISWPPGPPQQRFSVGPVFFSPFCCLWPRLGPPAPLWGGNGLQGLGQGLVLFGARPFSAFWYLNN

SEQ ID NO: 939413 - protein, 124 aa, Homo sapiens
MFPWFSWLSKYLPETLAANADKVGMCPSSCSRQVSSRSRLSLLVFTSREDDFVAITELMHLVGAGFQVCDAEPELPTCRQRVEAAVGMDLFQKAHEVTLKSKSLSRADSGIKQNVMPWVLPMIR

SEQ ID NO: 939414 - protein, 70 aa, Homo sapiens
PPGWGPSSSSLEMVASFTPKAFSLGSSLRGKQRMSKHNFLQGHNGQGVRAPRPFYDPPNLLGPLWALNKT

SEQ ID NO: 939415 - protein, 98 aa, Homo sapiens
HRHLFYSEHGRILSYAASSQQATLKSEGCPNRGSQIRNRQPLKSVRCNKSNGAFDIPKSCTPRKLYPQSVRVSIGKRHPVPLGAITTVQGAVFFGKVI

SEQ ID NO: 939416 - protein, 86 aa, Homo sapiens
PPQQHRPVTSTRLQGAAETRHHGMTVSGNTSHRHQYLPLLQQDHRRTQARPWAAAVKYTWQTFFISRGINEGPCLLFLLPLLIFFC

SEQ ID NO: 939417 - protein, 70 aa, Homo sapiens
KTVPKPEFPVIVLPNLVDPQDLHYYLEREVTKEFGKFGAVNRVLIFPKKQGEEEDAEILVKIFVEFSKTF

SEQ ID NO: 939418 - protein, 75 aa, Homo sapiens
VAYWRQGGLSYIRYSQICAKAVKDALKTEFKANAEKTFGSHVKIVKVKKGIIFPDYSLKCYISKGKMCGPMLWQI

SEQ ID NO: 939419 - protein, 157 aa, Homo sapiens
PRHPGRPISGHGMDSRPAMAIFELLDYIVNEPPPKLPSGVFSSDFQEFVNKCLIKNPAERADVKLLMNHAFIKRSEGEEVDFAGWLCRTLRLKQPSTPTRLQCDSQRPAVCVLVPVGTVAAASGDSDAVCCGRGPMPMHLKTKQNEERERKKESYKK

SEQ ID NO: 939420 - protein, 74 aa, Homo sapiens
QRQRVDALLIDLRQKFPPRFVQQKSGEKPVPVDQAKKEAEPLPETVKSEEKESTKNIQQTVSTKGPPEKRMRLQ

SEQ ID NO: 939421 - protein, 120 aa, Homo sapiens
GRSGKSLPTPLFFERGGPAGQPGVTTAFLVLTPRCHSFFQLPARPQSTLCARKKVPRGLKSLNGWFSRIKDPIPHARFGGPPQQGWSGAPGLSLNLFPRAKTVFFVFGLVCFVFKTIMFP

SEQ ID NO: 939422 - protein, 111 aa, Homo sapiens
CAVSMGTRSICVNAVPSLAEVLSCLALGSSNDARALLRQSESLVSGRVVWCSIFQDQLPGGSTGVLPQEAPHSAFGGNRTGQNRTEQNSVSRDAVWCEALYICSELEQTFQ

SEQ ID NO: 939423 - protein, 74 aa, Homo sapiens
EKEQSCSTPVIGLTFDFLSGNVVTHGVELQLCCIQLLKHEAERRIDNRVPDIEGRIKETNPLARNCNSSDHYIQ

SEQ ID NO: 939424 - protein, 168 aa, Homo sapiens
HTHLKLRLVDYETMLKGGSVADNLNTSSENNDEKIVQNAIIKKIGFFGSKLQDYQRSEIMMLIMGKVHVFGKYKNNLDISKLGDLGKRRIKIMLMRSLIMVTSGYKEKKIVNEMKGYLMDNLLITIYNGGLRTEKVGIGSNDINIMDRHDNREKLRGIRIITDVADLK

SEQ ID NO: 939425 - protein, 83 aa, Homo sapiens
QLQPGCYSKRVVLRSKGSVCSSLSVVWTQDAPPGSIDSARVCLLKVCSAEGLPTQPLYIDHFPALCKVIGQALYKRRIINTLV

SEQ ID NO: 939426 - protein, 124 aa, Homo sapiens
QWFDVVMLAREFAAMRGTISREHPWEVMPDLYFYRDPEEIKKEEQPPAEKAVTKDNFGVNGLSPPEFTATQPEVADCSEGKQVPSVLIKQFPTEDGSAHPPTEDCSAPPTAQPTEWVGPTTDWS

SEQ ID NO: 939427 - protein, 77 aa, Homo sapiens
AYFALPGLTQEGLFRVNGNVKVVEQLRLKFESGVPVELGKDGDVSQQPVCVKLFLRELPDSLITSALQPRFIQLFQG

SEQ ID NO: 939428 - protein, 121 aa, Homo sapiens
SEGSQVKAQAGSRAPLGCPTPHTVWYPAGTARLPEASQSTLVLKQAVRKPLEAVLRYLGEQPGVLGGSTTLLQAASHPSSCTGVPAFSSWELLDTPQGLELSCCGSLHRARLRQNHWDPGC

SEQ ID NO: 939429 - protein, 98 aa, Homo sapiens
GEVTNDFVMMFCGSSSPSSGGSSAHGMGWAGIFSVNPPLATPSLATPSAFQGQVGPHMKEGTTFLVEPGTLAQARQPEGWVGPQLGILPGPQHNYNAT

SEQ ID NO: 939430 - protein, 123 aa, Homo sapiens
RKRQPPSASGSPSSSASVAPASMCSGRGSSDAGRLFCLASPPSVFGSRGRREPAVPCRSGPGLLPLCPSALGAPCPSLLVVGPLCSSLPVGSLSSLLGLWVCRGSPAPPAALAASGLPPCCRR

SEQ ID NO: 939431 - protein, 74 aa, Homo sapiens
QRLCKPYIHAQKPQGPRKGSCAGMPCQQELKTLQTRHPRTKAPETSVRKHLCEDICPAPACPTPHRHHPCYGPL

SEQ ID NO: 939432 - protein, 70 aa, Homo sapiens
EQEVDYTLPHIEIGKKNYGEQFKAIRGSGEQHNFALILQLVFSKGGRRKRGSIEFTHFSSYCQEKTESLL

SEQ ID NO: 939433 - protein, 103 aa, Homo sapiens
NSSQSEEDDIERRKEVSILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 939434 - protein, 143 aa, Homo sapiens
PRGLAPRGIGSPRLRGERGGGKGPSKNPGFPFRPSQPLGRPGGPPTGGVGAPLPPPGVWGFGGGAPPPGGGLPPPPGVFFLGLKGAPPPPPPPPGGFVAGPLCLGGNPGPPRGPLDPGGVAPWGLGFFGAFFGRKKKRETLVF

SEQ ID NO: 939435 - protein, 57 aa, Homo sapiens
EYYESLGDLVEVIIFKKLHMSKGDKCYEILSVEAIEKLILNPEVGPEWNICNKGLER

SEQ ID NO: 939436 - protein, 97 aa, Homo sapiens
QPLINCIEAQLADVRADMSGKSGLTAVHGLKSRLKQEISTYRSLLEGQKDHYNNLSASKVLLRQQAKGLLLSFGGCLLGRGMGRKGPLPPALPLMCQ

SEQ ID NO: 939437 - protein, 117 aa, Homo sapiens
RAEVQLLNNTWVSSASPSASAACVPVQCQVQLHRCRCTRCPKAAHAPRAIIRTTLSPSWAGRFEQDRELVADMAGEDGQAAALTPAGCAASQVPGAIIPGRKIHHTWKQLGPPSDEE

SEQ ID NO: 939438 - protein, 61 aa, Homo sapiens
VSSSAGSTPTAVPRAASVSGEQGTPPKVQLPLNVELPFVSVGVLCLQPSLLPGLTCPRVVS

SEQ ID NO: 939439 - protein, 74 aa, Homo sapiens
AQPSQGTAALLPQQGNVLHGAEASVSSPATPCKKRRLPESGPPSFWSPLLVVIPPPNWEALGVSYGPRPPFPFQ

SEQ ID NO: 939440 - protein, 47 aa, Homo sapiens
MWPPKEQECGPEVIGAHGHILQALSLNGHCIWSLQFCEPINSFYSLK

SEQ ID NO: 939441 - protein, 77 aa, Homo sapiens
MFTDIVTQQLTGDLEHQKYLQKKYYHRHGRTNRPSCGESAGLAQKGGHFIQRTDRVAELSLTRSLSRSPGSATGSRL

SEQ ID NO: 939442 - protein, 59 aa, Homo sapiens
MSPLARCGLFQANSMVLVPTVSSVCCTFKCSESDATIRGSQAQRYPWLGLRQVVPLKGS

SEQ ID NO: 939443 - protein, 46 aa, Homo sapiens
MVTLVTAPSILSVSHKPGNCAAFSSLISYCPRWRRQHSYHSDVGAA

SEQ ID NO: 939444 - protein, 88 aa, Homo sapiens
VVAAEVLEVLARAIRQEKEIKGIQISKEEVKLSLLADDMIVYLENPKDSSRKVLELIKESSEVSRYKINIHKSVVLPYTNSGQKIKSR

SEQ ID NO: 939445 - protein, 82 aa, Homo sapiens
EGFRGFWKFPKDFGLSSQTNQGPWLVAFSKSRKLEKRGIKAGIGTPLWRPPPTLIGPPFLNSFPPQGQGSLYLPLDKLLFFL

SEQ ID NO: 939446 - protein, 102 aa, Homo sapiens
MDILPISNSSCSCLFILKSHTIALIKNEFMETESILVAAKGWRGRMGSASLTDTGLPFGAMKKFWRSPVLMVPRHCHCNKCHQWHLSCFAHFRPLKNYTFKA

SEQ ID NO: 939447 - protein, 76 aa, Homo sapiens
VSIDIGPSPGNEVNFDSSGRVLAQASGNGVIHLLDLKSGEIHKLMGHENEAHTVVFSHDGEILFSGGSDGTVRTWS

SEQ ID NO: 939448 - protein, 43 aa, Homo sapiens
MWRPSEKLSVNQEGILTRERAGTFILGFQPPELLRNKYLLMNQ

SEQ ID NO: 939449 - protein, 33 aa, Homo sapiens
GQAHGLMVTEVSSAFEVKCVYFIHKRKKRKRKS

SEQ ID NO: 939450 - protein, 148 aa, Homo sapiens
KGGGKRPGSYQPPKKLEKSSRGPNQKPKSMVAVWVFNPPPVAPKPGPVPFFPSQEPPPKREYDQCCIQVRLPNGTSLTQTFRAREQLATVRLYVELPRGEEIGGGQDPVQLFSGFPKRAFSKTDMERPLQELGLVPFAVFIVAKKCPN

SEQ ID NO: 939451 - protein, 70 aa, Homo sapiens
DHELTNLLGGMNNSGRATFMNCNTTKVCSFAPEASTTMNPLEGMNNSRRAALRSRNTHCEAFTGSLWLLC

SEQ ID NO: 939452 - protein, 30 aa, Homo sapiens
MEGKRLIKRKCSRTFETVLLLRRMKPFPGF

SEQ ID NO: 939453 - protein, 73 aa, Homo sapiens
GVFSNGPGGAPRQPTKVIPLKALWRMGPPPSYGPFKWFLVDQFPFGRSLGHHTSSFYQNPAFRLLNRGGVSTY

SEQ ID NO: 939454 - protein, 145 aa, Homo sapiens
MQTVTAALRKLMVTDSSEDGLSSGGVRVGQVDECDPASVVVCVLNIEKEEEDDIGLQMHFTLIQSMCCEIDMNIVRVSGMQRMAQLMGETAETQGTTEVGDVHCLLVTNPHTDAWKSHGLVEVARYCEERWGNNQWVPYISLQER

SEQ ID NO: 939455 - protein, 67 aa, Homo sapiens
AAVSSPGECVQAAECRSGGLLGALPQPAKQAAHGRHSSLQPQWHVKVVSTGLGVQPAQEPGAGPGGS

SEQ ID NO: 939456 - protein, 74 aa, Homo sapiens
AFYDVVGKTVGKTDYIPLLDVYEKTGNSKSKKKPCSETSQIEDTPFFKPTLLANGGHGVKGNDTTGFPTEFLER

SEQ ID NO: 939457 - protein, 121 aa, Homo sapiens
DRHVVLRLVVAERTGHAAAAGLQRRQAVAHHPAKGRRARRRPPQGFLMAVGVQQHPLAAGAHARRTRRCPPPCIDELLHEHRLVRQAPAHVRLRRAPQAQPVVLHRAQARRLHEQHRLDRR

SEQ ID NO: 939458 - protein, 112 aa, Homo sapiens
PFLPPGGLWGPLGLLYRGGGGPKNQWGNPLGGRGPVPPGVFGGGFLTQVWGGGVRGGPPLPFVRERGLVNGGVPPQRGLGFWVFFGVCPPPAPGGGVNEIILVFFKKKHTTH

SEQ ID NO: 939459 - protein, 108 aa, Homo sapiens
RRINCEQCSSCRNRKTGHQICKFRKCEELKKKPSAALEKVMLPTGAAFRWFQCRRRNPKLPSPCNVTARVVSSKGFGRRQTDAPVFRTKNILSQISFLFLYIYFLLSF

SEQ ID NO: 939460 - protein, 38 aa, Homo sapiens
AGPKKPLIPFKNATYAFLPDALEQVLSGLELFDPSVVF

SEQ ID NO: 939461 - protein, 93 aa, Homo sapiens
PIFDYNYDGHFDAPDEITNIYANTDVPIPTHYFVVLTSCKTKSHTRKTALGGWMSYPLSSLTDLPTWRAVLKVNQKLFGLKKDLQLTLPGSVM

SEQ ID NO: 939462 - protein, 75 aa, Homo sapiens
KIPFLGICEAKNPRLENLRLATILEAACHHLGSGSPPFWQPGRDLQSGSSKTQKNEIICLLSTYDLEAPSPLQVV

SEQ ID NO: 939463 - protein, 106 aa, Homo sapiens
NEEIDEMIKGAPGSNYFTCVPHNVWGETSGERTLRKPSQTHSKVFDPEGKGVLKAEYVRENADHAGGEVFSKRRVDKMFAAFPPDVTATLDYKNLVHIITHGEKKD

SEQ ID NO: 939464 - protein, 141 aa, Homo sapiens
ILLDSIMACGVVASNLNLKPGECLRVRGEVAPDAKSFVLNLGKDSNNLCLHFNPCFNAPGDANPIVCHSKDGGAWGPSNGRLSFPFSLEMYAEVCISFEQGNLTVKLSNGKEFKFPNRLNLEAINYMAGDGDFKIQCVAFD

SEQ ID NO: 939465 - protein, 60 aa, Homo sapiens
APGLPMLGDVGMYGYISQTLYMIAVNRHKKWSLRTVEFRVHHHHDRRIDRLSTCLSTIVV

SEQ ID NO: 939466 - protein, 38 aa, Homo sapiens
TAPQQPLLLFMIATYALLPDHLDQLLSGLELFDPSVVF

SEQ ID NO: 939467 - protein, 95 aa, Homo sapiens
APMAVEANTLQNPETKVGMAVPPPPVAMAVAEDFYEEPKLSRRGEPKKCQGSSRFPQICELTPAQGGQGLAAPKKTCFRPKLLGMGQKPGGGIWG

SEQ ID NO: 939468 - protein, 180 aa, Homo sapiens
YQERYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQHMRRMLPVAEFLFLMFLRKKTEQYKAHFWPRDLVAFSAQPLLAAPTHYARDAEWLSDTETSSP

SEQ ID NO: 939469 - protein, 135 aa, Homo sapiens
SNAGAAEIFVYRTPIMQHQNVYLQEHREYAGSIYDTHTDGSGICLSSRLRPILSIRPKYDHFLAQAPWQYPADLHLVYWLEHMGYEYDVFTDEDVTYEGLARLAPYNVVITGSHPEHNSGPQLDALHNYTQQGGR

SEQ ID NO: 939470 - protein, 113 aa, Homo sapiens
QYSTFAKSQGPIQQRWRRPVPLRGRSCLLLSTDPSIARAELSSPLHRLRRYSEAEHVLLSTDPGGRARGTARAELRSAQHTPGRHREGRAAFSAQTLWALPRFGTTRSRINGE

SEQ ID NO: 939471 - protein, 127 aa, Homo sapiens
RSIWAVETHCRFVHASPAVAVRPRTPKRFAGVHVSFPDTKEVCRGTRVLSREASATSVLMCLKAHECLEGRGSGWMVPTVGLELSSGLVYRRHSESSYGKYWVGIWADGASRILVALSGKSCGSKSN

SEQ ID NO: 939472 - protein, 95 aa, Homo sapiens
RAVATEAALQLRQWSANDWSESSLGAWKRSLCRVGLSLCAGRGFSARLGSAQLSLSRHLLSAQHLRSVTGEGSGPVPAFLNMGTAADSLTHVQGT

SEQ ID NO: 939473 - protein, 197 aa, Homo sapiens
VRPHRGPTDQQGIRLCQSLTYSYPCGKRVFGSASEAVLKALMDQWFSEHDNGLYSSVSAETAVCKAQSSPAFELSVQAIPLASKDGSSLLWVQAMEFPFAAQSSGGLGSSPPQLLLWLSRPLTRPPSGHKRGLFTLHSPRPGWPPDGQEAPGSRSLFQCKRHQESQGPGSAAWGWPALEESARGWGDSLRLSSLPSS

SEQ ID NO: 939474 - protein, 123 aa, Homo sapiens
VPKNPPLLFSTTYESRVAHFLEGSEDYGVIKTDVSQPVALFKAKDMQAVQRPLMALGSLPVTKNDGHYGDPNWFMKKAQEHKREFTESQLQEGKHVIGLQMGSNRGASQAGMTGYGRPRQIIS

SEQ ID NO: 939475 - protein, 79 aa, Homo sapiens
VHIEAGKDEIIKNGSLKKMSARIRKYQILNNEVFAILNENMKSVETAAHPPPRNPNHPNLWYPPCPVYFCEINFDSIYE

SEQ ID NO: 939476 - protein, 101 aa, Homo sapiens
QDLCPHLSPAGGRGDKRNRTIEAKSPDLGDEICQKIFYLRASLSGPPRECGSSADAMMQALLGARAKESLDLRAHLKQVKKEDTEKENREVGDWRKKKFES

SEQ ID NO: 939477 - protein, 98 aa, Homo sapiens
GDLAPGPQNLGPGGLKNCSFMGGIDGWSPPAGGALPPWANLPRPPFMPFFKPTATLPPPFGRRLVSPSFPIRGSLAPSSKPPPKFPCNGLLGPPVGST

SEQ ID NO: 939478 - protein, 89 aa, Homo sapiens
SQTLRAPVRVIPFGCCFEGYWGTVGTGRGWQVVSEYILCQQTVDEAPSSSLTKPGAVPACLRQGFAEALSVNTGKGVCSLPCGPGAAGA

SEQ ID NO: 939479 - protein, 69 aa, Homo sapiens
IAPIGIGLEARFAEVCSFHYSVTKLQRLGSPDPPRLSVTSKGGLRGDQAFSARESGHDEAGYACTTWVS

SEQ ID NO: 939480 - protein, 134 aa, Homo sapiens
LVASFSLQDCKERAEWMGVSDKDVIVCSTGSSLLLFDINGLRLQTFQYCPEEILRLCVDPVHVIVTCNNGSLDVYVWEERSPLLRRCYRLRKRGYLPLSGFIIKTLCDESSIILVMTSSPIPCFLMAYTLKVCS

SEQ ID NO: 939481 - protein, 66 aa, Homo sapiens
LLANKNDVTEEDRRGMLLTRPGVFASESPWVTDDKCVTSSDTDKPLPQQEGSSYIQNLRTQDLRGK

SEQ ID NO: 939482 - protein, 108 aa, Homo sapiens
QETNFPSGKGSSAKANPMVQIAPKNDVDVQIDRRSYLPQDIAGGVEFYNGVRKIRVPAPGKAVGSHSPAYYARSPGSLVWCKCQQEVFGLSLQEVELVGSLPAAMGSF

SEQ ID NO: 939483 - protein, 118 aa, Homo sapiens
VSSTGQTLYQAWGLGVSLLSGHGALVHLRLHVTLYLWHHASTVVPLPARAKPAQMPAESDRIIFLNVTASSLYPLERFAQEMCGGRFNKTCPEQLGKAQVCHSAAGTSCPSSHSLFLI

SEQ ID NO: 939484 - protein, 77 aa, Homo sapiens
GSPVLAMVQSISYEKLNLPVPRPSCVRSEYSPLSVLTIEPVGSIAYEYEDMISYEVHLSLAWGPLQQACLAEQCCGP

SEQ ID NO: 939485 - protein, 76 aa, Homo sapiens
GSDQGGGGEGKLDADRLTMAEHRRPQGSPCTYPSGCAHCMPGKGQHFMDGEAPPPPHTPAPHCRCCLNKSADLQKK

SEQ ID NO: 939486 - protein, 77 aa, Homo sapiens
QPSGSSSPWYDASTPYGGPSHDANDGPSSSWDDASGTCSWNEAAHGRPYANDAWAPNDETSCPSHDGAHSARNDSTR

SEQ ID NO: 939487 - protein, 66 aa, Homo sapiens
QEVGWDLEPLINPERHDRRLDHFRVCSDITLYKGKTWGLGDDPHKSIPADEPICGCNALSVHSPKK

SEQ ID NO: 939488 - protein, 104 aa, Homo sapiens
RGLVLLPRLECSGMILAECNVCLLGSSNSPASASQVPGITGTCHHTWLIFLFSVEMEFHYVGRADLELLTSVDPPALASQSAGITGMSHYALPIFRKNIRKQKY

SEQ ID NO: 939489 - protein, 81 aa, Homo sapiens
QRLVIPVIMFCHIRLQDQPVGLEDQPNSCAVSYHVLKGPFGWDFRNALGVESDPQLTASKKTGTSVLQPRGTGFCQQLHEL

SEQ ID NO: 939490 - protein, 94 aa, Homo sapiens
MLCSQEPGSVATLPSATQSAPGSAELRGGAPEALVVQCHAPGRLGTRVPGPDTLAGRSVDYRATDLLLTGPHTAAKMMAAYLANSNARNHLLPS

SEQ ID NO: 939491 - protein, 77 aa, Homo sapiens
HTVIMPVIAGGILAALLLLIVVVLCLYFKIRNALKAAKEPEAVAVKNHNLQGVVGPEQPGHTHCLGVLSCPTVLLRI

SEQ ID NO: 939492 - protein, 70 aa, Homo sapiens
ETHTSSFSSGKESPPVSDTQEGDEPMPIPEDLPTTSGGQQSSKSDRVVDNLRTMDADEGQDMSQVSGETL

SEQ ID NO: 939493 - protein, 71 aa, Homo sapiens
RENEALRCGQGASLTVVKQNADVALQNLRVVMISAQPSLQQLPSPAQTMNPAAEHPEIHSRIEVKDEEEDS

SEQ ID NO: 939494 - protein, 104 aa, Homo sapiens
QPPAARKRQERISLQSLQRKHGIVCVLIPDVQPPVREYISVTLSHKFVGLYPSSLSKLSIMSSLRKFNLKQGGIHVKKSGSYRKKEDAEINLSAKLFYKKRVDI

SEQ ID NO: 939495 - protein, 141 aa, Homo sapiens
MAVLLKGVREPPSGLLSQESGGFSPVAPFQRCKCLLCFLLSSGGILPLPTHLFFSLLQSRHRAATDYTMMGGWTPPSGAGGAEDVNKGAVQAEAEIMVRSRGRARRVQLCPEASPETEKMPESCLLYSQQNCEPIKPFLFK

SEQ ID NO: 939496 - protein, 168 aa, Homo sapiens
PSAGGAPLLSQPPRGGGPFSLWGGGFPAFQIWGGVFSPPPPFPPSSPRRGGGVGVVGAFFGGAPRLPPPGGGPDPPPPPPGFFFFFFKGAPPGGGGGFFFVGGPPPPPPPRGVFFLFPLFPPPSGPGGGGPPPPGVFCGGFPLFSPPFFSGFGVFGGFFSPFFFFFFL

SEQ ID NO: 939497 - protein, 46 aa, Homo sapiens
MLRGGLAFGVPTLLCKVHCGCHHGFRDLGQRERGGPGCVYIKSAFL

SEQ ID NO: 939498 - protein, 108 aa, Homo sapiens [sequence omitted]

SEQ ID NO: 939499 - protein, 88 aa, Homo sapiens
SGHSQGEKVLLEELYFTGLQGWVLLVMYCGIGAGNHRAICVNGGGGGCGERHVKVPANAGVLTGSPLVFPIRGVRWLEKPLFLCLELN

SEQ ID NO: 939500 - protein, 51 aa, Homo sapiens
KERERTLALEEEQKAGQKEAGVGGNGKKDGLCSAIFGPDGAWPDRIKDFFT

SEQ ID NO: 939501 - protein, 74 aa, Homo sapiens
PRLRQCPRFTFDLSGGSAASKPDLGLQKAGVPFGVPYHELKGPKTGGVLRLRAPPRAVKHSLFLVSCNKRDILG

SEQ ID NO: 939502 - protein, 35 aa, Homo sapiens
PPPPPPPTFPGFPPAPGAFSGHRSVFIKKDLLFCS

SEQ ID NO: 939503 - protein, 114 aa, Homo sapiens
IRLTGGARPPQAVVPFLQSRALRSPVCSKGAYLLMELAKSQGKTLKIYEGAYHVLHKELPEVSNSVFHEINMWVSQRTATAGPRPHHACIARCPAHGVGETSRVRTKMAFQIWQ

SEQ ID NO: 939504 - protein, 80 aa, Homo sapiens
EKIKAKYPDYEVTWAERGVLSTPSPGPVASNSHFKAPAFACTPFAGVALPVPGAAFGDVLSPRPWRQASLAPKLNVLPPL

SEQ ID NO: 939505 - protein, 46 aa, Homo sapiens
MFSIKKKKAISPYWGRECLSGEMLSCDVSLLFGNTEVNTKTKHAQQ

SEQ ID NO: 939506 - protein, 94 aa, Homo sapiens
RGGGTNWADPATFNRTGEKGREGFLDTLGVFPRAGGRLEGAKTWGRFPGDLLEMGPSFARDLGGLGGPKGSYHGRINSPEGPSDIPDLKNQKGF

SEQ ID NO: 939507 - protein, 138 aa, Homo sapiens
GPKKGVFQLVCPPPPPPRGGGVWWGGRFYKHALFVTPARPGGHPPRCFFPLKESAAGPPPAVFSLGGGGGIFFFPGRERPVAPFVGAPYYVLGQKPGGGGGANSPGLWQGGGGAPPPPPVPPRGGGENFCFLGVFFFE

SEQ ID NO: 939508 - protein, 125 aa, Homo sapiens
RGGARGERRGGRAAAPAPMVGYCNGAQGSTLSFPPGVPAPTAVFQRPSPSGPPPRWFVPGCPHPGRYACFRTGQALCSFQCYRINLQMRLGGAEGPGPPFWVRKALKPDFGPRPMAAFEYLPPPI

SEQ ID NO: 939509 - protein, 41 aa, Homo sapiens
PPPPPPFGGPGDVKFYPKRGGAPPPQGGSSPPPGAPGFFPG

SEQ ID NO: 939510 - protein, 63 aa, Homo sapiens
QRVWHISRTITAKSKGTHYIRIWAVCRSRDGQGVEEFIVMIVKHQAILIFFDLDRFDTPSVVF

SEQ ID NO: 939511 - protein, 108 aa, Homo sapiens
SDWVSLCLPGWSTVVPSQLTATCLPGSSDSPASASLVAEITSTCHHAWLFFVFLVETRFHPVGQADLELLASRDLSTSASQSTEIIGMSHRTRPILDSYCFCPLLSSS

SEQ ID NO: 939512 - protein, 90 aa, Homo sapiens
LYIQILVQLIVRFVMSLSVIIPIILSLLFVFFFKFFLTLRFFISLPFPNILWRWLIMQDAKLHTLIVSDAPHKKPSFVVTFLALPLLSSS

SEQ ID NO: 939513 - protein, 70 aa, Homo sapiens
SPMKEELIGKEKQGSNVQNFLNGQVRSLTLVTQALWGAERGGSPEVRSSGPAEVQEFQTILARLVKPRLY

SEQ ID NO: 939514 - protein, 33 aa, Homo sapiens
QTVFAFIGQEFLTEPTHTHPHTHTHDACPSVVF

SEQ ID NO: 939515 - protein, 38 aa, Homo sapiens
LDSSRVSLISPMLKCMERYRPTATSASQAPTTLPSVVF

SEQ ID NO: 939516 - protein, 61 aa, Homo sapiens
RATAKGKLLKDRSPCKQLLNKVCKSLDDHSSRRGLSGVEDCGKLAFAASVKFSSLQYVLSI

SEQ ID NO: 939517 - protein, 133 aa, Homo sapiens
RASIVALRKMITSFLALWWHVCVCICIYTHIYINTQTHIYTNTRIHFRPQFLAHNSHSPCYTLLLQHWVCQASGDNHSNLLPFLLPAQDRTLIFPTFLMVGHKTHSRDGPTPPLSYKPQKAFQPGQHNETLSL

SEQ ID NO: 939518 - protein, 148 aa, Homo sapiens
AWSRPRYGIEWNGKNWNGMESNGMIWNGMEWNGINPSAGECNGMECNGMESSGMDGMEWNGMEWNQPECNAMEWNGMEWNGTARMEWNVMESKGVERINPNVMEWNGTEWNGMECNGMESTRVQWNGMEWNGMECNVMESTRVQSNGI

SEQ ID NO: 939519 - protein, 30 aa, Homo sapiens
RSNVGSDSDPTGSNVGSEFGSNTNLKWERP

SEQ ID NO: 939520 - protein, 111 aa, Homo sapiens
FETESYSVTRLECSGVISAHCNLHLRGSRDSPASASRVAGTTGARHHAQLIFVSLVAMGFHHVGQDGLDLLTSGNPPASAAQSAGITGVSHRSQPHRACFYDLFSPLLSSS

SEQ ID NO: 939521 - protein, 156 aa, Homo sapiens
KVQKVYYIENKAEHLSDFETTFELQPLERGFANTLGNSLRRTILSSVPSVAVFGVKIEGVEHEFSVIDKVREDVVTILNNLKKLRFSFKKEVFLQNEIQVASFDGRKVGKITGADILVNSALEIVNKDQVVANTSEVGALKFEMFLTYGRGFVDFE

SEQ ID NO: 939522 - protein, 30 aa, Homo sapiens
ALFYFSFGRRRHCCTQLVSVPRFYPLLSSS

SEQ ID NO: 939523 - protein, 118 aa, Homo sapiens
MAIGGTSMTVKSDQVAEEQYMGVYRVQASELQNICTISSKLTSLDIVFLIYKRETSILFNGKSHNYFCTNVIELSKIRLDMLAHTFNPSTLRGQGGQITGAQVLETSLSTMAKPHRYQ

SEQ ID NO: 939524 - protein, 97 aa, Homo sapiens
RSSADVNVAPCTIRKSDEVQVVRGHYKGQQIGKVVQVYRKKYVIYIERVQREKANGTTVHVGIHPSKVVITRLKLYKDRKKILERKAKSRPVEKSKA

SEQ ID NO: 939525 - protein, 47 aa, Homo sapiens
MLLEKEVLGRTWCRMPVIPALWEGEEENHLSPRGRVKPRQHRETCDY

SEQ ID NO: 939526 - protein, 101 aa, Homo sapiens
ASISDPGAELRIGGWEAQEAPGLVWLNCDSGEIGRGGQFPEVRLEGGLCLRGGPGLEVWGPLFQVPGGVRPHGAAGVRSPDNLPTPTAPSLQGPPPWKKKK

SEQ ID NO: 939527 - protein, 173 aa, Homo sapiens
LQPAQPQLVQQRQDAARSSSDLQRRLRGSSVEMLQDVIDVIKRSESWALKKPKSVSQKLKSVFRVPDLSGMLPVLKKLTDVQYYWVDVMLNPGSAPSNVAIFVDQRQVKTVRPCPFKNSNPCDFSAFGVFGCPYFSSGKYYWEVNVFGKIAWILGGPSKISSLNKRKSSGFAF

SEQ ID NO: 939528 - protein, 34 aa, Homo sapiens
LQCRQILNHLLRQQHMRISQKTCAQGALKNAPLI

SEQ ID NO: 939529 - protein, 74 aa, Homo sapiens
GKAFMPKVGKEIVPKAKIEKWDLIKLKSFCPAKETIIRVDRQSPEEEKIFAIYPSDKDLIFRISKELKHISKKN

SEQ ID NO: 939530 - protein, 70 aa, Homo sapiens
QELFKRISEQFTAMFRRKAFLPWYTGEGMDEMEFPQAESNMNDLVFEYQQYQDAPPKKEEDFGEEAQKEA

SEQ ID NO: 939531 - protein, 58 aa, Homo sapiens
HASADAWVQKFKTRLGIIMSPISTTKFNKLAGHSVHTCSPGHSGLRQEDHWNLGGCHC

SEQ ID NO: 939532 - protein, 101 aa, Homo sapiens
YFSRRPPLPIDPSMFPTWAAKNEQQGVKRGPSPRPPEGGLGYNQLGDDDLKETGFPLSPPNQGAFSAGPGFNLKFLRSKWTPSWGKINRGPRGGYFGWNFD

SEQ ID NO: 939533 - protein, 33 aa, Homo sapiens
MPGVVQNRRQGDVAEIGLHCLWPLSSPCPSVVF

SEQ ID NO: 939534 - protein, 110 aa, Homo sapiens
ETESHSITQAGVQWHNLGSLQPPPPGFKRFSCLSLPSSWDYRCLPPCPANFCILVEVGFHHVGQAGLELLTSNNPPTSASQSSGITGMSHSAWPPGSSLIHPLSDPSVVF

SEQ ID NO: 939535 - protein, 40 aa, Homo sapiens
MRQFINPAWLAIRHLVGRYHLSVDTVQISVSLLSSSCSSI

SEQ ID NO: 939536 - protein, 47 aa, Homo sapiens
RVVKCLFIGAGGVHEGAGHGTLVGTLAVSYFRLRGIVCPKGTPSVVF

SEQ ID NO: 939537 - protein, 36 aa, Homo sapiens
MRQFINPAWRGVIGGADNFRLSGKGAHIIVPLLSSS

SEQ ID NO: 939538 - protein, 32 aa, Homo sapiens
PPPSPWAPPNTVSCPPGPGSRKTRLPSFPAAS

SEQ ID NO: 939539 - protein, 86 aa, Homo sapiens
MANNAICVIPIIKTRRVNWRRDPPNPGRKDRMSEHLDAVSRSEQPNKVKTFFGHPFGLTTIFFTEMWERFSYYSMRAILLYFLVDT

SEQ ID NO: 939540 - protein, 56 aa, Homo sapiens
ALYSLKFPPTQGGALPPPIYNIKPSFTGENTLRVKHLSPIFLLSPNPGIITGVSSS

SEQ ID NO: 939541 - protein, 101 aa, Homo sapiens
GGPPPPPNKATTGWGAAAIWAWRLGRGSPPKAPPAGVRIKGAAVEKTGGPTEGFWGLNPPPPPGGLKVRGPRGGGFPPPPGGQALFPAPHKPPIKFFLGPP

SEQ ID NO: 939542 - protein, 108 aa, Homo sapiens
IQLGTKKGGFWAKGPGPPPLHPGVGPRWLKPLSLGPPPTKWGAAPPPGWGFPPTPFNGGGKRGKGGGPPPPPGVWGGPAPQGFSPPRGAFPPPLWLNPTRIKPPGFFG

SEQ ID NO: 939543 - protein, 173 aa, Homo sapiens
YKGPLGSVLIVQGGGPPPLWGHYSGQTSLGPRGPGGLGNKVGQPPTVPFKGTGPFGFLVGSLIPAPKGKGGGFRPFGLKNGPDGWDTILVPPQPGGPCPPGGICQGPLFFPFLNQQPGPPPLEGGWFPPGSPSGGPGPPFLNPPQSFRGSGSGAHLGSNQGVFSPKNKINLAC

SEQ ID NO: 939544 - protein, 99 aa, Homo sapiens
VQTNAKAHSPHPPSGPCWAGPEMQVKLFPVPGLKSTLITDGSPPINLFNTAFGLLGMGPKGQPLGKRVASGPTPGEGISPQFVQAPQAPGNNPVGPVLR

SEQ ID NO: 939545 - protein, 62 aa, Homo sapiens
MPGPSASVSVGSEALAGRPFIAGFYSKGRIMGPATISYPTAGSLVAGFLIANNISPASPFQA

SEQ ID NO: 939546 - protein, 124 aa, Homo sapiens
SHRRFSPRFKRVSTASSIDLPPLPPPSFGRGVVAVFPKGSVLFRPKAKAQAQAQGSTRARVQPPLQFQVRVPKVPRAASKGFKLIFFPTLGQKGWLGPPPPPLGFPLPWGGVLLCFLFQLTLGR

SEQ ID NO: 939547 - protein, 69 aa, Homo sapiens
KETLGRGEQKGCRGSTAGAGPRSRERAQACTRSKAKATAPKPFFSCSPRFADFSPALVNNSKFLFWRVR

SEQ ID NO: 939548 - protein, 57 aa, Homo sapiens
MPAKPVKSASQPSQPSLTTPASKPSQPSQPANQASQASHPAKPGQPKFFLIKGTSRS

SEQ ID NO: 939549 - protein, 114 aa, Homo sapiens
RLETAAQLAPCTPTMKLPSGLHLLEPLPSGSPHILVFPSPKDLMGTLPPAHQAFDRRVDYQEKQRDLEIGIRKKPFAQPKESKQPSRSSPPLLFAVHCSQLEIVGSSMCLPSGM

SEQ ID NO: 939550 - protein, 34 aa, Homo sapiens
MQEVLGPLVWPHWTPKGTLPPEGAALDKLHVVLR

SEQ ID NO: 939551 - protein, 78 aa, Homo sapiens
RPPGQVRGGMEWNGMQWNGIIRNGMEWNGMEWNGMEWNQLQCNGMEWNGMEWNGTTRMEWNVMESKGVEENQPECNGM

SEQ ID NO: 939552 - protein, 118 aa, Homo sapiens
AWSRPRYGIECNGTNCNGMELNGMEWNGMESTRVQGNVMEGMQWNGIIRNGMEWNGMEWNQPECNGMEWNGMEWNGINAQCRGMEWNGMQWNGIFRNGMELNGMERMEWNKPECNRME

SEQ ID NO: 939553 - protein, 112 aa, Homo sapiens
SGRPGRYRGMEWNGMQWNGIIRNGMERNGMEWNGMEWNQLDCNRMKWNGINPNRMEWNGMESTRLQSNEDGMELTRIEWNGMEWKGTERNGMERNGMEWNGTEWNGMEWNGI

SEQ ID NO: 939554 - protein, 120 aa, Homo sapiens
RAAARVGTRANVMERNAMEGNHPEWNGMEWNQPECNAMEWNGMEWNGTARMEWNVMESKGVEENQPECNGMEWNGMEWNGMQWNGINPSAGEWNGTEWNGMESSGMEWNGMECKAMESTR

SEQ ID NO: 939555 - protein, 118 aa, Homo sapiens
RGRGRGTMEWNGMEWNGMEWNGIIPSGIGGNVFEWNGKEWYQPEWKGWEWNGMETNRMESTRVEWNGKDWNGMEWNGINSIVMEWNGMEWNGMELPEYNGMEWNGTEWSGMEWNQPEC

SEQ ID NO: 939556 - protein, 121 aa, Homo sapiens
SGRPGRYNGMEWNGMEWNGMEWNDTEENGMERNGMEWNGMELNGMEWNGIVPSGIGGNVLSGMERNGINQSGMERNGMEWKLIEWNQPEWNGMERTGMERNGMEWNGMEWNGMEWNEINAS

SEQ ID NO: 939557 - protein, 66 aa, Homo sapiens
SVVAAEVHICHVALGRTGCHGLGHCRGGEIDGREYGIKSIGILWLILELLSTEEYDNATSWLPHRY

SEQ ID NO: 939558 - protein, 32 aa, Homo sapiens
RAAARAGTPPLHPGRASCLIQAVLRNGCGGLW

SEQ ID NO: 939559 - protein, 35 aa, Homo sapiens
GRGAEGGRKGNQIGNNNEHLLRDRPWAKYLPGRPL

SEQ ID NO: 939560 - protein, 72 aa, Homo sapiens
VVAAEVRNRMEWNELKWNGIEWNGMEWNKPECNGMEWNGMEWNGSTRMEWNVMESKGIEQNQSECNGMEWNG

SEQ ID NO: 939561 - protein, 123 aa, Homo sapiens
VVAAEVRNRMEWNELYWNGIAWNGKEWNGINASAGECNGTECNGMESSGMEWNGMEWNGMESTRVQRNGMEWNGMEWNGMEQPEWNGMEWRVRELNRINPNVMEWNAKEWNGMEWNGMEWNGM

SEQ ID NO: 939562 - protein, 149 aa, Homo sapiens
VVAAEVRNIMEWNEMEWNGMQWNGMEWNGFNSNGINTIAMEWNGMERNRMESTRVEWNGKDWNGVEWNGMELTLKRMKWNGMERNVLEWNGMESNLSAGECNGTGMQWNGIIRNGMEWNGMESTLVQWNGVEWNGMEWNNPYGMECNGE

SEQ ID NO: 939563 - protein, 69 aa, Homo sapiens
GRYVTDMTSRQAKDTELKTLDSIAKPRLLNPFPLSNCCCGAAFTSTLWSTEIEGLCYPSSDKLQPELFS

SEQ ID NO: 939564 - protein, 41 aa, Homo sapiens
SPRGFPPAHGVKPEILALYASFDLASPYPEPMQFGNMPPSL

SEQ ID NO: 939565 - protein, 70 aa, Homo sapiens
GKQEARGSPGLRWGPFFGESLPPPNESPLFHWGPFPGFSFGVGNSGRYRQGMSRFYPIFPGPPSLPPSPL

SEQ ID NO: 939566 - protein, 128 aa, Homo sapiens
SSHMAPLLTLLLPSSTLKTYGQEQWLAPAIPSTLGGRGRQIAWPQEFKTVLGNVAKPHLERKEEKGRGEEEEELHIYTYTHTHTYVHTYIHASWTWWCVPVVLAFQETEVGGPLEPEIAPAWVTVRPC

SEQ ID NO: 939567 - protein, 122 aa, Homo sapiens
GGLGTYAFGIAFHSKKEKGSPPGRKHKAGGFGNALCFWVQQDQPRSPPAPAFQVLGGHFLLFKVQKSFLFPPPPGTSPCLTFSLYGNIFDFFTSFGVRCSTFFAPGCPPLSQPVYPDYFGGL

SEQ ID NO: 939568 - protein, 67 aa, Homo sapiens
HLQNIKMPATGPARWLTPIIPALWEAEVGGSRGQEIETILANTVNPISTKNTKNEPGVVVGACSPSY

SEQ ID NO: 939569 - protein, 71 aa, Homo sapiens
QKHMYYNRDWYKRNFAITFFMGKVALEKDLDPASTESQEEQPLVVLFEPARVQVSTCSRWSSCSQGLSQKL

SEQ ID NO: 939570 - protein, 73 aa, Homo sapiens
KGMGARPSRGGTVVRKGMGARPRSGNSGEKRYGGSSQVGEEQLVRKGMGARPRSGRNSGKKRYGGSSQVGEQW

SEQ ID NO: 939571 - protein, 36 aa, Homo sapiens
RYDFFCHFWLIPASQVTARKYLPAKIPVMFALLSSS

SEQ ID NO: 939572 - protein, 118 aa, Homo sapiens
SGNVLRLQVDAQINHAVGPLLPAAAGAPAPLYLRGPASAHVRPALARRILRPHEKAGGEPVPRLHNSLCVGPRDSVGQWLPSRLGLSQRRPLVRPLQLPHPAPCARLIGVYLDSKLCG

SEQ ID NO: 939573 - protein, 44 aa, Homo sapiens
RRPPGLVRDADHMHHVHDACQDAMPEPDVLLEIQHIHNGFSFRV

SEQ ID NO: 939574 - protein, 124 aa, Homo sapiens
QVTPFVLNSGKCKLVVEEYYEVLDHCSSILNKYDDNVKANFKRGKAHAAVWNAQEAQADFAKVLELDPALAPVVSRELRALEARIRQKDAQPTPRFLGFLFHSSSTWSCVSSRVQSYCCQPPCP

SEQ ID NO: 939575 - protein, 72 aa, Homo sapiens
SVSIQLIYIDIEFNYIVTNFCLLDLFLMEGADVSNCDSGSIYFSFQFCFCATSFENQLSGAYTLRIVIFLED

SEQ ID NO: 939576 - protein, 110 aa, Homo sapiens
WSWEAGQPPGLGTVGGHSPSRTNGLGLGSPSGRRVTLACQFAFPPPRVLWFGWGFTPTPGLTLQVVHSQNCILDFYPTVPFPAPQRYPDIYPQWMGGQDRQRSINRQALC

SEQ ID NO: 939577 - protein, 98 aa, Homo sapiens
KRNIPAAAHQVVLPYPFTPHWQFERAIQTPIGSPWNPQRAFQKLTPKVVPKPGHFFNPIKAKKVGSRFSPRWALFVIQRNPKRIPPRPKKQLKKCSVN

SEQ ID NO: 939578 - protein, 64 aa, Homo sapiens
MAKLDPGTRRPKRWFKVLFLEGAFQHVGKTFNQGKIFKEHFLPSPNCLHLPFREMGVIKGNLTF

SEQ ID NO: 939579 - protein, 73 aa, Homo sapiens
ANSRSSENTKQMMSSFMLSISAVVMSYLQNPQPMTPPGDTSLEGSHFGPCLSPRAGLWVVNLLPSTAILGFPE

SEQ ID NO: 939580 - protein, 154 aa, Homo sapiens
VPSVPALTNAKEFVYNGGGSASLFFDTADGQGSGTQSPFGVSGAGTCNNSSFDMAQVFGGGANSLFLEKTPFVEGLSYNLNTMQYPSQQFQTVVLAKLTIYLEKTPFVEGLSYNLNPMQYPSQQFQPVVLAKLTIYLPVGPGAPKTTEKRKERP

SEQ ID NO: 939581 - protein, 73 aa, Homo sapiens
RIGAHRVVQDTRGVGRCLCESSICVYAVLSKDTPTDTDTSLRREQPLPLSVQDDTFFLNIILRFAHHTEYVCM

SEQ ID NO: 939582 - protein, 69 aa, Homo sapiens
ALNGSTPWGKMSISSIGVVGAPEDNRSHSAHFFEFFTKEIALGQDRKIIRFFPLESWQIGKKGRVMTFL

SEQ ID NO: 939583 - protein, 68 aa, Homo sapiens
KEGVYQVKKQTIRELMLKTWTPQWLTCKVQRLQAKASINTWKPYIGLAKKVGYPEVGAYRLQVNPNIF

SEQ ID NO: 939584 - protein, 69 aa, Homo sapiens
SRFGERVLVSHRSVVSSQLVIEGQRWVNQYCQFPVGNYCGPPYICELIIGFVREVYECMRILPYEENLG

SEQ ID NO: 939585 - protein, 117 aa, Homo sapiens
PQKRGGKKKLPKPVEIAEGAPLEKTLVKKKKKKDSQWILPSRGLSAPQLSGPCGGRHLWPEVPTKFPPEGLGAFCGMPMGCRVLPSRPLSPQLHSQEGPFNVFHRGFQTQINFFVNS

SEQ ID NO: 939586 - protein, 107 aa, Homo sapiens
PPDPPFHGAGSPIPAPSSPKNQRGFVKVSNGGFSVAGPQGGARGGLTSQESRGAFSPPPGSGPLRLGFVPRFARNFPMPSPPSGGPPVGEKSALGFFFLSHFIFIME

SEQ ID NO: 939587 - protein, 71 aa, Homo sapiens
LGPGVQPLCEAPRTGVVPRGCLGPPGPFGGPLFHHHRPGVKGGSPTPRALGISLLEGRGASPFPGQKNGPG

SEQ ID NO: 939588 - protein, 127 aa, Homo sapiens
GSGLAPARLRNEPHLALVTNTGPAPGSFSAQLGGCLVATAVHPGAPRPFLKDIADNPGQAKGSDKGSPILPAQAPAPLGKKYFFFFIFRQSFTVAQAGVQWCDLGSLQPPPFGFKRFFCFSLPSSWG

SEQ ID NO: 939589 - protein, 81 aa, Homo sapiens
MLFERRYVLMLYAKPHTSVLPNSSVAEAFRMNGEPWRPVVVCFKSYIANALYSSCVKCWCLERPVLARTEQLRCMSAAQET

SEQ ID NO: 939590 - protein, 59 aa, Homo sapiens
LPTPLEPSTGIHDGLPANLLVGQTRKSRVPPPGGRSHGLLGLARGPPPWVPCGNKQANE

SEQ ID NO: 939591 - protein, 68 aa, Homo sapiens
NPPFLAPPGHWGGGVGVPPPPPFCPPPPGGARFGFFAPFGFLGVFPPPPPPPPPKKPPKGAFLGPRGP

SEQ ID NO: 939592 - protein, 123 aa, Homo sapiens
GLGEGGRRIIPSACLAKNQAWSLGLPPPRLLGAFWFQASWRWVAKIINSSPVAPVLGAFNPGSFCHSFPGALSKGVGSGRMAMPRCVFRPFTTVCVQAPPSPKALGPPGIRVKGLRGIKSVPL

SEQ ID NO: 939593 - protein, 101 aa, Homo sapiens
PLKILGFGWDWKDPKFGGNMGLSQIKKEGFQLLGKGGVRLGQAKSLKLGPFLGWVPKKIPGFPGKGAFFLKAFIPCQPPGKIRQKVLFIGAPKGSLGSGGF

SEQ ID NO: 939594 - protein, 105 aa, Homo sapiens
KNPPPPKRNFGEKPKGFGPPPFKSFFLLVGPQTKRVRHFPPPQVFGTSVKVVPPADLPAVGALGVLFRGQRGQVFFVGFFFGPVLLGARGGGAPFGPFFQLINCR

SEQ ID NO: 939595 - protein, 81 aa, Homo sapiens
TFPLPHPPQGTQYSLLATLELLGKLLLGTLAGGLGDGLGPHPCFLVLVNLFAFPVLDLDLAPSTFFLAEWVEWSIKPHVPV

SEQ ID NO: 939596 - protein, 71 aa, Homo sapiens
NATSLGEGKDLEDPGPLPEAQTRPPGPGRREPFKIYGPLGEKNQNPEKATPAALTGRHGHLRALGPLGTLG

SEQ ID NO: 939597 - protein, 96 aa, Homo sapiens
EKELAWEKEKHELGLMKLKNRFRDPLESDTIVVHAILSDHKISSYRLVQPSKYSKFKRASQSERKPSKLDRFEKEGPGRKDSQRDAGGSVTIQEES

SEQ ID NO: 939598 - protein, 75 aa, Homo sapiens
NHPHSPRSNSHSHPNPLKLHRRSHSHNRPRAYILITILPSKLKLRTHSQSHHNPLSRTSNSTPTNSFLMTSSKPR

SEQ ID NO: 939599 - protein, 136 aa, Homo sapiens
FTVGGLTGIVLANSSLDIVHDTYVVAHFPYVLSIGAVFAIMRRVHSLISPIFRVHPRPNLRQNPFHYQIHRGKFNFFPPTLFRPIRKAPTLLGLPRCKPHMKHPIICRVIHFFNSSKIKNFHDLKNLRFETKSPKS

SEQ ID NO: 939600 - protein, 112 aa, Homo sapiens
MGEIASFDKAKLKKRETQEKNPLPTKETIEQEKRSEISEDPGGFPTPVLFETPVVCGGKAPCKMDTSPKLPFELGHSAPMPPACGFLKGPPPNRTAKFSGLPRDFIENFLFE

SEQ ID NO: 939601 - protein, 85 aa, Homo sapiens
HEEVDSKCYVQTRQQFFVEWIPCQDNQFVTFTLASKIAVTFIGNSPAIQELFKRISEQFTPMVRRKAFLPWYTGEGMDQMEFPQA

SEQ ID NO: 939602 - protein, 173 aa, Homo sapiens
MFARSTARAIYKPVVRPGLHDYCDIIHMDMSTTSSKLEAREYRDAQEFGADVRLMFSNCYKYNPPDHEVVAMARKLQDVFEMRFAKMPDEPEEPAVAVSSPVVPPPTKVVAPPSSSDSSSDSSSDSDSSTDDSEEERAQRLAELQEQLKAVHEQLAALSQPQQNKPKKKEKDK

SEQ ID NO: 939603 - protein, 90 aa, Homo sapiens
IQHPSLLQSTLHTAARGTLQRPTRLCSELCGLPPSQKAQPAPGLTLHSAPCERASGPRGSLVPEGLPDPGAAFLEVVRTHGPARSERCVK

SEQ ID NO: 939604 - protein, 180 aa, Homo sapiens
KLKTTGLRSCSVICVEQLPLSQDICVVPLRWNGSRSCTLSHPHTPRRCAVVEARRSPHHLLEWIAHPLRGGVPQDDYPQSAALRWGRLSLLRSLIWVPRRAVEARWMVCYTPAVVVMRPPHLRGATPTALYGGAPPLLLGAPYHSLLGVRNAHPPQFIGEPPTASCGYPPHKRAHAAAPR

SEQ ID NO: 939605 - protein, 68 aa, Homo sapiens
SELRGDVLYALQPCGTKLRKQKRTKTHLSALVTKGASEMNCYKAFRNIHLFLSSSKYNDNSTDAIKNL

SEQ ID NO: 939606 - protein, 103 aa, Homo sapiens
GVGLSKRMPPMVSRAKWKSFHCSPPRCWPCCYPTVKGKFFPQKIFGGFGPLNPFKNPNSFLNRFRGIVPKKKKPQKKGSWVSLKAPPPPPQKAPFFKTHGKGP

SEQ ID NO: 939607 - protein, 103 aa, Homo sapiens
GPLYTDPGNRGWAPKPLSPFICSLDSSGCPKVYFVVSGPWAQQMYGKGESLWEPHMGPGPLFETLSQTMFNSVGREQGSGMGVIVPIIEKGKIPPRALKGRMG

SEQ ID NO: 939608 - protein, 112 aa, Homo sapiens
AKFEENVILSPPPPAPDIRDNNTGVMYTHCFIGSNIILSFLDIRNNITLCVYTCREIQWNVILCLPGYDEQYHVGMYNFRDIGSDIILSPLEVRDNITGVVYSFWDVGTNII

SEQ ID NO: 939609 - protein, 117 aa, Homo sapiens
QDWVYGKKYSAKVSTKPFQPPIEKTISKTKGKAPRTQVVTLPPSREEMTKNQVNLTCLVKGFYPNDIPVEWENNGQPEKNYNTTPPNVEIRGVLFPLKQAPRGQKQVATRENFFMLR

SEQ ID NO: 939610 - protein, 74 aa, Homo sapiens
KNHPRKWERPSSDEENENGDFTVEKCPGRAPPGEMEVPTLCWTKPHCPGPCRPPVHRLNCHDLEADKRPPAPQP

SEQ ID NO: 939611 - protein, 95 aa, Homo sapiens
RPQKPSLEFKEFVGLPCKNSAAFSQGRRYQGSPGALLCLGTPKRHCDGFAFQYEYEPPCTSLCGRVQAARLPPQVMGWALPFLMDAQPGFEPTPM

SEQ ID NO: 939612 - protein, 84 aa, Homo sapiens
PQHRCRVIVLERIRDRFKPVLELNRQACYAFILCVRYSMVYGCNAAYNLYFRKHEGPNQIEGRNGMSFLLEAGTWFCIPLEQPF

SEQ ID NO: 939613 - protein, 114 aa, Homo sapiens
FILIRPSIGILAPEAKNLARGGIGAPPSAQQPLVPPLFPLWAPGLVSPSANPRAPFGPCPAPRPVAPCPCPRGDMAAQSQGWVGGCPKDPFWEPLFPGLGPINPPLFLQLVLPP

SEQ ID NO: 939614 - protein, 73 aa, Homo sapiens
PPETTGSSLLHQGWTYFASVLFDSWAHGYSDRIETMAHLGFFIFGVCHAKEPSNCDAEKLLKVFRNVKPAIVW

SEQ ID NO: 939615 - protein, 102 aa, Homo sapiens
DTRMIRKQTALIAEMEKVIVVWIDQTAHSMPSQSLIQSEALTRLISVKTEEVRKLRKKSWFMRFKEISCLCNIKVQSEAASTSGEAAASHPEDLANARHGGS

SEQ ID NO: 939616 - protein, 125 aa, Homo sapiens
LFQGRAGGGPQIGPIWVPRGPCPTLQGAPGASPFLWHANWVVVGGCALRPLKTPSFKGPLRKKNPAPGPAGGGSRLALTFFFFFFKKKKPLKNPPLKPNLFGFLTKGFSKFGWGFVLKVREFFPP

SEQ ID NO: 939617 - protein, 75 aa, Homo sapiens
QQLTELYRDISQHLRDESGNSYSPEEYALQQAADGTIFLVPRGTKMEATDLAGPKEVELLMGFPSFPFDKGTPPP

SEQ ID NO: 939618 - protein, 76 aa, Homo sapiens
VRPGLMALSGSPKPWGQLSISSMGVVGPPEDNRSPRAPFFEFLPQELALGQGRKLIRFFPLGSWPIGKIGAVMAFL

SEQ ID NO: 939619 - protein, 102 aa, Homo sapiens
MAVRGHWGASSQELPDVGSGGNPEKGAHLQVHSRVPAAPMKAPSDLPASPFPSPAPHCHCRHDNVTLSLTGFDSTLSACILTANEKAPISYLFIFPINRRKQ

SEQ ID NO: 939620 - protein, 152 aa, Homo sapiens
KSSLSLLCLSPVLPQGHREPNALAVRSPSSEYLGLLPSSSTGGQHLIVSTDTAGWQQHGGQCCHCKPEDKEMNYQTSGRGKFHERSSKTLRGCTEGHSNSGVVIKAFYKYLCIHKRQATGQLQKEANEFQICFFSCQMQGCAATFAILVKGK

SEQ ID NO: 939621 - protein, 124 aa, Homo sapiens
VLAAVGKKKKDVILADLLPSLAVYLRTLAPGLFFSLMASRARKERKSKNSSTLTSQGQGREAALLGLLTLQGTVAFVEKFNGDFVSQRGKVLKKQHLGADHAGRGTNQNTSNNASIPGVRRKAP

SEQ ID NO: 939622 - protein, 101 aa, Homo sapiens
PLLGPQKKGVIWVARENPPGGPFKVKKKGLKGGKGGLGPPPPRPPPPQRGGQRGEGLKGWGGGRFPPKLGEKFSRGGPQNFNPKGSLGGGIFGGFWFFFWG

SEQ ID NO: 939623 - protein, 95 aa, Homo sapiens
WFPGIIAAPLPPLPGPQWLCRESGGDLQRADAGEKPKAFIHWVSQPLMCEVRLYERLFQHKNPEDPTEVPGGFLSDLNLLVFNRTVTLKEDPGKV

SEQ ID NO: 939624 - protein, 122 aa, Homo sapiens
DLDSQVSQKGLGPVIQPQPKSYFKSISVTKITKPDGIVEERRTVVDSEGRTEHYSIPTPKQYEQILVGDPRITIDLRTLDRCLFPSVDIIPGTVGSESQVACVNPQSAFKVLSYLYTPLPTS

SEQ ID NO: 939625 - protein, 99 aa, Homo sapiens
DFLQKLSSSLSRTWEDLAGGAVFGAQAFTPPVGSERQSILTRQCCWFPECTQVLPGSVCSERAWPNALACEVGTPGPCEPLEGRPRNVRVGQGTPLPRV

SEQ ID NO: 939626 - protein, 70 aa, Homo sapiens
INVGGNTAAVEFSPGMKTTSASPSRVSGRMFQSSTILRCEQRYTCALSESLPYILQLNGRLVALAFIKLA

SEQ ID NO: 939627 - protein, 170 aa, Homo sapiens
DWCISLAIKAKVPPLWVEASQGLFPPAEKKSMMWTPWAMVFLDPWKDRSLPDTLLLKECGLLRKGPVLLADNVICPGAPDFLAHVRGSSCFECPPYQSFLEYREVVAGLEKAIYKGPGKTGPLPPPAPLWGFFTQPGTKGAKRAPVALLRLRAVSYNAKPPSAEACALTC

SEQ ID NO: 939628 - protein, 46 aa, Homo sapiens
GGAPPNPAPETGGGGRQGSFNSKPPLLATKLCGDMIFVTALGRSPP

SEQ ID NO: 939629 - protein, 120 aa, Homo sapiens
SEIPKLPAVSSPPGGVWFNFPGPELVIQFAQGTVRLCLSGFRALEILPPGPVWIPGDVFLGGDVTVFSPGDIKNGAPVGLGGACPSGRGLGRGETPQGQFPGGPPGYGPGPRGAKLGLLR

SEQ ID NO: 939630 - protein, 68 aa, Homo sapiens
MPHVPRLQLQAAPPIVGKAFAPAQPPPYSPCALGTLCKGALCSLSPPSLDFWTWPPDLPLLNKTAVDV

SEQ ID NO: 939631 - protein, 136 aa, Homo sapiens
ERDIDHTLHAANTGWLCPCSACLEERRRRQLLSGDCAAPDRALNAARISPSVHDMRYMRITECRFILCARFCFACRCPLCVHFQCSDPPHPYMRFTARMSSISCPVYVHLLTVTNILVSHEYFTAGLASAPSTTVL

SEQ ID NO: 939632 - protein, 39 aa, Homo sapiens
SQGKETIYYPEWFVLMLLVGMPPHQGRFCPDLFVPSVVF

SEQ ID NO: 939633 - protein, 98 aa, Homo sapiens
GLRGKQHSLFKGLGKAKKEAPPMEKPEVVKTPLRDMFFLPKMVGSMVGVSNGKPFNQVEIKPEMFGPYLGEFSFPSKPVKHGRPGIGAPPSSRFFPFK

SEQ ID NO: 939634 - protein, 151 aa, Homo sapiens
GKGPIPGPGKPLPPGGLFGKPGKFFKKKGPGWAPFPCPRGGPPPFKGPSRGGAPPPKFPQNLGGKGPAWSPPVWGPPFFLKNPGPWGDFKGPRPPLGPPPPPPSLGGGGGVKKTPPPPFPKKGGGGPRVPLGVQKPGKVGGPVFPFLKGGR

SEQ ID NO: 939635 - protein, 100 aa, Homo sapiens
PPPPRPPGPMGFFGREGEGAPFPNPPPPRGWRFFFSPGPPGFPPWKRAVGAPPFFLVWSPLWPPPLFPFFFPVVFFLGFLGGYPFPPGTPFSFFWIWARG

SEQ ID NO: 939636 - protein, 128 aa, Homo sapiens
FQNWKFTWMSSWPRKIHKPGPPGSKKFWFIVSNPQRPFFLACWTKSGGCKNLAPPQKNEGPPPRKTGGPPGQFLPPTLVKKTKPGGPSARPGAINRAPWAPGPGVFSPPPPVFPFWGFFLFLEMMGLF

SEQ ID NO: 939637 - protein, 34 aa, Homo sapiens
TKLVLFHKMFRDRQWLVLGQQLSNVATGIFVVLL

SEQ ID NO: 939638 - protein, 111 aa, Homo sapiens
QAPPEGGGGLLVRSLGRSQGGGGPRGAGARGLFFSLGGSGDHFWPPFWEGGGGLGGPVFLGPRVPAPGAGDLFFQGWGAGGGFGPPGGGGVGGGFFFGPPPPSPFRVNFPG

SEQ ID NO: 939639 - protein, 118 aa, Homo sapiens
GPFWGAPPRPPPGEFPTRVGPFFFPPPPGGWGPRGYFFFFLKKGFFPFAPAGFFFPPPHHSPSPPPPQGLVSGVGPPGPPPLIFYPFFGPRVGFPFGLTLYGGFKKLKGGPFFCPGVG

SEQ ID NO: 939640 - protein, 134 aa, Homo sapiens
GVGGGGVRGAGVLGGVSVLWCAGGGGVSGVRLGGCGGGPWDGGGRAGVAQGGGGVGVRGVGGARVSGVCQGGGLGIGGGGGVGFRGPGGWGRWGACARRGREPACGGGSAVRGVHLSPILLLSLNPGIITGVSS

SEQ ID NO: 939641 - protein, 122 aa, Homo sapiens
VGSPPNVLTNTPAELQFSLLTTCRRLPEAIEEVKNGGWTSWKPLWLCGYGLPQSPVGIIGVGGIGEAPPGPLARPGFHRVVCIPGPPCLKAEKTPMLSGPFACSKDIFNEGYSFVKPRQIHK

SEQ ID NO: 939642 - protein, 54 aa, Homo sapiens
QNGPVDGQGDNPGPQGVEQGTDPAGPSDSDKKLPEMDIDCIPPLVFIKTDYYKA

SEQ ID NO: 939643 - protein, 101 aa, Homo sapiens
IPFGNRKRGVLGKGPWGPPPPPWVGSPVAIGPFPWAPPHRLGARPPARLGFSPNPLLWGGERGGGGGARPPPRALGGARPPGVFPSPGGFSPAPLFKSNPD

SEQ ID NO: 939644 - protein, 123 aa, Homo sapiens
MGLSAPSCLSKCDRAGPKPGCTLLDWDNLLSLGKSAEGPKLLRGLRLVPPPKIVRFLPLPARVSGPRSIENTPPMARWKGLLVPASNCPPWCSWPGQPPGLGTGQAGPGRGLSLGGNKSSPTP

SEQ ID NO: 939645 - protein, 118 aa, Homo sapiens
GGTKWASPPCPLQGAGPGFWVGPLIPAPQGTGIVSAPVPKKLLMMGGIDCYPSARGCTAPLGFAKAPFDAIFKTYRYLTPALWKETVFPQFPYQEFDPLVKTPPKVSGQRTQAPTGGT

SEQ ID NO: 939646 - protein, 118 aa, Homo sapiens
MGFKTVLPFTALGFGQDALAVLKNRFHPNITLEAAQGLLVETVPPGFLGDLGSGGNVDACVIPKTGAQLFRTLGSPPKPVKRFGRSPFVPGTPAVLTPPVKPLTLGLVEETVPAMEVG

SEQ ID NO: 939647 - protein, 88 aa, Homo sapiens
PPPQGFLPVFSPPRGGEGPPWGWAPPPPPWGPPPPPGGGGAPGGGAPPQIGALYPKGGPPGSGFFFFFPVFFYPLSPPLKKVFFFPPP

SEQ ID NO: 939648 - protein, 70 aa, Homo sapiens
AFPFNPRFNENNRGVLVCHTKLDYNWGREKKPSVFPFESGEPFKIQGLVEPGPFKGAVNDGPLLQDHPRV

SEQ ID NO: 939649 - protein, 100 aa, Homo sapiens
FAKSILLGGFVLYGEVNGFVMKGCVVGTKKRVLPLRKSLVVLTKRRALEKIGLKFIDPTSKFGHGRFHLMEYTAFLRPPPHPLPHQGRKSSGPSLQLIFH

SEQ ID NO: 939650 - protein, 62 aa, Homo sapiens
VPMFQIAIKSGPSIPTGAGVETQKQVRDNVVSVGTINQPLSVVVENQQYNLRADAGIPSVVF

SEQ ID NO: 939651 - protein, 41 aa, Homo sapiens
MGLSDERTILTLSEQLKCEPGNKLTLHVQLDLGEVVPQPVC

SEQ ID NO: 939652 - protein, 140 aa, Homo sapiens
WLSQYGPKAKAQSKQWLSRGGSGPVKPKPWWRAKVTPTGFGNAQALLLVALLEGQGVITSAYYENVLRKLAQVLAENPWGGFPWRVFFPRAIFFITQGQFCKGFDEKSLGIPLPVPIWPLLTFFCFLILKICRGPPFFFV

SEQ ID NO: 939653 - protein, 30 aa, Homo sapiens
INLISMLRKSLCENSLGPFSGCSYPFCRLL

SEQ ID NO: 939654 - protein, 74 aa, Homo sapiens
TGPKMWFKILPGLSVMGVCLLIPGLGTGYIPRFPNGGKEKRVAPFGYPWSLMEKDRGIFGVDRFYVSKGLENLD

SEQ ID NO: 939655 - protein, 117 aa, Homo sapiens
GEPPGPFPPGFLKIPGPLFFAPPWFWGPPKNQAPFAPWVPGVFGPPPPGGGGVFFLPPFFLGRGSPPFFPPDPPTPFGKSCPPGPPGPPPPFPGGPLKKLVGRSWARFFFFFFLNPP

SEQ ID NO: 939656 - protein, 109 aa, Homo sapiens
LIQAAQLLQVKKKTDDDAEALCFMGNALTTAQIVKVLNLYTPVNEFEEKVFGSVIRTIQMGLRDRKDSPQLVMDGKHIFPVTFPFNPFSLALETIQIPASLGLGFISRV

SEQ ID NO: 939657 - protein, 129 aa, Homo sapiens
GTPRFLHRVKGALGVPPVTLAPTRGGEPPPLGLEPGWARAHPRGGAPLERVSGGVGGPGAPPASPGPVGPPPLPGASWYPSPPGGGVVWGRAPFVLAVFPSPFLKVFFLGDPLFKLGFFSWVYPLVLFL

SEQ ID NO: 939658 - protein, 185 aa, Homo sapiens
PHQNLTKLPPLGMPPGHFSHDAWEPGFTCRFGCICSDYFHVLPLSNHFDWLDNRASRRQNPLDPSNVWGADPNFNPVEGFSDRPGSLPGFAASLSLGQYLIKVRPSSETGGLGGRLNHAEFSQIPLLVFPPPPDPFVEFLNRQRFPGFNRLVIFRFYPLFPPLGVFELKGFYSLFWSAGDGEIPI

SEQ ID NO: 939659 - protein, 51 aa, Homo sapiens
SLVNLDLQASYTYLFLGFYFGRDDVALEGVNPFFRELAEEKREGYERFLKM

SEQ ID NO: 939660 - protein, 45 aa, Homo sapiens
WSLFRFRSRPQYRFRFRSRPQYRFRCRPQSLSWNQSQPPIKPPPP

SEQ ID NO: 939661 - protein, 61 aa, Homo sapiens
VYLYCQPSSMQRSIVWERVEETPKSRSDILAEPSEALAVALPHHDRAHEDLDGADIGQRYL

SEQ ID NO: 939662 - protein, 69 aa, Homo sapiens
GLGGRGKAKRVFEEKGGDKRAREEFGAKARGVFEGQEGFRGAKGGGGAPKPQGKKKFEKLLSLGFPFSI

SEQ ID NO: 939663 - protein, 120 aa, Homo sapiens
VCPFRRGLFQSAQSLPWTRGKAMSFLPQPLPVPVYISGERPRGLPARHPAGCQPGLHGALGLGSLRLPPAGLGMRGSARARATAATRVAGGAEVRPCWKSGCGKKGQVRGAEGRSPSGSP

SEQ ID NO: 939664 - protein, 72 aa, Homo sapiens
PRPFCKKCGKPPPHKVTQSKKGKVFLYAQGKRGYYRKQSGYGGPTNPFFRKKAKTPKKIVFKAWGGWAPLQI

SEQ ID NO: 939665 - protein, 73 aa, Homo sapiens
EAQREFERGASGPEVLWYPVHPPQLLARVLSPSLPRASGTSRLLQVRGLVSPAELELVLAHECHAPLPPPQKK

SEQ ID NO: 939666 - protein, 103 aa, Homo sapiens
GGPPPPGGGGGPPPLFGGKTPPLPPPREGGAPPRGGGGGGAPPAFPPVFFFFFLGGGGAPGGPFFPPPFFFFFFFFFPPPPGGGGFFVFFPVFFFFLIFFFPP

SEQ ID NO: 939667 - protein, 124 aa, Homo sapiens
PWRDGGPSVDLSITEGGGKRNKICGRHSLYVDFSDVGWNDWIVAPAGYQAFYCHGDCSFRWGEHLGCSRDGSVQTLVSSVDSGIAKACCVGSEVSAMSMLELDEYDKVVLKNDREMVVEGCGCR

SEQ ID NO: 939668 - protein, 112 aa, Homo sapiens
DTAVREGFEETGIKSEFRAVLSIRQQHNPGAFGKADMYIICRLKPYSFPINFCQEEWLKCGWMGFNGLAKTENSTPLPSRGGRLLLYGDKKGFGKIGLAVEELPAVYPGLFY

SEQ ID NO: 939669 - protein, 41 aa, Homo sapiens
QRSAVFISRGSVVPPPIPLDVPSLTTPSVVFQQQYSSSRRP

SEQ ID NO: 939670 - protein, 90 aa, Homo sapiens
PPGFSLFASGLDVGGDWGRVTISPRGPVWPGFGFYTPPLRGFGPPGPKFGPGGSPKSPPPAAASQKPAPEKKPAGKNPPPRGKKPGGLTF

SEQ ID NO: 939671 - protein, 79 aa, Homo sapiens
IAKMVRDALDAHQQSIPAVLEIPPKGPPYDAAKVSLLGRARGMFPAEDLRWGLLIALSPSLVSRPLPRVALSLFYFLSL

SEQ ID NO: 939672 - protein, 105 aa, Homo sapiens
GAPPRGAPGPQKRALGFQPSPPGAMGGMPPGVLQAGVGKGLAPGWPGGLPNPGGGGGPRPPFLPPALKGGGGPFPPWDFPPGRGFPGVLFGFPKAPPFNPNGFSP

SEQ ID NO: 939673 - protein, 129 aa, Homo sapiens
GSGTRWGLGLAPSPPTVFSRRMGLLVKTQIFWGEKKSPGVGLNPGVVVPVFQPRKKDLSLKGKPLGLVQIQGVLFRQPPPFKTRDSGNFWGGFLVLKKGLVRRVVNKVLRFPGSRKKMPDGPLGPLGVF

SEQ ID NO: 939674 - protein, 114 aa, Homo sapiens
RGPMAVMLCWFPRDALTNYPKPGGLKQQNLIPLQFWRLEIWDGGVGRAVVPLKALGKNPSLALFSLWRQWAVRGIPQLIGASLQFLFFLFFPFLTTVIGFRAPPNPGWFFFDPY

SEQ ID NO: 939675 - protein, 84 aa, Homo sapiens
GSAAVLQRRSENEEFVKVGRLGPSDYFGEIALLMNCPRAAPVVARGPLKCVKLGRPRFERVFGPWSDILQRNIQQATRFVSLSV

SEQ ID NO: 939676 - protein, 95 aa, Homo sapiens
RASPVAALKAKVIQKLEVSKPPAYAYPATPSSHPTSPPPASPPPTPGITRKEEAPENVVEKKDLELEKEAPSPFQALFSDIPPRYPFQALPPHYG

SEQ ID NO: 939677 - protein, 102 aa, Homo sapiens
AFVEKTKGPWGPPALFRTHGEKKRRPLALKNGLRRAPSGGQRLALLKAKTPQRCLGFPIFFFNPKKVLIYNSLFIKVAPTIRIIPGWALGFFPPWEKTLKPG

SEQ ID NO: 939678 - protein, 133 aa, Homo sapiens
QSNVLATGGGPSDRHICIWNVCSGACLSAVDAHSQVWSILWFPHYKEVISGHGFAQNQLVIWKDPTMAKVGELKGPPSRVLSLAMSPDGAPVASAAADETLRVWRCFELGPGRRREREKASAAKSSLIPQGIR

SEQ ID NO: 939679 - protein, 101 aa, Homo sapiens
NLILKKGPAHLWFRIKFLPPGFGGKKKILNPPWVGRGPPPPPPPLFPKRLKPGFRAGFNRFFFWEKIPFFAPRVENPVNPRPGFGFFSLNPFFFMDGAQLI

SEQ ID NO: 939680 - protein, 108 aa, Homo sapiens
LGLLPPPRGVGLPKKKGSGKGGPKWGKLKGFRPGWIPLRGFFCLGPHPLLGQGGPPLSDMGGPRFRPLFPGPPWAGPPGVGPPPPGPPWGPPPLGAFGPPLWGGEFFF

SEQ ID NO: 939681 - protein, 66 aa, Homo sapiens
YASGTRFFLRQVRQGLCRPGWSAVARSISAPCSLRLPGSGDPPASTPSSPTTTTVARTTGVRHYPD

SEQ ID NO: 939682 - protein, 30 aa, Homo sapiens
RYDFFFFHLSHFFLLCYFYYFVFTPFCRLL

SEQ ID NO: 939683 - protein, 39 aa, Homo sapiens
AGQKEPLLLFMIGDNDSLAKCHGSRCSLVSSFYPLLSSS

SEQ ID NO: 939684 - protein, 138 aa, Homo sapiens
QIGGGVAAGVAGEGFDQHHGEHDYARDQQKPEDPGKSHPAHTKAFIIKGDSLSLVVHGQAVPDRGLSGAVQCRWFQALADWPEFCQVCQPAVAALELDDVVPGPAQGAGRDGVPHAGLAVAHDSAFGRKLIQVPHGAA

SEQ ID NO: 939685 - protein, 133 aa, Homo sapiens
MRERTAVQGQYLTVEQLTLDFNMTLPSSRPPPLCVYHVSIFSSSMSSSFLEVGPGCNQSPINHLLNATGIRVVQSGGAPPTTDTITPVLKVAMVHSLHGSTMQVSVEWIELGHMSVHPQSMELVQPYVREHGH

SEQ ID NO: 939686 - protein, 115 aa, Homo sapiens
MGVFFSPPFLARGGFFFSPPPKTGERIAPPCPGSPPFNPGENGGGGGSQTQGPFFGFPFAPRGVFFFFFFSRVGGAFPGAGLAPGVVFFPPPFLFFSGFPFSRGFPGQKKKFFFF

SEQ ID NO: 939687 - protein, 107 aa, Homo sapiens
FVGPPPPPPALLYSSRSGFSLLFFATFYSKLCCGPAVGLGLAKRIPMEPPFFFSVPPLCRALCPPSPFPPLVFIFKAGVCQGAGCQIDSFFNWAVFLNVIKPFCLRG

SEQ ID NO: 939688 - protein, 45 aa, Homo sapiens
MAYRTQTDFSPLPMLSLFLLSIMLGVHFDYVLSAKMYNKGSVLYK

SEQ ID NO: 939689 - protein, 109 aa, Homo sapiens
ARKAVLKGVLSHIKMKVRTSQAFRRPKTLSLRSQLEYPGKSAPGRVKLVTSAIIKFALSTECAMKKIEDGSTLVFSVDVKATWHQIKRAVKYLYGIHVGKVSALIGPDG

SEQ ID NO: 939690 - protein, 145 aa, Homo sapiens
RKKPSSEGGFLQNGVIKAPVRKMLHLPPVFTKSRTFQRWSPPGSFFWGGGSLFCPPNLQGVFWGPPFCFPKKLFSSSWGYPLGGGGCLPKPRGAKTGACFRPGFFPPPFFRVALGEGGTPKLGFGFFFRGFLLGRGGGFFFNRWA

SEQ ID NO: 939691 - protein, 133 aa, Homo sapiens
EGGWQYLILQSINKTCSHYECAFLGGLKTENCIENLEYFQPIYVYNGEKNQKLEDHSEKNWKLEDHGEKNQKLEDHGVKILEPTQIPAPGPVPVPGSQKPSFCILGQTAASTVWDGHHFNQCFCYKSLCCSVV

SEQ ID NO: 939692 - protein, 101 aa, Homo sapiens
PFPPSGFPFPGSVQDPGLHVWRVEKLKPGPVGQKNQGVFFSGGSYLVLPNGPKKVSPLPLWIGQQSSRDEQGACSVLAVPLNPLLGERPVQPREGPPADVQ

SEQ ID NO: 939693 - protein, 108 aa, Homo sapiens
MALPFLPRRAPYHVLTDTVGVLCVILHLRRDVIMHNSKVLIPEYLNFITLHADSQISLSYLGSLCVTALLTQLCCRLSAIRAAMTGTDLRVIYRDLLSTSTGGASSNI

SEQ ID NO: 939694 - protein, 120 aa, Homo sapiens
AAGCLLFDQNDKVMRQNLVYYQTPGTRGAFQMSTSSPDLKQFSSLMWPHSRRSCMTSNDPSALASPSAGITGVSPHALASFSPLHLSFYPHICFHPFIPVFLMFTLVFPMFIAAFFTILV

SEQ ID NO: 939695 - protein, 112 aa, Homo sapiens
KGGRAVLVFKGFGFPPPFAKKKGMGVPSAPKVGGLKPPKKFAYLGGLAPEVGWKFPAVPPPLGGKRKEKAQIPSRKKKPVLGVREPAEKNVGKKIAQFPGVLQTPGLLVWAP

SEQ ID NO: 939696 - protein, 68 aa, Homo sapiens
LATDKMTPFVDFIETLLNEQVKPSKIGCPRANVRKMGAAESGLAEYLFDKRTLGDSDNERYSLGLISP

SEQ ID NO: 939697 - protein, 33 aa, Homo sapiens
MQGGNGNANNTGDHGRHTAEGSSTIIATLLSSS

SEQ ID NO: 939698 - protein, 40 aa, Homo sapiens
GRANRTCITCYDSSLWFLARMLVAHGMHYRMQLLSPSVVF

SEQ ID NO: 939699 - protein, 39 aa, Homo sapiens
GTADRTCITCYDQQHCVLAEDLCTGCILGCSTYPLLSSS

SEQ ID NO: 939700 - protein, 160 aa, Homo sapiens
GRGEDPELHGHTAHTRGRATLPDHSHRARRAHRARDVVEELVGGGVPASSSLGARQAGRHPRAVLSGDKARGLVAWPRSGWGSPAPRWPHPRPAHLFPFSEGFLEKEARSLLGAWGTQWLFPMARVVQVGKSGSLSTASCPRLPRAGGAPGRPARHQGLE

SEQ ID NO: 939701 - protein, 112 aa, Homo sapiens
LFRLNIVLFRALLYSCLFRLNIVLFRALLYFCLFRLNIVLFRALLYFCLFRLNIVLFRALLYFCLFRLNIVLFRALLYFCLFRLNIVLFRALLYFCLFRLNIVLFRALLSSS

SEQ ID NO: 939702 - protein, 85 aa, Homo sapiens
NMLGLMHGTCPETSGGLLICLPREQAARFCAKIKSPKYGEGPQAWIIGIVEKGTRPARIIDKPRIIEVAPQVAPQNVNPPPGAPF

SEQ ID NO: 939703 - protein, 30 aa, Homo sapiens
MTYNILYHSSHTYKKEMFKDLPILPFCRLL

SEQ ID NO: 939704 - protein, 66 aa, Homo sapiens
GFSEKAFLVPAYTEQSQIKGYVWRSAVGFLFWVIVLTSWITIFQIYRPRWGALGDYLSFPIPLGTP

SEQ ID NO: 939705 - protein, 131 aa, Homo sapiens
LGFIEWATGPNPKKFWAQGFRPPFLRGPRPPGWLQGVENLGVVSVLGPQEVSPKNDWGRCWRRSVDKMGKCGNPQSPFSGSPASKTDKWVRGPQTWLPPLLCGKRATTVPDGYFFLSPNPFGTQVNPMHVG

SEQ ID NO: 939706 - protein, 55 aa, Homo sapiens
TGPNGPLVAWGPNPWASWALALAFGDLLGCEGKGRVIKELGIFNGINKTYKFILG

SEQ ID NO: 939707 - protein, 33 aa, Homo sapiens
EIGYCYVAWAGMQWLLPDTIIGQCSLLGSSDPS

SEQ ID NO: 939708 - protein, 56 aa, Homo sapiens
SSKSHARENRCCSCWEQNPAFRGNGYFTTKAGCGPFGDRLGPSQNVRLQCGENAPA

SEQ ID NO: 939709 - protein, 84 aa, Homo sapiens
PELFSRKDLGSTEDGDGTYDFLTDKKDEKAEPPKKKAPYEGRKKTTVYRGLVQKRGKKQLGSLKKKFKSHPRKPKSFSSCKQSG

SEQ ID NO: 939710 - protein, 35 aa, Homo sapiens
ESDRSKRPLKTIYDLPGCSLTRSSWHRGKLASSRK

SEQ ID NO: 939711 - protein, 67 aa, Homo sapiens
TPISDRVWAGGSFFPTNGTPGAPTFPRAPERPLLICRFWSKSVQEARTQLPSGVQFNWSPVEKPVFL

SEQ ID NO: 939712 - protein, 59 aa, Homo sapiens
RLQNQLQGALYAVGLLHAAGSGFHPSVLDGGGQYLIGFHNAHVVSQGLLRANLTSWVGQ

SEQ ID NO: 939713 - protein, 158 aa, Homo sapiens
RILRSVMAIIRMLVVDPVDRSKGLGHALTSECFARARRDRCRTIALHTSPIMTVALPMYLKMGFSKVHDAPPIHGVPYAVYTKVLLIPMPFLLVDFPVFDPVALALGPIVIRWYALAYIVGIVLGWVYARSLIKKERLWGGEVPITLPQLDDFILWVT

SEQ ID NO: 939714 - protein, 154 aa, Homo sapiens
TNLSVTLDWPVPDISHERNHAIYVVLVSGFSLSIMFPRFISTSLFFITKLYSTVLIYNWFSLFLGVLFCKVTANIELANIEPLPLQEIELGSCKPLVTFLPTDRYVILFYVYFCLKTTNLIYNVSIYLYTYVHMYICIICAYIYSWFINIEVMA

SEQ ID NO: 939715 - protein, 195 aa, Homo sapiens
GLIMEQVKVQIPVANARLLQKDGKVFPEVYKETWGLPGNSEQKCIPMCMDRYMDAWNTVFCAYNLRQRERTNMFPARAGHPPLLFSITVFKRGGPHVRTACPGLKRVAPVLGHTGMCPCPPPPCPLPTSAAWISGVWGPVPSLSAGSPVAPPSGLWGIPLVGPSQPHILGGQLVWTLELGVVKPPRSCPLLRMGK

SEQ ID NO: 939716 - protein, 76 aa, Homo sapiens
WNLPWGFGVLAGARTLVRGPMDLTCQGNFNVAVPFPDAKGCRRVLLALPPPCDKIGASDSGLLPGQEGNALSQTSL

SEQ ID NO: 939717 - protein, 59 aa, Homo sapiens
REPKAKIAKWDSPNLKSFCIVTEPITPVKSHRPDWEKILPIHPLVKGLIFKFYEDLNLP

SEQ ID NO: 939718 - protein, 105 aa, Homo sapiens
VFWFRLFPTTRGGEGRPGHGFSPGPGQFWGPGPPALVGSAPVPAPPRPAGPYFFWGPSWAPCRGVAQVPPAMGLLIVRPRRGVLVPPGGAGGFFDPGFFLRGLPP

SEQ ID NO: 939719 - protein, 38 aa, Homo sapiens
RNDFLAFSSSMGDTPSSSTSWISSKVTGRVLKRDWRGR

SEQ ID NO: 939720 - protein, 131 aa, Homo sapiens
QCPIRVVEPNFACEQNSTSVRPKAERFLPPPFRPRVVIGKGGPGGIRGGKGGLMDCGGPGGMFKGGPGGTKGGFRGGRGMDQGGFGGGKQGGPGGPPGPFMDQMGGKKGGRGGPGKMDKGEPRQERRDRPF

SEQ ID NO: 939721 - protein, 111 aa, Homo sapiens
LALFGGPFDPVCSKNRVGPGPDFPGFFSPPGPRGGGVFGFSRIPPFFFFCWPPPPVFFFFSFSGPPFFGFWVFFVGSLIFGGAFFVFFLVWRPFWGIFLGVPFKGLGTRKL

SEQ ID NO: 939722 - protein, 123 aa, Homo sapiens
ENFIFMGDFNAGCKVPKKAWKNIRLRTDPRFVWLIGDQKDPPVKKSPHCAYDRIVLKGQEIVSFVVPKSNSVFDFQKAYKLTEKEALDVSGPFPVEFKLQFSRAFPHSKKFVPLRKKTKSQRS

SEQ ID NO: 939723 - protein, 122 aa, Homo sapiens
QRGLAQDPQGFHPQARLTASIAHPKLGKRACARISKGLRLFRPKAKAQAKAKGQTKAQGAAPASVSGQASQQYPGPFKGFRVDIFAHIRAEGLVRPPPPAPGVPFAWGWGPPVLFVQINLRP

SEQ ID NO: 939724 - protein, 73 aa, Homo sapiens
NGILNGKIGNGVGFNHVNSRVPEEPSRTPPEIFREEVGAGGGGWWSPYKNFSFRDPIEVFKRPPIKNRGPFGG

SEQ ID NO: 939725 - protein, 118 aa, Homo sapiens
TPKKLYLVLDYVNGGKLFFHLQRERRFLEPRARFYAVEVARAIGYLHSLNIIYSEACLWVKARTKPFLLQQLGVGGTLNPDEILGDLVLCFGGGWSFLLRGPRAQPFWGFLLHFWQPP

SEQ ID NO: 939726 - protein, 171 aa, Homo sapiens
MPVYSPPHKAPPAARSHPGFLNNVNQSKWFSITLLELGLPIPPTPNSSLIATLALPKATGTRRQLAHPAAAQPGPPPPLTCQAQLDGPVPPASGVRHVPGGGGGGGGGRHGGDGEARRSHHSGRGWGPSSRRLGRHGRRVPDVPRVVAMSRGGSGTPSSPLLPLLLPRPGP

SEQ ID NO: 939727 - protein, 130 aa, Homo sapiens
ALKPEEKVEDCEEVQISPELLAHGRQKKLDLLNEGSARDLPSFQRIGPKKAQLIVGWGELPGPFNQVTAPWIGGGRGRGKPGTPKTLSPIILSPQVEDLERVEGITGKQMESFLKANILGFPPGQRCGAS

SEQ ID NO: 939728 - protein, 97 aa, Homo sapiens
SPPLGARVGFRDRPSGPAPKRGGMAFASPFATIQLLIRPKTAAHRSARTWFGGPPGDLGPPRASGGVVWSPLRAREGDGFYGPSLVFSPPFKFGLKL

SEQ ID NO: 939729 - protein, 39 aa, Homo sapiens
ENEPSQRAALPINSTLSYRKQRPGRPRRLSNDDPSSHAI

SEQ ID NO: 939730 - protein, 82 aa, Homo sapiens
KKKSPLFLRTVSFVGIFAGGQGFPPILQVFRALMKGPYDPLVGPLFFANQTEKGFLLGPELGELRNKLFARFKFWDPLGKAP

SEQ ID NO: 939731 - protein, 133 aa, Homo sapiens
GERKPASSYVGPPINKNARAFSSIRHMIRKNKFRPDLGMVELGFGDQAWGDWPVLWGRASPYWLQYGVERDGFLLSAYSPPPALAKGAACGGYGVSPVLFPRPQAAIRRARAILGSQKPVMVKRKRARPPKSS

SEQ ID NO: 939732 - protein, 108 aa, Homo sapiens
VPNGVPLGRTHQKLGIAPSPKMGFGKVKIPKPFFGGFFKKKKLGEPPPQEGGFFAPEKEKFGFSGRGKFVQKAGGSQIFPKIKGFPRVQGSLGFGFVTKGIYPPKWGF

SEQ ID NO: 939733 - protein, 117 aa, Homo sapiens
RAPRSLSPRLPPSAPGASSSHGNGASVPSLRSFPLGPKPHFPLELVLFEVFVSPWLPGLFPANLPPQAFFFSFPYPWYPVLFPAPGGVGPKPSGMLSGPLLGLGRTPPPLLRCCLGG

SEQ ID NO: 939734 - protein, 121 aa, Homo sapiens
GKNFGFWVGYSSRAGTPNMFREYRGLTPAGAVTQCFRDMGARPRGRAPSLQFIKVEEIPAPKCPRPAVKQFPDSQIKFPLPPRVLGRQPKPRFPPQGPPPFFLGPGPRPGGPPINSGTPRL

SEQ ID NO: 939735 - protein, 85 aa, Homo sapiens
PFFPFARQEGRKGSLRVHGFKELGSPPVPPLVKGGGSFDEKMKGLDVNPGSGVQVHEDWGLVGGLGQGIREKKGLKVREKVNRLG

SEQ ID NO: 939736 - protein, 96 aa, Homo sapiens
LAVERGLGPWFRLCLVVWLRGRGKKAGRPSLQPSASNPLWSIRVDAVVVRPPRSLPRQPGVVLGFPVPNAALLGFKFFISRSLFMPMPKINDAPEL

SEQ ID NO: 939737 - protein, 124 aa, Homo sapiens
VLFPVTFSGLASPVGGGYSGTGPGFWGLEGRGPFALGSQGALPAQAGLFWEPLAPRLSLANLGGCVPPARPSCGLPRSPCSLLPRFEGRVCGPFLPSCPCPFLPVAFPCYPRLLAPSFYKEGPS

SEQ ID NO: 939738 - protein, 64 aa, Homo sapiens
GPSPEGPCKPFSSCSSPAFTPKPSCPPKKPLRLAEPPCFPRGVDLAQLGPQGPPMELNSPGPPP

SEQ ID NO: 939739 - protein, 118 aa, Homo sapiens
LFGRHRLKGPPEMWWSQWLFCHLEKVSLAQLERKWWSVVEEQWVQGQFWSIEILNASTIISMQGETLHVFVHGIHRGIFSVGVILTKSMSELTPSRQNPYPPFSSYPPPPASLPGFPL

SEQ ID NO: 939740 - protein, 104 aa, Homo sapiens
LVFLQFPSPLFAPLNFVMEKVESILPSSFWPQLTRVLEKPCSPLTSPAAAPISFVPTPCGPQKSIAFKKGSPSEIFKCSWAFPFLKLFFLSKIPLCSVFFFFAF

SEQ ID NO: 939741 - protein, 118 aa, Homo sapiens
QSSVRSEGERRLPRRGVFFKIGDTTASCVCDAQYAPGYAIVWVISEVVTPRFLCSGGVSPYAVPNACRGDSGGPLIVHYRSRFVRVGVICWGVVDVCEASSGLSRFLLTPGSFSSASF

SEQ ID NO: 939742 - protein, 109 aa, Homo sapiens
ALGLAGAQLGGPGFLETRWPPRGALGPAGQLVGCWGFWLGPGGSRFWSRAAGWGVVFIAGGGGAAPLGQSPGFWGPWVGFPLRGGWGGGRGWDDGRFPYWGPLTWSSPG

SEQ ID NO: 939743 - protein, 111 aa, Homo sapiens
CKGTGPFGFVVRLIPAPKGTGIVSAPVPEKLLMMGGIDDWSPSGRGCPAPLGNFAQAPFYALFKTFSYLTPGLWKEAGFPQFPYPEFPGPLVQTPPRVSVQRAPGPAVGST

SEQ ID NO: 939744 - protein, 107 aa, Homo sapiens
KESNNINISIKKPQNPIQRSPASKIKGDKSTTMKKKQHNNAETSKNKNASSPPSDHKSSPARAQKCMQNEFDELTEVGFRTWVIKNSSKLKKCVLNQCKEGVKTRLE

SEQ ID NO: 939745 - protein, 93 aa, Homo sapiens
QGYYPAIHSPFHSPSCPKQGMFAPFPFPCFCHTTLSGGLSIYPGYMSPHAGYPAGGLLRSQVPPFDSHEVAEVGFSSHDDEDKADDVIEVPGK

SEQ ID NO: 939746 - protein, 114 aa, Homo sapiens
LRGPQGGECPPFFSGPQGVFGGPAFHPRSQAPPFFPFVGIIPPPTFGGPHWGGGPMGGPLNLGPPFVGVWGGPPSGPPGHGAPRGGVLVLFLLGFFLGFVFCFFVPPHKFFFFV

SEQ ID NO: 939747 - protein, 120 aa, Homo sapiens
RRSGAGWRGKNNRAARSPRPPDSRLAPLAVPFTPKFCSLKADWVMALQPQAKVCLKDRVTLTLSPLLGFHPGLCFPWGRRWGRFDQGKAVRRGFPPAFFSFEGENPEPSPCPWVPVLEMV

SEQ ID NO: 939748 - protein, 84 aa, Homo sapiens
VEAGMELVGRKSWGGFTHRPELASQAWAEHLHLPERNVSVLFAFAQVGPLGCLLWSKANSLSPWGTTASGVRKRVGFPVSINVD

SEQ ID NO: 939749 - protein, 113 aa, Homo sapiens
SPSAPKQASKGRPFSLCSPLAVSKADYGEPKVFAWEVPPWGLGLPVPKSFDQGRVFEGEVPPPGPQFQPGPLPSFGLWPFFPRGPPPFGGLQVFFPLPPLLPLGFYFGNVGGE

SEQ ID NO: 939750 - protein, 119 aa, Homo sapiens
SGLGPPGGDLGWAPALGRGSNKWAPPQGFGPLKGAHFPPPPPKPFGVFPRARGFWPPKRGFPFFLGALVGLAPTPGFWVGPGFFKGALWFPPGPPPFGLVLNPPRGKVFPFFPLKAGPF

SEQ ID NO: 939751 - protein, 98 aa, Homo sapiens
FSPKAVLVRWLQGLQRLPREKYLWAFGQGPSQGPPPFVVASILGVAAEDWKKGAPFSCLVGPGALPLAFPQKPFGRLGGKPPHVNVFVVMAEVAGPCF

SEQ ID NO: 939752 - protein, 125 aa, Homo sapiens
MEPDGAYEPGFVGIRFCQECNNMLFPKEGKEDRILLYACRNCDFQQEAGHSCIYVNKITPEVGELTQIIAHVSQDPTLPRAEGHPCQKCGPKEAVFFQSPSARAEDPLGLFFVGTAPPCGPRWTE

SEQ ID NO: 939753 - protein, 122 aa, Homo sapiens
RFPRRPGPPGKAGSSRPRGLAFRGGGPPPWRAPPLRVYESSGVKFRNGPARPKPPRPQSGLPPDKNSRGGLPFIPPLEGAPLLGGGPCNSSESGARPGRPCSLPPPCFGPFFYLHKPPPSPP

SEQ ID NO: 939754 - protein, 116 aa, Homo sapiens
PKFLGVKIYPLPFTSLPRGGPFFPLGPFPFGGPPGGPNFWPWGVGKVGPLSLKPNGSGPRLGLVNGFFFPPPFFFPPSPFPPRAPGGFFLGVPRRVGFFEKIFFPLGFFPWGYGGF

SEQ ID NO: 939755 - protein, 113 aa, Homo sapiens
RQCFRQFRYQNGGGPREAFRQLGEFSPQGLGLAFRPKDQFVEILVQNQLFPFLPKGVGARGFPPRRVGGFLGVTGGVGGGQGGAFCGDWGHVGAGGLELGPPPRVNKKWVLAA

SEQ ID NO: 939756 - protein, 102 aa, Homo sapiens
LSPNFGGPHLRTRVFGPGCGGRGPLGLGVFRGPPWSQPWGKGGPGVFSFAGERGPYPGKTLLFFFGPVSLKREVFWGGAFFFFVFFPPPPFWGRPLIFFWGW

SEQ ID NO: 939757 - protein, 72 aa, Homo sapiens
APPPPGALRALPLVPRAGRGPPGLPKCHPSRAGVGFPPPDLPSPREFSGRVGNENPLGVPPFPFRAFPPSLF

SEQ ID NO: 939758 - protein, 107 aa, Homo sapiens
GGAPLPPGGPPVQGLGQPALGGGAFWALGERRAPKAPLFPPKKGPRGSQVAGVWVFPGSPPGGGAPPPLGGGGGGALSFPLERGPPLMVSPQPPFWGGGFWFKRGVF

SEQ ID NO: 939759 - protein, 111 aa, Homo sapiens
PLVQGEVHPRVAAAPNEDLAGDDENDAEHENTLDNRPNFDGPFAKTAKNPVLTKAFMPFKKWLLYPYCPPRPFKEDLCSNLEKAFVLFSWANFVKKKTGFSVSTKNSKGLE

SEQ ID NO: 939760 - protein, 88 aa, Homo sapiens
FLQRPSRTPPKSRKDQKNHLTQWNISFDEIVNIGSTDAGPGPEPENSSGTIKEILGAAQSVGCNVDGRHPHDIIDDINSGAVEMPNRK

SEQ ID NO: 939761 - protein, 66 aa, Homo sapiens
LSGPMQAALQAAAHASVDIKNVLDFYKQWKEIGVILTPRPCSGADSRFFLPSLAARTSTCIPPTQL

SEQ ID NO: 939762 - protein, 64 aa, Homo sapiens
MTCLWVALCRQAGLSEAPSDVSVGRPVPPGRAIGNTCSNRSALADSPCSGASSWAVQSSSPSPS

SEQ ID NO: 939763 - protein, 220 aa, Homo sapiens
MGRCIHVILQEEFSTSFEQPGFPTTSKSWKKQGKSKDKVAVAECPPSRGVPSLLSSLSRETIGVQPGRGGEEVQGIARAGLSMGKGQRPPGPGHVRATQAWARRGGGARQRPEEGARVPGAARGGARTGPDTQLRATRTHRARAQTPQLRREAARAVSFLFPKFRQSPRSHGQPFQQLRSHWQAPRQGWPAQKGEGGGRPFRREEAGAVTGKGKRTARGT

SEQ ID NO: 939764 - protein, 73 aa, Homo sapiens
FLPPPARVLGPRSIKNPPPLARWKGFLVPAHNCPPWCRWPGQPPGLGAGQAGPGRGLRFGGNKNRPPPQFCLG

SEQ ID NO: 939765 - protein, 54 aa, Homo sapiens
MTQHESTLLLADPCPLTRSQGPQLAFKDPILSTLAGSGVPEYLEGGPHGRIWSS

SEQ ID NO: 939766 - protein, 88 aa, Homo sapiens
PPCGFTTGDSESKGAWLSWWKLSGPISNDRFDEIPPPWGGNVLGPKFVARIAKLEKAKGKELAPKLGKWTLVSFLDIKIIEIIPIFLP

SEQ ID NO: 939767 - protein, 105 aa, Homo sapiens
RLGILGGSMTPSPPDPDLGRCFDMDPARPSCSDLLPWEGVPEPALCGAQLQGAEGWLEAPQLGRGLLSACAPWGGGSPQPGPLGFFFKGLPEKTAPQSIKNWAEP

SEQ ID NO: 939768 - protein, 119 aa, Homo sapiens
GQGPGGGPKRPGPPGPSPPVNPGPSLPKWGFCLKSFFPKNSPRSPWPPPPFRPPFLFPIGYIDPVGVPMGFPAPCWGCFVPVGPSPPRGVSVFGGPLFPFWGKGIRGPPRLSLLIPCFW

SEQ ID NO: 939769 - protein, 85 aa, Homo sapiens
GWVFYPVPPEEKSQWGHPKTGKRKRVAGDFPYGWDQETDENGQVFFVEAEKKMLAYAAFSFCFGSLKGKGPFSCNPVACFPLSIP

SEQ ID NO: 939770 - protein, 78 aa, Homo sapiens
WPPSSSAYLGTVCPEGPCFPSSCGSALYVPLKSFAVYSFGHNIHICEVYQLQKTQLSSRPQLNASLLCKGNACNTIIT

SEQ ID NO: 939771 - protein, 109 aa, Homo sapiens
RSWPKAAKSFFLAALQVAVPRRSPRLPGARVASAPPSLRLLRLRVQGATVLKIVPPCPEPPFSSSPVFPEALLRPRRTDEELEIRDGTDGPAVCAPGSESAPPAGSCGR

SEQ ID NO: 939772 - protein, 169 aa, Homo sapiens
ENLPPESPYLYGLHPNAEIGFLTVTSEKLFRTVLEMQPKETDSGAGTGVSREEKVKASAGRTSWRRPEFTWLRMAKSGKDTHYVVVALSRDVKEMNSSLTNECSLFAHRNAEWELKEENMTIHRPTVEDLTASSSYYRHRAIDTVGVGPRTIPTTIDGARRAWGTQTDR

SEQ ID NO: 939773 - protein, 80 aa, Homo sapiens
CCSDMSNQFGGFFKPVGKKAGGAGKVPKFAPKGQKGKWILSLIPAPPLFISGGRTVSELFVSIGPLSLVVKDWFMITMPC

SEQ ID NO: 939774 - protein, 107 aa, Homo sapiens
GGFCPRPNNLFPYPLRDGPKLSLPLAPPFFGSIHPPNSLPIEARPCIQDGTSSRPSPPPSPGALKGPRPPKVGGRGPPSPALVWGKKLGVGGSPVGRGAFKLKSFPF

SEQ ID NO: 939775 - protein, 109 aa, Homo sapiens
NRITLAIVCSCHWCKAFPALASSTSLSAKNRVIVCVPFLILSHGRIFQKRNLNWVHSLSEEFPLVLELYWGIFCVQGNCFLFADYVTMGLLKHMPPRVKKEPTCFCESS

SEQ ID NO: 939776 - protein, 83 aa, Homo sapiens
PMIFSSPVLVSVRPSKGLMDKVLSRALPLTSTDFIPVCFRVNYALLSVTPGGPAEMFPKTGVHGDFRFFLWPLQHGPFPFCGF

SEQ ID NO: 939777 - protein, 84 aa, Homo sapiens
GMAAGQKHSSLSRGSQAKGLLTSTIGGQAKTLLTSQTGWRPGKGCNFGILGGQNRRLGGGGCNELRSRPCPPAWAPLSPSFSDF

SEQ ID NO: 939778 - protein, 106 aa, Homo sapiens
TVVMRRTEPAAQQTLSPELGAKGASLVEHVWLVFGPPQGTYGGYFLGPEERLPHNHRFYMRRGGSSHLRWHAASWALPSGCRLVHPLFKSFSSPLSFKVCLTFKNI

SEQ ID NO: 939779 - protein, 103 aa, Homo sapiens
VLGRLIPAPRGPGIVSAPVPKKLLMMGGIDDCYPSARGCPAPLGNFAKAPFYALFKTYSYLAPDLWKEAVFPQSPYPGFPGPLVQTPPRVSVQRAQGPAVGTT

SEQ ID NO: 939780 - protein, 54 aa, Homo sapiens
DDEEDDDEDDEEDDDDDDDVIITRLSGELGEGRSVTEEMNQLSNCLNKKTPFLK

SEQ ID NO: 939781 - protein, 76 aa, Homo sapiens
EAPDLLLAEIDLPKLDGALGLSLEIGENRLVMGGPQQLYHLNAYIPLQINFHESKAAFPRKRKQLMVAMPLLPVPF

SEQ ID NO: 939782 - protein, 153 aa, Homo sapiens
KQFDAWVGNNDHQRALWPGIMTLSDEYFSELRASAVPLDNRALLALKGSALALDVYAWLAHRLHRIHGRGVTLYWANLREQFAQEYKGKDPDKDFKKEFVPTLKKVLAVYPQAKVKPVTGGVLLLGSPPPIPYKGGPTVWLNSVRSPPPDEAA

SEQ ID NO: 939783 - protein, 80 aa, Homo sapiens
KEPTSDEVRGALGGHPGGHFLNADPGFVHSNGPLSPHDMYDYLHLNRLGYTPVCRGLHSLFLGLLAQNQGQGVPLLEPAP

SEQ ID NO: 939784 - protein, 115 aa, Homo sapiens
PLFALGALHSPWSLDGPMGPGLLNTPPFNFGFPPPGNPRLGPRGKPRRAESVFFKRQAWPKCQPSGVPGGPKKNPVPFVKRPGWPKCPPSGVPGGPKKTPARFVGICFFLKNPWP

SEQ ID NO: 939785 - protein, 104 aa, Homo sapiens
PPFFFLPPRGVEGGFSPRKALLPPPGKKGVFPQKGGGPPPPPHFGPGGFSPPKRFWGPPGGLNGGPKGGGAGPPPPGGPLFPPRGGFCPPPPPFKNPGGGGFPF

SEQ ID NO: 939786 - protein, 101 aa, Homo sapiens
AKWLDGIPKWYSNAAGFNKLGLMRDDPISGDEVVKEPLKSLPETLYNARMFPLKRALALNLKPQILPKKQGAQFEKENFSPDPFLKGVFREKKKKKEWAKK

SEQ ID NO: 939787 - protein, 119 aa, Homo sapiens
SSKEFGGDALLVFANGQPFNGDAFEVGKGGPFMPRFFKTPWGGFFQGKQAIFWGKGGGGSPWGFSPPLPNKNLPFSPGDGARGPDSSQNHPCFLPLPWGGPPILFFQHPFFPSPLLPLK

SEQ ID NO: 939788 - protein, 52 aa, Homo sapiens
PPARQTPPQPYTAVWPERSLGIYLWSLVLQNVAFHKALAKGGELFGGGGVEG

SEQ ID NO: 939789 - protein, 109 aa, Homo sapiens
EAGWAQLVKAVSWSPVVHVKPRSGRCSWHCRACRCSPIHSSRLAGPAPTRLSTRWASSGVRGVARSPPSSRQARQASRKVRRRGKRAVAAAGAAGGTGLSSPGVLAQCG

SEQ ID NO: 939790 - protein, 101 aa, Homo sapiens
KNWAPPGGGWGFNFFVYPKKGGDVGVPFGRNPTRWPRWVLWGGPLAPPFPPPFSPGVPFGFWGGANKPSWGVPFFPPPWTPFGPAFSLVWNLVPNKDFIPP

SEQ ID NO: 939791 - protein, 75 aa, Homo sapiens
HTPSTSPQSPQGGLRSAKASQECEGAQLPGGAMEHTVTFSITLSDTWTSFWTGTVDLAAYFLVILPVLALAEGGA

SEQ ID NO: 939792 - protein, 43 aa, Homo sapiens
VLNSMWQYRLRSLYKKDGWSQYHFLASFSTIRDRQRPYSSSRT

SEQ ID NO: 939793 - protein, 96 aa, Homo sapiens
MADAKNEVAHCSPGEQASFMRPLLLGGYWVLCLSWGHAALYHLREEGKGPPQGTSVLLALPEGCAPGLFPGTPYSNSPLWTGMGNPQPSGTNPPHS

SEQ ID NO: 939794 - protein, 83 aa, Homo sapiens
LKALRLKNLSKLPQVVTDVGVHLQKLSTKYDPYTKLILNSLKKMNLTELELIRCDLERIPHSIFLHNLQEIDLKDNNLKTIEE

SEQ ID NO: 939795 - protein, 60 aa, Homo sapiens
KFSRFPEALSIGIDANDMEVEDITSCKDVVVQKQMFMLGRHGVLELSDVEEYEDLTEIMS

SEQ ID NO: 939796 - protein, 137 aa, Homo sapiens
GHPVPDPDVKLLMDAADVDGSGTLNCEEFVTMSIHMKRISSEEHLTQAFGYFDKDKSGYIEFEELREALLDENLGPNNEQVIQDIIFDADLDKDGRICFEEFQAMMKSGIDWKMASRQYSRAMLNALSLKLFKDKSM

SEQ ID NO: 939797 - protein, 39 aa, Homo sapiens
MGGLFYPLRGPAFEGTFAHVIQLSWELLRWKTPNKVRLS

SEQ ID NO: 939798 - protein, 114 aa, Homo sapiens
LRKKVVPVRQDLSHSRAVFPNTRPSRGPCEVAPLPHGGEFSPPLLKITPCSLLALWPRGGPIGAPRGVLMQINPFFFLKKRGPPPSLGGGGGVFCGGPGQVRAPFLPPPRLTGS

SEQ ID NO: 939799 - protein, 49 aa, Homo sapiens
LPLIPKKQVSWELLPPLPRDQQGQEAVPDPETFASCTAKGPLLKAHCWF

SEQ ID NO: 939800 - protein, 149 aa, Homo sapiens
QGGSFFGPLVGRGIFSSPVGGWGRLFLFGLRAPPFFWGSTPHPVGGVGPSFLPPGGGALKGGGGFFSPGGLPPLFQGFFPGGGPSFVGDFGGHVFWGPTRVCFARGGGFFFGVKNAPGGGFSHFGFFGGGSGGGGVGFPLLGLLTFAPL

SEQ ID NO: 939801 - protein, 32 aa, Homo sapiens
ARVASVDMGPQQLPDGQSLPIPPVILAELGSD

SEQ ID NO: 939802 - protein, 82 aa, Homo sapiens
LDCLGPCHLLPLLSPGSPWGVGFHFSLPPPSAAFAFHALPITSLPPGLLPFVGVELPAPPQALMGKGFPFGMAAGGKPLCFF

SEQ ID NO: 939803 - protein, 123 aa, Homo sapiens
VAPPLRTGFLEQKKTTAFPRGGVGFPSSLPLKGGRGFKGFPLKKTSLGKGFSPRGNFKGGGPLFQNQFLGGGPPPGFWGFFPKFFPPRGSRGFWLGPPPFGKKLLGPQAWLKILGDGNPMAPF

SEQ ID NO: 939804 - protein, 110 aa, Homo sapiens
RPVNPKCRPGKQGGRIPPAPVWGPSGHLCVAPGWVHTKVGAGPGFTLEELRLAGIPKKVARPLGIFLDPRRGKKSPGSLQANVQRVKGARSQFFLFPRKPSAPQKGNSFF

SEQ ID NO: 939805 - protein, 85 aa, Homo sapiens
APPAGARANGNFWWPIPRDANRVSPAPPGPAKVDGATATEGPGTPCRDPIPGENPQPTKNRGEISVIPGGLRVSPTARASLSLFA

SEQ ID NO: 939806 - protein, 158 aa, Homo sapiens
VEELLKEVRLSEKKKDRIDAFLREVNQRVVRVPSVPETELTDQAWLPAGVRVPLHQVPYAVKGVFPTSQPPSPGLLYVRQATFLGNLASDQIQMWNVGTGPMPRRNSYRDKRRARTRRYFQQAVPIYRGPLRLTTMSPETTPLRQLFASYTNGPPEPH

SEQ ID NO: 939807 - protein, 96 aa, Homo sapiens
SSFGAGKKHGGGALASYPPPLGVTRGTPSPNWRKRKGTGSLGLGGNPALEEVVGRSLGTPNFLPSPLGPAWKPTDKGGFPHGLPRVYDAKIPTHGP

SEQ ID NO: 939808 - protein, 40 aa, Homo sapiens
MTCRIHRQTRVLTGWPVPITFYDTFPPLYSHPWTGGPCLG

SEQ ID NO: 939809 - protein, 88 aa, Homo sapiens
LGVAPEDVRNDEQSGFICNPAHHGRRNVCSDQAFPISLIRPWVLQVIFVSSPSLVYMGHALHRLEFSRKALKQLRVELEQVESEMPRD

SEQ ID NO: 939810 - protein, 97 aa, Homo sapiens
MGIEVCYWVARGVRGGGPGPGVIGRGAFRPCTWGFGSFQDSSRGQGGQVGVRPHRGNLAGDDPGDCLGSIKSGGKDLPFHPSHPLISSQKTSKVIFN

SEQ ID NO: 939811 - protein, 46 aa, Homo sapiens
PLWPRGGPPPPPQKTKWGPPAPPRGPPPLGGAPPPGGFFPKKPRGF

SEQ ID NO: 939812 - protein, 73 aa, Homo sapiens
MASKGLQDLKQQVEGAQETVSTAGTAAQQMVQATKAGQKTMDQLAKTTQETIDKANQASDTFSGIGKKFGLLK

SEQ ID NO: 939813 - protein, 33 aa, Homo sapiens
GPSLCSLLPPPAENRLFKMLRSRFAARNKNALR

SEQ ID NO: 939814 - protein, 118 aa, Homo sapiens
PPALRATGFPLPRGASPRQGNHALPPFFFPPTLPGRVIFGAPSFWPEMLQGPVVFSLPQPEPSYFWCSLVHCGKMSSKARGLAPDVLIATGGSFQLGEQGNPFMYMPPRICIPPVSWG

SEQ ID NO: 939815 - protein, 184 aa, Homo sapiens
MGGPAGEKIIPPTNPPPRGGEQHISLPPPCCEGVSPCPSPPTPLGGEGVWEPPPPSPHIFPTGRGWGGNPKKGTTPPPPPKKFGGVPKFFPRVGGGGGPQAPLPLFNPQKSKTRGRAGPQIFLGPPGGPPPPPPRGFFGGGALFFWVPPGPPPPPGKRKPPPFLSPPGVPPPPPPKGKIGGLFF

SEQ ID NO: 939816 - protein, 114 aa, Homo sapiens
QEPARGPPPEIAPNAPFLYEAFYTGAGAKGPRGKKNPLFGGPRGFPPPGGPPKGCLVLFQKGNPWVLPPKKRGAPPRAPRGGTPGPLFFFSGPGGGGGRGGKKVDPPPPPLFFF

SEQ ID NO: 939817 - protein, 148 aa, Homo sapiens
QGEALRVMDMLHSMGPDTVVITSSDLPSPQGSNYLIVLGSQRRRNPAGSVVMERIRMDIRKVDPVFVGTGDLFFPMLLGWTHKHPNNLKVACEKTVFTLPHVLQRTIQCAKAQAGEGVRPSPMQLELRMVQSKRDIEDPKIVVQAPVL

SEQ ID NO: 939818 - protein, 78 aa, Homo sapiens
RVFGSLLWALVCIGLNRSVLGLVVFGILFCMHVPGVSLVSRGLFPRGSVFASDPQSSFPGSCLRAVGCRSGRWAGNGD

SEQ ID NO: 939819 - protein, 115 aa, Homo sapiens
MERFDKKKPPLAQGHHQHRLWPPPPSSTCALTTTYTAHQPLQGSHGLSGEQFPGLSSQLPPPTHAYTHALLDKANIPLSRTLHLLRPHSLGGGDIALLAFGLGAPSLLLHCSLWL

SEQ ID NO: 939820 - protein, 90 aa, Homo sapiens
INPPVQNRANGPCRTTARSIPHGQLPLRPRNFALHLLFFTFLSLPVRKLPPLVGSQGRLTQLTAWSKPGPGPCQGQPKEMGIKRPKSPQL

SEQ ID NO: 939821 - protein, 97 aa, Homo sapiens
ANPGRFPPSERIRGVLRVITEELPDVPLYYTLAQRGARVKTFPCKRFKEGPCQRGGQCCYSPSPPTPRVFVDAAPGCPKTSNQTPPGPGGAAGPGID

SEQ ID NO: 939822 - protein, 68 aa, Homo sapiens
PISPLPRPAQIGLPLPSSSHSLVPENGFCPANPFFKNAQAQPLGGGGASLVNPQTFRTPLITINTCAQ

SEQ ID NO: 939823 - protein, 121 aa, Homo sapiens
DRAQIDFNGRIRNGSVYSAHSTNSLNNPQPYLQPSPMSSNPSITGSDVMRPDYLPSHRHSAVYPRLFRPTSDYVIVMNQLSRDMMHRERHTLLCCEASTSAAQYTSSSTQSLVYTQPEHSE

SEQ ID NO: 939824 - protein, 67 aa, Homo sapiens
MRCARISRHDAQADRACSVRGTRVASHIAFPSLSPPRSPPPPEQPQGGGEGESSVRSSSLGPVRSAL

SEQ ID NO: 939825 - protein, 142 aa, Homo sapiens
LGQMKKIRMVPGPLSRQKMLCEHILCSKPLPCRQPAPIGFWIVPDILGPPMICITSTYECLIWPLLRTVHPGSPPLLCTRKNVEVAKFPPRVLGETPDSFEKHIKSLLQRRVANPAFLKAFEKDKAPPPEKCLPAKGHSVPP

SEQ ID NO: 939826 - protein, 155 aa, Homo sapiens
RVCYDLFHFACLNERAAQLRNTPPARYQCPGCNCPFFTPTNLACPVASALREKLAPVNCGPRKTGPPSDRGGVEAQKPEPSNTSDFSDLSSFNASSTPEPEEVDRRLCCPSLLQPGPPAPSFPKAPEQHTVIHMGNPEALDLTPLGRVYDTRDDD

SEQ ID NO: 939827 - protein, 107 aa, Homo sapiens
QRGPPKKKMVGQSFFFLKEGGRKGGFLKFPFFLNPKRVVIKEIGRFVLPAPHFLKKIFHIQDNKTQASGCTVGLLLICICWASVYVVEAEILATCFNSVILILMKMY

SEQ ID NO: 939828 - protein, 73 aa, Homo sapiens
KLSPERFGFCSYHLKFTAHAGKQLLNMSTTFMGRSRPLEDVCRQTPRSADPARQEGWVRALVCALGTQILPAQ

SEQ ID NO: 939829 - protein, 137 aa, Homo sapiens
EHRRRNAADECELQQHVDQRRQQDRQDQRDRDRALRIAHLARDRHDRREPEVREDDAARGHGHLDARHAERREALHGQVRGLEEREQHRDHRQWHDELEDADDVVRLRERLHARIVQVKEEAEQRGLHEPAERRRIA

SEQ ID NO: 939830 - protein, 83 aa, Homo sapiens
EEISGGGALPACPRRSYNISFVALALYGFIGGAFSRVGYGRRIAFVGAGAAVTRIVGFAVQAACGNAPALNLLQYLIPIIPIV

SEQ ID NO: 939831 - protein, 82 aa, Homo sapiens
RGQGTSTCSTAGSNFSRGSSSFRGSRGPGRSRSQSRSQAKGQDRNPERNQNDPCWGIENIMSAPGKGSRDVFSPPPVMSGAS

SEQ ID NO: 939832 - protein, 141 aa, Homo sapiens
QIGCLGGPWALNKGHSGPYRLQQGKTGPQAGEEQLKIWRGSFDIPPPPMDEKHPFFNSISKEGRFAGFKPGDFPPLESLKDTIARALPFWKEEFVPQIKAGKGVFFSAPGNSLGGIFKPLEGISNQGFMEFNLPPGFPIFF

SEQ ID NO: 939833 - protein, 115 aa, Homo sapiens
RLCIDTVIWPAPAPPPGVSPPETARGPGFGRSAREAPPRPLARAPVVTVEEAPALRCPEEPSRARFLFGWIRPAPPHNKRARAGRRRSQRHVRSTRRSVRVWGARRRPPDSPGAA

SEQ ID NO: 939834 - protein, 139 aa, Homo sapiens
MGAALSLTAGVALAGSDTRSGCPDPQCAEAEVRHPRPLAGPQVDPAASAKEASFLNTVRNRQSRSLSLGERQEIADIAASKPKIDLEIHFDYNSADISKGSTQAVQELGKALSDTSMKGSTFVLAGHTDAIGGEAYNQA

SEQ ID NO: 939835 - protein, 53 aa, Homo sapiens
GVHSRTRWDGTYRPGVVGEPAPVDVLVLLEEHADDQPVHLSCVSSHLAAWPAV

SEQ ID NO: 939836 - protein, 74 aa, Homo sapiens
HKISWVSECALMLAQGTVGAYLNKYIPAKWTWMVFCINSYCSLTDVINTGDACSLDEYLGSWNSQVNAFCVPFP

SEQ ID NO: 939837 - protein, 32 aa, Homo sapiens
FRPLTPAPGGGGGAFWAPGLNLTRPGAPPGPP

SEQ ID NO: 939838 - protein, 112 aa, Homo sapiens
AHISWVVALSSRLCLKPRGSMAAAGTLRLSAQILPWMDQRTTHRPVIWVNQFCHPPQNRKQHEKLPLTPYESISNQVISTPPFPSPYPPNFENFDPRMLREADLNNKTPVSR

SEQ ID NO: 939839 - protein, 155 aa, Homo sapiens
GLGSIGPCGVPQVGSHKSGARPGFNLEEFKVAGISKGGARPMAFFWVPGRGTNSRSSFRPKFNGLKRSAPKLFFFPGKPRAPKKGTVFFKNLKWPPHLPGRLFPSGKFLKKRKAGFSLGKKKILKPLLVSVWAGPTPGFLGYGQKKPRKPPNRVF

SEQ ID NO: 939840 - protein, 68 aa, Homo sapiens
EGIRGHRGLHPGPLPAKKMALGMTQVGGHPACNIPQGPQLVAQNLGFSLANLLLSKGAKNILGCCPAA

SEQ ID NO: 939841 - protein, 153 aa, Homo sapiens
MRWTFSYYCTILESWKLQKSVLTATQYLMSAPDTLQWTASATAPRVRRLAGLLLLAVLEDFNMSQDLLHPRGQPDSVDQAMTESRDRRGRPHSPTASRAAEHSGIPVQAQGHRVQARHTVLLRPRSLGVSQTHFPHVSQPQLGCSMERHLPLK

SEQ ID NO: 939842 - protein, 142 aa, Homo sapiens
RPRGELQVPGGRWQWDTRANAHRETPGWLGSARVAALGGMSNEVPRDIWRADTFEGQPCQASPRPMKDKPETGRGRRSTRRPVRVEGCRTTSGVPVPGPGTIVCKPRRQDARLETPVSSSELSPTPRSPQTVPKPPAGDIRM

SEQ ID NO: 939843 - protein, 122 aa, Homo sapiens
PPIGFFPPPGGQVCPPKPRGSPNPSLFFPNLTFWAFPPPFPGVKISGATPGPFAADLGVLFKKKTGGGGFFGKLGVGGKGGCPSFGVLGPVPGGYGVFPPPPPLFFFFLKKAKMGINPRGPG

SEQ ID NO: 939844 - protein, 85 aa, Homo sapiens
TGHPMSASTKLKRNSATHHFPWMFPCRMAWLETRVHSHPSFNVTARDFQRFFADLEEGWYMWQDLGGQQDLHLLQTPLPSCVPCK

SEQ ID NO: 939845 - protein, 224 aa, Homo sapiens
GGVAQVLPPLVHTPPGGCCPPNFFFSLGARGPGFTRGAPKPPPLLVVAAHLLLGGGGPPPPPPPLRGGFFRGSFWGWGPLGWAHGWGGGHGFPPGARGPRFFLVCGFFGSQTHWGGFFFGGGDPPPPPFGGRFWGGGPRGAPPPNVFPRGGFSFLGVTLFRGAPGPPLPPGGGGPPGAPPPPGAKVPPPRAPGGFFSPPPLGVFFFFFFLGPPPPLFSFRGVFF

SEQ ID NO: 939846 - protein, 120 aa, Homo sapiens
GCFGAKAKRKTIDGARRSCRRERSYSGRLHKVGQIVFEFVGEPELMDVHVFCTDSIQGTPVENDEMRPCWFQLDQIPFKDMWPDDSYWFPLLLQKKKFPGYFKFQGQDTILYTLREVDTV

SEQ ID NO: 939847 - protein, 67 aa, Homo sapiens
PGPSLPPNWVSKVRPAMEEGGPSATPLSPALGDPENTPGVFTDSRDIIQRMPLCQSELLKKGTPKFN

SEQ ID NO: 939848 - protein, 141 aa, Homo sapiens
VFRAPRGFPGFSGVPPLPPRGWCGVFCPDLPDFLKLAHFPQFAEWGGGGGVFRATSILPLFPWEPPRPPFFSFFLPWGPRGRFLFCVFGGGVGFFPIFPRGPLGPFGLFWWPFFSRFPPGPGGAGPGFSGPWVPPGVPPGP

SEQ ID NO: 939849 - protein, 115 aa, Homo sapiens
GGAGGGFGGVGGGAAGGVGGVGGGGRAGPSGVAWGGLCVVGGVGGLVWLSDVRGSGCGSQAGTPPAFFPRKWGAGAPRINNIKPSFPRGTPPRVKPPSPIFLLSLNPGIITGFSS

SEQ ID NO: 939850 - protein, 95 aa, Homo sapiens
KTLVQTQWGTLQRRTRLRAQAGGSKENAEDAGGETRGRHLGGNPRTQRINDSRGNLATATANMGNPKGKAHGKKEPTTLGEAIKHPEDLKGTWPS

SEQ ID NO: 939851 - protein, 113 aa, Homo sapiens
MGQPLKGRVTLEIALNEHNTEGCNSKLTLPLRRNKPKHGLRMDSPLPTHEPFRKRKQACYTQLKFYQLRILKEAKCSAALEQWSQGSSPGVAPIARNHLRGPYTNKQRPMGSR

SEQ ID NO: 939852 - protein, 83 aa, Homo sapiens
CSSCKPCCTLLGYGATPPLRFVTVGDWGGVPNAPFHPAREMANAKQIAWTVQILGADFILSLGGNFFFPGVQDINDKRFPETF

SEQ ID NO: 939853 - protein, 81 aa, Homo sapiens
RPPARRNAWALRLGPRFYRHSKQGGNEQSHAGFCRTPDMPKGIYSVKGTLAKRQNWLQFPEETPYHVPQGMNQTTLPPTVD

SEQ ID NO: 939854 - protein, 155 aa, Homo sapiens
EEKRPGRWAMRLTPFDGSRDILGTPEGGQRGGGNSKREKRETKGCKRGSAGNEDISAESKTTVEQNVREITQGKQDIKGRTGPKREQRQRRLGPAIGVKIGIDSEDGTGNMEKEYDRCNRTRRARCQNLMEQGGETTKRMTTGTRTTLDRRKGSQ

SEQ ID NO: 939855 - protein, 238 aa, Homo sapiens
PKRLDSVVQFAELRSQLGFRLSFDVELNRGGWTLAWRLRDAIVPGSNKRFWKRRGAVLNAEEVAEDWGIWSDHRMTMAVELQRDRCQLKLAEGLELLEDDEEEKDDDRHMMREQRIERATSCDYHHGVRVMLTCLMTACTERFRNQWIDLLMYQSDSQVRQDYYQNECIDQEHALHEEVTMDQNGEFSEAWMVEKMPYMRHKALLGHVGDYIEWSKTKVTLVKNMKLRKWELENVGLD

SEQ ID NO: 939856 - protein, 139 aa, Homo sapiens
NSLRLSIALSFNQSKELGAKTDQQQPAQNGGINQTWWGETPKKSREIPLQKRKRGGPLKEALGMGKKTVGITKSGGTGERPGGPWTGGPKHSSRAGKAQGPWNPRRVKGERLGGKRQAGKAREGSARKKRGKREHEAPR

SEQ ID NO: 939857 - protein, 40 aa, Homo sapiens
MKGLAEQKKQARATDPGQDGPEAQLRNQGISADEGNEKGT

SEQ ID NO: 939858 - protein, 77 aa, Homo sapiens
SAVGMPGLEQATDSTHDINVTARAIRIIPMVINDVWLNLLRNANYGIRAQEEIKVLTGGGVYSPIETKMIQYLHTQS

SEQ ID NO: 939859 - protein, 53 aa, Homo sapiens
MKSNIPYEYRGKNHQGNISKTNQKHVKRIIHYVKGMYLREAKFRSTYNTISAM

SEQ ID NO: 939860 - protein, 74 aa, Homo sapiens
EEKRRQRGGNENRCLNPIVSTLFAETPRGQQCEFSYTLPDLAAGITILLTDRNLNTTFFDPAGGGDPNLYQHLI

SEQ ID NO: 939861 - protein, 137 aa, Homo sapiens
MNDNKPQNRKRYDQGSEGTAERRGGKVNQQPNRQGISMELYEALEEDSTKGLKRRERRGSKDRNGHDTGDVPGANKHKNWLRDAQEIHHEKCRTITKDETGGPSRKRMAENPDGRTRRKDRLRMVKEKGNRGTQEAA

SEQ ID NO: 939862 - protein, 75 aa, Homo sapiens
IPIRLQAITTLRLFMPALELMVAYGRISPSFGHFVEYSGRYPIIVIFLQAFYVSFTLNLDFFNFFLVIDTGGFSE

SEQ ID NO: 939863 - protein, 166 aa, Homo sapiens
NAAFFDWGTIKIESPGIDQTRSGFPGVARMKTEALDGDLRKIGSLDEGQTMTGPPGVTQMMTGLPDEMPMKTGETGVMRMMTDHLDEDWKRTEEAGQQPMRTEDQDVGMDDDRGPRRGGADDERQPDVMQKKTRGPGQGWTKNGDPGAWKKTGAQGEAWMKTGDPS

SEQ ID NO: 939864 - protein, 173 aa, Homo sapiens
MLPLFDTAPDKPISTPRSINRGKLQGVLKEVNCCLRTFEARLNGSHPWTQNSLASNRKLEPALPDTTYNHRMDNGKKRRKARSPRGDEIKDLKETKTALGPPTQLERTIRTRNDRPNADNYRAKGKIIQANRICTKAEKAKEVTTRNATTTGHKHSALTEAKKTTPFLEANGN

SEQ ID NO: 939865 - protein, 108 aa, Homo sapiens
RAQGPPFPPRGEELALNNLVPLVSLAGGFSPRVVLVPWLQGSQELPPKKYFIWVSRQEPNQGPPPFFFTSILGVAAQDWKKGDPFSCMVGPEALPLAFPQKTFDRLGG

SEQ ID NO: 939866 - protein, 131 aa, Homo sapiens
NPRGFWQGEDNWPTSLGVGHETGIQIPVGCETGVGAGDCTSPPLLEGEDAPLTQSKKKPVPPRQGGSHCGKGPGGQGLLLPGAGPPDPPLRIQLPRPAPQEAGGQPPHLPPSFGPFQPQPPVSVPSPWFLA

SEQ ID NO: 939867 - protein, 135 aa, Homo sapiens
GPPRLPPFFPARFFGGMGGGAPFSPGDRFCRVLGFLPPPQGDLAPPAPNLAPGFFFRRGGPPKGVFFFLGWGGGPPEKKTPPWGGGPPPPEIFFLGARPRGGFGVSPPPPGAFSPGAVFFFAPPPPRKARGFFFY

SEQ ID NO: 939868 - protein, 112 aa, Homo sapiens
LTPPEIFGQSSFPQLQRGGRLLKGSPDDMFRRWGLQLPLSWSWVRTSLMPVGTFERAKAKNSWPGLQGFAANAENGAGPLRTPPHHPFLPLYFSPIVLVNIDLGIKMLVEVW

SEQ ID NO: 939869 - protein, 115 aa, Homo sapiens
VKVLEDSRAAFRLFETKITKVLHFTKDVKAAANQMRNFLVRASCRLRLEPGKEYLIMGLDGATYDLKGHPQYLLDSNSWIEEMPFERLCRSTRQRAACAQLNDFLQEYGTQGCQV

SEQ ID NO: 939870 - protein, 81 aa, Homo sapiens
APYPKNKKATSRKDEELDPMDPSSYSDAPRGTWSTGLPKRNEAKTGADTTAAGPLFQQRPYPSPGAVLRANAEASRTKQQD

SEQ ID NO: 939871 - protein, 117 aa, Homo sapiens
VALGKEGDKNVLPTLSLGARPVFHEKDYDSLAQPGFFDRFIRWICKPPRPGPPVEGCEPTPSMVLSGPGSHTASTVHWEDAWGLHFSSSSQGVPEAPAPAQPQVSPGPPKVGGPPSP

SEQ ID NO: 939872 - protein, 103 aa, Homo sapiens
RFALQKHQWGLVQVDTLNPSSKKKLWLIPCGDTQRGLNKLDNSVLVKLEFFFVTWTALQKTSANCPSQSPGIVPIINNVNGFKWGPADKIPKTPVILKIPPFL

SEQ ID NO: 939873 - protein, 95 aa, Homo sapiens
IFIVAGLAALVACFWYGHQNVTDLYNPLIPTNIKYEFGPAIFIGLARFALIILGRALFSGSCPGNETKVGYRAPRFYPKSNSSKECVTWDLLAPA

SEQ ID NO: 939874 - protein, 106 aa, Homo sapiens
PPPFYGAGGISRKQFILVFWSLKYVSKRGGAPFPVFVPRAAPFFGRPFFTPCFPGLVSSKFSFGISRGPPNRGAPRPPCVLGPLLLWGQGERGGPLPPSLLKRGPL

SEQ ID NO: 939875 - protein, 113 aa, Homo sapiens
VQGQPRQHRDIPPHKKQKTKQAYGQGYVVCGALHMLYKSQISSSSLRKLKGTVPRYCERTTISGNSFHNNRNQGCGGRCSRSPPPSSPSLLPPHSNASCWPCTSRLPLGGEFL

SEQ ID NO: 939876 - protein, 70 aa, Homo sapiens
HPGAVSVDQQRSQSLLNRPWVIPVEFRMLLTARFRKVKCYTGLERPQFIKSNQSSNAYQRYENNVGLCPQ

SEQ ID NO: 939877 - protein, 65 aa, Homo sapiens
ILKKALLSQMTTSMRVIAPEDLSVGYSVEVEDSDTDDPDPVKTYANVCLCLSFSQKRFKNKNTKE

SEQ ID NO: 939878 - protein, 154 aa, Homo sapiens
FQTQAPPKTRGSRAVQWPYPGGGPFPPPQFRQNQKIAPAPPPVPQMMDLLYKNHFPILGGGHPNPSGPPVTGNKEPWGIFLFLFLMKQKKGHVPQGFFLPAPPVTFNRILGPRFQLRATAGQVVGFHPGLAPGVATGFWGNPFGFFKKGQRWFF

SEQ ID NO: 939879 - protein, 83 aa, Homo sapiens
WHRFQPQGRVGSLAAGVTGIAPRKVPYLGIPAGAQPGHPPFFVTSILGVATEDWKKGGPFSCMVGPEALPLAFTQKTIGRLGG

SEQ ID NO: 939880 - protein, 148 aa, Homo sapiens
QFQARDPLGRRCCGVFLCGPFILKGVGAGSRFCFGAKLFCHYQCPSLLAPSASEHASGVHTGSALSTTQLFPDLHEGMALQSLGPVAHSYSVLRYCYHSSLICIWIPFPLQDYETPEGEGLGQIFFLYVQFPAQPLQPCNCLINDLSL

SEQ ID NO: 939881 - protein, 137 aa, Homo sapiens
LPAFQKGGPAMGIFLDPEGGTSPRSPFRPTCNGLRRPAPKLSFFPGSPRPPKRETVFFKNLNWPPSWPDRLCPSGTFIKRKKLGSSLRKKKILKPSLVSVWPGPTPGFLGNGQKKPRKPQNRIFKKKNKALLGAWNP

SEQ ID NO: 939882 - protein, 161 aa, Homo sapiens
QGQESGLHPAGPFLVGSKARVRLSTFWAGAHKKLMPNCKWVSNLAVPPAGDNVICWSYNKLVWFDLGLSPKPYRMLRPPKKGLGGVAFPPRDPLFGSGSDGSVIVHGMVDNDLLQNPLVVPVKVLKGHVLTPDLGGVGVFFPPPQPWVFSLGGEGAVRLFP

SEQ ID NO: 939883 - protein, 123 aa, Homo sapiens
FCLPRVFCGDFGGNPFSREPVVQFSVFNAPHRGFGPPGPKFGPGGNSFPGPPFGPVFPTPRAWKQNFFGPRGPGGGFSPPWGWGPLGNLSKGPPLVPPRLGSPPPPLFFFYLGGSPKRGILLG

SEQ ID NO: 939884 - protein, 114 aa, Homo sapiens
GGLPAGRAQPFPPLGGPGGGTGFPEVLKWPFKYGSYSGRWGQGGDGDFFNFKKKGRFSPPPFPFLKQRRRAGCPPFGPLVPLPPLWKGSLGRLPPFKGSSPRGPPLGKKPPFFF

SEQ ID NO: 939885 - protein, 74 aa, Homo sapiens
QNRPSFIVMSPWGAKNVGDPGTPPAERGIKPGLRPQSPGGAPTFYVPGPQTDQTLVLLMGKEGVPGGLVTKRCI

SEQ ID NO: 939886 - protein, 106 aa, Homo sapiens
EAMQSIPKGVFEAVSFPKRISFFSDQPTLLPLLVIRIIDAGWNHWGLDSLLFKPWEPKDSSPYAKAPKLVVCALGLSVGLMGIVGGTVFIIQGLRSVGASKHQGPL

SEQ ID NO: 939887 - protein, 81 aa, Homo sapiens
KPDAVQPDSLPYPQYLGVIKAQISCAKDIHPALLDCANKVTGKTPAPPVGPGGPFYKWGTGSGAASGWWVVCKRNKKRPGP

SEQ ID NO: 939888 - protein, 107 aa, Homo sapiens
SPGPSPVLKMCNRQFAWATAFSPWYCMHAMLAPFPFWAPQVFPDPRVPGMFPPPPAPLTTFVSFKHLHAHLVFSLCPQKGGHKGRVYFSWEEQGKGGGPRISPPFSK

SEQ ID NO: 939889 - protein, 189 aa, Homo sapiens
MIASSWAVKKNDYLKKDEVERLKASLDGSFKNLEFAFYYIVGVSSFGAQVPDAKKACTYIRSKIDPSNVDSLFYAAQASQALSGCEISISNETKDLLLAAVSEDSSVTQIYHAVAALSGFGLPLASQEALSALTARLSKEETVLAKVQALQTASHLSQQADLRSIVEEIEDLVARLDELGGVYFQFEEG

SEQ ID NO: 939890 - protein, 146 aa, Homo sapiens
GGGHAFDDLVGNFAATFAVGHHSDAIALGDMGNGAAAEAPVGAAVTEIPALPLLLDGKADGVRPDAHRRHHVLHRCPIEHDLRLAGERFLHIDHEQRIIRGRGPQAGRRLFGIDMPAGRPQRLAIFMAACGPCLPVRRQRLFETGM

SEQ ID NO: 939891 - protein, 94 aa, Homo sapiens
QTPPGASELLSDPSKGLRCWPSIKGEGWVLMDEVTFKNPLVWVHASPEHVVVTRNPKSSAYKWKETLFSVMPGPVLPGGALGISNSIKLRQTPP

SEQ ID NO: 939892 - protein, 100 aa, Homo sapiens
MAEICNANGPPNSPKGSPDPKHARKPPQNCQAYPQGVCKKHRGRPEPGVPGERPKAHPGLAGELLKAPWPCASWPLSASPPGSVFPHLCVAFGQIKASFG

SEQ ID NO: 939893 - protein, 56 aa, Homo sapiens
LAGGGARPLESRGSRYEVVVRGKPSTKQQPSGVASSPSRVPPGPVSQGLFNNRPPP

SEQ ID NO: 939894 - protein, 161 aa, Homo sapiens
LSGGTLGGLLAFRSQTLDPAEAQLGAIATSFAAQVNAQNALGVDLSGKPGGNLFTTGSPITYANQGNTGNAALSVSFTNASQPTTGDYTLAYDGAKYTLTDRASGTVVGTSTSMPGSIGGLNFSFSSGAMNAGDKFTVQPTRGALNGFGLTTSSGSAIAAA

SEQ ID NO: 939895 - protein, 137 aa, Homo sapiens
EGGGPPAPSTRGGGGKAKEGGPPPPCGKGKTRFLGVFGVFPPLAPRFFGWPPHLKRGPIFPGVPALFLGPKGPPPPLLGPPSLPPPWPRGGRGGHPPPRGPPPFFPFGELGAKNPPPWGPFFFFLGGGEPGPSPFFF

SEQ ID NO: 939896 - protein, 103 aa, Homo sapiens
MARPCYGIQQRQTLSPLNGGDIINALCFSPNRYWVCATGPRIKIWDLKGKILVDELKQKVFSSSSKAEPPQGPPLAWFVKGQTLFSGYPDNLGRVWQVTLGPP

SEQ ID NO: 939897 - protein, 151 aa, Homo sapiens
SNLGGVGSPIKPGGEGFSSGVPGPTVSHVSDIVGPDGLVYAVEFSHRSGRDLINLAKKRANIIPVIEDARPPPKNRMLIAMVDVIFADVAHPNQTRIVALNAPPFLGNGGPFVISLKAHCIDSPAPTEAVFAPQVKKMPPENIKPPEPFTP

SEQ ID NO: 939898 - protein, 160 aa, Homo sapiens
SEARRTFSSAERPARCRHSGRTSEPSVVFRRLAAHPSLFRRHVDRRRAEQRVAECALHDLERDAGGQHLPADRVPERVRRGTGQLAPLGLAQVPHHLEQLRDRPLSEPARAAHRIAVRCRAYGRFADIWGSPNFSRARGGVGMTSGATSGNPGGLRRGGR

SEQ ID NO: 939899 - protein, 89 aa, Homo sapiens
LLGAPFKSNRVKAGIRMHANFFVEAASQRAKQDMPGQIAGVQKFYDARLGLDMRSPPYRSFEGEKKRAGVWDAEHEYLYEDPQRAMQVV

SEQ ID NO: 939900 - protein, 66 aa, Homo sapiens
NALTVASEPCREVFKLYSHWGVLDDLEEASVKLALPCDINLRGELAVLVSRSPDEIRFPGLQDSAC

SEQ ID NO: 939901 - protein, 67 aa, Homo sapiens
SARSGGLRREQLMPQAFKDLPKGVDPARREFFFSDFDFQNIFGKSKEEFSSMAPWRQRQEKKQLGFF

SEQ ID NO: 939902 - protein, 167 aa, Homo sapiens
VAPPGGRFSPPRAPRGVPWGWGPLSRTPPCGRCGLFCWGPGFPPAPNPGVSPQAWSSGGGFSRPLKPPPKPAGWGPPFRWVFFAPPPGAKGFPGVGSPLGRGWGVFFFGAGPRGQGPPPPRGLFFPGGGPLGPGAPPPPPPGPPGDFVFLFGAPVWGPPFVGGPFFF

SEQ ID NO: 939903 - protein, 58 aa, Homo sapiens
GPWNARKKLFQLRSRLPGGNPCKKALRQFSSYVTKGKNGHRVLLVLGWSHDPIQPLDL

SEQ ID NO: 939904 - protein, 117 aa, Homo sapiens
LPERICKNWFLERGCRRPPKVDVVEPPGGTNRDRSGHGRAEQRENCPPQPKGDHEKLLLAGGAEVEEVREPRRSSSGDAASPSPPRLMRHVHAAARTRTWAGSHGLAPGHRFDLAEC

SEQ ID NO: 939905 - protein, 119 aa, Homo sapiens
QEGEKIPRVPSGPRGRGEGGPPPNFPFPPETPGPPKRGQFFLKNLNGPPPCRGGFSPPGSFLKRKNPGSPLGKKKFLNPSLFPVGPGPPPGFWELGQKNPRNPPPGFFKKKKKPPLGVG

SEQ ID NO: 939906 - protein, 64 aa, Homo sapiens
KKEILETIQLPLSTLYYVSLGLKRSGLLLHGPPGTGKTLLAKAVAPECSLTFPQVWYSINRCPF

SEQ ID NO: 939907 - protein, 72 aa, Homo sapiens
SGRSSEILKKALLSQEMTTPWRVIAPEDLSVGYSVEVEDSDTDDPDPVETYANVCLCLSFSQKRFKNKNTKE

SEQ ID NO: 939908 - protein, 118 aa, Homo sapiens
LSRVGQISRNVGGQRSLVNKWTTFLKARLVCSVPGVKGDTHFDQLQDVFLLSSRDHRTPLYAVFSTSSIFQGFVGVYSINNVPRAFLGPFAPKEGPMPQWVLYQGWVPYPRPGMCPSR

SEQ ID NO: 939909 - protein, 81 aa, Homo sapiens
TALNVGGGEEGGKPFLAGGGAKERVMRNASESAQNAWGECSTVIGDLPNKGLVALGEFLSAKQVNLGSRPLLTLGEITPPY

SEQ ID NO: 939910 - protein, 101 aa, Homo sapiens
QGGVAAAFVGKPELGGPHVAPPIKEKEGGILAWRPLEPNGKKVKLSFPVCTLSSSFRKNGCPEDFPPWVGVKKQPAKVRGLRALGCCSIETDSGPGPYLLF

SEQ ID NO: 939911 - protein, 70 aa, Homo sapiens
PGALFKKLAFSERGLDKARLAGKELRFPKEKKNIFVVAAGQLGNMHFSNCWASPPITPRAFPTLFFMSPF

SEQ ID NO: 939912 - protein, 40 aa, Homo sapiens
VPGGGGGVPPPSRGLSLWAPKRQNLNKGNKGPKNPVFFRG

SEQ ID NO: 939913 - protein, 46 aa, Homo sapiens
MAAFKPWRRKKPSWGPLKKTFPRKKGLYARDKFFRWGGFHKRFFPL

SEQ ID NO: 939914 - protein, 118 aa, Homo sapiens
KPKIPKGVNRKLDYLAYIAHPKLGKGACARISKGLRLSRPKAKAKAKAKDQTQAQGAAPASVPGQVPKKDPGPKGFKVNIFANIRKKGVVPPPPPAPGVPFERGWGPPLLFGQITLGP

SEQ ID NO: 939915 - protein, 113 aa, Homo sapiens
SLPLPGKKPPYSPSPPGWGPPPSLNFGAPPPHCILGTFPLQGVFYFQPLGETSPLKKGAGQGCVVMGFPPPPPPGQGWNWTKTSPFNSFFSKPFGVRRLCGFPPANKPYPVFP

SEQ ID NO: 939916 - protein, 92 aa, Homo sapiens
GKRSGEFCFFRAWRGPCQPQNKVELWPDIGAFCLSGPEGTLGVLGLPPTPPCQQQRKKLLPARDIKALFVCEEEKLPRKGVSLKNGDKKGSC

SEQ ID NO: 939917 - protein, 158 aa, Homo sapiens
PPGGGWTRAGVFFSFKKGAAPPGGVFIKGGGVGGGNPFFRGGGGSFFLGGGVFFFFLGGGGVFSPPFFKKRGGGGPPPPPLGWGKKNPPLAFSPRGGGGGEGFFFEPPFFFFGGPPGGGGGPRGVFFFFFFGGGPPPLGGVFGPPPGFSPRGGGVFFL

SEQ ID NO: 939918 - protein, 174 aa, Homo sapiens
TYVQKFKRELSTKWVLNTVSTGAHVLLGKILQNHMLDLRIANSKLFWRALAMLQRFSGQSKARCIESLLQAIHFPQPLSDDVRAAPISCHVQVAHEKEKVIPTALLSLLLRCSISEAKARLSAASSVSVHFQGDMCQQYTLWEELSFGWVGPNCPELGKSPVLNRIISIFTGVF

SEQ ID NO: 939919 - protein, 185 aa, Homo sapiens
QPGAELLLTGVGHLHIVAGLSPQVRIAETVGVGVYPDAKRDELPVAGTVDAAAERQGQLVLFRQLLLDARAGKQLEIVAGEALARVLRPALGVGLLYPQAPGKRQVGPGAGQRQVGRVDVLVVPEAVALVGVGPRDAFHGVSELHVVVRGYQAGFQAGLQRHFAPQGHYIVQLCRLNGEPAFLHV

SEQ ID NO: 939920 - protein, 156 aa, Homo sapiens
RMERSPPRAVLVQALDGGANMLQVLADAFAGALRVAVQDGLHEALVLHGQLLQGLGRAQAEHIVAVALHRGQHHGEQAVHDLHQHQVVRGLGNGQVELRVGTRRQLGVAALLVLDHHLEAALDMVLVALRGALGGQPGRTGLQRMAGFQHVIAVVG

SEQ ID NO: 939921 - protein, 44 aa, Homo sapiens
EGAREWGERKEGTVWRDKKRRPILTLMALSRVLLPISPFIVIMV

SEQ ID NO: 939922 - protein, 90 aa, Homo sapiens
SLPVRGENVEISKTPYPVLTRIGLERSLRYPIQLFPASLVCRKPKGTKVQVDDIKRVFSLFLGESPSPQYMKEDQGPFLFELKGETMDPS

SEQ ID NO: 939923 - protein, 33 aa, Homo sapiens
QFLLLLVKNSLQNPHTHIHTHTHTHDACPSVVF

SEQ ID NO: 939924 - protein, 43 aa, Homo sapiens
MIAAAVTDSIPSVLADGSCPGNRPSRTIVARYREAGRRPGIGC

SEQ ID NO: 939925 - protein, 39 aa, Homo sapiens
IPPGPPGGPPFLGPPTGTPPPVLNFPRFPPKKGWGPPWG

SEQ ID NO: 939926 - protein, 104 aa, Homo sapiens
SPGEMHREKSIPVGAFPLKLSPSGPGWVAWPTKAKTQRLPVFHPPVKPPWLNGKHVVFAKILKGMEVGRKVESPKTTTRDKPLKDVFLPWGKIEVEKPFPLPKE

SEQ ID NO: 939927 - protein, 46 aa, Homo sapiens
RSVPLDPIRDEFIGNWAWVIVELVYFWLKLTPLQSSLGDKARFHFE

SEQ ID NO: 939928 - protein, 76 aa, Homo sapiens
EWNLDTIPKLFLSSEKDGETKVTEMVDMPGEEQTMQFLEKNVMFKFEVPAILPEKESEDVEDVPEADSDSDKERII

SEQ ID NO: 939929 - protein, 47 aa, Homo sapiens
ILVAALTFFLGKDEDEKQDSDSESEDDGPTARDLLVQYATGKKSSKN

SEQ ID NO: 939930 - protein, 122 aa, Homo sapiens
MGSPLPTGPPKCGAVPPGGSPNARGGGLPALLDPGGPGIPCPGFPRFFPASERKPPGIFPGPEGTAPGPSALKNPCPGPPAPPARGGPLGPKAPPGGGAGPPSGGPGPGLGGALSIKPPGVG

SEQ ID NO: 939931 - protein, 153 aa, Homo sapiens
GHVALREHRGVAAVREVLVIEEAVADAGIDVDVAGRPQRQRPRFGAEAIGELDRARGRVEVLVADRGGKQSVQEGQAVSGQVAHGAGREIPRARHGDVAAIDAEVGIDQFDPGAQVEIGNGRELARLCAGQHLQRVERLLREAGQRRLVESLV

SEQ ID NO: 939932 - protein, 127 aa, Homo sapiens
LGVIVVQGITRPLAHLVSVLQRMAQGEIDSEIKEAVRGDEIGSVGRAVEGIKAMVARKAAEEAEVKRRADAAAAAERRRTMVELADGFERAVGGIVGTVSSSATELQATASTMTVTATETASQSTTV

SEQ ID NO: 939933 - protein, 72 aa, Homo sapiens
ALTGVLFGVPQKAKGEVAENPAKVQTGDVADRSFVVQGFSSRFPLPMHPWPNRTGVDLAVFIFNLFPYMGSF

SEQ ID NO: 939934 - protein, 135 aa, Homo sapiens
MRFLCGPRLLVIDEFAYARRNPDPEANTALFEVISRRYLKSSTILTSHTGIAGWGERLGDPMLAAAVLDRVLHTGIVVSIDGPSYRMRAHQKRSDALRRALHPEAIPGPPPTAGGNHADTSRPPAELQLAAAMPP

SEQ ID NO: 939935 - protein, 30 aa, Homo sapiens
FETFKLVSAFAAFDPPFAPDNPHSIKTSEA

SEQ ID NO: 939936 - protein, 102 aa, Homo sapiens
GFSPFQREEHRRGRSGCSAPHGQIQETVTFKCGHGLSPEEWGKLDPAQRDVMLENYRNLVSLWLPVSKPESYNLENGKEPLKLERKAPKSSYSGEPDRWESS

SEQ ID NO: 939937 - protein, 118 aa, Homo sapiens
FGLGGGKGGPLPFLGPGNIGLGVSPKRGPFLKGRGPSPGVFWPRFGQPGPRKPRWGSLGPSFCLGPQMGGGGDWVWGFPFLFTPPPPPIPPPRFPPKGFSPVGLERANLKKKGPRWVF

SEQ ID NO: 939938 - protein, 78 aa, Homo sapiens
RFGKKRKMALILKSGEAAIVDMVPGKPMWVESQTYPPLGRFAVRDIKPHVSVGVLKTVAKKAAGAGKVPQFAPKAQKG

SEQ ID NO: 939939 - protein, 120 aa, Homo sapiens
LQPLLALGVPFFAKEKHKPQEKIKTVMGRPRPFPSPSVFFLTQGSGRPCGFRTPKTSMFNSEGAGVKNGPQDWSPLRRPNSPSLSPPQQGIRDAAPCRSFLLTPPVDPLPFGWPFPKPKK

SEQ ID NO: 939940 - protein, 139 aa, Homo sapiens
MAGEKINKDFQVEIPEFLSAFENSLGAVDEMLKTIMSVFKNELLQKLGPLDQAKVDLVFAYPLNSMFWVFLATQGVYPKEHPVKQELERIRVFMTRVKEIPAKKKAGKLGKGAASRFVKNALWEPKSKNASKVAHKGKS

SEQ ID NO: 939941 - protein, 58 aa, Homo sapiens
METGQCGLLVDSDACLLREGGPLKHPLVCRLEGPPFRMSLMGCTMRVMATKLSAPLGM

SEQ ID NO: 939942 - protein, 130 aa, Homo sapiens
KGGPPPFGSVLNSPPGRRGFWGNPPSGFPSFFFQKRGGWFRPSGPLEGPLFFKRAPPPFFLSPSLWAPPSPRPPPLGLSPGLFWGCLQTFWVGGPQNSGGPPPGGGSLAFLGLVGAPPPGFLFGFYPPFL

SEQ ID NO: 939943 - protein, 144 aa, Homo sapiens
LVVEVAHPKIIHEFGAQILRHANLLSLGVTMATHPDGFRLEGPLVAAHSLGPCIVLEGPVRGFCPFAPGNSNPMGGVALAAPSLGFNGVIGVLVVDTSLLPAPLQAGDPFLLRSLLPPETRSFAWPFTPPIPPLPCPTSPGFPF

SEQ ID NO: 939944 - protein, 150 aa, Homo sapiens
RRISKHTFTDRIQSVASAARSRLDKAIRQASRPRLGSGRSPRSAKRDRAVRTPMGLIKTIGRKPGVQRILGVAAAGYLRLVRRTNRFTVEPEGAYGRLDATGPFIAAMWHGQHIMISFMRRPQDRVATIISRSPDGNINTLALTRLGVRV

SEQ ID NO: 939945 - protein, 104 aa, Homo sapiens
MPRWVATRKTGAEVVLQSKALAGPDDHVRPSLLMMTPSQIISMPVLSSAFPPGTFFGAARLGAGFPPVAVAARGRRGESAPLRAPGVPGPRSSAALYPLSAADI

SEQ ID NO: 939946 - protein, 103 aa, Homo sapiens
TRCSCWQTGGFGFLQSITPSSRIILYKGVLGGAAYVNPFPNIALETSDEHREFPMGAPCIFYPLGISPSGVRGLALQEFLCRLSLLWGSPGSRSHSPVGKGKG

SEQ ID NO: 939947 - protein, 133 aa, Homo sapiens
FCQEQVNCPHVRWDTRFCFPEKKGGGEGCLWTCSGTPRRVGKNGPWWWLGRQSVVLNPAWNLFLAQPGCGLTCRKSISLHPTPCAFLRQTFHGSLRFQHCQHFPSFFSCFPPLPGSSGTKAGKVSFSSLRFFF

SEQ ID NO: 939948 - protein, 109 aa, Homo sapiens
GSSESSFGKSSFWGSAYPKIPLKDVSPRVEKGSDGMPPPAAPPAVYKVMKCWHLDAAMRPSFLQLREQVEHIKTPEHLCRASAWVMGLWGLNLENHGPGAPAHWARALN

SEQ ID NO: 939949 - protein, 135 aa, Homo sapiens
RVFPIQESPHALGQGPAPAHVYPVSQPALQRAGPPGYRFRALVGKAKDPHIFSIQPPAMGPPFLPKGPGRPQPLLQVRTLVPSPPCLGAEIFPQKKAKFFVSFFSLFFFKEPIFPYVEGGSHAMKLKFLIPFFWP

SEQ ID NO: 939950 - protein, 84 aa, Homo sapiens
GNIPPMPNSWQTLSGSRLYIEEKIRNAQLAQYNFLLVVGEKEKISGVNIRTRDNKVPGGRPLFETIERVQQLKEFRSQQAEEEF

SEQ ID NO: 939951 - protein, 84 aa, Homo sapiens
KTSQYFVIKRWLSRRRRAPQGHLGYTEHKVVSFDFKATPTSPPLTLGLAIALNDHFVKLIFWYDNEFGYSNRVVDLMAHMASKE

SEQ ID NO: 939952 - protein, 112 aa, Homo sapiens
RGGVSVIHPFPPRKFGLKPKGGGGNPGPPPGGPPPIFFPPVPWGGPWGGPPSPKLPPVLRGSPPRPPLGGGALWGAPKFKIFLGPPPGKPLAGGPPPWPPRGGAPPPPGGFF

SEQ ID NO: 939953 - protein, 102 aa, Homo sapiens
GPPPPPRGLRVSPPRGPGRGGRGAPPGGGPLGGLGPPRAGASLPPGPRVGGAGAPFGGAPGGTGRFRIGGGGPPPPPPPQGPWFGFLPRIGGVFFFFFFFRR

SEQ ID NO: 939954 - protein, 111 aa, Homo sapiens
PRRVFPSPGRVGVISKTPPPLWGAPGFLGPRPFWAPGAPPGKLKGFFLFWGPPPGGFSGGKKRFAPPGFFFWPPPPFGARGFPPPGVFFLNFGPRRARGGFFFPLKFWVPP

SEQ ID NO: 939955 - protein, 114 aa, Homo sapiens
RVGTQGLAIPFGADEKDAKIPNDGQGRFGGNISGRPGGKDLPSSLGPARGKTRPFWDGAGWPSGGGPRGGGEGGNFGPPPWRPPPPGFPFLGPPPPWTPLFGLAGFFFSQTKNG

SEQ ID NO: 939956 - protein, 150 aa, Homo sapiens
AKKKKKKPGPPKAPAKKPKKPAAKKACIKPVGATAKRQGTPGPTGHHNGRRRIHRKALMRVYVAQLVARPAFKVPFLVGQYLLYGFEVRPFFPCSRQPCPHVVDCFVSRPTEKTVFLLVMYVVSCLCLLLNLCEMAHLGLGSAQDAVRGR

SEQ ID NO: 939957 - protein, 128 aa, Homo sapiens
RPGPLRLKRVWQKSLLPKWRVLEYNLPPRKGNFLPGPFHRVSQLNSDSNRSPSLRIPSAGKGLWAKGFSKRRVTFWLLWPRLPALGPLPAVVPHFAVGRPPGPFGLWVMEGTALPCGDSPHSHVAPPG

SEQ ID NO: 939958 - protein, 138 aa, Homo sapiens
LCRAPAVLTSTRTSAEDGSQSPKGPIQILPGALPLHLEPGHQFTKVLALYNSINRAPRRPRFWYPRRWNPCPLCYSWAPNPKWSNCPTLLCAPSNSTKVPPRPAPPRQGRPPPPPPPLPFPWGVYLRTPVPQTPLGPP

SEQ ID NO: 939959 - protein, 139 aa, Homo sapiens
MGARVDMFEVGLAPVPSLFNQMILIRRVGRSLGPPTPTMGLAPPEAPAPQKLGFQLAQKMGRLGGNHQRGVFPQQGPLGGFFPGPKGGFPQKKGFLGPGGFPPPPFPTGLLAFPFVFPLGPPPLKALTPPPALKGCFKF

SEQ ID NO: 939960 - protein, 88 aa, Homo sapiens
FGPLGAPPPWGRDPPVFSLPPGGAGGGFSPVGGPPRGAGGFSPPGGIFPRKNPPPPRVWGGGAPFFGKNPGPPGGPPPPPRGGGGGFF

SEQ ID NO: 939961 - protein, 102 aa, Homo sapiens
FPKIKFGPPLSFVFRAGKGGGPPSLAGFGPLAGGFPFKLERGGGPPGAIKGLGFSLPPFPGALGVLYRALFSPPGLFAGGPFPPFRFVFSPGPDLKGGVWAF

SEQ ID NO: 939962 - protein, 124 aa, Homo sapiens
KPHLFPFKVTGPGFVVGASSLPPGGLGLFPPLCLKNCSLWVGSMAGTPQAGGALPPWGNLPRPPFMPFFRPPATWPPPFGRGLVSPSFPFRGSLAPSSRPPPEFPGRGLRAPLGVPPRGFFPKK

SEQ ID NO: 939963 - protein, 81 aa, Homo sapiens
GALPKVNGPSCCSRVADALLASKGAYLLMELAKSQDKTLKIYEGAYHVLPKELPEVTNSVFHEINMWVSQRTAPAGIGSPP

SEQ ID NO: 939964 - protein, 115 aa, Homo sapiens
ISCLKSTWVLAPWQQWLFFKISLGPTLKRRKPKILLTKPLQLAFSTTLAPETTFTFGLSTKTKWIFSGQTQCPTKKGPGLAGTGVKKGLLQSSLKKSLLWKFRGWKKQFQPWTLP

SEQ ID NO: 939965 - protein, 121 aa, Homo sapiens
RWSGTWKKNLVCLQGSLFLSLGAPRGGTFKPWPPTSRISPQKCWVWPGPPNRLPRVVPVSGGFSIPAPRIRARVTLGAPPLPFTWSTPGAFSRIFSAGADRFSRFQTVGGGPWGLSPVSFF

SEQ ID NO: 939966 - protein, 117 aa, Homo sapiens
GRHGWGKRTRGSKPGGGQAKCVFSPFPPLSPKMPQKGQTKAWLPLLHVFWGFSWSMKTPKDSLSLPFDAKADQAVPLQFHGEVSSFSSLKKFLEKSLSAHAAFPSVKGVGWGGFPCP

SEQ ID NO: 939967 - protein, 93 aa, Homo sapiens
PFLPMAPASPLLNGNPDCGGGCHVWYVKIASKYILCQCPQWLDMAPFSSFQTTTGIRRACFGCAFRREAYVNKRAGPGFVVPPPTPNTALWVL

SEQ ID NO: 939968 - protein, 110 aa, Homo sapiens
VVQTGQQGPPFTSPAPLVFWKTGFEKPKVFALEISPQGLGLPVPKRFPPGEFFRGKGPPLVLSFSLAPPPPLGFYPFFPGGPPLFGVSRFFFPPPPPPPLGFFLVMLGGN

SEQ ID NO: 939969 - protein, 117 aa, Homo sapiens
MRKWISCHQKPPLPKRGISISSRSPASLNLGPKAKMAERTLAKIFPVPCFTLFYFSDPSPPPIEPVACHLVSPLCLFFLMDLFPPLLPLSPWIIRLGMGVRGVIVFKKVANKNPPMW

SEQ ID NO: 939970 - protein, 62 aa, Homo sapiens
GNALTPKLAPVQIKVEENFGFETNEALDSSWVFRGPNKMLPYPTLASPAFDGRMPNKLAPPS

SEQ ID NO: 939971 - protein, 80 aa, Homo sapiens
SPREQKRRHHVPLLTLAKHDNGRVVARSFDAEVRAVIRIGSVGIAFLVVQIVFGLIADEVFEREAVMCGNVVQAGGRPAA

SEQ ID NO: 939972 - protein, 172 aa, Homo sapiens
RALDQFSPVVEAKLIKHKKGIVNEQFCCNGWQTGPSTFIPWWWFSQGPQNPLVRATPRPSIKKFFVTPGVLRLQLRIQKGMAPLQFYPWQQKFFPNFKSISKALVERGGVVTNNPLGFLILPARACPSYVPSLKPKPKPLSLRPWFVPKGPSVPNTVPAFKSPFCLANNKNF

SEQ ID NO: 939973 - protein, 151 aa, Homo sapiens
RFDRALWSANNVRRAPGSERDSLLRLRPRPGTSELHSALALPGPPLHCPDPRGLALRAPPRRLRARRASRAPGLRAAGRRAPGCRGGSRAADPSAPEAAVRRLARRLPPAGRCVREPVGLARALRRVYSKGVSANPTARAAFHPELEKPRP

SEQ ID NO: 939974 - protein, 61 aa, Homo sapiens
MHAYTGMCARPHHAFLGPLVHSSSALLFSLLMSQSYMYSIVIGIHVRLRHQETKVLSCTVK

SEQ ID NO: 939975 - protein, 126 aa, Homo sapiens
AGPREGGGVTPCPGELGLRARRCGQGHAQPLLGATAAASQQPASFGLSGEAMGQRLYNVNPPLAFVKAAELKDEGRSYFKKRKQLRELKIPTTYQVKYITKLIFPTRHRLSVPLGSVCYKIFKGRF

SEQ ID NO: 939976 - protein, 36 aa, Homo sapiens
GVSEEKEERHTQRLSRRAIHKQWPTGSDGTAVGSNN

SEQ ID NO: 939977 - protein, 113 aa, Homo sapiens
MPPEFKDLSIVRETKPLQKKCADYQINGEFICKCGQAWGPIMVPKGLDLPCLKIRNFVVVFKNNSPKNQSKKWVEFPIPFPIFAYSECCLLSNKDKPLIENSFKKQPVNHLKG

SEQ ID NO: 939978 - protein, 77 aa, Homo sapiens
PQKALAGLAVFKMSKTQPGAVAQACNPENLGRPRQADHLRLGVRDQPDQHGETPSLLKIQNKPGVVVHACNPSYSGG

SEQ ID NO: 939979 - protein, 176 aa, Homo sapiens
QRAVDRVRPASKAPRIPRAPGWVHLAHRGMPHGSVPTKVRAGPGFNLEELRVAGIHKKVARTIGISVDPRRRNKSPESLQANVQRVKEYRSKIILFPRKPRPPKKGDSFVEKLKLAPQLAGPVMPVRNVYKKEKARVFPEEKKNFKAFASLRMGRANARLFGITGKKSQGTPKTGC

SEQ ID NO: 939980 - protein, 106 aa, Homo sapiens
MGKPDPLRDSGTYDQKEEPLERDFDRFIGATANFNRFTLWGLETIPGPDAKVGGALTWPTLAAAIHAQGPEDGEPELEIQSCDPFPAVNQLFGTDSIPPIKELFPA

SEQ ID NO: 939981 - protein, 113 aa, Homo sapiens
LNISPCWGRENKAQLLSRGSPWGSVKAPWRPLKSKCLWKPLQLHPPTLSPRKAPHQPSPRRPSSRPLRVLPFSCNLAANTPARPLRCLLQPMFLQALHRVALINFWLRNEINE

SEQ ID NO: 939982 - protein, 72 aa, Homo sapiens
PRRKPEKAGLLENRWFNGSRSRGAVTRAGLQKSLLPPVLNGKKPPRRLLQLHAFKAPFQKAGGAVWPPSQKK

SEQ ID NO: 939983 - protein, 79 aa, Homo sapiens
GAQRRFQLWFQNIELVNWADGGQHTSIHPAVRLKLPLPPLPPGGANFFGQQEPKPTSKLACPKPLISLFPFAPPQPRGV

SEQ ID NO: 939984 - protein, 73 aa, Homo sapiens
ASMEFVGYKDFLAAAGHLDVYVQFTGVTMAELWLRGLTLTSDDPPASASQNAGITGVSHCARLGSYVTRMFVQ

SEQ ID NO: 939985 - protein, 129 aa, Homo sapiens
FFQNRNPVGKGSFAGGPRTDSFPDCTPGGVTRPLCAASFVKGCNSDLARSSGVLSPSKVFRTGKRLSSSKAPVLGPPRGGRVPPFGPWVGPPLPPYKNQTGFPGRQQGQPPPRVGSSPAGLFCNKVPGV

SEQ ID NO: 939986 - protein, 92 aa, Homo sapiens
GTGGPTTWEEFRKWFTQHTFLQQSCCLDLTTSYNNLATYVFLHTVKGTPFRLLTKERLGYCTLGAKDYGLQFTSSRKFLSISPNVLYFLANF

SEQ ID NO: 939987 - protein, 122 aa, Homo sapiens
EARSGEGDTPPNGYSRGGCPSGAARAGPSLPQPPFVEQSRFGETPSFRLGSPPQGAGVARPKKFPPGGGLKGKGPPPGPRVQAGPPPSLGLWPFFPGGPPPIGGPRVIFPPPPPPPPGVLFW

SEQ ID NO: 939988 - protein, 51 aa, Homo sapiens
MGIKHSVEILVIGRGAGAQPVSLCSPTERGSSGSLYLDAHLNPNRGPSEKP

SEQ ID NO: 939989 - protein, 59 aa, Homo sapiens
EFGTRRLAFFFLSLLPFSAPSVESTSSSFRPLSGWSAVFSGLEANDAGHVVTPGTIPRS

SEQ ID NO: 939990 - protein, 79 aa, Homo sapiens
LQEFGTRICNLSPNPVLAKTCAVLTQGLMDLGLCRMCFVKNVFAGSMLGKRHRHAPFVTQGHSALWKAADPLPARVLSK

SEQ ID NO: 939991 - protein, 77 aa, Homo sapiens
IREDLSWCLFYKGTNPIYEDTALILITFQRPHASSCRIRRKSRGGGLQVHATTPGKFLFVETGFHPVSQDGLDILTS

SEQ ID NO: 939992 - protein, 92 aa, Homo sapiens
FGRGQPEEGEFSRTSLESHVEWVWRERGTFRYMQQEIGNLQGEAKGIHTPTSLSALTLISCHNSWAKLDQKASELEPVDVVHSVHLFQGKRV

SEQ ID NO: 939993 - protein, 104 aa, Homo sapiens
SFKTVSRSVACCPCLLCIGSLQPLPPKLKGFSCLILPSSWNRHVPPCLTDFCISRDMVLPFGQAGLKRLISPPTSASQSVGIAGVSTCAQPRPFHTWLGILAVC

SEQ ID NO: 939994 - protein, 63 aa, Homo sapiens
SGVPYFYLSPLQLSVSNLQENPYATLMTLAKDKLLQRNMLNSKKSLCVKIMLEGMTKVNTEIG

SEQ ID NO: 939995 - protein, 130 aa, Homo sapiens
IRHEATPYHSTPFHSTPFHFTPIHSIPLTSIPFHSSQFHSTHSPFHSISLHSTPLHSTPFHSIPFHSTLISTPLHSTPFHSIPFCTFLLHSTPLHTLHSTPFHSIPFHSMTIPTNFHFHYPIQAIPLPLH

SEQ ID NO: 939996 - protein, 80 aa, Homo sapiens
HLGTAGQKALELVACIEEVGLAEETATVCGLLATGGQLALRGFSFPVWKAADGLSLIQGCRLHREHFSLRFRLVLSDTTA

SEQ ID NO: 939997 - protein, 77 aa, Homo sapiens
VTINRRQVTQAKLKFRPKSDLTKKAIRETTTQIPQLVIPRLSTTTRLVLQKTRHQISPKTLHSDQHPQHLPYRIAHQ

SEQ ID NO: 939998 - protein, 33 aa, Homo sapiens
MSKRRVGETDVRQHVRAQSQILAHSPFSIRHSS

SEQ ID NO: 939999 - protein, 89 aa, Homo sapiens
MQNSALKAWLDSSYLSGANQSWIEQLYEDLTDPDSVTLTGVRRSSSYLVRESNPDQFHSQTREYFRRLKDASLLFSPDTNCEAWLNVPV

SEQ ID NO: 940000 - protein, 69 aa, Homo sapiens
VSTGKPLQPSSGLTGWDVPGHTEQAPVGAPMRTPAEPWTIYRHTASCRPDAPPVFRSSAHPCFIGLFVC

SEQ ID NO: 940001 - protein, 39 aa, Homo sapiens
MSPSDTTGLLTPASTICRVSNSYKVALLMKSGSNLGKSS

SEQ ID NO: 940002 - protein, 41 aa, Homo sapiens
SNRIMIRHLPLAFMSWDTMYSVGGKLITLERQRHDRVSQLY

SEQ ID NO: 940003 - protein, 47 aa, Homo sapiens
VTVVGTSEDVIGCSATYSLFDCVDVSWSELRTYNRMREVIWQFHARG

SEQ ID NO: 940004 - protein, 33 aa, Homo sapiens
MPIVINRLQRKLGYTFNQLLQQALTHRSASSKH

SEQ ID NO: 940005 - protein, 131 aa, Homo sapiens
RHEGLSALTARYPCAVQIISEERFRQLKIKTIGSTYMAASGLNASTYDQVGRSHITALADYAMRLMEQMKHINHSFNFQMKIGKKWIMARFPRAVFWGEAGGSRLGDGVSGVLGFLFLLLPISSDVRIDPF

SEQ ID NO: 940006 - protein, 120 aa, Homo sapiens
MWLLADCGNPQHRSTCEDPLFVTNVDDTRLDDIAAWTYRAPVEDQARLGFAIAHALDNSAPAVDGIEPELQSKIDVIVQALGAKKPLIISGTNGGSLEVIQAAANVESPERSRALTSVSP

SEQ ID NO: 940007 - protein, 122 aa, Homo sapiens
RSISHIVGNAEGGQRATGHQHLFANVHHLVQLGRVRVEIDHIARLFRRLAGVHRHRDICLRAGSIVGAVGHRYQTTFRLILTDQCQGLRCRFEKIIDTRLRSNRGGSQTVIGGNHHRFNGHF

SEQ ID NO: 940008 - protein, 56 aa, Homo sapiens
MVPVSPLIIRADNPRDEVGFLCQPAVTVIVKIVRVKRYGYPTLRVAVPGASSGSCS

SEQ ID NO: 940009 - protein, 112 aa, Homo sapiens
DKFNQVMAGIDAAFEAGFEKVKVNTVLMRDVNHHQLDTFLNWIQHRPIQLRFIELMETGEGSELFRKHHISGQVLRDELLRRGWHQLRQRSDPAQVFCHPDYVGEIGLIMPY

SEQ ID NO: 940010 - protein, 92 aa, Homo sapiens
NSARARDDVDAFNFIRTIAVARIMMPTSYVRLAGREQMNEQTQAMCFMAGANSIFYGCKLLTTPNPEEDKDLQLFRKLGLNPQQTAVLAGGA

SEQ ID NO: 940011 - protein, 108 aa, Homo sapiens
EISRGQFENAFNSENRMQQQLGDQYSELAANEGYMKTLRQQVLNRLIDEALLDQYARLKLGISDEQVKQAIATPAFQVDGKFDNSRYNGILNQMGMTADQYGQALRNQ

SEQ ID NO: 940012 - protein, 122 aa, Homo sapiens
QGIHTKQGGRTVEHLATVDRSRLFVAVIAIYLSLAEQSGFFTLPLVPKIPPAQAERKIERPPGFAGNKIFRIKQPRTADIPRTNRHLRQPVTLFPQTQFEDLGFIFIRLIARERGRLVTCRV

SEQ ID NO: 940013 - protein, 105 aa, Homo sapiens
GLQTANEKSMKHESCQTLQPEAQKKAEAAAAALKKKAEGSEAAAAEARKKAATEAAEKAKAEAEKKAAAEKAAADKKAAAEKAAADKKAAEAAEKAAADKKAAAE

SEQ ID NO: 940014 - protein, 109 aa, Homo sapiens
MLNAPGISTIGVVCGDLTGKPAPYVGPQDVLAIIGAVFKNGYVKNKVMVFVGPGVQALSTDFRNSVDVMTTETCLSSVWQTDEEVHNLALHGRGQDYLNPQPNGYYDVC

SEQ ID NO: 940015 - protein, 87 aa, Homo sapiens
PVVASYSEQCGAYVSLTAKYPIGEHVVLMASAGYSELPEEITDPMIDRNESFTFVTGAELAFLIHRWMSVRLLRRNATKVVTLDLLC

SEQ ID NO: 940016 - protein, 108 aa, Homo sapiens
MSETITGELPNLREKVVWGEISPFRPFCSKRCQLIDLENGLLKKNESPAVAIFPKAMTGAKNQSSICLMPHVGLIRRGQRRNQASCANGCGVNALSLQKQNLSMMLEI

SEQ ID NO: 940017 - protein, 73 aa, Homo sapiens
RFPRVLSQPQVRALPGRGELINIPPLMVELKKHKPNFDVPETALRFAGHFLEPYPLPSWVKNYSEVSLQKINI

SEQ ID NO: 940018 - protein, 76 aa, Homo sapiens
KAFLGDPSAFGGAAPVGVAPPTAPVVAAAPAKVEPKEKSEESAEDMGFGLFDYSPKSNPLSPFFLPTKEIKASFFL

SEQ ID NO: 940019 - protein, 113 aa, Homo sapiens
MVECSDSTVGFSQYGSDCSGQRCFTMVNVADSTDVNVRFCTFKLFFRHRLSLYDTDKSVISPHQPGNMPDLLNAIKEGKNREEKRSGADRQIRTADLTLTKGALYQLELIIQH

SEQ ID NO: 940020 - protein, 119 aa, Homo sapiens
DELHLQTLTQFKQRGDRTSIQSRCFIEEQQAARRDIFTAQASRFIFPALYHHHQNRQYRYQSPHRSTMHQTLRAAIGTTVNLNFHFQIVAVIQQFFTDGLRRPHYQSAGLRRLIQFLPV

SEQ ID NO: 940021 - protein, 121 aa, Homo sapiens
IIASGELLMTFAPPRFEIEHCAVAHREQFFPAGFAQHAVTVHQTGEMAQLRIVFDSSKQRHHKRQLGRGFTATHRYPFDKQHCFAVMAKHFGHHGLRHGVGMLRALQVGTLFANPQFHTIL

SEQ ID NO: 940022 - protein, 95 aa, Homo sapiens
IFGLANPDDVRNICDAKGNSFVDAMKVCGFTLPAPLTRQAIIFVELHIEQGCVLESNGQSIVVNAIVGQRRYTVNVRRIKPCRHHADGVIRRDTD

SEQ ID NO: 940023 - protein, 132 aa, Homo sapiens
LVPECWQCPGQKPCFPTPLALKFLGPVSPPPPPRRKPGKGPVIFGPCFLLTPPHFCERVGPGQRLFKFCLALFGKSPLSPLKAFFPPFGGAFGVLLFLVPVLSPLRLGPPPDSPPWGKAWPPPGFPKVPLFP

SEQ ID NO: 940024 - protein, 98 aa, Homo sapiens
LAVTSSTTKSSYGWARIHRNNDSSSCSTASSLKKANARASSRHSSGCGGCPPHLAQSQSRYVPKACSAHGRTVPANGNRYCPYRTIPGRCVLRGRRYA

SEQ ID NO: 940025 - protein, 151 aa, Homo sapiens
RNPVKHGGSRLYGVSFCQEPRGGPLGGQMGGQAHPRQPPRGGALSLGAVPTGSPQVCPASQKGRPFSFNRGRGRPGRPPVLTTAPALCRVGLPCLPSQRLPFGLSFGQREPFGGPACFFWFWGGGGGGGRAPPPPWFFFPAKGKKVLFPFL

SEQ ID NO: 940026 - protein, 236 aa, Homo sapiens
GLPPEILPRCGRGGPDLPGFHRFSVTQVFFPSLGGCFCDPASFRHLRRWEGVGGTFPVGRFALALVPRARFRFKKNPGGPGCFLVPPSAPPGWKFYPFPPPEDFWTGAVGPFLPSGAPPKGGAPPPLFFSPGPGFRFGFPLTPFFKPGGQPPPRGVSFGVSPKRVERGGFPPFFFSPLGPKGGFSRKGISGVFFFGGRGAQPKFSPPGGGVSFPNFTPPWSFFFGPPAPNKTPFFF

SEQ ID NO: 940027 - protein, 121 aa, Homo sapiens
FPWLKFSIGFITLVFLILRKDFSHSSAAAGTIFAFSFTTLLFYSTYGALYLSEGFNPRIESLMTAFYFIETMSTVGYGDIVPVFLNQHDCSLFRSLFPALPFFATSMIFGSGYPRGGRYPN

SEQ ID NO: 940028 - protein, 82 aa, Homo sapiens
RHERTETLQKLCPGGQLPFLYGTEVTTDTNKIEFLEAVLCPPRYPKLAALNPSNTAGLDIFAKFAYIKISIPALNDNLVKGS

SEQ ID NO: 940029 - protein, 122 aa, Homo sapiens
SGTSINGNSVNALPELKNSKAIYNQQKAPTVVGPVGIYNPSADAIKLFTKEPLKPATSTITLYITDPTISSHHRSSTMNPPPHTQPGQPQPRYYYILATKPSRLLNPMIRVSIKLKTAMIGL

SEQ ID NO: 940030 - protein, 127 aa, Homo sapiens
RVRSLWPNPNLQYFIHDKISNDSKWREVQIIFSGHEVPGEGEHKIMNFIRHLKSKDFNQNTRHCIYGLDADLIMLGLSTHGPHFALLREEVTFGRRNSEKKSLEHPNFYLLHLSLLREYMELEFLPG

SEQ ID NO: 940031 - protein, 32 aa, Homo sapiens
SAPFPPGPRAKDARPPPSPCLPVPENKVLLDF

SEQ ID NO: 940032 - protein, 78 aa, Homo sapiens
KESSSSDSSSSSSSDSESEKEESNDKKRKSEDAEEEEDEESSNKPKNEETEEPATIFVGRLSWSIDDEWLKKEFLQPG

SEQ ID NO: 940033 - protein, 166 aa, Homo sapiens
LLSFKRKDGLGARHRFPFRDLGFPTQEAWESFLLRLYNCSGPLSTASNLFRGVFVVVKKVVALVPSIQALFKQFPSFFLFFLKVFFFFFQFGAPRGGKEEFSPPKLFLPPFFKLKFFHPLFPFRFRGPPLSPSLIFFLPALFRPISSPFWGFFPNFFFVFFPWVFF

SEQ ID NO: 940034 - protein, 72 aa, Homo sapiens
IYEVDKQDCRQFCPTGIDGAMTIWDFKTPEFSIQGLLDNVKLSEPPPSSMTNCGRPQLFRGTMARKPAPRKP

SEQ ID NO: 940035 - protein, 95 aa, Homo sapiens
RNQHIMIYLGAGHHNKINWAMEDKQEMVDIITVYPGAPKGPGLVVSPKDYSPKYRFLGAAQFARINVVEPLLYGNVFSYLKAFGKYRKLQGWSPF

SEQ ID NO: 940036 - protein, 63 aa, Homo sapiens
MEFRPVGVPKKNPPKNPPKGRNGPPPRAGMTAFFLLGSWAFSEFFPMPINLDLHLLIKTPATP

SEQ ID NO: 940037 - protein, 137 aa, Homo sapiens
MLGVRLGPTSAKIPFLLLFTGGNLTFFPQHFLGPIRNAPTLLGPQAYPPWNPLSFGGSFISLTAGIFIIFLVWEALASKRKVLMVEEPPLNLGGVYGGPPPLPPFEGPGFIKFCPKREGSDPPKLVSSPPPGPPGFF

SEQ ID NO: 940038 - protein, 113 aa, Homo sapiens
KSGTLSGRSSPVPPPLEELALTKLVTLRCLAPGFSPKDVLVSWLQGFQEFPREKFLIWAFRQEPNQGPPPFFLTSILGVATQVVKKGDPFFCMVGPKALPLAFSQKTIGRLGG

SEQ ID NO: 940039 - protein, 34 aa, Homo sapiens
MACTYLIAAVLSGDPRGRSPCCGGNVVVIGAGGS

SEQ ID NO: 940040 - protein, 130 aa, Homo sapiens
GGQRPRFFYEVFCLGHPQGTANPPNWDGFLGGGASLKPNFVGIINAKTMSPILLPPPSCQGRGIPAQKPSDCPFPAYAFDGVICSLLWPHPNCIFLCLYFPPVMVGARPIPFPLSIMVGTKRPQGGFSLA

SEQ ID NO: 940041 - protein, 88 aa, Homo sapiens
EWSFQNSGGARGRGKNFPPMFSLCVLGISKRNVFFQPVAELKKQTDFEHRIPKEQWWVKRPLMKILAKYKAYYVSDSGQLEHVQPWSV

SEQ ID NO: 940042 - protein, 104 aa, Homo sapiens
PFKVPVINIPTNPPADHVVWSLFNTLFLNWGCVGFIAFAHSVKSRDRKMVGVGAQAYASPPKGLNIWALILGILMTLGFILLLGFGSVAVSPILFPIIQEKRGF

SEQ ID NO: 940043 - protein, 99 aa, Homo sapiens
PRPNLAKNPFYHIHRGKFNFFPPTLFRPIRKAPTLLGPRCKPHMKHPIIWRVIHFFNSRKIKNFHDLKSLRFERKSPKSKKTPHKPGGAIWMPPPLPPI

SEQ ID NO: 940044 - protein, 87 aa, Homo sapiens
IGEDDIWRGLQPLPSFLKAKVSVAKGTGKTKGSGFVSFKDPYGGPMGEINGKYVGSPPIKLRKSMWKARNLEGVPKNQKEKKKRGLK

SEQ ID NO: 940045 - protein, 143 aa, Homo sapiens
FVIKGYYANPYAVRARAPYISIGTTLATGATNDLARFACHSPIDFSLPCIISFICESFSFFALLACAATIGIFFSFAFRSTFRSFLRSLSLFHNYNYLDRHRLSSQTLAVLTGMHIRSHLFFYISISHFEGIGGNELQIVYSV

SEQ ID NO: 940046 - protein, 62 aa, Homo sapiens
MIFLVTVAIIVVVTIIIAVPRHVVVAIVFIINVNQNNKPIYAVVVQFRVGVRTAGRTVEEKC

SEQ ID NO: 940047 - protein, 104 aa, Homo sapiens
IRESPFCSVYQKKTHLKMNSQQQKQPCTPPPQPQQQQVKQPCQPPPQEPCIPKTKEPCQPKVPEPCHPKVPEPCQPKIPAPAQQKTKQKYVVHSHALEELATGY

SEQ ID NO: 940048 - protein, 194 aa, Homo sapiens
LDYQERIHVHIITTCNTSTCASVPIPPAPSTTPNPVITISRVPAPCNRIRITQPTVLFESCIIRPCMPIRHRAKFNITRTRGKCTIKYSISEWVLSHNACMSNLMYPCTRYCREFPYTPSRAPPYAADRALSNRNRVHSRTQALMRRFEQDFDLINTHNGGGSKLQKKTFPSRGSTVDVPKEGRNLDMGVGLRG

SEQ ID NO: 940049 - protein, 134 aa, Homo sapiens
IKAYYRLRHIPPGEIVVHRITSSSPASQPPIISIIISVVGAAFPPMRLPGISKGSPSPITPAIIIVHLAISKVNQTSGRGRPRFRNHTNPPFTPGVFIREGGEQQPQAPPLPPPAQSSNGGTSRCTRVGGWDGV

SEQ ID NO: 940050 - protein, 41 aa, Homo sapiens
MARTTAAIPTPYALSSYGIAIVFDNRFGGDNKKKCKESVEK

SEQ ID NO: 940051 - protein, 118 aa, Homo sapiens
PRLDYRITARFPSIPSGHLPCHHQRRHWYVIAAQSIIPMPIFDYMGGHNCGGRDTQEFVKDRSPSIIVSFDPRVSLGRPQIRSTSHCHHVMYSHLSIRVECPWLLEPYRHIMWHTAWS

SEQ ID NO: 940052 - protein, 74 aa, Homo sapiens
LLPVIKDYYHSKSIIVPRNPVIRPGGPRMTVEKWCSNSSARAFVFATPATAASATIVVPCRFRTFAKHSVYCPG

SEQ ID NO: 940053 - protein, 84 aa, Homo sapiens
MQVNYCFRSSDRTSTKTVNTSNHGCNNGKCRDYLQFSFIISLFRGGVVFDGNFVVTFCIRAQILFHDTAGITSCRKKILSPYKK

SEQ ID NO: 940054 - protein, 110 aa, Homo sapiens
MGLKQKVFHICCLINGIGGPGIKRRQGWASGPFKAFEAGQTTQGQSNRINAEQGFRVTLTVRWINAEVLGMKIKVRSAETHEKGKSGNISAKGDRGPRSVGPKYFQVQEE

SEQ ID NO: 940055 - protein, 129 aa, Homo sapiens
NPGVFGDEILMAIYPARQCCKPGEAQFAFPIPYEQATLLEKNKNIELMASPSIMQRYISMNVTQKPFDEPEVRELNYAINLSRALESCLLRAYANGSYVWVPAKYRLTGQKIKPVGLTSGKPRGIYLEK

SEQ ID NO: 940056 - protein, 100 aa, Homo sapiens
NSARGNPEIPAPGEEHWLLDTSLNVFGRQSLKSNPQLSFATRMEDWTFLGQHKRHPEFPVVTRESRRNSRKTTCFPRHRKMKPFSTAQEEVPRLGIGRFG

SEQ ID NO: 940057 - protein, 81 aa, Homo sapiens
NSRATPSLNLQWPCTWDNVKHLRCGPTGSACSGLDHSSILIYHIVPAADIRSDSLLISRALTWHQMSVCITGVLALQPEEP

SEQ ID NO: 940058 - protein, 94 aa, Homo sapiens
IRHEPSVITWIMHCFVSKHALIMCREPGRPSTLDKVHEEGCSYANASSLRGPPGYSRASPPQKNQSLPTVLLCALTSDFTGGYPPPSHSLCQRV

SEQ ID NO: 940059 - protein, 77 aa, Homo sapiens
EFGTSTGLIRCDRLNPSRQSSGVEPPVQIRRGDRAQRRGCRKTSVFLSKETRISGNFVGRIKGTKCPFDLQFLTWDF

SEQ ID NO: 940060 - protein, 95 aa, Homo sapiens
IGHERHELLVYANFDFFFDFFCDLLVIQQRVVQPPYVGIFNSFSPVIEISSYCIVVRKNAWNDFYFFEFTKASFMAQDVIFLEKVPCALEKKVKF

SEQ ID NO: 940061 - protein, 96 aa, Homo sapiens
PEYKAAFKALKVRQRLTIQMNFIAFFCSWYLFVLGLWKAIVLLLGILSLFVGALIGVNILGIAVAAYVAVNTNKWFYEEVKGLKYLEPLNNRWLSQ

SEQ ID NO: 940062 - protein, 70 aa, Homo sapiens
THNRKILLLNYVAQIQFSNGFTENARLQQLDLRCRLGRGVRDHIAQAAENGVALFLLNLDQSICLINWCA

SEQ ID NO: 940063 - protein, 67 aa, Homo sapiens
MRTRRRGKIILLRRAGTNQHINVNGVDQLTCGRHQFAPEVLVVTTNHQIHIVFLDCIDQNLAQVAAA

SEQ ID NO: 940064 - protein, 86 aa, Homo sapiens
LQEFGTSSCCPHHPHPSTPEPSSGDPLTADEWTLWLVLNFLSSPALLFCRLIPVHFLVVRAQAQKTQPKAQILGSPPASSVRGFPP

SEQ ID NO: 940065 - protein, 79 aa, Homo sapiens
MEFGTRSCVTTVGPGCFLTLSVTWIGAAPLILSRIVGGWECEKHSQPWQVLVASRGRAVGGVLVHPQWVLAAHCIRNKS

SEQ ID NO: 940066 - protein, 65 aa, Homo sapiens
EFWNEKKLKKKGKEKAEEQQVVDPETGRTRLIKGDGELEEIVTKERHEINKMPSWVASLRAPAGQ

SEQ ID NO: 940067 - protein, 109 aa, Homo sapiens
GIRHEGAADVLGSPGAAPCLTTRGEAAISSGHGFTSPEGTCELECSLSTGMGLIEVHSPPIASILLSLSLKSRKSLSWCSKQFEAQSARTFLKGHVVLQTTLSSGLNSP

SEQ ID NO: 940068 - protein, 47 aa, Homo sapiens
ADRIPRVNYPGVRRKTFRSTSVTKAEGGYPGPFLVIPFHERNKRLCL

SEQ ID NO: 940069 - protein, 77 aa, Homo sapiens
CRPRGSEQYSDVQHTGTNPPKYPSKQVGQPFQLSTPQPLPHPYHGAILDRGVGVMEQVYCACPVLGASLSQQWEVGP

SEQ ID NO: 940070 - protein, 43 aa, Homo sapiens
MDEDKFELWAFSSGEYEYPDQETNNSTLFDSVCFLNKAPMRWK

SEQ ID NO: 940071 - protein, 68 aa, Homo sapiens
KRARHRTPECYVCTDCGTNLKQKGHFFVEDQIYCEKHARERVTPPEGYKVVVFPKGASRFDHCFPAGL

SEQ ID NO: 940072 - protein, 84 aa, Homo sapiens
YILEVRIGELNAAGPIYKGNRVSYVKAFMKKSEEEISTDYLRDQVSCVHSCLNAGSRIVCLASINLELQDKSPCLLSSSIKLSF

SEQ ID NO: 940073 - protein, 72 aa, Homo sapiens
EQRKPEPAGELLTGEGEAHGLVRFRLNSFIATCNNLTGLGTGRNNLGFGLKLSLFQILEEFYIYKDGTINLF

SEQ ID NO: 940074 - protein, 103 aa, Homo sapiens
PPRGRVLGSPPRGGGVPFFGPPQGKPPGVGFFFPGFFSKKKGFPPPPGFWKGKGGVFFFWGGGIPPLGGGPLFFFPPPPPGGLGGFPLLGKGPKKNPRGGGFF

SEQ ID NO: 940075 - protein, 137 aa, Homo sapiens
DIFASQASAAWPGPAPRGENFRPISIHRGMAQEERLSRYHQFKDFQRRILVATNLFGRGMDIERVNIVFNYDMPEDSDPYLHRVGRAGCFGPKGLTIPFVFDENDAKILNDVQGRFEVNVAELPKEIDISPYIEQSR

SEQ ID NO: 940076 - protein, 88 aa, Homo sapiens
RPPADPVSHHHGTRDPRDNGSRSGALPYNGRLLEKVEKRGLEKRRPPKEEEEKAYYPPAPPPYLETLQGSQKGRLKKNLALSRESLVV

SEQ ID NO: 940077 - protein, 104 aa, Homo sapiens
SPFRPTCSGLRGPAPNFSFFPGSPRPPKRGTVFFKNLNWPPRWPGRFCPSGTFFKRGKPGSSLRKRRILKPLLVSVWAGPPPGFLAFGQKKPREPPTRVFKKKN

SEQ ID NO: 940078 - protein, 125 aa, Homo sapiens
QARVVVRGSPPPPPCPFLLGKDPLVPTPQKPMSLEVPLVCIDPTRLPEAPALCSPRRRPFEVLVGWAQRPSRRLEASPCISFPPPLWACLWFFSLPLWRQALCGVFSLVLGPRGGWSPFPGPNTF

SEQ ID NO: 940079 - protein, 86 aa, Homo sapiens
LVGGASEQNPTSEQDMEDFPSQSELLYSIDPITWPTEQVSLGITAPSYFKVHINNRVFDLDVGSGHPHGATAIKGLFVQRLKSYVI

SEQ ID NO: 940080 - protein, 118 aa, Homo sapiens
PPGAYMETLSLSGALALEFTKGHQRPGAYPFFGQPSAPEPTPALAPMAPLLATDCALNTAFAWGSGASHLITILGVKPHANRIAFDFQRGNDVAFPFYPRFNENHRRVLVCHTKLDNN

SEQ ID NO: 940081 - protein, 90 aa, Homo sapiens
TNIVGLLLERDVDINIIDWNGGTPLLYVRGNHVKCVEALLARGADLTTETDFGYTPMDLSVALGYRKVQQVIENHILKLFQSNLVPPDPE

SEQ ID NO: 940082 - protein, 92 aa, Homo sapiens
MVLSPRVRRQDFLLLFLVVFVDFIDTLSFLHVVGQFPGFLGHTAPGRRHRRGSGEVVVSTTKTQLYLARFPGCGLDPPHHEQTLTLDVLLVP

SEQ ID NO: 940083 - protein, 53 aa, Homo sapiens
PTWTLSLYEGWMNFRPDTSRKTRKETLIRYSTPPFSTNDCFWKLSRSPVRSSF

SEQ ID NO: 940084 - protein, 157 aa, Homo sapiens
EGVKGKKLKTFPEPKKKPFSSKATWIKKPNPFTHIPPLLEQQMVWYPQDLTDGAPTVSKGFFRQTDLGTWKYLLDDLGFMEKREAEKVEEAGSGDLRFPAEEHCFEDGMAQQPPSREKSFEWEEFYPGPHDGSQHIKGFSPQKDAMEDFRRDLARAE

SEQ ID NO: 940085 - protein, 86 aa, Homo sapiens
MGLTSFLDMQSPCPGILLMQGVFMFLGVSGRLGKGKGEPVLPSSPLVDALSHTPWEFKGPEVVRGCTPFNNKVCGPKLPTLIAIKV

SEQ ID NO: 940086 - protein, 61 aa, Homo sapiens
GCEFGTWNEWRGSLKSVAVQLGKANLSPCFWPKRNRMLSSVLLAVCVFMNTMSRRGWQPPA

SEQ ID NO: 940087 - protein, 84 aa, Homo sapiens
AFLTGVTEPLEFLMFLAPLLYLLHALLTGISLFATLLGIHAGFFSAGAIDYALMYNLPAASQNVWMLLVMGVIFFAIYFVVFSL

SEQ ID NO: 940088 - protein, 111 aa, Homo sapiens
SPIRIVDDICHLNPPSTARLLHTVFVDLHFFIDAIAHMHDLTVINARTRRIDTNKAPFAFCGIENALTVGYQATKCNDPTDLPTHDTTNFDCVVKRDHREIGGNVIDLAYI

SEQ ID NO: 940089 - protein, 52 aa, Homo sapiens
MAGAPPPASLPCSLILDCCASNQPDSVGVGPSKPVGYNLMPVFKPIGKHSIR

SEQ ID NO: 940090 - protein, 108 aa, Homo sapiens
SARRIHAHGLLELEYEGFYEGILRYEEEDAVIDEEGKVITRGLEIVRRDWSEIKETQARVLETILKHGDVEEAVRIVKEVIQLANYEIPPEKLQFIEQLTPLHEYKGR

SEQ ID NO: 940091 - protein, 101 aa, Homo sapiens
GKKFPLLCPPGGECKDSLSVQGNLVPPRKIVVNPGGKGNRDLRGSRQCALSSRVHQSREPQSLQNKKKKFLLACTHRGQTSFFSRPLLIKDFTLVYYYRYT

SEQ ID NO: 940092 - protein, 85 aa, Homo sapiens
AAVQWCNLSSLQPPPPGLKPSSHFKRRKCPQPSGVLLEISRKPYSIVKSAVSLSGSSSYGEASSRYIYIHTCIYIYLRIYIYVYI

SEQ ID NO: 940093 - protein, 211 aa, Homo sapiens
VVGFQGAVGATPNIRAPPFCPLAGATPLHPPLGLVPPRALAWARFPQGPFPRSRFMQGRCPPGQPLFGDPPNHFLFLSPPPEGTTEVILSLLFNQFPGFKEGRLGPGRHNLPFGGFPIRARQGPLPIPPRGFRFPRTTPLSFPLPKRRPFFPQGGPFPCFGGPPFPLGSAPLRLVPPWGPFWNRVWVGGSPPPLVPRFVPPPCPRGCLAGI

SEQ ID NO: 940094 - protein, 135 aa, Homo sapiens
PPPPQEKKRISPPGEGGGFGGPPPPRGAPKFPPVLGEGSPARFFIFPTKKGGGGVCFPGVPPAPPIWGVFFFPPGGGGRGFFSTPGPPFGKGAPPPKGGGLPRGPPPKGGGRGGPGGFSPPPPPGGGPPGIRFPL

SEQ ID NO: 940095 - protein, 88 aa, Homo sapiens
ISTTTGRNLVFGWWGMVPHPKYLGALIRARGGSLPGGGSHLVPYFTLLYFPGLGPREARDKRQCLKKYGLAWQENCGGVPFRIMPYIY

SEQ ID NO: 940096 - protein, 143 aa, Homo sapiens
WVSLPPFGGGEGGGVGGTPGGLGPAPPGFYAPREGFFFGVRGTPPPGKRPLSHQFVPLWAGGFVGASPFPPPEGGGVCPPHPPPPNGGFCSPFFPKIPRVGGVVLGGEKKPPPPPGGGGGRPPLFFFFFFFKGGRPGPPGGGG

SEQ ID NO: 940097 - protein, 144 aa, Homo sapiens
MRVEPPAKKQPPQQRDARDDDIALFGSDNKEEDKEAAHLRERLRQYPEKAKKPALVAKSSILLDVNPWDNYTDMAQLEACVRSIQLDGLVWGASKLGPVGYGIRKLQIQCVVEAHKVGTNFLEEEIPKFEEHVQRVDIPAFNKI

SEQ ID NO: 940098 - protein, 102 aa, Homo sapiens
QGRKKRGPHGPLKEGGQGGRLDSKRKNVGAPLALMGMQIRPHTPPPRSLFFLSFHQKDVFEFILEFRCFARCCDRYAPNPAHSLFEDTSERSHSFFWGIYTP

SEQ ID NO: 940099 - protein, 171 aa, Homo sapiens
MLNTSSVLEQLIDKFNWVSRLADLTQGVDQYYLRVTTVASLTSDSDVPSGVTEVVVKLFDSDPLTGTVPVEVSRENPKFMETVAEKALQEFRKKPREEEMWMLLLHQRGHFESSSPRDELQPPRESFARHQVARPQPPGPPLRPASPRFGSCPLTLASAAHGKNRIAPACN

SEQ ID NO: 940100 - protein, 118 aa, Homo sapiens
NVVQAHARQHEEEAVLQHLCVLFVLLLPQTGAPVASRCVAGTSTVRWGVSSICVFGGQTCHGLWLVKAFVATGPQLVIIAAAALLTAEHTVCLAQLHKAAVQAWVHRVPVWVQLFERG

SEQ ID NO: 940101 - protein, 109 aa, Homo sapiens
PYRPCHWPWSLCIFVLVGKTISLPWSAQVCFRHFSRRFPKGRAKNGGWPLVSTLLLPQPFGVPPCPQKMLTQWGLPPPGPKVTKLQPPCFLLPGVALGMERGGIKPVPL

SEQ ID NO: 940102 - protein, 30 aa, Homo sapiens
RPPTPRQPGKGREETSPPPTRTKNKGFCAS

SEQ ID NO: 940103 - protein, 162 aa, Homo sapiens
APVRQQSKREALWGPGEKKAAAKGTSNERDHLSFEQELTVPTLVENKKAQLVVIAHHVDPIELVVFLPALCRKMGVPCIIKGKARLGRLVHRKTCTTVAFTQVNSEEKGALVKLVEAIRTNYNDRYDEIPRPWGGNVLGPKFVARIAKLEKAKGKELAPKLG

SEQ ID NO: 940104 - protein, 177 aa, Homo sapiens
WPAIGEPDFQALAIHRGDAQEEEGFSGISSLKIFNGEFWWRTNLFGRGMDIERVNLAFNYDMPEDSDTYLHRVARAGRFGPKGLAITFGSDENDAQILHDGQGRFEGHISELPDEIDISSYIEQTREKTRPFWNGTVCPSGEDPRGGGKETLLPPPLAAPPPWVPFFGSPPLLDPPF

SEQ ID NO: 940105 - protein, 143 aa, Homo sapiens
GPWGQIWPSVSFPPPPPGPGVGKPFSMGGTMGPGPPSFNFFFRGGNTQGWVGGGAPFCGVPFFPLQEAPPVLGVGVFPFPGLEGINPPAGFSPPPPVVWQGAPRIPRPPRGWPNPPPVAPLAPLALFFSGAPWGRGCSLNCSL

SEQ ID NO: 940106 - protein, 160 aa, Homo sapiens
RRGNGGRDSPGPLFSPLDAPGGKGWVSLTHRVGRYYLGGPWASGVLSERTPPKFGLAPSTQIGIRQGKIPKPFFGGFFQKKKVGEPRPPGGWVFPPKKKKFLSGPGQVGPKSGGPPIFPKIQGFPPVPGPPGFGVGFAEGIFPPQLGVLMFLGPYLKAGP

SEQ ID NO: 940107 - protein, 75 aa, Homo sapiens
SSESSHMVAFRKDLAPGGVMPAYLASEISPWDGVIVPPQKKAYENPPEKKEGEEEGGIPEAPPQGKEEESMETQE

SEQ ID NO: 940108 - protein, 37 aa, Homo sapiens
KQIETGPFLEAVSHLPPFFDCLGSPVLLEEKASCRKK

SEQ ID NO: 940109 - protein, 70 aa, Homo sapiens
EQIISFSTLCLYMRPDRGFGQRGKQLPRPYSRPQVHGLGSQFWAPSSGSHSILILFLHSLLGALCDTMSV

SEQ ID NO: 940110 - protein, 114 aa, Homo sapiens
SQRNKDIPNMLDVLKDMNKVKLRAIERSPGGRPIHKRKRQNSHWDPVSLISHALKQKFAFQEDDSFEKENRSWESSPFSSPETSRVSYTNVKLIFQFFSRCVVICYSLCVQGSL

SEQ ID NO: 940111 - protein, 112 aa, Homo sapiens
GVGQLCFALHHIRNRIDCKTLDANFVMKVRAGRTAGRADIADEVALLHVVARGDREAREVGVAGLHRGAMLDADVEAVARIPVGAADDAVGGGVDRGASRRGEIDPGVLAAA

SEQ ID NO: 940112 - protein, 100 aa, Homo sapiens
ICLPLVKALANSGKNQRFPETTIVPVSQASLPKGWPAGLPPAFGGQASTAFFKPRQRRPWGRWNPSIFTDALGSCRTLTVPRPFGPCPFPYNLINPFFKG

SEQ ID NO: 940113 - protein, 208 aa, Homo sapiens
LDSLPGPLHLPQDLHPRDDEMETDKQEEKEVPKCGFLPGNEKVLSLLALVKPEVWTLKEKCLLVITWIPPLIPKIEDGNDFGVPIPEKVLERVNPVQPKVEAFPTTLSKFFSERGDAVAKASQETPVMEYRALVHERDEAPYGEPRALVLDLRAFYAELYHIIRRPLEKIVHPKGEEKPSMFCTRGKKDKSSFLFCAVNPDSKPSIHQ

SEQ ID NO: 940114 - protein, 97 aa, Homo sapiens
MGGNLTFFPQPFFGLSGMPRGYSGYPDGNPPWNILSFVGSFISLTAGILIIFMVWEAFALKRKVLIVEEPPLNLGGLYGCPPPSPPFEEPGYIKFWP

SEQ ID NO: 940115 - protein, 101 aa, Homo sapiens
PPPPPPPAGGGPKKPGGGETAGGGLPTTPRGKKGPRPNWGPQFLGFRTKRKGKGIPLPLPPPWVGTPPKAKPALGPPNQGWGDPPPPPPGPKIFSLKNVLG

SEQ ID NO: 940116 - protein, 143 aa, Homo sapiens
GPTEPVVFGNLWRPPLFSPGEGPLQGGFCAGPKSVSPERGLFFGVCPSQGWFSPQIEAGAPPKKGAFLGFLWGGHHPRVWFSKERRRAPDFWVGGLFPPPNGGGPPGGAPKFTPGGFFSPPPWGGRPPKKCPPHPRFFFGGGP

SEQ ID NO: 940117 - protein, 166 aa, Homo sapiens
MPFVFPPCHVSVGALPSRLENLPQYDDIKKVVNQALEGPLKGILGYNEHQVVSFDFNRDPPSSPFDGGGGIALNDPFVKLIFWFDHEFGSRHRVVGLMGHMAFQELDPLAPRPPQEPKRKRETLPVGGSLPPSVPPPPDFPLLPVSMLTPLKGGGPREPPLFLFPQ

SEQ ID NO: 940118 - protein, 172 aa, Homo sapiens
GKGPDAAAISPNQSPTSSLIWEGPPPPFFRWPFSGKVPPLAPQQISPGPRCTPIISVRMKKNNVSSPLSCPPLLSPYLQKLFGEFPIGAPPLNLRAASKESPLGEKDLGWGEPHQPVLQVTSLPPPKEGGCPLKACFASLYPPPRGLFPCLCSRGFPREIVLFLNFLKNLFF

SEQ ID NO: 940119 - protein, 112 aa, Homo sapiens
IFQEMADKCSPTLFLFNGQAAFHMAQGRWEAVQGLQEALNKDSGYPKTVNLIVLFQHLGKPPEVTNRYLFQKDAPRFHPFFKEDQAKENDFSRVGLPVRSQGLRLAQNCQDH

SEQ ID NO: 940120 - protein, 38 aa, Homo sapiens
HYGFWPGPLGAFRELRLAELGEAHRSRGLVGTRPRGQG

SEQ ID NO: 940121 - protein, 72 aa, Homo sapiens
FYHSDGLNASEGAISPHFFNDSTFKMEMFVGSIPFLAALEWMALANQLAILDALATAYGFRPDEPYYYGYGS

SEQ ID NO: 940122 - protein, 115 aa, Homo sapiens
GLYLFSGVVHNFPGTFKSFCGAPRGWPSPGATPAFKPFLSLKKPFCFKGPGARGPPPPRVFGSFKFFSGGVFFFRGFSFNPRGGDPFFFKKNPPQMGGGSFFSRFFPTQGGFPPY

SEQ ID NO: 940123 - protein, 126 aa, Homo sapiens
RWVWDRALGASPSPAPKLSWGSNFGFGGGSSSFNRPRSPRAGVVKKIQTPYGKMGFWSFVLPQGKNWGAPPRLPLLGCPKGWEGGPFSGGPWGQGTPLGVSPSPPPPWGVFFLGAPPGPAPRYKTI

SEQ ID NO: 940124 - protein, 109 aa, Homo sapiens
GKNDIVWFGCLSPPNVMLKYDPPMLEVGPSGKCLGHGDRFPHECLSALLVVMSEFLQNLVVYKGCGTSPLSLCLATWYAGCLFTFHHDCKVPEVLTRSQADVGAMSVIA

SEQ ID NO: 940125 - protein, 122 aa, Homo sapiens
KGRASGNWPWRPFGIQQRTRSSIKTPLGSYECKLCLTLPNNEGSYLAHTQGKKPQTNLARRTTKEAKEAPAQPGPEKVKVEVKKFVKIGRPGYKMTKQKDSEMGQQSLLFQIDYPECPEKKK

SEQ ID NO: 940126 - protein, 144 aa, Homo sapiens
GGWPPPGPQSLQRFGEGVGHIFRWGPQHQGWPVKEVSLPPSAPRVGGYCSHPPQLFLLFYKFRPAVCKGKGDAFLDQFRKEDIFKATFYEMARFRGVVQRPFYESPAAPQPKYFFWGPQEQYFPPPQPLFLLDGNHSLGQACSL

SEQ ID NO: 940127 - protein, 199 aa, Homo sapiens
SGPGCVLPLLNFLGLPLFPPGGPPGSPLFSISPGGVFFKPVPPLLLAAPIIFALCLGGGRKGSLFSFPPTGVFPPGPKIGCPPPFPSPGGPSPIGGFFPFPRPRERGLRFWGGFKPYSPPPPPWGGLGPFFFNPPPPGGRGPLLNLGGKVFSNGFPPPPGGGGFFWGPPRGKKNGVLGFFFPFLAPPRGGFFFLPPGPL

SEQ ID NO: 940128 - protein, 68 aa, Homo sapiens
GVGTRHKALIRIMVSRSEIDMNDIKAFYQKMYGISLCQAILDETKGDYEKILVAFVGETKHSLEGLKL

SEQ ID NO: 940129 - protein, 152 aa, Homo sapiens
MGIVKAARYLKDVAVQEQVCSVPRLQWWSWQVCAGQAVGLAQGRWPKESDEFVLQMVINAESDAEVKGLDVDCGVIEQIQVNKAPKMRRWAWRADGGINPYMSSGCRIEMIVSGKEQFVRKEEEVGQKRRVWEELQPHFFPAPAPLNSLLPR

SEQ ID NO: 940130 - protein, 144 aa, Homo sapiens
APGLVHKKVGPARVQLGEAQGAPIHQEGGPALGFSVDQEGGQVPGVLQANVQRVKEYRSKLILFPRKPSAPKKGDSFVEELKLAPQLTGPVMPVRNVYKKEKARVIPEEKKNFKAFASFRMGRANARLFGIRAKKAKEAPEQDV

SEQ ID NO: 940131 - protein, 123 aa, Homo sapiens
PNRKADDNATIRVTNLSKDTRETDLQELFRPFGSISRIYLAKDKTPGQSKGFAFISFPPREDAGGAIAGVSGFGYDPLILNVEWAKPPPTKPAAPVYSVRDPWRQKTASERAGSKGNKTAPLP

SEQ ID NO: 940132 - protein, 70 aa, Homo sapiens
PMVTRFLGPRYRELVNWVPTAYTWGPVGVGLVWATHWRLILDWGPYINGKFKKDNELPQPFTDCFGAWWC

SEQ ID NO: 940133 - protein, 220 aa, Homo sapiens
TTQAKPSLQAASGIGLSGTPARALALVEPCPYALMPAESGAGAARSAPGSPWLGDLAALLEIMLACPCSAPRGVGLVSAAAAAVAASISSKSGLSSSSSSSSSSSSSTCSETAAQTPGGPGGPEAGSKEGGQAMPPLPFLWSLPWSLAWEEGEEASGGDAKGPQSRSDKGGKPKKPPTQKKKKKKERTYPPKEKPKNNPNRNQLPQKDPEVKTNQKKKTN

SEQ ID NO: 940134 - protein, 56 aa, Homo sapiens
GPPPGGGGPPFWPWGGPPPPPHKNQIGFPGAPQGGPPPWVGPPPPGVFFHKIPGVW

SEQ ID NO: 940135 - protein, 83 aa, Homo sapiens
IVCPTVWYTQKVRPGPGFNLEELRVAGIHKKVGRTIGIFLDPRRGNKSPESLQANVQRVKEDRSKIILFPRKPSAPKKGNSFF

SEQ ID NO: 940136 - protein, 110 aa, Homo sapiens
EKLFQTKRSPETQVFPLSPFRDYVPENQASLWLVKSFFSNIPFDWENNWPPEKNFKTPPSRCGSEGLFFLLTNSPVQKKVDQGNVLSCSLMVRVLPNPFPQKNLFLFPGK

SEQ ID NO: 940137 - protein, 172 aa, Homo sapiens
GQFQPPAPLAGPPKAYHQVRKPVFWADNIEFFGGYKGKGSKGSQWFATKKFPPKPPGPCQSGLYWGMASCLCTFFVARVGQKGSIPALRSQKFIRLARGFLIKGGKLIKNNASPYYLFYKSINPLGGFVPYGEMTKFVILKSCVVGTKKRVLPLRKSLLVQKKRGGFGKNFP

SEQ ID NO: 940138 - protein, 67 aa, Homo sapiens
QVQRSFVAGPTPWPKKPSLAPQEGAEQGWSTIPNRLYTGPGGSRPGRFGAQGPKGGFGAGPPPEEGI

SEQ ID NO: 940139 - protein, 213 aa, Homo sapiens
PGNQLFGQDRCESSGGVQGKGYKGGTSGGPQKNCPQDPQGPGKRGLDGARHLLRVAFSVGAVGEKGFIPAFRSHKKFIRLARGPLQGREGQEQCLPWLPIFKKEQPPGEGLAPMGKGPKTLSFLKGGWGGPKKGGSPPPSPFWGKKKGGVWRKNDLKVIYPPPKVGPGRFPTLGGKKAFLGPLKKGRIAKEKGGLCPGPIFPGGGGPKKVFFP

SEQ ID NO: 940140 - protein, 167 aa, Homo sapiens
ALYGPRPVVITSSDLPSPQGSNFLIVLGSQRRRNPPGSVVMERIRMDICKMDPVFVGPGDLFSMLLGWTHKPPHNLKVACEKTVFSLPPVLQRAIQCAKTPAGERVRPSPIQLELRMVQSQKGIEGPKIVVQAPVLLGPPPLARYTQRVGVSVFVPVKTCNVCLKTL

SEQ ID NO: 940141 - protein, 99 aa, Homo sapiens
KRPGQNPPTVFWMEFPLTPEGPLSPGLLEPSNPKGGFCWNPPCKQAVFFFSPAPDPKALLGGPRAVSYAVGFPPPPGDIFMGFRHANTPDCPLFSNKVA

SEQ ID NO: 940142 - protein, 108 aa, Homo sapiens
WKVPLGAGGRSTGEFGNPFSPPVALECEAHFGPQHGASPGTGGHPKAQALFVSFRAPGKHNGPPWEWPFAYPPGCPGSQADWIVPCGGHPPACALQGTCGPFLKGPPK

SEQ ID NO: 940143 - protein, 72 aa, Homo sapiens
RPRTNSDNQNMLSREFQISRTEKAETKRKSPCFPKKRWNRRSKQANRNEACAANMHCTFHKHCLLILLLLAV

SEQ ID NO: 940144 - protein, 129 aa, Homo sapiens
SGPPPAQGSKNNFQFLLKFAEKQLETDHVFICFHKNRKDKTPLLRTFSFLGFEIVKPGHPLVPKKPDACFMAYTFEKKFSGKEEEKAPSGLGIRPLGPPLVNRVGKNRKLAHLAWVCPHVVIVQINAPS

SEQ ID NO: 940145 - protein, 40 aa, Homo sapiens
LGLGAKWLVHSSIYIIKVGPDFLIRPQCCSTHTKSIPVLL

SEQ ID NO: 940146 - protein, 96 aa, Homo sapiens
FMGGPWKGKPPFPAPQGVFGWGGGNFPPPVFPPPKRFFGGFRAPTPGPVWVSKGPRGSFPAVGKNPPGGPKFWKFFFGFPFPLGAPPPPGGARGPF

SEQ ID NO: 940147 - protein, 159 aa, Homo sapiens
LPQSSVSHLERSLTPYNARPQHGKKLMVRIVKHAFEINTCSQAKTLLQVLVNPIINSGPREDSPPIGGPGIFKKQAVDVSPLPRVNQAIWFLGPGAFEPFRNIKTLFEGLANELINAAKGSPNSFALKKKGELGGVAKSPPFFSPLLPNKPVCPLGRSP

SEQ ID NO: 940148 - protein, 93 aa, Homo sapiens
VLRALRLPPWGRFAVRDIRPVAVGVIKAVDKKAAGAGKVTKSAQKAQKAEMNIIPNTCPPPFNQWWKNGLRTVCFNWPFKFSSKRLVNDNHAS

SEQ ID NO: 940149 - protein, 84 aa, Homo sapiens
KKLIPFWLKGEEGPKFLKFGKPPWLKWVLASPIGLRAFQTIPLGLLFWFVFRQTVRVGVIKPVDKKVAGAGKVPKFAQKAQKGK

SEQ ID NO: 940150 - protein, 50 aa, Homo sapiens
MGFPPPPPPGQGWSWTKTSAFKSFGSKPFGVRKRGGGVLLAKKPLPGFSP

SEQ ID NO: 940151 - protein, 133 aa, Homo sapiens
MGFEVSFLKFLEESAVKQKKNTKGHPNSGNKKGSHSNSRKNIDKAAVSGNHVCPCKKNETFVQFANPSQVQGRDNVKIVLNKNFKNCPELVLKQLQEMKPPVSLKKLEGHSNGPKMFVMKNISIGKAPGKGQL

SEQ ID NO: 940152 - protein, 111 aa, Homo sapiens
LGGLGGEGIQIGVGGGGDQFRIPPPGVRARGGWPPLYPKVPRGDFYGGWDWRLYKVFLEGRGRGWNLLVPPVPPGVVNPPPPLFLFFKGLLVFLNLASKGPFFCPIKIGNA

SEQ ID NO: 940153 - protein, 140 aa, Homo sapiens
WVGQPGHFIPAPPPWGGGEGPGSNPNPGRILFVRLGPLRHHHGNGLYNMGEPFSATDPKAIGHRNFHAGYSMVGAGLTVGLSNLFCGVCVGIVGSGAALADAQNPSLFVKILIVEIFGSAIGLFGVIVAILQTSRVKMGD

SEQ ID NO: 940154 - protein, 173 aa, Homo sapiens
PTTRRFVLGAPPPPPERVVCVFSLFGAAKNFLKRGGGPFFSALLWGGVVWGVFPPGGVFFITPLFVVPPAGGVFNFGVFLPPRGGGRPPRVVFYPGPGSWRGVLFFVVFFPPPPPFFFPPRGSSPNIVGPPSPKKGGGGVFFFFFFLGAGTPPPPPFFFFFWGGGEGPRFPPP

SEQ ID NO: 940155 - protein, 163 aa, Homo sapiens
PAMWLGHWWGLGLLRWAFLARFGGPSPAFLGLSVDRSGEPKAVLFARLEAWNNQGFLDGVVPPVLAWGSGAAAGGWAISGPKGSLSLVRLWFGFPVSFLVEPFLGPVGLGGGGVGLNVPASSSSPGRCLGFVGVWSFLAPPGGPVLLFCPCLFWRSLSLPPYF

SEQ ID NO: 940156 - protein, 109 aa, Homo sapiens
SGRCSHFSLLEQLKSSFNGWPAGKLTQGEEQYISGSPGGFHNFESVLSGVTKVVVKLFYSDPNTVGPVEVSRKNPKFMEAVAEKALPEYRKKPREELNVDFAFAPTGGF

SEQ ID NO: 940157 - protein, 145 aa, Homo sapiens
SAAGKEDVASKRPRVLRAGVNSVSSLVENKKAQLVVIARDVDPILVVFLRALCRKMGVPFCLIKGKARLVRLVRRKTCPPVAFTQVNSEDKGALAKLVEAISPTPISDTMSSSVTGVALFWVFEFVARIAKLKKAGGKELATKMG

SEQ ID NO: 940158 - protein, 83 aa, Homo sapiens
PRVPVTPWKQTVFYMEDYLPVKTGEEIFGPLGIRPNAKNNRGLGFPLDLGFKGQLCELSCSPDYRMGLGPAFPPCTSPGGEGF

SEQ ID NO: 940159 - protein, 116 aa, Homo sapiens
GGGFGWFVSAAPIPPHFLWGGPPPPPLFSFLPVFLTIRGSFPLLGAARLGAKVNGLVPHPAVSFPGRLGPPNWFSFSLLPGGGRPFFSRPGGGGVLVCGLLVLWRNNPGTKLFFWF

SEQ ID NO: 940160 - protein, 86 aa, Homo sapiens
ARGSPFGWACPLGLKVSFPLGVGGPGGYGFLFPPPQVFPPGRVSWVGVFPLLGPPLGPPFSPFPFPPFLSPPLAPSWGPPWVLGDP

SEQ ID NO: 940161 - protein, 39 aa, Homo sapiens
VSCPSFRPHKDFLEGLPIIIFREVLTRLRPKLIAFPPQP

SEQ ID NO: 940162 - protein, 168 aa, Homo sapiens
MFNFSAEKLSSWGLVMKYLGMATPFFFLPDGGKIKDWRNGLTPIIIPKVLENEDRRSASFILPQLSISGTYDLKSVLGQLGITKVFNNGADLSGVTEEAPLKLFKAVHKAVLTIDEKGTGAAGAMFLKAIPMFIPPEVKFNKPFVFLMIEQKTKFPLFMGKVVDPPQK

SEQ ID NO: 940163 - protein, 80 aa, Homo sapiens
VTAPGMPHSQEPAGLGSARPPAMLVATPACIPTDADRCSVQDRHSESQPGLRGAGTLQSLGESPAPPHQILTEETATESP

SEQ ID NO: 940164 - protein, 44 aa, Homo sapiens
GTGFKPKAKQENGERTGGVPLIKAPKKETPDENGETQKADDFVL

SEQ ID NO: 940165 - protein, 122 aa, Homo sapiens
AFGARGPFPPKCGGGPQAPQNPQVGLGKPGFPLPRGGEGAPPGAKAPGGGGVRPPPQQGGVGGGPPPRGLGGPGVGVPAPGLLGAPPFPLTPRGGGGPGLGPGKPGTVGLGPGPEPGIFFFP

SEQ ID NO: 940166 - protein, 138 aa, Homo sapiens
MPEKWVPGWQCSPVPQNPGVSFCPPQESHLLGTLGGGQGLKAPREGPLPGLFPQEEGKGLCVPPQRKRALVLGSNPPFCVFPPKWKVPKVPFLFPFLPPGRALPPPPPEAPPPPWGVFRSFGQGGHFFPRGENFPLRA

SEQ ID NO: 940167 - protein, 102 aa, Homo sapiens
NPTSPLGPVWQFTTLKGQARALSLWPRVKTSVLWKNTKGPAGPGSEKREARVTCPPPTSESRSIEPCQRREKGGCRFLFLGHGEPQDLCTLFLTPWLGLRPV

SEQ ID NO: 940168 - protein, 35 aa, Homo sapiens
RLNLPKCWDYRHEPLYLVFIKFLTQFMPLPPSVVF

SEQ ID NO: 940169 - protein, 103 aa, Homo sapiens
PPPPPKNGPRAKPPPGFPRGGGPPLFSPGPQGGAPPPPPGPPWGAGALLTQMGGPPSPPFFFQGGPRAPLGGGGWAPWVSLYFFTFFFFLGGGFIKEKTLFFF

SEQ ID NO: 940170 - protein, 102 aa, Homo sapiens
PLSPKKYVPGPQCLAPGPRPVFCPSILAVSQKEWKPGEPYPWVVAHKALPNRVPKRAVDKSPGEPPLYKVSLVMFDKMAPVIYPFGLPPGLGGVAPLCGQPN

SEQ ID NO: 940171 - protein, 74 aa, Homo sapiens
GPGPWGPPPPHGPGPWGPPPGHGPGPPPRVPILEEVKKNGPQDGKPEKIAQLPWNGAYNPNFFFLINSPLGAPF

SEQ ID NO: 940172 - protein, 69 aa, Homo sapiens
NKLLLLAKCLAQQALDLVLNLAKTLAILHCVAQPLLLALFCQQGTRNLLPFLPLPEGWFFHLDTPGSKS

SEQ ID NO: 940173 - protein, 110 aa, Homo sapiens
IRAKRERIDLPPLLFVVWGGETSATIIFIISRGSRGHCAPFSGGGYTGVVGGASLGKGCFSPARPKGRSGNFLSSLLEGGPTGIVLGAYSTRALWRSQGCHKNSLVLARL

SEQ ID NO: 940174 - protein, 106 aa, Homo sapiens
AQVHCSRRLRRSWPLTIWLPDVLGTRFQPKGRFGSLAAGVTGTAPQKVLFLGIPAGAQPGPPTFFCSSYFGGGSRGLEKGGPLFLLGGPQGPAVGFYTKDLRPLGG

SEQ ID NO: 940175 - protein, 86 aa, Homo sapiens
KPHGPRTLYFALLVLTSPATTLLGNLFFWRELQKAPLSLAKGWQLFLAALTQGVLEPPPYGALFFPLLSLGLYPCWLLFWNVFFWK

SEQ ID NO: 940176 - protein, 107 aa, Homo sapiens
GLLRNQKEHGCKTRPSTWASPRPLLNWSRKAQQGKIGGCPQPCAPVKPAPPLSFKHPGWPLGPGSLHASALGPVGSKHRACPPPPKDLRAMPVPPHVGGCLGPLPAP

SEQ ID NO: 940177 - protein, 103 aa, Homo sapiens
MSSDEFANTMPVRPPRVKRKMNPRAQSPAADHFILLPWSVASQLNTTPVGITIIMVPEVKYARVSTSIPTVNIWCAHPINPRKPIDIIAQPIPMYPNGSFFPE

SEQ ID NO: 940178 - protein, 111 aa, Homo sapiens
ERVSVAQAGVQWHNLGSLQPPPLGSSSSPPSASQVAGITGVHHPHLANFCIFGRDGVSPCWPGWPETPDLRRSGHLDLPKCWDYRREPPHPASSPTFDITSFLLFSPSVVF

SEQ ID NO: 940179 - protein, 44 aa, Homo sapiens
LKLMNTDLVAFTKNQKDPGVLDRMMKKLDTTSDGQLDFSEFLNL

SEQ ID NO: 940180 - protein, 144 aa, Homo sapiens
QQQQEKKAGIGLMLPPPPALEDDMESQLAGSLISGGQFMCDLDTDRDRARAGPSAPDLSTPAWVPDWLALFVWAALEWTPASPFLGAWREVAQPPGLLPSLGLHGEPGELSSGGPERTPAPKELVLAPAFPWPRDTQELINALE

SEQ ID NO: 940181 - protein, 68 aa, Homo sapiens
LGMEFRFPPPPPPPRAQKFRGTHSGAGTNSFFFVAGATMVGYPFLNGIFSIQRATPFWAPGPRTLGMV

SEQ ID NO: 940182 - protein, 95 aa, Homo sapiens
ADICKYAELKEKIDRRSGREMEDGRTFLKSGDAAIDEWFRQAHVCESFSDYPPMGRSAVRDMNQTVTVGVIKAVNKKAAGAGKVAKSVQKAQKAE

SEQ ID NO: 940183 - protein, 137 aa, Homo sapiens
RARSALFSECIHGIISSLWLLLMLKRSRCLSSVSLFQGHLSLPHRLPVIETLSLSLLFWVTSLPHRLPVTETLSLSLLFWVTSLPHCLPVIETLSLSLLFCSFIPMLQLLESRAVSLMSLGNKQPLFVYVLPLSCFL

SEQ ID NO: 940184 - protein, 70 aa, Homo sapiens
SSTRSKGVQQHPPPHTSATEPFLVDGPTLGAQHLEAGGSLTRHVTQEFVSRTLTTSGTLSTHMDQQFFQI

SEQ ID NO: 940185 - protein, 124 aa, Homo sapiens
VHGAPRGVGGRGGWIKTPRTPRPPPYMGGPLGGGAPNPGFGFGGPGFREPPTIPKGGPPPPPIFPPTGGRAGHPNGAPPKAQKGGAISPGVGGKFFSLGLPPPPWVFFLAPRPGPKTQGGFPPP

SEQ ID NO: 940186 - protein, 101 aa, Homo sapiens
KNLKKPLPFYSASAIEKGFSFFIPVGHSPTPCLRVCPLDRAPCPLWWSGPFFCSSSTPRLPQIPRAAAGARGSFFTLLDASKGGPFQLPGLLRLLIKISFF

SEQ ID NO: 940187 - protein, 100 aa, Homo sapiens
QKKALLGFWVTWNTNSGHCHKAQAVLGVFFRREAPKKFLAYKGVRAALKALLPYLEGPFEGLSRTLQAPAFLAFFWPNIKLPVPAPAPPPWETHKGALPL

SEQ ID NO: 940188 - protein, 100 aa, Homo sapiens
MDISKGKIPKLLFDAFFKKKKLGKPRPQEGGFFAPEKKKFGISGQGKIGQKAGGSQIFPKIKAIPQLQGSLRFGFALRNGFIPPNGGFKCFKTLIKKLAP

SEQ ID NO: 940189 - protein, 95 aa, Homo sapiens
HITINMMHQNHGFQTASKVYLPGPGAVADACSLSTLGGQGGRIAMSGVRGHSGRHGEALSLLRMQELAGGGGVCLSSRLLGMLRQENHLNRGVGG

SEQ ID NO: 940190 - protein, 123 aa, Homo sapiens
VGGHRGGVGTQGFLGQTLVLWDDGPCYPQFLPVGFIWRVVGFFLKKKVLKSGRNLQYVLVEGVILTPRVAARWDLPLSQNALVPAFCPTVDYVIFLKGPFSKARGFTFSLWPAHFVFKAFGAQ

SEQ ID NO: 940191 - protein, 136 aa, Homo sapiens
GSRGGGGVFPGVFQLPPGAEGWLWAKNGGFLKCVPPPPFPPRGGGWGGGGFLNPALFLARRAPGGPPPRFFPPLTPGAVPPPGFFFGGGGGSLFSPGTPFPPWALLGAPLNPVGPKKGGGGGGVFPGFFPPPGPPF

SEQ ID NO: 940192 - protein, 108 aa, Homo sapiens
EKKLGSPIRQSPKGERGGKFTSSCNFEPPTRGGCGSDNIGSWIFQAMGWKKGTGLGRKKQGIVTPFKAQTRVGGSGLGARGSSFGVPSTESYKETLPKTMVARFNKAQ

SEQ ID NO: 940193 - protein, 213 aa, Homo sapiens
SGWPCGAGGVFARRPLGVSLGVFSRLSPFSSWRVIALLAYGPWVAFLVFRLGRSSPLYPSVVSVWPFCPASLGWFPRCSPGFPRCGALGGWGFFLAPNFLGLFKMWGPPPPLFALGGLGGGGEASFSLFVLGGGGFSFPALPVVFASLWGARASPPFGFLGGGGGGLPFCPGGPFGPLGAFGGPFLPFGPLGGGGAGRGFRGFGGPRGRPRGR

SEQ ID NO: 940194 - protein, 72 aa, Homo sapiens
HYVLSIGAGFAIIGGFIPYFPYSQGYTLDQTYAKIHFTIIFTGGNLTFFPQHFFGLSGKPRRYSGYPDANTT

SEQ ID NO: 940195 - protein, 100 aa, Homo sapiens
EWAIMVPERALYRDVMLENYEAVAFVGPPPSKPALVFHLEQGKKSCFPHPQGVLNRNSWKAGWIGSLELKRYPFLAKPVFGRIGSKIFRNRQCWEDRKKA

SEQ ID NO: 940196 - protein, 103 aa, Homo sapiens
KKFGGVPKFFPGVGRGAGPQAPWPFFYPKKSKTWGRAGPEILLGPQGSPPPPPRGFFGGGAVFSWLPPGPLLAFGKGKLPPFLSPPGVPPPPPPKGKFGALFF

SEQ ID NO: 940197 - protein, 157 aa, Homo sapiens
GVPRFPSQKSKNISFVIAKPDVFKSPASDTYVVFGEAKIEDLSQQVHKAAAEKFKVPSEPSALVPYQHPGPGLGWSARKRKRREEEKVDQAGLELRDIELVMAQANVSRAKAVRAFRDNPSDIVNALMELAMSAPGRKLEPSYAFPQLWYSINRCPF

SEQ ID NO: 940198 - protein, 105 aa, Homo sapiens
PPIPREPPPPFFFPPKKTRGPFPPRVFNFGPGGENIFPRETLLPFGPFLGPLKHNFFQKTGLGPPRISRNFFPPPPQIFFPLSFFFNPPPFGGFFCPLKKNFFFP

SEQ ID NO: 940199 - protein, 71 aa, Homo sapiens
VSAAKEYGAAGIFPARDTYHPMREYPPYHTHGRYVPPSSTDCSPYEKVFAGNGGSSLFYTNPAVAATFANL

SEQ ID NO: 940200 - protein, 142 aa, Homo sapiens
GFSPYPPGPVFPGVSQGKKGGWGGVLPPRGGAFPPQGGQGSPPRGFFGSPPPSGGPPFGSPPGVNRGGPRGALRGSPPPFPWKGAGPGGENSLFGEGPRGGGFSPPVFFFFPRAFFKIFFFFPPGAFFFLGKKGGGVRVSPL

SEQ ID NO: 940201 - protein, 45 aa, Homo sapiens
PTGQKEPYYFYDATYAFLPDALEQVLSGWAFDPLCLSSRIVVVAG

SEQ ID NO: 940202 - protein, 93 aa, Homo sapiens
QLKTDAALIALEAPWTITDAELWITLTVEDSQLYEDTLAGRSVLIKNLTPQTLQPRWTGPYLVIYSTPTAVRLQDPPHWVHRSRIKLCPSEKK

SEQ ID NO: 940203 - protein, 85 aa, Homo sapiens
FMNQSGAAPDNRRLNMLQQNVEWSDRMNTYGLRSPEWVQICCPDAYATNLHNLFVRRAVQMSKCGIGNDGPLVAEMQDPKRKSRS

SEQ ID NO: 940204 - protein, 126 aa, Homo sapiens
TARAPGRKNTRSRPYLGVSFDPWRSPCGNRAIPMEFVIKQALGGATKDMGKILGGDEEKDPNPPKKEEERQEALPQAEEEGMAPRAPSLTETVVSSVRLSWACASSCMSGPLGVFSPDGIPANKPQ

SEQ ID NO: 940205 - protein, 99 aa, Homo sapiens
PAQGAPKVSSALDKLKEFGNPLEDKARELFSRIKQSELFAKDAGVVFKDLLESEGETQDLLFGALRVTSQEGPFKFSPPQGLFEGSLHVAPGAPHKNPS

SEQ ID NO: 940206 - protein, 104 aa, Homo sapiens
LGPFFPGGPPPLTGKGVKGPPPRGRGLGAPHFKGFLIFLRGGNFFAPPKTPGGIFLGGISPVKIFLVVFLEKPPLGGVVPGFPIWFFGVSRGGGPFPPPPFSGI

SEQ ID NO: 940207 - protein, 79 aa, Homo sapiens
GFGTTPLSRRGPQPEVWPIRFLNAGKAQKFQPKFEECRKGFEKKKKKGSGQNCPSQKGAEKLKALSVKEEPQEDAEEKP

SEQ ID NO: 940208 - protein, 71 aa, Homo sapiens
RPKSVEGGYALQSGYFQESVPKQGSKGRPSSLSSPLLLSKTDSRKPKVFACEVPHQGLGLAVQKSFYRGEC

SEQ ID NO: 940209 - protein, 102 aa, Homo sapiens
MGMPLPSGWCHPPWRVFWDIPKVPHRRREFFIVGKLQDGFLPIPTCSFVAPWNSLSLAQGRGFPKTHPVGCEESPVFSCFSLPCKMQRGPHCLWGGQLLQGF

SEQ ID NO: 940210 - protein, 109 aa, Homo sapiens
LAQHVVQARALRCAARLPAKRYSGDGPAGVLGRELVALEVQYVAVRAVQRNAVGVGLGGGNEHVLRQVGAAAVPRDDGALRIVQPIGTDHARDEPAVLRDGRLLHGQRE

SEQ ID NO: 940211 - protein, 101 aa, Homo sapiens
KIRLPLGQSQDLCTRIMGITYPHKEAGKQPKTPLTLLNISSFVKFIVNCFSSLTNLNSVQKPFPGGFVPKRFASRFKNHFILSLHKLVERQELKKKKNGFF

SEQ ID NO: 940212 - protein, 101 aa, Homo sapiens
ANVWAPKPVQVLLSSSGLLVGCGAGHSLALCQMPAHPALVQDPKVTYLSPNAIEDPEFQKAMGKKRNWKKANQKLQPKANLAGPKMGGCDKESLIKWLFPP

SEQ ID NO: 940213 - protein, 190 aa, Homo sapiens
FSQGPPSFLHTCYWPPGLIPGTPLVGFLLWRGIPGYVPLFPRGYGFCRPPMGGGTGVSSRGFPVSPPLAMGGFFWPPKTGAFPKFFNTPPPFPQKGGGGGGGGVFLTKPLFFTPPFPGGPPPPFFSPLKKPGGGSPPRFFFWAGGGVNFFPGDPFFPLGPFWGPFKPVFSQKPGGAGAGFPGVFFPPGPP

SEQ ID NO: 940214 - protein, 122 aa, Homo sapiens
MSPKLSPEVTFLFGGQKEEEASSTLIPIPRPFPRPWALTFSNGRALQASALNAWRGHRDNAGAATEKFIKRAEVNGLQPRASMKAVKKMVEHQHSHFTLPTMPEYPLHTTALGPAICTHFCL

SEQ ID NO: 940215 - protein, 110 aa, Homo sapiens
METLSNMFELDLPPVPSLLSKMIINEELMAPLGQPTQTVVMPPLEPPAQKNLVFQLAKKLGTLVENNKRVFSPKQGPSGGFFQNQKGGSPKKKGYMPPGGSPQKNFQRAY

SEQ ID NO: 940216 - protein, 126 aa, Homo sapiens
KTEFHFCCPGWSAMVRSRLTTTPPPGFKRFSCLSLSSSWDYRHVPPCPAIFVFLVEMGFLHVGQAGLELPTSGNPPALASQRAGITGVSHCTWPKTAVLTCPAGCKFEQSENVIGSIGSFSYPLFP

SEQ ID NO: 940217 - protein, 35 aa, Homo sapiens
QVKRPLYFYDATMLLPDALEQGASGLELFDPSVVF

SEQ ID NO: 940218 - protein, 36 aa, Homo sapiens
TGQKEPLLLLGCHYALQMPLEQVLLGWSFLTLLSSS

SEQ ID NO: 940219 - protein, 42 aa, Homo sapiens
IEQNLAVFEVSGMAFGRGCLGSSALLVFGLLLQPLRPFCRLL

SEQ ID NO: 940220 - protein, 60 aa, Homo sapiens
SHPHKSPSAYQPRTRAQGSGRSELLSRSHTAARLGLSGGPVCPPVVAPIPGGVKRLHPLA

SEQ ID NO: 940221 - protein, 104 aa, Homo sapiens
PGGGSPPGFFLGAGGGFLFSPGDPFCPLGLFGGPFNPVLSKKPGGAGAGFPGVFPPGAPPNFFFFFSPGGFGGLGPRNPPPFGFFEGEFPPPRVFFFFFFPPPL

SEQ ID NO: 940222 - protein, 120 aa, Homo sapiens
TVGGAFGAAPLFGVTGGFQGFPPTLFCSGMAVGNCIPWVLSPGFVSGPFLKLGPSGGGFFPAFLGPGRKGLPEEAFGLEGPNGGGPPLPLSPWGDGWGGWLPPTWFFYFLFRNKPPSAPG

SEQ ID NO: 940223 - protein, 135 aa, Homo sapiens
GTPSPGPPGGNILFFLEGPPPFVVWPTPPLRGAPPLVFGPPPFGPPLGAPGVSRGFPPPNGEIGSPRNGGWVFSPPGGAPPPNFSNFSPRPRGAPFFGGGGFFPPPPPKDPPFFPPGGGGGAPGGGFFLKPGFPP

SEQ ID NO: 940224 - protein, 128 aa, Homo sapiens
GQIPFFKFCYQCGRSIGVPLLPCPRYGILTFSKYCKTKAWAEFPKKDFGDLVAIVTQLEQVSRRKKKFQLNTTCPSQAWGGPRTVWVFYLPEPPQGIFQPNAGIFAPLGSCFVTVFPLRPPNKLAPRG

SEQ ID NO: 940225 - protein, 142 aa, Homo sapiens
EFRDIVDHASELGRFPRTNGPSNFQEKGGAHIRAKRKREELSNVLAAIRKAAAKKDEPLPCPFPEIKNSLTEALGFLLSVVGVGVSGAPSPLFGGRFEPHPLRGVAGCESKTVGRPPFPGQQVRKPPDCKWLLSFNRFYAPL

SEQ ID NO: 940226 - protein, 41 aa, Homo sapiens
PPDFTSTKVVPVTAFVPPPQPHHAQPPCLGEDPKVKVYAVA

SEQ ID NO: 940227 - protein, 127 aa, Homo sapiens
MANHLISGGTGYVPQDWLTVQQLFLGANCRTHNNFLILPWFIDFIADEVDLTSALTRKIMLKTPLISSPMDTETEADMAIAMALMGGIGFIHHNCTPEFQANEVHKVKKFEQGFITDPRGAEPLTHG

SEQ ID NO: 940228 - protein, 68 aa, Homo sapiens
AVNGLFLNPASNNGKGQCPVPWCSQLPSCFGPGPRAFCRPCSSGNCPGPELGPPTALGGGSCITNPNP

SEQ ID NO: 940229 - protein, 77 aa, Homo sapiens
IGGAPPPVVAPKKNGGVSPPGFIGAGGGNLFFPGNPFCPWALLGGPLKTRGGHKKRGGPGRDFRGFFPPRGRGEFNP

SEQ ID NO: 940230 - protein, 137 aa, Homo sapiens
IHEVMQAALPSCEKNLFPSGSYWLLHLVAITNQYCSMSWTWKVPLSLSPLFSRPSPESCWWPPYVVTSQLVQGALSLVRSLSYLHSASSKSRGTPVVHTSVRDQKGPCGISGHASLAEVSPSQALVHRITSNYMCYP

SEQ ID NO: 940231 - protein, 46 aa, Homo sapiens
VWAGPAFVLQGLAGFRGGRLPPLAAPPLHSVTFENPAGPSLAPGFA

SEQ ID NO: 940232 - protein, 83 aa, Homo sapiens
NLVMGFFNNMQDINGQILCVLAKSFFSLPNGAAILPFSLKQFFTFTVVLFKMNVKALFYGCNLPFPLQKFLFDGIHKLWYDMI

SEQ ID NO: 940233 - protein, 89 aa, Homo sapiens
LPPFDVGGGIALNDHFVKLISWYDNEFGFNTRVVALMAHMASKEEDPWAPSPSKSPKGKKRPSLLGGPCPTQSPPPLNFPSSQLPCRPL

SEQ ID NO: 940234 - protein, 109 aa, Homo sapiens
LLAPPYSHPPLSRMGFFGPYYVLPKARFVALVFRLKKERVFRGDFLWAGVLKVPPPGEKFWGLGGFFFRGGPPPFFRGNRGLSPPGGFSPFFQKMGGRARAPAPPLFFF

SEQ ID NO: 940235 - protein, 116 aa, Homo sapiens
LICFVLFCFGKDRILLWDPGWFSTPGVKQSSCIGLPKGWNYRHEAARPALITFITPNSLCGIPGLCTQIARVAPKGKKVGPLFPFFMPTGVANFPNPPGAGADFCPLFAEIKFPLG

SEQ ID NO: 940236 - protein, 104 aa, Homo sapiens
RFLGSPFGAPPPVFPQNLKNPPGGGLFFFGPRAPRLFPPCLGGGGIWVLPPPPPPRFFFHFRGGRGGPFPPLAPPFRPRGFPVPLSRPFFGAPLGGFFFFWAFL

SEQ ID NO: 940237 - protein, 155 aa, Homo sapiens
PLRFRGRSHFNNGRGGYILIIILPSELKLGAHSQSDHNPLSRASDSTPPNRFLMTFSEPRYLALPPPINLVGELSGVVTTFSGSNITLLLAGLNKQGTALYSLYIFTPTQGGSLTPPINNIKPSFTGGNPLRVKTPIPHFPPIPQPRHHYPFFLL

SEQ ID NO: 940238 - protein, 117 aa, Homo sapiens
SPHPTARAQGFFEGERGRAPIPQPPFPGGWAFSLIQWARRFSRLKRGRWAHPIYFGLVPSLGPPGFPFLVSGWFFVGICGGFPFSPGNRFCLVSVFIPPPFGVLAPGAQVLGRGLGP

SEQ ID NO: 940239 - protein, 148 aa, Homo sapiens
DKCGHWPLASCRQRSPADKLRASTKGCLRSHGCLEPHLSTGLAWSHGGSPLAHLPTKPCVQTVLTNAWKRTIPVLQILTAQRKGTLPTLRSQEGNLEGMPKLGFDGCIGVHQTDSGWAGWERRFCKKKRQVPWLDRMTNTMTGRRRGK

SEQ ID NO: 940240 - protein, 127 aa, Homo sapiens
GYSGGFRPAYGGLPNPAPKNWGSNFGLGGGPTPLTPPSSPRGGVLKKTKPPIGKWGFSSFSLPKEKIGEPPPTHPLLGGPKTWKEAPFSGVPLGKENPLWVNPNPPPPLGGFFLGAPPCPAPQKKKN

SEQ ID NO: 940241 - protein, 159 aa, Homo sapiens
AHVFRTGNFRSKRLEKIGKELKQANREGKIIPLTVWNDWAIIKATLEPFQTGEDIVSVSDAPKSCVTDCEEEAGTESQQGTESSHCKYVAESVMAQSTQNVDYSQLQEIIYPESSKLGEGGPESLGPSEPKPRSPSTPPPVVQMPVTISVFAEHSGIKR

SEQ ID NO: 940242 - protein, 114 aa, Homo sapiens
QNPETHSGPEVHLFPPPSKELALNKLVTLTCLAGFSPKDVLVFWLQGSQEFPPKKYLFWAFRQEPNQGPPPFCVTSIFGGGTQGLKKGGPLFLHGGPRGPSVGLSPKNHRPLGG

SEQ ID NO: 940243 - protein, 77 aa, Homo sapiens
EEDESGTREKRAYACVFRGIWDSIGDQPDELSFHRGGFIRILSKEYNMYGWWVGELNSLVGIVPKEYLTPAFEVEER

SEQ ID NO: 940244 - protein, 149 aa, Homo sapiens
SGNTSGAKVHLLPPLLEELALNELVTLRCLAPGFSPKDVLVPWVQGSQEFPPEKYFTLVSRQEPSQGPPPFPVHSILGVATEVCKKGAPFSCMVGHEALPLAFSQKAFARLGGKPPLVNVFVFMGGGGGPWFLAARLSPPLNKLHVPPS

SEQ ID NO: 940245 - protein, 131 aa, Homo sapiens
ELKYAKQFALSPVALKKLRVKKLKKFLDAWGEPSKGWAEKFSIRKINELMPKYAPKAAQGRGRFVVCPIFVAPEGEKPGSGYSQNSPFGNFFFKGAPAKPGIKCEAWGFPDDAGPPGPPWGDSLPFVGGGL

SEQ ID NO: 940246 - protein, 167 aa, Homo sapiens
TSSLLEQLNGSLLVSRLANLRQSEDQYYFRVPPVASHTFDSGVPSGVTEVVVKLFDSDPIPVRVPVEVSRKNPEFMETVAEKALQEFPQKPREEWNVDVAFAPTGAFESSSPPNEVQPPKESFARPPVTRPQPPGPQLRPASPRFGSCPLTLDFAGHGKNKIAPACH

SEQ ID NO: 940247 - protein, 96 aa, Homo sapiens
EEEIQNLEIDVDELLDMESDNARAARVKELLVCYKPTKAFIFGLLDKIRGMQKYEPPPKKVRVPDPGERWVPQDNCCPPNLVATEYRGTLRPGLVP

SEQ ID NO: 940248 - protein, 87 aa, Homo sapiens
ILPPTGRPRVWGFFILWGKPPPPPTNFFWGAAKKKRAPGGFGFWRDKGAPPNFFPPLFGGPPPPPRGLGAKGFPPAPPLFFFGGFFF

SEQ ID NO: 940249 - protein, 125 aa, Homo sapiens
CKSKGSRPGEPGPLGGRAFGFYHVKLGCPPRGGPVSYTSHEFLFLHPDLSQRVNFNQRGFCQRDSGKFRPIFCQCYFFCAFPCSFLLFPASLMGFRPWPTFFRTQREGSPISKKPRGFILTPFPP

SEQ ID NO: 940250 - protein, 165 aa, Homo sapiens
RAVFRQTLPKAQCPIVERLSNSMMMGRNNGKKVMVGIVKHAFEFIPLFTGENPLQVLVNPIINSGPREDSPPIGGPGIFKQALDLSPLPRFNRPFGFGHRRFKGPFRNIKTIFEGLANEFINVAKGSSNSFALKKKDKLEGVAKSHPLFFQLLPNKPFCPLGQPP

SEQ ID NO: 940251 - protein, 76 aa, Homo sapiens
LGPFFRGAFPPLQTPPLFGGGTWAPGVSFRLPWWGGGGPLFPAFCLAPGSHFFSGGLGKIGEGFGFVHPRYQEALF

SEQ ID NO: 940252 - protein, 111 aa, Homo sapiens
PPPPRSGCIPPPKEGGPPTLGVPPLLFKKRVPFLFPPTPLTLEPWGLGAILTPFPFLGGPPKPWPLGRPNCFFLWGLGGGFSPAPPPAPSFFSHLKAPFLKKNKHKRQKKQ

SEQ ID NO: 940253 - protein, 155 aa, Homo sapiens
ARRPLKAGGREGLLGWSSLCGSGATTLGAGPGLPPVGLSWIRRGGGGPPPGRGPGVIWGRGRPGFFCGGAVWPFGPLGFPPFCPGRPGPLGILGKFITRFPGGGVGGGGGGAPLGVAPGGFFFGPGPPPPPPPLGPRPFTPVGFFYFFGGVFFSP

SEQ ID NO: 940254 - protein, 101 aa, Homo sapiens
PSSQGALFGVFWVFFPPGGFPAPPGSLCNEKGYPRGVFPPSLPPRRWFFPPPPPFKGESGFPPGLFPPSKGPGFEPPKPPPRTRPNFCSPPKEFWRVPFSG

SEQ ID NO: 940255 - protein, 179 aa, Homo sapiens
RPRGPTISPSSPVLGGGLRGPVPGRSSKTPLRFLLRKTRGPLWGISLKGGFPPRGGGFPIRKGVGGAKKPPFPKRGVFFSLGFPGPLKQGAKTKRGWKTFGKIFPGPGFSFFFFLGPSPPPQKTGGGKLGFPGGPFFFGGFFPPLFPPWPWLNRPGKGGGGVIFFSKGGDKKPPMGGAR

SEQ ID NO: 940256 - protein, 112 aa, Homo sapiens
FISTLAEANRPLLALAEGESELVSGFNFEYAAGPFALFFIAEYPTFIIINTSPPPFFLGATYEALSLELYPTFFVPKTYFYPPGFYELERHTPDSVRANSYPSYEKTSSPSP

SEQ ID NO: 940257 - protein, 105 aa, Homo sapiens
LSASLRPRSPSPALTKDVKAAANQMRNFLVRASCPLRLEPGKKYLIMGLDGAPYDLEGPPQYLLDSNSWIKEMPFERLCRSTRQGAAWAQLNDFPQEYGPQGGQV

SEQ ID NO: 940258 - protein, 136 aa, Homo sapiens
ELGRPRNIKKQSSVKGKRPNYGLFFSARKQRGLGFFPQNKKRPTKKRGDPSSFVGLGPTLFPFAWGAGTSPPPLGFSPLGVPGPNPKGIPFALSLKGGPFGVPSPQGTSFPLGPPRGGGGYPLPGFFFPVGAPPKN

SEQ ID NO: 940259 - protein, 79 aa, Homo sapiens
YRFEKRRPGRGRGRARRKGTAAPFPFSLFRVRRQTRENEDVGGNAAKRRILAIRRAPTPPRAVQSSARFEEKKAARQCL

SEQ ID NO: 940260 - protein, 130 aa, Homo sapiens
GEGPPTPPFPRGADLLCKSAPVFPPYRAGGAPFLWGGASFGPPRFPIFFARFGCGGVCGAAPFSPPRARPVFLCGFWPPIRGLRPPPPNSPLIFLGAPPRGVGGGGPPLPWVVFCFLKRGRGAPPPRGFF

SEQ ID NO: 940261 - protein, 104 aa, Homo sapiens
FPPPFPPLPRPQPTWPPGAHQGGAHQKTMAAMGGQKLNWTPPGPGLELGAPQGCGDPGGPGRGDPGRAGGFPKIPLENFIKKFFWVGGPVNFLGPVGPSGVFPA

SEQ ID NO: 940262 - protein, 113 aa, Homo sapiens
RRSMADAYVQTQTAATLWNGSHTMSKQPSVDIPPRGLKMAVTFIGHSTTIPELFKRISEQFPAMFRRKAFLPWFTGEGMDQMEFPQAENHMNGLVFEYQQVPDAPPKKEEDFG

SEQ ID NO: 940263 - protein, 124 aa, Homo sapiens
AGFGGGFQPPGAFGIPPWEGGGAPPFPGQKGGPFPSPALFLGGVFLNPFFPPKFFPPPFFGGVGGFFPPGGPKGFSFFPRPPGFFFFFSKGAPQNQAGGGPPGPLFPRDPPFKFPRGPLIPFFG

SEQ ID NO: 940264 - protein, 92 aa, Homo sapiens
QVTESFAFLWCFSPILYAFSSPRFRQYLKAFLAPGLGWPLAPGPAQASLSSCFESSILSAQKEMVGMNALGEGQFETSPNKGDVGNKSAWVP

SEQ ID NO: 940265 - protein, 96 aa, Homo sapiens
NYVALQLQSPFPISRPRRERPYMEHPTRSIDLCFPSRLWDFMPRQWDMACPPCPKEDQIKDSMMDACFKGFPLPLHEGSTSQYSCFANPGGPPLNG

SEQ ID NO: 940266 - protein, 126 aa, Homo sapiens
DSTSGLLGAFSGGGVQKIFTHFFLFGVSTTQVTSRNQGGSGFLFPYGGGQKKPWVLFPLPPKNLVLSCDGFPQPCWKFGFFPKPDVLGGRRAMAPPRNLKGEPFFYFVGKSPKVWAPPVRDILKKM

SEQ ID NO: 940267 - protein, 80 aa, Homo sapiens
RQKPPEELNVDVAFAPTGGFESSSPPDEVQPPRESFARPPVTRPQPPGPQIRPASPRFGSCPLTLGFAGHGKNRIGPACH

SEQ ID NO: 940268 - protein, 90 aa, Homo sapiens
SVPKSGTRYMVPTEGPLDLWMSIFGDCHGRNSSFKREGRQGESLCPGRNLMSLKSSTPAPTAIVFLIKGGDSLPFKSIYMRQIDPMVGLI

SEQ ID NO: 940269 - protein, 58 aa, Homo sapiens
TDKGTELSPESLNLPAQPPQQELNSKSEGGDSRTTHTRLGTDRKQKYRLTVVQGMAAS

SEQ ID NO: 940270 - protein, 81 aa, Homo sapiens
DPRSGKSWKMALILEVCDAAVDMVPGKPMCVESSQTIHPWGRFAVRDMRQTVAVGVIKAVDKKAAGAGKVTKSAQKAQKAK

SEQ ID NO: 940271 - protein, 169 aa, Homo sapiens
QVQGIVAIGDYMAPSVLGVKCSKEVAPPSRGAIILAKLSIVPVRRGYWGNKIGQPPTVPSKVTGPFGFVVRLIPAPRGPGIVSAPVPKKLLIMAGIDCYPSARGCPAPLGKFAKAPFDALFKTYSYLAPGLWKEAGFPQFPHQGVPGPLVQTPPRVSVQRAQGPAVGST

SEQ ID NO: 940272 - protein, 138 aa, Homo sapiens
LLRGGVSRTRCLFLFVEEGFIPTTSPLVGGSYWGPGNNSKPPPPVGSQGPFFSFNRLPGGQNRWAPGEVFFFSFGGGGFAHPLTQKGLFLFPGFLVWRAGGPPFPGFLGWPGGVWGVPLFFFSRAPAWGFRPPPPPWG

SEQ ID NO: 940273 - protein, 100 aa, Homo sapiens
AAPSIYMINLAVFDLLVVLSLPGPRNCMAVKGRSLEGISSLSVMDNYGPVGVPWGPLPIPKPCGKKGLFSVGTRVCGNGHRSIFQAPTAARQEGRKFGPP

SEQ ID NO: 940274 - protein, 125 aa, Homo sapiens
SISGKLDLITLMSKTIDGQILLWLLGVNTRNLFLPLFLLLGANADKTPKAEEVKSSDSFLKLTTRAQLGAKSEQLLKKGKSIPDVLLVDIIVNAIKYVLHFSSSHLFNIFFITQRCIKNNTDFLL

SEQ ID NO: 940275 - protein, 104 aa, Homo sapiens
SWKMAHPVCYNIQKKSTLHLVFGLRGGMQIFVKTLTGKTITLEVEPSDPIENVKAKIQDKEGIPPDQQRLIFAGKQLEDGRPLFDYNIQKKSPLPLVLRFRGGV

SEQ ID NO: 940276 - protein, 109 aa, Homo sapiens
METLSNMFELDLPTVHSIISKMIINEELMASLDQPTQTVVMPRIEPPAQQNLVFQLAKLGSLVENNKRVFSHKQGTYGGYFQDQKGGSPKNKGYMPPGGYPQQQFQTAY

SEQ ID NO: 940277 - protein, 78 aa, Homo sapiens
GDLAPRAQNLGPGFLGPGVGPPGVKEPGVPFFLGAPPPCPRWKNPGGVLDLPLFFAPFPKGGGFFRGGDPPNGPKPPF

SEQ ID NO: 940278 - protein, 191 aa, Homo sapiens
PTEASKACGVGGLAGPPSFIFANNQDLPGALSSNAIPEVLELDSIRSHHWCIQGSSAVPGENLLPGIDWLLDDISTRIFTAEMNHSKCPPPNSSGSSTFSQPYPWGVGSKAKITLPLLPPSLVVVMLPAVALWPPGSHGGRAVPWLSFWLLTWPLATIPKKKGWAGRSCYFCYPGCGPHPSLSCEINRSLP

SEQ ID NO: 940279 - protein, 190 aa, Homo sapiens
MRANITLANVIRQLGSLSKNAKDIFGELFSQANTFAFRVSSLAERVDRLQVKVTQLDSKEEEVSLQGINPRKAFRSSPIQDQKLFGRNSFPVPVLETYNTCDTPPPLNNFTPYRGDGKKALKFYPDPSYFFDLWKEKMLQDPQDIIKKKRKHRKEKKDYPNRGNVNPRKIQTRKEKWEKMKMLQGPQDFI

SEQ ID NO: 940280 - protein, 136 aa, Homo sapiens
PARKRLPQFEFFLPPWGGFPRKIHFWFWPGGPLGFGPLWARAGGGPFLPWGLPAPFFGVKSLVSWARLGKLGGRLLRWPPRGKKKKNPVGVSGGFRPPGAFFPLGPPLGGGGGPLPPFLFFGFLGFFFLKAPLFRP

SEQ ID NO: 940281 - protein, 92 aa, Homo sapiens
QRGGGGGGGGVFIKKAVFWTPPFPREPPPPGFGPQKKPRGRSPPRLIWAGGGEKFFPRKPVGPLGPFGGPIKPGWAKKPGGARAGIPGEPGG

SEQ ID NO: 940282 - protein, 84 aa, Homo sapiens
PPFFVPPRLAGAPPPVFFPPLKPRGRLPPRVFFLGGGGGKIFPRGPPFPLGPFWGPLLTRFFPKTGGGRGGISRGIFFNFPLLF

SEQ ID NO: 940283 - protein, 118 aa, Homo sapiens
FDSIVNTGVPYPRFLWAETIGFFRRLLWRNPNRRVGSSEKNPKNVKKPPFFRILGWEALLGRGLPPPFGPPLAGRPEVSNFYGGFPGGAPPLGPPPAGGPLPTGGQAPFLDFFGAGGG

SEQ ID NO: 940284 - protein, 157 aa, Homo sapiens
MCSLWAPCLRGTIVCCLEEKPEDRGKLAPGIREFAPVISHNLKTKKTRVKLPSGSKKVISSTNKTVVGVVAEGGPIYKPILKAGRGPKYKAKRNSWPQVRGVAINPVKHPFGGGNPQHIGKPSPIPKNAPVGRKMGFIFAPRTGGFRGTKTVQKKKN

SEQ ID NO: 940285 - protein, 76 aa, Homo sapiens
LGAPVDKRGLQKLAGLGPPAFFFMNMKHFGLPFPSAPKAKGKCGLQAAQPKGLWLRAVGPFMGLPWWIHIKPVFVG

SEQ ID NO: 940286 - protein, 103 aa, Homo sapiens
GFPQPAPLPGALQIGASISRCSLWVCPSPTLRSSWKEDGSSQSKGLETGLKALKNWANPPPPLGPPQKKGGAGGSFWLVPKAGKKKPGFKKKGGFPGPGDPVP

SEQ ID NO: 940287 - protein, 115 aa, Homo sapiens
PRGFPFLLPGGFLGGIWGGYPFSPGTRFARFWVFFRPPLGVLAPGAQILGRGFAFFAPGGGPCGVFGPPPPFPPRGFVFPWGGGVSGGRGPPPSPPPGGRGGAPFPFFFFNFKIP

SEQ ID NO: 940288 - protein, 115 aa, Homo sapiens
MRSPLLGALRVGFAWKKPFRLGVHCGEPWAPVWGPHGVPLEPRGPLFPLGPPGGGKGFFPSPVPVLRAGKKGGQTPFPPPFLQRGGGGGGGGFFFFFLFFSILGWPKKGKAVFFP

SEQ ID NO: 940289 - protein, 166 aa, Homo sapiens
FCAPVAAGPPPPVFAPYKTPGRPTPGFFCAGGYIFFPGGTVSPWALFGALITQFFSKNRVGPGPDFPGFFYPPGPPWGFRFLGVSKNRGGPGGRAKKFFPPWGGRGFFGAPPPGPGGGPPRGSFFWGGKPPFFPPPGPPGGPPFFFPPGVFFLGGWVLGPTPWGPL

SEQ ID NO: 940290 - protein, 88 aa, Homo sapiens
LPLMREKLTQRHDWERQNNEFQVLGIKTTVEKEITTSRRLLEGESEGPREESKSSMKVFATPKIKAITQEPINGRLVFCQVNEIQKPA

SEQ ID NO: 940291 - protein, 131 aa, Homo sapiens
AQKNTFPLPREIFLPWGAPKKGGLDTPWEECGGRPFAPPPLGGPFFYTPWVFVEQLICPRPHPRVLLPFTHGGFFERDLFFLSLGPREGKTPAYRGVKSPPLFSPPIWGGLFRPPPQNGVFFREIGGPPFF

SEQ ID NO: 940292 - protein, 106 aa, Homo sapiens
GLRPALICGATFLPTEDWVGGGPGPSPAGKGAGPFPPGHSLFQCCLPPGLPRAPPPSPRGGRVGFHPERAKFPPGVKRQDWMELFIYPFKLVPRDIVGDPETPLAL

SEQ ID NO: 940293 - protein, 116 aa, Homo sapiens
GGSPPPPKKVFLGKPPPPLGGVPRGFFPKKNRGPPRGGPGGGGDPPLFPPPEKGVFFFFGPPPPPRGFGGFHPRGLFFQKGLKGRGAPPFLGGPKPRAFFFWGPPPQKKKRRGFSF

SEQ ID NO: 940294 - protein, 144 aa, Homo sapiens
CVNPNTGNYPGSPHHRGGPQVSFFLQLTAEGSRGAHPTDTVDRNQPVLGALAPRPFSNTGKKRKVLWVVGAGGFSSFDTRIYIWKKTSPELGPSPAFFFPDANATPAPFFFPRGRKGVVVGELGYRFGEGEKKFFFFNPCVPFA

SEQ ID NO: 940295 - protein, 109 aa, Homo sapiens
TPALFSSPFQGSPGENSLPCIPGFGFRVQGPALPPPSCFNQKNGGANRVFWVPKTQAPRRDFSGQEGRAPPPSLTGVGVQVPPLPLWENPCFNKMGQGPPGFPRPCLFG

SEQ ID NO: 940296 - protein, 114 aa, Homo sapiens
GPGPGLWGFKGPCSLRPLAPKRVGPRGRGSGWGFSKGKGPKKGGGEFLLGAPPPPPRGGFSPPPALGGGRLGFFLFLGAFFNALGLFKVFFFLFRGVFLGEKGYPLLKGKVSPP

SEQ ID NO: 940297 - protein, 143 aa, Homo sapiens
MRIYKKGDIVALKGMGPVQKGMPPKCFHGKTGKVNVPHHAVGIVVNKQVKGKILPKKINGGFEPLNPFKSRKSFLKRVKENVPKKKKPKKKGSWVQLKAPPAPPKKAPFLKTNGKEPELLEPIPYEFMAKKGLKKKKKALWAP

SEQ ID NO: 940298 - protein, 104 aa, Homo sapiens
GGGYYFSRGKARPFGLFGAPLARLCPKPGVAGRGFRGIVHPRAVLKKWAAPPQGVPKLRGIPGPLRLFSPPFPGGGAREWGFCFPPPPPCPLGFSLWRGGGWII

SEQ ID NO: 940299 - protein, 117 aa, Homo sapiens
LSGPFVEFFQAKGAAAAPRVVPLAPSGGGFSQNPGSFPCLVQGFFSHLPCGWGGNGPPGKNFKTPPSVLGSGGSFFFFCQPPVGKSGGAPGGVFFFSFLGGGLPPPSPPKGLFLFPG

SEQ ID NO: 940300 - protein, 95 aa, Homo sapiens
FSSDTHSSPFGGGGGIALNDPFVKLISWFANEFGSTNRVVALLAPLASKELDPWPPPPSKSPKGKKSPSLLGGPCPPQSPPPLIFPSSRLPCSPL

SEQ ID NO: 940301 - protein, 79 aa, Homo sapiens
RRLSANEVRSAPFCMGTSQRFPLGLALLLYPPLGPELAFSGSANFGDVGLSAGMQASDLPSRASLPTKGDLLFSTQPGR

SEQ ID NO: 940302 - protein, 87 aa, Homo sapiens
RTNLTLGPCAKFVCRTSHILNGQVFASSGRLLAAPVIVSLCRPPRMGGMALAAKCPQHPGMTCHLCFHTGASYLSCACHSINSVCAP

SEQ ID NO: 940303 - protein, 126 aa, Homo sapiens
KFPKPGFLFSFQGSTLPRQQGEQNWMENELTEVGFRGWVVTDSSKLKEQVLTQCKEAKNLEKGLQELLTRITSLEKNIYDLMELKNTARELRDAYISISSRIDQAEKRISEIEDQLNEIKREDKIR

SEQ ID NO: 940304 - protein, 141 aa, Homo sapiens
GVLPFSPAFEGSGLNECVTLTCLAPGFNPKGGVGFLVAGVPGISPQKVLFLGIPAGAQPGPPPFFFYQNFGGGTQGLEKGGPFFLVGGPQGPSVGFSPKDLCPFGGLTPPCQFFFFFGGGGGAFFFSRPLVPPLYLISCFP

SEQ ID NO: 940305 - protein, 94 aa, Homo sapiens
LLKVKLGELPNWIFMRDFSPEGIFGGFQKGFSRFHQYLHVKKGSISGITMGVAYGLFRYSFFYKHFKHERVRKYPLKGPPLPPPPPRPWAEPLC

SEQ ID NO: 940306 - protein, 51 aa, Homo sapiens
MVQTQTSATSPRATCMTAHGRLLNWSLFSAKIACACLDLNRKNNKTCWSKL

SEQ ID NO: 940307 - protein, 97 aa, Homo sapiens
DRSFDILKNPSRPPTLLVAGRLSHMLNGGDEVSPTCMGIDQVGDLDISYINIEGIPAPSPESKGCPLWPQSSKPPLPSETSPRGGPLSENVEGAAPP

SEQ ID NO: 940308 - protein, 108 aa, Homo sapiens
PGLFGPGGPGGGKNGPGGTGRGNRWGPHSGGLFGKGPFGIWTLKGGGSARGGEGGGGLETKVEGILAFEEGEIGALGGEGKTPWVNGRGGGETPGIEKKGFFPFPSQN

SEQ ID NO: 940309 - protein, 100 aa, Homo sapiens
LPFSTSPLKNCQVIPLWVPSLFLLMVGFKQVLQPPQMPQQGQMLILEAVGRPIMLLLHQLPTPPEQSRAASCPGKTPRFLSVPQPPWSRLEKIFKKEKNP

SEQ ID NO: 940310 - protein, 200 aa, Homo sapiens
MVGIETSNGALTGRYRVVDALATLAFDYAPRAAYFRGELEQFLLAREAHVDPLKATGSYAGAMGAGQFMPSSYRSYARDGDGEGRIDLWTSWPDIAESVAHYFVAKGWRGHEPLVAPATLVDPDVEDLPANRLEPPDTVGSLRARGVEIAAPADDATHAWFVALRDADAPSYRVGFHNFWVITRYNRSVMYALAATELAA

SEQ ID NO: 940311 - protein, 109 aa, Homo sapiens
KCPSTVEATVKSQGEYYCTATNMNENIAMHSNMDKFHRHEVKQKRSDVLIIKREIHEYDLSFLQKSTEIEHNMIHWCVEDQVEQCNSGSGLLREAAYLDVLCLTSICGV

SEQ ID NO: 940312 - protein, 121 aa, Homo sapiens
HSKRVFGAPPPWGRGFALTPPKRFFLTLGGILEARKDSIVKIPFSLGRWGPGPPFPLGRKKRGYLKGGVPPFFFFPKKGGLPPKPPPLGPGAPPLFFFFPPPGGALPPFFFRFWPFWDPGF

SEQ ID NO: 940313 - protein, 180 aa, Homo sapiens
AALSIFPGGHSRGVGGGPPPPAFGKKGRGGPSPKPLSLGQAGDPLPLKVFGLGPATTPAPFGTSPLGRAPEIPPGGFKGALGPNYPPPPGGQSSGSNPPLNPGAPPAKNPNFPPGPKKGFFSKLVSPFPKRGRGGGGAPPISKKPPGGGVPIFGKRPPKGLKRGRPAKKKGFFPNLFLKV

SEQ ID NO: 940314 - protein, 154 aa, Homo sapiens
SDDHALPCPALPCPALPSTFRALCRRLGTGRPICVSVSTQELLGTVPEWSGLLCHLPTVYYEGLQDKLAQIRDARGALSALREEHREKLRRAAEEAERQRQIQLAQKLEIMRQKKQGPLSAATAKGGGFRLQLLCFSAAISSAPEWYSDNKMYF

SEQ ID NO: 940315 - protein, 61 aa, Homo sapiens
VLGPRSIKNPPPLARWKGFFVPPPNCPPWGRWPGPPPGFGAGPGGPGWGLRLGGYKNRPPP

SEQ ID NO: 940316 - protein, 109 aa, Homo sapiens
SLAPPKTFKQQKVRMANEGFDPSPLFDPLYVLDQAVGAYLPLPTARYRALLAGNLGILELPPLRPLKKELCGVGAVAGVLGCQGFFLYQNCGPYFVINVAGADPPVFAP

SEQ ID NO: 940317 - protein, 75 aa, Homo sapiens
NAEIWVGLNDMAAEGPWVDMTGARIAFKKWEAEIPAQPDGGKTQNWAVLSGAANGKWFDKRCPDQLPYICQFGVV

SEQ ID NO: 940318 - protein, 108 aa, Homo sapiens
AGRGFFLSLLHLPKDKSSKGNSIIMNPNPKYFISQGRVSGIPGKDVGSDPIPNRLLPLFLRGAPDNIYYPKDLLFENQPSFIQDPLFAFPFPLPGPPPCKSPKPPFFR

SEQ ID NO: 940319 - protein, 52 aa, Homo sapiens
GPYLVLLTTESTVVNSGKRMDSPYPSQRNAPTFRVMGHCSKIKLYQIKAKNP

SEQ ID NO: 940320 - protein, 97 aa, Homo sapiens
IIQLVGIPGLGARGWIAALSTLDNHSLAISVIMMVVAGFFTLWAVLSVFLLQGVHSLYRRTGASFQQAQEEFSQGIFTSRTFPRVVLFVAQGAFQGN

SEQ ID NO: 940321 - protein, 154 aa, Homo sapiens
AGEGGGGAKTNPFSPGFLFWGPHQEGPPFFFPQPFYFRLSRKWAPPPPFGIGPPPGLVHLRFPEGPQMVLSFFGFFFPPPQPHFSSGSLSPLTFGSPSLMFCPLPILPGPWVSPRSPFFKQGPGGGGPGVGPSPPTAPPPPLFGLFYKKMGGLP

SEQ ID NO: 940322 - protein, 112 aa, Homo sapiens
LLSFFFLKKPMGGLMWARCPLFKKLSLTPLFGFGPGPPYIREMPPPWYPPGPRPYRPIAGEKPKGKGSKTPVVGNRVFKGSPWAPKKAGGGNQGNLVPPPPPLNQSGGSLGL

SEQ ID NO: 940323 - protein, 108 aa, Homo sapiens
MSNAHSCTHHARAHTQLLTVGPTPSSQRGNYGSGRTVIGQPIPHRGPTANGWPLSPGPAPTERVARDGGTDHAGSDPARPPACARGRPPSAAPLPAQSGLGSVSRQRP

SEQ ID NO: 940324 - protein, 101 aa, Homo sapiens
GPGGLVPPIFFYPKKSGEGGAPPPPLPFILFFPPRGVGGENFPLLFFSPPKRGFVGVGGGGPLNPPRPLLAPFYKVWCSRGGGGDGGALENKTFPPPFGVL

SEQ ID NO: 940325 - protein, 101 aa, Homo sapiens
LQLQLRKNKRPSNSSHATGEADNGPFCWEPLNRPLRDFDCCFAETAPPVSRKQLRSVFVLILILILMAVRCISLEGAMRQPGGKGSPEKLQPAHWEECALG

SEQ ID NO: 940326 - protein, 231 aa, Homo sapiens
PNRGPVPELARMPLGLFPPPKGRGKSRPPKLVVQKAGVGPSFEKNPSKMWEGQGFLLPLPSKIGVFFPNLPPKTRRVGAWQETPNGFPRGNIGVGKTKPFFWEGKFPGGTPPKPGGGGALEETPHGFPRGNIGVGKKKPFLWEGEFPGGNGPTFFFPSKFLKWNPPSPLRGFGRSPHPPKKNFRGLFFGQNGVRGFFGPPSPPQFWGSPFLFGQTLFGPPLGEKKKIPGFG

SEQ ID NO: 940327 - protein, 137 aa, Homo sapiens
HVPKGLAVGVGFGAIKKTASATFERARNLAIGIGIQNFPEGLAVSLPLRGAGFSTWKTFWYGQLNGMVEPPAGVFGAFVGLGEPILPYALAFSAGAMVYVVMGDIIPEAQISGNGKLASWAPILGFVMKKSLDVGLG

SEQ ID NO: 940328 - protein, 66 aa, Homo sapiens
GLAPKRQSHVVIRINPRFPICRMGLGKKPQTGVGEQGLPPGLGPRSPRGKPKTGASNGPDQSPVAS

SEQ ID NO: 940329 - protein, 103 aa, Homo sapiens
GQVRTQVQASSSLPSMQSASASQRKRRRMQWPLLHWNWSMSQRGVQSFSSEPSAQSWSPSHFQRPAMQRPLAQENSLSEQGRGAGKDRGRQAQEGGHKDSRPQ

SEQ ID NO: 940330 - protein, 120 aa, Homo sapiens
VSNLNGTPVLEITQGLGFPAFCILGRGVLIIFSQDLGFFSPTWKNRFLPDFGVLIVPMGAPLTIWGSFIPLELLGGIIFGGGVLDQINRRRACYARLPFLKILEKFLDISLESEYNPALS

SEQ ID NO: 940331 - protein, 177 aa, Homo sapiens
APSVMKSKILSASNARKRPAEVSHILEVTGVVATVFVLHVNANDVARIVVEKWIYLWQQDLDRGVLSFKEGRIRGSQMNIRVSKQPRGETSHLPLSTDVRSWSQNNQQVHFSCLIQEGNEVPAAIKVIDPRLWLMVVPRHIKLHSVEAAQLHLEKPVGPQNRRYSKVVQAARNIAEG

SEQ ID NO: 940332 - protein, 119 aa, Homo sapiens
MPPSWAYKNPETLSKAPPSAESCFHSITLRTDSPSPGVIRFFWYTQARTQEQTALCPFDNYEGLIDLVNTSCLQTAKLKEHPGTHAHWGFSCKHSPLDTAMGLEPACLYAPLEVWAAGH

SEQ ID NO: 940333 - protein, 217 aa, Homo sapiens
RPPRGARAPFFPSGGVSPKLFFGAPREARPPPRGFNSSRGQKFGVGWRFSPPPRGALFLKKPPGFFQKRGVCCGGYNPGFSPPPLWGPPKNFFGFPPPAGPPQFSPKKKKFFFGGPPPVSPRFSGGGGPPGKKKGGGGPLGGFNPPPRGGPPLFCFYPFFPPPGGGPGNPGGGGGGPPPPFGGPPSPPFFFFGGVFFGGGGVWGPLFFFFPAFFFGP

SEQ ID NO: 940334 - protein, 147 aa, Homo sapiens
MGLLWFVPSTATELLLCCTRLYLKQKLLELQGETDKSIMIVGDFNTHFSIIEQMSREKISKDIENTIVLKNTIHEVDPIDRYRDFKAAGWVAYPVHTEHLLRYARKKLRKKKATHKICSLTKWASLRNYNKGFSETAKYQIIKDTFL

SEQ ID NO: 940335 - protein, 143 aa, Homo sapiens
GFTTRGVKSQVEPGKQRGLPPRPRFGFHRAHCGLPPGLVPTKVRAGPGFNLEELRVAGIPKKVARTLGIFVDPRRGNKSPESLQANVQRVKEARSQLFLFPRKPPAPKKGDSFFEKFKLAPPLAGPVLPVRNVFKKEKARVLP

SEQ ID NO: 940336 - protein, 149 aa, Homo sapiens
MPLIMACEAGWFQKDRVVLNIKNDLGLHVDLTVHCKSADDDLGVHLVPYLGKYSFRFRPNFAGSTSYTCRFSWRRESHSLNIYDAGRSSETVCRGGGDCNWSIRADAAYWLDPSPKHNDKRFTWAGTNVCVFFFSFYEKKKNLTILCDQ

SEQ ID NO: 940337 - protein, 158 aa, Homo sapiens
PRAPRWVPFGPSWVPPVLCSQKGAPRPGFNLEELRVAGISKKVARLGIFLDPRRGNKSPESLQAKFNGLRRPPNFSFFPGSPRPPKKETVFFKNLNWPPHLPGRFFPSGTFFKKKKPRFSLRKRKNFKTFPCFRLARANPRFFGIRAKKTKETPKPDF

SEQ ID NO: 940338 - protein, 107 aa, Homo sapiens
EEEEPSVAPQGGEQRPLLSSQEAPPGGFPPPHFFAAASPGVGGTRSPPPPRALNWKRPPSNITHYPSLYPYLLPNSNFTAYPRNRGRLNPSLGFPPFSKPLPARPPI

SEQ ID NO: 940339 - protein, 143 aa, Homo sapiens
FWAPKRAPLRAKLFMPAPGRPPEEAARDPAFIASQLFRGVQGPLPPGKKNWGQCRYFPGGQAFVSPFWPPAWRIWQPPPWPWGVQGAPFLPNRRGWGGSHKGRAIPFPPLPNKPPPPWVFLFPPSPGGFGLPQMVLVFLFLLG

SEQ ID NO: 940340 - protein, 96 aa, Homo sapiens
MGGWGGRGGFFMPNSFCSLLVPWVARPRCFSFFEAPGAVPGPGILGLVAGGVGLFPRFPLFPFGPFWLLFWPRLSRLAGWARWGLSGVSWAPGSPE

SEQ ID NO: 940341 - protein, 97 aa, Homo sapiens
LLGSGVHSRLGAGKPAKLICIYSHSPSLALPPELRLLSHQRWALDSHSSTSPIVNCTHEGCRLHAPYENLMPDDLSLSPVTPRWGCLVAGKQAQGSH

SEQ ID NO: 940342 - protein, 59 aa, Homo sapiens
PPRKMIKRLSLRPAPRQFRPPWPWQIHNEVIDDQGRAGASTAARVSSPRVYFLPFGLEM

SEQ ID NO: 940343 - protein, 45 aa, Homo sapiens
GSPKGGKRASLVKKLGFDPRAIIPCPPWAPPWVDDDKKSGPWALS

SEQ ID NO: 940344 - protein, 104 aa, Homo sapiens
FRGFFSPRGPWGGPPPRVWGGGPPPPPAFWGPPPWGGGSLGFGGRAPGPPLVFPPTPGGLVGGPGGALFFPPGPPAGPPGFVGGFLGRGLFSPLVFFFFFSPPG

SEQ ID NO: 940345 - protein, 98 aa, Homo sapiens
ALFAPMGPLGAFGPPLTGGGGPPNPMGLPPGWLGPSPPGCFWEGVFTPSFWVGVSGGPPPPLFSVKGPFLWGCPPPKGLWVLVSFRGLPPPPPRLGCF

SEQ ID NO: 940346 - protein, 283 aa, Homo sapiens
PFSPKDGAVSPVVGGGGLIPRAPFPWLFVPYTSCQKGWAGRIPGYGPGCGPSGEGPPPPPVGFVGFFSPHPSWGVGFPGEPGGAPPPLGGGGPSHIRVVGNIPPEEGCTLPAGGPPPPNPQLGGGGPFLFPPPQIFLALGGFCLGGFFPRGAPFFPSRGGKGGPPPPPKNFLKGVGFPFFGPPGGPPPNFPPPGGARPPQEKGPPGGVPPPPGFSFFSPPPGGGGGFFFPPPPSPPPGGGPGGFPGPPGGFFFFFPPAGPGGAPEPPPPLLGFFFFFYPVPGF

SEQ ID NO: 940347 - protein, 219 aa, Homo sapiens
FSGGATPRIYSPPFPRVGVFGPPPKGGGEGFFSPGFFQFPPPPLPLCGVCLVAPKPGVFSIFVTPPPSPQKGGGGWGGGGFLNNTPFFTPATAGGPPPLFFFPHKKPRGPPPPLFFFWGGGGDFFSPETPFSLLALFWAPLKPFFSKKRGGARPVFPGFFSPPPPPPPPGFKAPKKKVFFFFFFFFKGGVFFFFPLFWVFWTPFFPPQPRFFFFFFFFP

SEQ ID NO: 940348 - protein, 67 aa, Homo sapiens
GLSVCDVSFMEQAKPDVWEDRELKESDSPTQAGGPRTPLRPPLRVPALVPPQPESTVWTAKRVGTGG

SEQ ID NO: 940349 - protein, 143 aa, Homo sapiens
ELMCFPNHVVAIAVDWQYLFTIHNDWKAAVDTLFLLAAQEWKWVPVLMINTEKGELLVASGKNFLKPKKEAEQEMLLLLLDIALSEKEALQLGSSDCQLRVKLHCDAVSRLRIVVLNAEFPFPPSLLRWTFGECEPQNIANRR

SEQ ID NO: 940350 - protein, 110 aa, Homo sapiens
RCGGGKRRRQQRQKAAGAKSGGNSGGGKKPRRGKSRCGGGAKSRDSGGQKAAAGKTPWRVKSRGDKKPRRAKSHGGGGAKSSGSRKPRRQKATAARVQKAVSAVGQKAWS

SEQ ID NO: 940351 - protein, 183 aa, Homo sapiens
KGTGHTLGGALLGLTDTGGLRLRALPGWPRRWTAWPLAAFKGFWRRRGWIPVWPQPCAREVPQKGFFLGPGSRRNFWGPQMAPWNWSGAFPWGWFCTSLGPGATPLGNPSPWGGGQKFWFTWVKGWPGGPPGSGGPGGAPRSRGPKTGPRRGGLFFPAGGPFPPPRPLQGLFCPPPNKGPFPR

SEQ ID NO: 940352 - protein, 98 aa, Homo sapiens
AGAPPNPEAPETDGAGGRQRSFNSKPPPLGSKTVGDMIFVTASARSPPPGVFPGPHLFLSGQNYARLPYTLGGFALGHAPPFFHYGKNLPSGPDPFLF

SEQ ID NO: 940353 - protein, 179 aa, Homo sapiens
EECQSSQKTMKSFIQEGSPPDLVCPCAALTITLPGLAPPPPPGPRDKPSRLLSILTPRSSRTICGLAAGWRLLSMCCWKVLTKDYLQQLIFMVLFSASSGQPGGWRGSAGPGGCKLVPVPWTPAGALPGPVGCCPDLHRLQRLAQECALDVTCGNVTCICFHEMLATMLHFSFLYKVVW

SEQ ID NO: 940354 - protein, 219 aa, Homo sapiens
MSARTLGRRGGQSFRLWNKTAIASQPEDQILYQDRYNERPLANEVPIKEEDYVLVLKFAEVYAQSQQKVFDVRLNGHVVVRDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKRTINGRGPGTPNLLATTILIFPGGLFSSNPLLPLPVVRTNDY

SEQ ID NO: 940355 - protein, 126 aa, Homo sapiens
NENLQGDINDWANTKILAQCNEIIPRLYKTPPPQKEIFYLHKKRWEKFAPPFSPNFTKVQEASPEKILGDFLGGEPPPLVGLPQGPPFKRFIKPPKCECSLFPPLLNLLRALIWNKFWGRFKKLNR

SEQ ID NO: 940356 - protein, 127 aa, Homo sapiens
APPRLKPHYAPTSHIGKQFGPGVHLFPPPWEELALNELVTLRCLARGFSPKDVLVRWLQGSQELPREKYLIWASRQEPSQGPPPFVVTSILGVATKDWKKGGHLFLQGGPRGPAVGFHTKDLGPLGG

SEQ ID NO: 940357 - protein, 147 aa, Homo sapiens
VDAAKQQQHVVVGVHGPRTPFKILVKHVGNRLYSVSYLLKDKGEYPLVCKWGDKPIPGSPYRVLVPLVWGPCQPAAPKLAPLPKKPRPFSLNPGPWAPLAAPLSFQPPLPFAVLLPSLPNQPLTFWFLLGQKEPFGGPAFFFWFWEG

SEQ ID NO: 940358 - protein, 110 aa, Homo sapiens
FTSRGFPISPPFPPKGGFFGPQNHGAFPNFVTTPPPFPQLGGGGFRWGFFLTKPFFLTRRFPWSAPPPFFSLLRRPRGGFHPRVFSLGPGGVTFFPREPLFPFGPFWVPF

SEQ ID NO: 940359 - protein, 103 aa, Homo sapiens
LSLVNWIWLSRAFPGNPCLGFCGFGGKRALFLNVTRKLSQGPRGLAFVRVWKMVAPLSPLVLPTSPRVLRGWFNPPPPPVLKKAPLPLSKKKGGQAPRPLGFW

SEQ ID NO: 940360 - protein, 72 aa, Homo sapiens
SLGCSSRARRDPRVSGAKYFIQEYLRISSAGDGRHYCSPHFTCAVGAENIPRVFNDCRDFIQRMHLRQYELL

SEQ ID NO: 940361 - protein, 232 aa, Homo sapiens
GGFIQFPEGQGGGSRGAPPFSGRALPRKPPYWCIFSFFIPLPPGGGGEGFFFSFLSVFVVPSGVKKTFFVGEGFPFFSGSPPWGGKHPPFYVFGLGGAFPPIPFFFSPRKGGKGPPWGPPPPFGGGGVAPGGGFKNQGFPFFFNPPGGPGFGPGKKKTGPLGGGVFPPGVFISPPPFGVSPPLARPKGGVSPGAQKGGAPGFGVGGAPPPPPPGAPPRSPPPGGFFFLGGGF

SEQ ID NO: 940362 - protein, 114 aa, Homo sapiens
KIGKHFRAEVHLFPPPLEELALNKLVTLTCLARGFSPKEVLVFWLQGLQEFPPEKFFFLAFRQEPNQGPPTFFFPSILGVATKDWKKGDPFFCMVGPKALPLAFTQKTIDRFGG

SEQ ID NO: 940363 - protein, 137 aa, Homo sapiens
RSVSPAPLGGFLFVFRGKPPGDGASWGPGGVALNLLFFLVPPGAKVGPGGPPPPPPKKKRGPKRPPRGFSPPLSQKKGSRVLPFWGGRKNPFLPGGGPGPPPPAPVFFFKGFWGPPPGGVFFGGPKVCPPKLNSGGP

SEQ ID NO: 940364 - protein, 183 aa, Homo sapiens
ELEREEGILVGCTTAACVRVPKGFTFSWFDGYRLDITRMACVDINECDEAKAASPLWVNARCLNTDGSFRWIRPGFAPPPQPPPVGPQGPGPEPWHPLAGHPGPPLGAPSGNPTARFWVCARGRPPGPGKGASGRLGGGGPCTGAASPRPSPLCWGPGPGPGAPFQALSLLKNFPLKTPYFLS

SEQ ID NO: 940365 - protein, 73 aa, Homo sapiens
ANHTSISSLFESSCQQFDKLRKRDAFLEQFRKEDMFKDNFDEMDRSREVVQELIDEYHAATQPDYISWGTQEQ

SEQ ID NO: 940366 - protein, 150 aa, Homo sapiens
TSPYRNFAGAGQRLGPPAGPTGPGGIENGASTEIFPCPRGGPPDLGDESSNPGRVGSPDQLPLACSPHYLRCFLHADARPDCSPNPGTPLDLGTWTPSWLPRRGPWHGLKNPYPKKGPSLFLAGHQGDLRLERRDFLGVGLGVINPAGSG

SEQ ID NO: 940367 - protein, 79 aa, Homo sapiens
AHGQGGIRGFGGPWGPRAGSISRLLGYQKRSYASKKMQDKGGVDMRAPRMPTQNPAVQRSLFREIEVCRQKQPGRWQQG

SEQ ID NO: 940368 - protein, 89 aa, Homo sapiens
IRTDSKAIPQSWMDYRTSGVLPVGHVQVAQVQPGSHSRSDFLLFTVKIRSKVVGSQEGLSGRYLDRGPKVASEGRPPTASSRSASFSCL

SEQ ID NO: 940369 - protein, 78 aa, Homo sapiens
SWRDLEKARGQKAAFEPPPEESLAEVLKKDPLENFRIMVELNPYAKALGRDPLFCPGRDSQPRGGKAGAATALPTQSN

SEQ ID NO: 940370 - protein, 146 aa, Homo sapiens
YQTLQLGIALPNFIIGFPFGPPMVPTCGLAKPHGPRTLYFALLVLTSPATPLLGSLFLWRELQEAPLSLAKGWQLFLAALAQGVLEPPPYGALLFPLLSLGLYTLLGAFLECALLEMKSARPGWDKNPPRTPFSPLLGKKIRVCFT

SEQ ID NO: 940371 - protein, 140 aa, Homo sapiens
EEKAKKGLMLPPPPALEDDMEFQLDGSLISRRAVYVLPGHKQKQNQGRPFRPRPEHAGLRFQTGWTCLFGRHWNGTLPPPFFGLGRRWNSTLDFFPSLGVHGEPGENNGDPKRTPAPKKLVLGPTFPWARDTQELIKALE

SEQ ID NO: 940372 - protein, 103 aa, Homo sapiens
RLSDCSFPDLLSLAAEDCCCLIALEAPWTITDAELWITLTVEDSQLYEDTLAGRSVLIKNLTPQTLQPRWTGPYLVIYSTPTAVRLQDPPHWVHRSRIKLCPS

SEQ ID NO: 940373 - protein, 117 aa, Homo sapiens
HQFLRMIPKNVMGSLLPWFSLGPNDSFSQNPLLLLGPGCFGEMKVPRIQKNALLGPNRGPQPPGFAGSGLGQAPRKLKICREPPCLPSAVNPCLSGGDPPNPRIHTDRFNKWPSLKS

SEQ ID NO: 940374 - protein, 105 aa, Homo sapiens
NFYYAVCWPWVILPFYKEKSFQQKESEAFILDSQGFFFPFSPSRKTTVSFVGFWCSPQGLQTFDLVSLLTLKNLRRAASLTLGNPASPAHFFILFCSMRGACRTF

SEQ ID NO: 940375 - protein, 143 aa, Homo sapiens
WGKLEIQQKYPWAGKISPFVVVTARPQEKEETKVPGLRFYPGKIDVHWTRAGEVQEPELRGDVLHNGNGTYQSWVVVAVPPQDTAPYSCHVQHSSLAQPLVVPWEASRKQGLEAMWDLRPSSCPSCLMWELNHRNHSQWIHKA

SEQ ID NO: 940376 - protein, 56 aa, Homo sapiens
VFSVGRGGKRVGPGNQFSKVVGPIGGHKPLTPKRCQPKLTCDLLGVYAIKTNVGAR

SEQ ID NO: 940377 - protein, 150 aa, Homo sapiens
RQREGPEPGGVPRPPSPREIPKPRQALPAWLKVFFPPTFPWGGRAMGAGGTIQRPPLPWLGSGSFFLLNKLPVDKNRWQQGEVFFWSVKDGGLANPFTAKEPFPVPGLISWGGKPPLPGVFGLPGDVWAVPRFYFFPGPRMGIKPPPLPW

SEQ ID NO: 940378 - protein, 136 aa, Homo sapiens
GVPPGAPGGGGNLFFFVPPLGGGPVKFSGKTPYFLGPGGGKGFRDSPQNPRGGLIWVFFFSPRGGFWSPPPPIGFRPPQRGFGVPQLTGPPLLGPKSGPPFPPLGSAPLPPPFLVFGGTKFFPPAPFFFKLFFGVG

SEQ ID NO: 940379 - protein, 180 aa, Homo sapiens
GVWGPWVKWASCSKPCGVGVQRRSRTCQLLTVELHRSLPLPPGPPRHPEAFLPRGQGPRPQISPETLPLYRTQFRGRGGPFRGPVSPLGREEPQEFRAARGSRFRAPIKPGMLGYGRVPFALPHGNRGPPGGPPSFELSLFFFRGEGVFRSPTPRAEPFSAKGGPQIGLPPPELFFPPLP

SEQ ID NO: 940380 - protein, 127 aa, Homo sapiens
NLEAPDAFDSRVGDSDADPSSWAPPPRSPSVTQALWTHPGFLRRGLALKIPVPGPRPFRGEPTWAPGAAGDPPEPLLPVFPSPHGFRGGLFSVFEEFLFWGLSFLCSCFEWRFPFLFICPLKFIIEY

SEQ ID NO: 940381 - protein, 136 aa, Homo sapiens
GDRSVPHRGVKTNFRLENKGKPGEAQKPKGPPPPPFPPPGGIVGKGGPGGNRGKKRGPMDCGGPGGNFKGGPGGNKSGFPGGRGKDQGGFGEEKKGGPGGPPGPFMEQMGGKKGGRGGPGKMEKGGPPQEGKDGPL

SEQ ID NO: 940382 - protein, 165 aa, Homo sapiens
ILKALENAKKKRKEGGKFGFAESIANQRIQAFKMEKAPIDTSDVEEKAEEIIAEAEPPSEVVFTPVLWTPGTAQIGKGVENSWGVLEDFEKENDEGGGDQAIIFDGIKMAPGVEVFDIGSQNAPIILSDKEEEEMIFLEPAKNPKKIRTQPPSAKQKKAPSKKPV

SEQ ID NO: 940383 - protein, 101 aa, Homo sapiens
GAPLGERAPPLCSVTGSQIKPGVPPRAPRAPLATFQLSPPSLPSGVPPGQKFPQQSPQRPGLGFPPPLSPVGAKCMPKNPRGPPGFVFNAWPTFWICQGGF

SEQ ID NO: 940384 - protein, 107 aa, Homo sapiens
AGGGKKGAFPPPPPPWGFGGPGPPPPRGAPPPGPLFFFFFFLGGGPGKNPPRGGGFWGGGGFFFFFKILGRGGPPPFFPLLGLFFPLLGEIFLGGGLFFFLFTPAPP

SEQ ID NO: 940385 - protein, 111 aa, Homo sapiens
QAQLSPIPSFLKLYPPLPVAKLGGFLDLTEQEFRIQLLVFKHKMKNLVWTSGISALDGEFQSASEVDFYIDKDMIPIADTKVARGYGDFFIRQIPKFEELYRTLKKMGQSP

SEQ ID NO: 940386 - protein, 88 aa, Homo sapiens
GLSSYRFVQNVTRALQLAAEFAAKAASEQQANTSGGDSPKVLSPPGVVHLVTQDRAIMTRRGRHKQPRACGGVLKVVSAHRERNPSWR

SEQ ID NO: 940387 - protein, 70 aa, Homo sapiens
SRGRRITRGQQVHTSGNTARHRIYRKNFKISAWWCVPVGLAAQEAEAGGSLEPEFNTAVSYGGTTALQPG

SEQ ID NO: 940388 - protein, 142 aa, Homo sapiens
GTDRAGVRRLQPPPSLWPAPCWSLKCSSPSFWCFGPNSPSSLFSWGGYMTPGPETSRIRLGRGIPFQPQFSVAALVLPAWIWAPAHLLPRVPVFPQKGSLRVWARDLFFLALFQGPAMLSKPLFAAFFGSSSPASLNKPCPP

SEQ ID NO: 940389 - protein, 124 aa, Homo sapiens
YIGFFPRPQSSFSLGLPLAPGGGANRAPARGLFFPPLLFLQMWGGGGPAPVFFPTPFPLPWGPRIFPFNQGPAFSPPPFSGGPLVPSPPPPPAPGLEYWWEEGERGGPPPSPPFKGPPFLGPPP

SEQ ID NO: 940390 - protein, 114 aa, Homo sapiens
GFRPKKNPPSAVCRKPHVVLPRSALGGSPFPAQIIPCGQKAADPTDLLLEVVDVLNRKLPGVQPWGHFLMYVNPQTECERCWPRALSLSRSLWNVRGVLFGFGALKTRNKGPCP

SEQ ID NO: 940391 - protein, 140 aa, Homo sapiens
GGGGLPPGGERPPSFGKGGPPRGFGGLSNVGGVGGGAPLSFSRGGGSKCGFPRAGTTIIFVGGGAPPPRVPPPGGGGVFLGGFKGGGPPPPLSWGGGGGGGVFFFSPPRVGGGAPGGGPFFFSPPPPGGGPPPFGFFFWG

SEQ ID NO: 940392 - protein, 150 aa, Homo sapiens
PHPPEGFLIFRLVFKGQFGGAPEVTQPPYFQGFWDQVAQMYKGFQALRDAASFGFLYPPPMESGLGYSPRSPNPKEEFFIGGKMQDGFLPIPTRSFVGPWNSLSLVQGRGFPKTYPVGCEESPGFSCFSLPRKMQRGPHCLWGGQLLQGF

SEQ ID NO: 940393 - protein, 127 aa, Homo sapiens
GKPPTVPFKVTGPFGFVVGPLIPAPRGPGIVSPPVPKKLLIKGGIDFYPPTRGCPAPLGKFSQGPPFALFKTHNYLTPPLWKETGFPQFPHQGVPGPPVQTPPKVSGQGDQGPPGGPPKGFFPKKKK

SEQ ID NO: 940394 - protein, 110 aa, Homo sapiens
PQKPIWLWEGPVFFGGGPNFFQKSIFRAHQGAGPPFGPLPLWVLLGHSPLGSWWFVLIGILGPFPRGPGVWGFCPPFGSLGPPGRVFGPPPGPGFGGFFLFPLNPLGAFL

SEQ ID NO: 940395 - protein, 68 aa, Homo sapiens
RPRSPSPALTKDVKAAANQMGNFLVTPPLRLEPGKKNLIMGLDGAPYDPKGPPQDLLDSKNWIEEMPF

SEQ ID NO: 940396 - protein, 104 aa, Homo sapiens
SRPVPEGPVPPTAGPDPALTAKEWLGGRDGPLLISLKDGYVPPKNREFRVNRGLDTGRRRAAPKASGTPSSDVFRLEKKIRKLQAPVQELQKRLDRLEETVQAK

SEQ ID NO: 940397 - protein, 173 aa, Homo sapiens
PPKALRIFGEVCPTGHNFVNVLPGGGDPYLSFYCKYLDLSLLLVLKQKHYLFGKGGSWGNSNFSPVLMVSSLLCRELLGPPSPSCSFWYSPRDRSRLEVRPLSPQSLIKCLPSWIHYSLIKITPQIPAPVWHWHCPCASHLRLTGGPSSLKRCMLALSVLTHGSTCGCGAPCV

SEQ ID NO: 940398 - protein, 204 aa, Homo sapiens
GVLCHRTLELPRETVFCWCGSPTVYPLFNLPGNCGPVGPKTHGPFPLGGSLPVSPRAGFGPALPGSGGFPGIPFWGGEAGPPLKPIGPARQKGKRVFFFFWAPLTRNPPALKSPLWERGVQKNWFLRTPGLGGGAQAFGGIPLKAKFGRGGPLLVFWPPPPIFGPHKFFKGGKKFGFLVWTQGGSGFWFPLEGPRGWLPPAFWF

SEQ ID NO: 940399 - protein, 105 aa, Homo sapiens
WGGFVFWFLVFLNPKIFPGVWGPVGGKKKIGPAPGQFFRGFPPGAFSKNYMGGPFRGGGLGPFLVFFGAQKGPPWGALSPWPPGAPFFFLKARPSPPYKKAPGFG

SEQ ID NO: 940400 - protein, 66 aa, Homo sapiens
QAWGPPGGPWGAKPPHFALMQQSFNPFKYYSPFFFKVVAQLVNPGYPPPLEDFFLGLNFHHYFPDA

SEQ ID NO: 940401 - protein, 138 aa, Homo sapiens
PTFKPPVPYFGRLQGGLQARRTIIIKGYVPPTGKSFAINFKVGSSGDIALHINPRMGNGTVVRNSLLNGSWGSEEKKIPPNPFGSGQFFDLSIRCGLDRFKVYANGQPLFDFAHRLSAFQRVDPLEIQGDVPLSYVQI

SEQ ID NO: 940402 - protein, 112 aa, Homo sapiens
SVWKTGFVGPPAPPPAILYSSSSGFSLLFFATFYTKLCCDPAVGLGLAKRIQMKPLLSLSVPQLCRALCPLTPFPLLYLILKSVYCKEAGCQINTIFNWAVIEDVIKPFALR

SEQ ID NO: 940403 - protein, 102 aa, Homo sapiens
LTPGGVVPPPGGGFLFWDPGGSPLLTPPLSPRPKGGGGGGGLPPKNPPGFGGKKPPGPPPFFFWGGGGGFLPPFWVFFPPVGPGVFGGPPFWGLGKFNPFFP

SEQ ID NO: 940404 - protein, 72 aa, Homo sapiens
TGPGFLSMANQGQNTNNSQFVIPLKKPDPLAFKHVVFGFVKDGMDPVKKIESFGSPKGSVCRKITIPECGQI

SEQ ID NO: 940405 - protein, 187 aa, Homo sapiens
CPTGSSPRAWVFPVWGAPFPISPPRGGVVWGPPPTLKIVFKRAGFSPFKAPFRGGGFSPPQKKSQANRLFPGNPLEGVFFLEPKTGPGNPGPPKLLGRFSPPPRPRGAKNPFGGVPPPPGPPPRGFFGPKGGFRPNQRVWGGKTPPGGPVFPPPLFPLGVGQIFSPPCPLKKRGGPFLSPKKKFFFL

SEQ ID NO: 940406 - protein, 71 aa, Homo sapiens
GVKGWVAPSQPPPMDKQTSEPKWTSLGPPRDQKQSLCRTQQMGTWDPLHPGPCPKRAKARPKGKASPLCQT

SEQ ID NO: 940407 - protein, 87 aa, Homo sapiens
NPVGALQKLVVQKGWRLPEYPVTQEFGPAPPKKFPMTCRVERFFRLVTGQKGVFPTPLPQHFGPNQGPQSLSQPRIRPLFFGDYEWE

SEQ ID NO: 940408 - protein, 133 aa, Homo sapiens
RAWSRRCVRFSQARPRAGQGFQVGPTSFWGSGHLGKPRLPRRPPKGSAGFCLGPRPCLCLKLWGLGQGSSSSAFNCGCHPWGFPSAFQDPPSLKGRFTIPFALQSQPPRLTSGLEPPLDELPPAPAPLKTRKP

SEQ ID NO: 940409 - protein, 83 aa, Homo sapiens
TFYAGGGIALNAPFSSSFSGMKRIWVQQQGGGPHGPHGLQGVRPLGPQPQQEPKRKKKTLPFGESLPHSVPPPPEFPLLPVAM

SEQ ID NO: 940410 - protein, 122 aa, Homo sapiens
GLPIQHCRCPLAHLLLVPPSVHLAGVPGPNRNSQAITQGSQGCPPPQRCQGAAIRALAGGPKGPPRICGPVTFPRFCFPVPPPSGFEIPDLGYIKNAELVFRSPASFIFLVFQKKTLKTGKE

SEQ ID NO: 940411 - protein, 113 aa, Homo sapiens
KEGQPTSPRGYWSFWAFGTLGQGGFLLRANFFPGGKKETRVVPNPCLLPQHFQNKAFKKAVSQRPQAIQAFFWSIPLPPILPHTWDGARKNFPPLVGQPGGPPGMDNKNSKEL

SEQ ID NO: 940412 - protein, 146 aa, Homo sapiens
HPLVANTCRDSCLAAPSCLDLALLTELCQRVSFCTDMDPEPQTFHPVLSSFLFKAPLVPPGSPVVNALFRQRCIENILRAWVGLPPQNHMFLEHKMERPGPSLKRVGPVAAPYPLLNKKGPVPPAPNGCPGDANGHLQKEPPMPPP

SEQ ID NO: 940413 - protein, 82 aa, Homo sapiens
SNQQCWRQTHQCDPPPEYYVGEVKQIVSPLLGDHYVQLPATYMNLGPSTSHEMNVRPEQPQFSPMPGNVRRPRPLSKPPRPT

SEQ ID NO: 940414 - protein, 224 aa, Homo sapiens
VLWRLRPVPAGVWGLPGAARFQPFRSPFVWVGGGPCRPPLTLPGLGELVSPLPAGSRKSLLVPGAEAGAGLPTLSLAVKPKWGTPRFKGWLGIAKNHPLCPPGLPPGRKRGCRAFGRVLPRFGFLGGGALPPVGGSPFHPFGRPGVAFKVGPPLPPALVFLRVLGGFAPFVTRGFDPPPLGGPVGLWGWGLPFACGEIYLWGPLVGGRGPAPPWGFNLGAFSPL

SEQ ID NO: 940415 - protein, 122 aa, Homo sapiens
LVKGFYSNIPLEWGNHWAPGKKFKTPPPLLGSRGSFFLFNKLPVGKKRWAQGEVFFFSLMDEGLPHPLPPKKPFPFFGVISWAGGQPPLPRLLGLGGEVLGGPRVHFFRGPRIEIKPPPLPL

SEQ ID NO: 940416 - protein, 223 aa, Homo sapiens
PKLLTQYYLVLWSFLVQGDWETGGLGARKLPVKPSNLYDKEQHFPSTTSTTTKSGTSCASRFEYVDNVHPAELISGDPQVISHVSPPKSSSFFAEFGMDSGFPKKGSSNSSKVQIQETDEARKKFTNAKSISSAQYFGDQNKADADAQVSLQKFSGSSAISSADLFGHSDDQTIDLAASDLINRISFQAQQDISSLKNIAGETGKKLSSFASTFMNDLQDRIL

SEQ ID NO: 940417 - protein, 83 aa, Homo sapiens
PPRGGGPFGPPPPPGVYPLPPPPPPGPQGGGGPPFLGGVFPPFFPPPKVFPPPPGLFFAPLWGGGGGGAPPFFFPPFGALGFP

SEQ ID NO: 940418 - protein, 133 aa, Homo sapiens
GGLQMLRVIQRQSPRFPRGALTLEVHRRFLDLEKGGYKHKDIPAPSCPPVEAPPTRPPRDRAGFSVFVQNNREEPGGPPPRGALFKSGLSPVALPACKKSVKKLNGLGASYPAPSTVGPGAGGPAHPKTGSKK

SEQ ID NO: 940419 - protein, 153 aa, Homo sapiens
GHKNLGLWVKRVFVLLIHSPSIFIIIIQVKRLWSLFTNLVRTLKWVDPNPKILWQIATNIINVQTPFFGCLFNHWGPFFPYGYTFKPRSFVWLFRKPGPFIFFLKKSFKFFPKNVDPFPGKLIGQIRNNKIQCYLDFKLHSWYAPKLGFNSPP

SEQ ID NO: 940420 - protein, 108 aa, Homo sapiens
VPGFFYWVLKTLSLHPWGGFAGGGGGNVPASGPVFPNGAPPRSPPRPGFLLNPFPPGAGGGVSSPPGGAPSSSRAPAFPAPFPPLFFLPPPPPKFIFVFPGGPLSPSC

SEQ ID NO: 940421 - protein, 84 aa, Homo sapiens
SGDIQKLLKNGSPGFRLSLGILALLTLLGALGIANSFLDENLGLNIAKKLRGQFKLFFFPLKLAETVPPMKVIWDHLLNKNKVF

SEQ ID NO: 940422 - protein, 74 aa, Homo sapiens
NSLLLLNVPKPISSVRRLTNVLCRGDQTQCMALLFSFPYQYVSISQIVIDVGPKRQGLAWLNTSEFILTLTDGD

SEQ ID NO: 940423 - protein, 101 aa, Homo sapiens
NPSGIRKRWILAKGPCALPTHPWFGPLLALALYPKHHPHRLGTSPLACLCFSPNPLKWGRKRRKREGACPPLRHLGGPRPQGLYPSLRGLSPTHLLKSNLN

SEQ ID NO: 940424 - protein, 90 aa, Homo sapiens
CSGGALENLVVETPDLTNLMGTWRTVSSSGIVNAPINDLSKQATRLYQISRMWVGPDKRIKAGCPSQHWQLARVPFHAVGALFFAINLAT

SEQ ID NO: 940425 - protein, 62 aa, Homo sapiens
PDSAEAERAELQPAWKGRLGRPIPLDGGEVSSVRKKAQRRGADRLANMPALYLLGGGGGSVN

SEQ ID NO: 940426 - protein, 142 aa, Homo sapiens
ETWLSAILPLPWGPSPWYCLHSPQSPPQERRLPPPPHLRWFNRSACPQPSPIFMAKLILKQNETANLVCLNSPQGCHSIPPPRGLVREQTKTPKQGVLQTQMVGYNQTTLDPKHGLHPRFLAHLPPPHPVYLEISLIKRIIS

SEQ ID NO: 940427 - protein, 64 aa, Homo sapiens
SGKGKGIAGREKMTANPGYVSGYKGFGPSDKKTKKEELHFSLLPPDPACLTPGSLENNKHLCVQ

SEQ ID NO: 940428 - protein, 82 aa, Homo sapiens
PGGIACEKPAAGMGQAPAYSATSVDVPTPVQGAHGDRHLGMSSLEQLEQNLAAAEEGPLEPAVVDALIKLAFELLRMSQYFR

SEQ ID NO: 940429 - protein, 39 aa, Homo sapiens
MAGTFWTGLPLLGQSKRCQEEHGCGSPVSQEIKVYLRAA

SEQ ID NO: 940430 - protein, 149 aa, Homo sapiens
PPPLPKKGVCPPKKKMGGAGGGAGDPPKKAPILRARGAPPCVCCWPACCGCPVSSKSCCRPPGTVAESERSASCAPRRPRKGVLSAASAPSASSASSSDAEAEPPPEPLLSDSESLAARARCAASPLRRERRQRRGPADVLRDAPRARG

SEQ ID NO: 940431 - protein, 71 aa, Homo sapiens
MCSYCSTDLYSLWSAVGCFPEASIRLFAELVLVLCYLHDLGIMHRDVKLDCAAAETTPLHSSSQGDSESPS

SEQ ID NO: 940432 - protein, 68 aa, Homo sapiens
SSVMLSTFYLHTVCNPSPEAFSSCKIETGPIKQQLPICPPPAPGNRLFASFSMDVTVLGTSYKSNPPV

SEQ ID NO: 940433 - protein, 94 aa, Homo sapiens
SFCTAKETTIRVNRQPTEWEKIFAIYSSDKGLISPIYKELKQIYKKKTNSPINKWAKDMNRHFSKEDIYANLDTSCFCLPHPTLFYIFYKCAKL

SEQ ID NO: 940434 - protein, 106 aa, Homo sapiens
KFPEPVLNRGRARGVFFPPKKPPGKIFLLKKNGGEIGSPKFFFFWAKTPPPPRICPPRVLVFFVSEKRNQRGPKINFFKKPKGFGVWDLGAPILKAPPSQKKFFPP

SEQ ID NO: 940435 - protein, 173 aa, Homo sapiens
KNRGCVSDQRLKVFSGALQEALTEHYKHHWFPEKPSKGSGYRCIRINHKMDPIISRVASQIGLSQPQLHQLLPSELTLWVDPYEVSYRIGEDGSICVLYEEAPLAASCGLLTCKNQVLLGRSSPSKNYVMAVSSSGPSAPALGAERPLQELRDGSLQLGPSAPALGAAVLMLP

SEQ ID NO: 940436 - protein, 116 aa, Homo sapiens
GAGTPVQISKDSGRDGPGQAQPPGAAGEPGAGQNRVQGQEARNLSVRGRWTPGTRYRWGRDRVSHEGRLLLPAEQQDPQPDSVPTGLQPLLGKAGRPPIQDTGGRSVIFWAGQSWG

SEQ ID NO: 940437 - protein, 101 aa, Homo sapiens
PPPPPVSQKKRGGFHNLAFPLKGPFLGGSPLGEFSPGFPRGGFKVKGFYRGFPPSKSRGGKFWGFPGVFCQNPGLGLGKGGKPGPLNPKTRGLTKGGGGLF

SEQ ID NO: 940438 - protein, 106 aa, Homo sapiens
PSVFSGVVEDTGPPAQPFAPPSPAICAPQPLWSFFLVLSPLPQSFCPKLPFERVFFIFHTSPKLSSSPFPGLSPAVLSVSWAKKRKWGWEGLSLCWVFPPINWGFL

SEQ ID NO: 940439 - protein, 81 aa, Homo sapiens
VGGPPPGGNGFGRGQNPNVQGFPPYRREAAGPRSLHGPDPGFPTCELVTIPNLAAKWRLNLGGGGGGRAPGFWNGCGCRLD

SEQ ID NO: 940440 - protein, 92 aa, Homo sapiens
MEEERKESSIKKEREKKSRRKEEEEKKEEEERKEDEEKRKGKKKEEEEEERRRKNKKDEAEEERRKEERKKEEERKEEDKPKKEAEEEGDSK

SEQ ID NO: 940441 - protein, 139 aa, Homo sapiens
KLQELRLFTSSALLPEPVPTLFFTNRRAGERDLTFGLPAWLFGSALAVFGFFIFYRSLLCSPPTKTVFYHYLPFTQGKGYGREMENSLSYFNPKGRIRCSGFSQTSHLLVQGDLLQLSTQGSIIYLKKMKFSSPRSIGM

SEQ ID NO: 940442 - protein, 42 aa, Homo sapiens
LRKYPVVYLCWGRCEEPECLLCGNIMSIAAGGAGCAPAKRPG

SEQ ID NO: 940443 - protein, 108 aa, Homo sapiens
FLKKPPPPPPPKEKPGFFLGVFPPPDKKFIPKRSVCFTLFFFLFLPKRRWCFPPPPPKGVRWDPQKGCFTPPIPAYPHESLILVFIGIAFINNAFIIIKTLVLVLSLR

SEQ ID NO: 940444 - protein, 67 aa, Homo sapiens
DPDHLFETISQTMLNAVGRDAVSGMGVIVPIIEKGKIPPRALKGRMGYTLFPEPPFFSFFEIKKPVF

SEQ ID NO: 940445 - protein, 145 aa, Homo sapiens
GVGGGPQRAPPPEFGALIWWGEHPPAVFRPVFPYFKEAPGGFFLPPWGGPSPIWGKKVVVLAPPPKTPPLFFCLLGGFPPPKRGGVKGPPRGGGVPLFPKKFLGGGGGETPPPWGAPPGGFFLGAFGKKNPLFFSPPPFLGGGGF

SEQ ID NO: 940446 - protein, 152 aa, Homo sapiens
QNPNATPAQGASSQSGYAGSGGGSSASHVSPRQPSSQWPHPYMTPRFLFRAPSQAISPPQYPQVQGSTPPQLGQGQPQPFFSFRQRQQQPKFHSHAALDWGKMAEQWLQEKEAERRKQKQRVTPWPSPSPMVESPPMSLAGDAPPLLDEMGR

SEQ ID NO: 940447 - protein, 135 aa, Homo sapiens
TFEDVAVYFTQNEWASLHPTQRALYREVMLENYANVTSLFSLLRTLRQCVKLVTPAMFQTAWRQMESCSIDRLECSGAILVHCTLPLWGSSDSPASASRVAGTTSTRPHTQLIFVFLVETRFPHVGQDGLDPLTS

SEQ ID NO: 940448 - protein, 132 aa, Homo sapiens
MGNPFGPGVPLFPPPSKELALNKLVTFRCLARGFSPKDVVVRWLQGSQELPPEKYLIWAFRQEPSQGPPPFVVTSILGVATKDWKKGAPFSCMVGPGALPLAFTQKTIARLGGKPTHVNVFVFMGGVGGPCF

SEQ ID NO: 940449 - protein, 104 aa, Homo sapiens
TVLFSILASSTLIAYHQIAGVANSSSPQSFAGGKPPLSYASALGAPPKPRPPPEQAKKSNAPLSFFQESLGGSFGPQGFSSFFKKSLFFSPQGECFNFCLDPEN

SEQ ID NO: 940450 - protein, 112 aa, Homo sapiens
DEIFYTLIYLSGITLPLKAREKSQLPYRRGKGQVIWGKRSYTWSKVSSRLGNLSCAGATGPEPSQKPKGRHGSKRLSAAAFGDYMRMETSKEARLLELLPPISAWIIYVISE

SEQ ID NO: 940451 - protein, 138 aa, Homo sapiens
PSPGVTFPIRGVYPRAGGEQKTLFVNLGPRGDPPTTEMNLWGRGGHPPPFGVLLVFGGTPKPRGVSPQIFGGAPPISMPPIFGAPFSGGEGEKPPPPPTNWKGVSSPKKPRGGGFFLFPLKKGGFFFLPPAFLKASPR

SEQ ID NO: 940452 - protein, 93 aa, Homo sapiens
TITASSNLRFPGSSNPASASLAAGTLLSAPDASHQQRGRNFSPGATASCCYFKWLKTKRVAPCHCHQVGTLASVRKPFLLGKPMKFNTHFKTS

SEQ ID NO: 940453 - protein, 65 aa, Homo sapiens
KIVRPASSTGQKTPLHNSLALSTRLECNGAISAHCNLRLPVRGEASWTSWVEWGLGELFCLAKDL

SEQ ID NO: 940454 - protein, 64 aa, Homo sapiens
GVSFDDEMGTERKSDQQVQVYVRRDVMDIQAGIVYDVASEAPLPGVLLYRSLCIYTDKPNPMTC

SEQ ID NO: 940455 - protein, 75 aa, Homo sapiens
EQSKRTHTPNFKTKQQVIMIVWYWHKDRHIDQQNRIENPEINPHIHGQVIFNKDAKTIQLKYKNTLFNKWHWDNG

SEQ ID NO: 940456 - protein, 71 aa, Homo sapiens
QEIPLAHGSYWKVTGPRFNTMDPSGLPFHGHTHLEGHPHGLSISCKNTSIPSSPRQQIHRTFPLSFFWGFP

SEQ ID NO: 940457 - protein, 111 aa, Homo sapiens
SYVQLPMGKPSRSPICFPKKTRALKGALPAAFFSMLEERHQRQNNDPRGGGVPNWFGFLGVANRDAPQVGNFGKTTTPGGGASPIGLGRYGAANRDAPQVGSFGKAVPPPK

SEQ ID NO: 940458 - protein, 131 aa, Homo sapiens
GQVHVLQSRKIFVGPKESLYLVTHYARPLRSPVPLIKGNDTIQIYLEAGQISDFIKFDPGNLCMVTGGANLGKIGVIPHKKRPPGFFYVVPVKKANGNSFAPRLSHLFVFGKGHQPWIFFPPGKGIPLPLF

SEQ ID NO: 940459 - protein, 68 aa, Homo sapiens
APPPPPPPLVWKAQNTWGWGNSLGAFINSPGEKVAMPKLVRSVTVVYDHKDEDGNDLLPPPPVSGNPP

SEQ ID NO: 940460 - protein, 39 aa, Homo sapiens
KITKKEALGWFQQKYDGIILPGKEIPVFIQKSNKKFSVN

SEQ ID NO: 940461 - protein, 34 aa, Homo sapiens
ELSNVLAAMRKAGGKKPEPLQSPHPEIKNRSAFR

SEQ ID NO: 940462 - protein, 76 aa, Homo sapiens
SIGTASPIAGFLQKTKAGGMLPICLEVDNINAAVMGLKKKKIPRLSEGVKIGAHGNPVFFLPPKDWGGALVELEQA

SEQ ID NO: 940463 - protein, 130 aa, Homo sapiens
APMSGRRAPGNKTRTFISVAFSINYDRGEEEGYLNFIAPPKREFYLWTNGVSALLGSSMGNEQTRLGLEQLLTMETQLGFLEVEKVPIPEGPPPVAPPPPKLKFCYECSIAYTFTVWVAMGPNFGPFNNP

SEQ ID NO: 940464 - protein, 107 aa, Homo sapiens
PPFFFFKGGARGPGVLKIFHPGPRGGKNGAPPGSPPLFGGPLFPNGARGPPLFGGGKKTPPAGFPWGGPQIFPFGVSPVFFTPGGPPVSPPLGGGAPPFFFPLNFLF

SEQ ID NO: 940465 - protein, 96 aa, Homo sapiens
QGPQGLGQDRFQGQCTQVGVEFMADPSRSFIPNVKGPVGEGDVLPPFGVKAKSPEVALSLAARWVLDVGFAPLADGNGLSQFAPFFCPPPGTEMLL

SEQ ID NO: 940466 - protein, 74 aa, Homo sapiens
MGSSAVQSQLQFLLRVYSREDSQALPPSRVPRPPSRASFGACADWSCVQGQRGARAAAVKRLCSAETAVPIARL

SEQ ID NO: 940467 - protein, 80 aa, Homo sapiens
WSPQGLWGQGFRDQLNPGVPFFLGWGLGPNPGNKLKKFKGLGPPWGPFVFPPGVTVSRAFGTPVWVWPGPFGPWGFFLAL

SEQ ID NO: 940468 - protein, 76 aa, Homo sapiens
MAAEPLQSLKESLETVVTPFFTFARQEGRKDSLSVTEFKELVSQQFPLRPRMWALLIKIWTAWMFIRFRSSSSLSP

SEQ ID NO: 940469 - protein, 77 aa, Homo sapiens
QIGKKCRKRLCGGKPCACESCVKFKTKVEGLLQALTRKLETVSKRLAILENTVVLRLPVTPVASPRVLHKSPGALPF

SEQ ID NO: 940470 - protein, 141 aa, Homo sapiens
DRSSLCTVGHGRDDRVVDRRARRGRDPAGEIDRRVPDVAPGDRQVRQLGRAARRRERDSVRRVVIKAGRDGGVAADRDTDRTRIAARRLDRQTRRAGRDDSGIGPAELHRVVGRVRIEAAADNRDRRVRCALGRREVVDRR

SEQ ID NO: 940471 - protein, 106 aa, Homo sapiens
PEHLGPDFGHLHDHFAHHHPSVGCPGPTIDQEASFRPGASARDLYPTYSIFHSSPCPQRPGALPLTCIPLTPPSIPRPVPTTESCISPLSSHAFLQWHSIKCICFW

SEQ ID NO: 940472 - protein, 91 aa, Homo sapiens
PWWGKTTPPIMRENPELVEGRDLLRCPSFGPLTLGEMMSCPGPMAPRALQATLLCGQARIPGAGLRGVNGPSGAQVGVSTLSPPPQPPALK

SEQ ID NO: 940473 - protein, 84 aa, Homo sapiens
RSKIKNALAHFLPQGTPTPLIPILVIIETISLLIQPIALAERGAASMAAGRVLMHLIGGATLAISTMTLPSTRIIFTILILLTI

SEQ ID NO: 940474 - protein, 156 aa, Homo sapiens
LCAPYGRAVIMFGVPYVYTQNRIFKGRLENLRGQFQICEKDFFSFDSMRPPAQCVGRAIKGKTEYGLMVFSHKRFARGDKRGKPPWIQEHLTNSNLHLSVEGVQVAKYFLRQMAQPFPREDQLGLSLLNLEQLKSKETLKRIKQISQQLLMGRVGP

SEQ ID NO: 940475 - protein, 124 aa, Homo sapiens
GRPKVKVEYPIMSSTDPENGLILDCIQRSHQNTWKVEHAILIFRADGGVKHPRIAYGLGLAWTVGRVLYAYGYYTGELSKRSRGALGSIALLGLVGTTVCFAFQILVGLKVAWAVDPNAAIKEL

SEQ ID NO: 940476 - protein, 64 aa, Homo sapiens
SPPSFAPPLPPMDPRKVNELGAFVKMCKQDPSVLPPEEMRFLREWVESMGGKVPPAPQKAKKTK

SEQ ID NO: 940477 - protein, 167 aa, Homo sapiens
PQRPKNLARGKVVYFAPRSPGPGASLGTGYDPKDYFKGQTQGDPTTTNPPQHPPPPRELEGAPGHPGCSLASEASPPPKTRKPPRWIGAASPTTPGFSGRAVDFGAQGPTCMDFKPPPFGARGLGDPQYLTPPSSPIGPLPPCSRWAGAGSPGRGPLYFSIKAFRFA

SEQ ID NO: 940478 - protein, 62 aa, Homo sapiens
MVSVRQDPGSTFGMVLSMATTICDYITLKSNPAAKIRSPELGGSKPVPLSARPPPSRPAREG

SEQ ID NO: 940479 - protein, 64 aa, Homo sapiens
MSNPGIQNGENKALFNKNLGTNTMCTPSCGVRTGQDDDAAMCPIHLAQRHSAEDGGVQTATRVN

SEQ ID NO: 940480 - protein, 139 aa, Homo sapiens
LKGTILTLQDRFSHSNFIIQTLILLEGFVWMVSNCPPKVLETSLNIATVLTSIQLVMSEPNPDDPVMGDISSEFKYNKPAFLKNARQWAKKHARQKQKGDEEKMLDNLPKGGDSKGPNSTQKRKASQLVGIKKKFHPYV

SEQ ID NO: 940481 - protein, 74 aa, Homo sapiens
GAFSGPANGPISTHFFPAEVHKNPGLSQSSAENSQRMKMVETRGQDDQLQRAVPSLLIAGDGGVTSYREEYLLR

SEQ ID NO: 940482 - protein, 48 aa, Homo sapiens
NVFAPPPPARDTGAVPYIHVIYLCPDSLCPVQIKNPKVRAPGPRLRVG

SEQ ID NO: 940483 - protein, 68 aa, Homo sapiens
SGTHSRKLLKEMVDLIGSMSESSAGPVGGSPGQSGPVEGPWIGFKEEEALGKQEGGSVLSGVNPISDG

SEQ ID NO: 940484 - protein, 185 aa, Homo sapiens
TIGGNPRGSRTAINESSVRNSNSSAFGFCQNTCNCFDDIVSRRSGNAVKNRFRIRCGGKDCTFAFEFPTPYIRERQISIMADCQLAMLADEENGCTSFIVLRPAVEYRVWPMAEFPLSFAESFFIKNIGYQPNRTKLMQFISIGRNNAASLLPAVLQCKKTELCKCGSLRMAKNPENPTLFFELI

SEQ ID NO: 940485 - protein, 109 aa, Homo sapiens
EQPENAHQVESPLAFSCFRNIVDHLLNVKIRKMKAFMMIYFHFNKCTYPCACNILVDAVNVRSKSRRNAKAQSNKKMNGTLSGGYKEDFSQKHNPAPNITTSRLPPLKI

SEQ ID NO: 940486 - protein, 115 aa, Homo sapiens
MFFAGPRFDLKLLGACCHWVLPLQRLLRFPGAPQDPGSQILFGDVHFWPPALQSFSPGEEQWLFKAWGNQKKAGVYFCVGFGVFLSPRDCFVFLSPPAFFFVSLPPLNKLWVLFP

SEQ ID NO: 940487 - protein, 68 aa, Homo sapiens
PKGEFGVYLVFDGSTRPYQCKIKAPGFAHLAGLDKMFKGHMLADVVAIIGTQNIVFGKVDLVSRGTSV

SEQ ID NO: 940488 - protein, 93 aa, Homo sapiens
GPPPQFFFPILGFSPGPPGYGKNPQILGRGPPVWFPPQKISGFWFWFPLTKGPPKGFFFWGFGEKTLWGFLGNPFPPPPQNGSLAKGNFGLNF

SEQ ID NO: 940489 - protein, 109 aa, Homo sapiens
RGGRHASVPTTPQDLRSALQGRAGGQQGPGTAFPLRPRHSARGLLTCKPGRSPSGRAWRKGGGLHALYVETTGPARAFVLRRAPQRRPRPRRRPAGCDQAPDPAMHAAP

SEQ ID NO: 940490 - protein, 172 aa, Homo sapiens
MLAPLVECLPLRPPGRRSRSPVIPGVDIVMYPPPQGTSFPKEASQKFLKDFMESIQGELEEPRPERVNPFLAGGAEPIKPLLAYFQNSPFFFGENLNPNGMGAFLGPREDGVPPYMIFFKDGLKMGKCFPKGPIFLGLSPVLITGFCLSSPPPPGFRPMGLMSFWAFPFFWL

SEQ ID NO: 940491 - protein, 109 aa, Homo sapiens
MEQETGVEEGSSSHRVQATSEPGNASSQRAKRVHALKRLRDSANANDVETVQQLLEDGADPCAADDKGRTALHFASCNGNDQIVQPCSHLDWLSEANFIILADFRTLTA

SEQ ID NO: 940492 - protein, 81 aa, Homo sapiens
ASVCVCWGYSGNALPSLPCACDEEGCQAVVCGWGGGGGAEEPLLLQGRPLLSLPNAGSRGPATFHRPRWKSPPAEGVGGGG

SEQ ID NO: 940493 - protein, 75 aa, Homo sapiens
KRAVRGWNRLAGPTYRGVYGTNLLRHAKVVWEMLKFEMALRLETLAMRLTALLGCVLVPLNLVPPTEELYQYLET

SEQ ID NO: 940494 - protein, 109 aa, Homo sapiens
GGPPPFFGDFGGFPPPGVFPPFSPTWGGGAGAGAPPFFFFGGGGFGPPISPGGFFNVFPPPKFMFSFPPRGFGRGAQPPFSPPGAPPFFFGGGPLSGGAPIFFGAPPVL

SEQ ID NO: 940495 - protein, 114 aa, Homo sapiens
MGGGGGRWGVFFTQPCFFYRPVAWGGPPPCFFLLLKPGGGSGPRPFVLAGGGVAFFPRKRFILFWRFLGAPLIPVWFKKRGGGGPGFPGCCCPPGPLCGGGRGLGPPPPPGFLC

SEQ ID NO: 940496 - protein, 126 aa, Homo sapiens
GTGWCRASLSQCWCWWPAVAAELSSCTPLSCRAPSSGTDLDPGCHPLRSRAAQLFALAPRPEPRAARGAGAYPERLEAQLAAQLPAHRPQPLLSHPEAQRLNQPTLGWAQVPGPKPLGIKNPLSRP

SEQ ID NO: 940497 - protein, 154 aa, Homo sapiens
FRPIPASSPCPRAPGRRPGPWGVTQRKDGGDLRGLEIRTVQGLECRDEWGEREPSELVPGLCQSVGPGWGGREEDQIRRPGQGGRSHGCGGARWGFDLAALTQAPPRPGLRVWEIEGTAGPAALELGDRENPLPGSLETVPTPHHYIPSARVSE

SEQ ID NO: 940498 - protein, 157 aa, Homo sapiens
IYSPDTIIGGVPFFPFSKRGGLPLCGENFNRKVWEALKPPRAGFLVGENTRVNCLGGIYNGMVLGTGFWESFPKFWNKPPGRVGPMGMGSPFPFGGVSPGGNSYPPGLRGAPPPPPQNFKRGRFFFLPFLLKPRAQFPLKKKFFGGKIKKIGLSFRG

SEQ ID NO: 940499 - protein, 94 aa, Homo sapiens
ESSFGSQECVHLFLSGLCRVCRHSTRPGSFRYTGGPSSNLESRRTLQLECIFLRIPCISTSPSDLLFPLQSRALQPNSCTGLKVLKLRRKIFYQ

SEQ ID NO: 940500 - protein, 119 aa, Homo sapiens
TPKPCGWRAGVGGVYLFGFSHGLGQSSGQTGVRHPGAKFLFWPLQYPKKLGGPFTSAAPRVVEKTVKSPPTSTRTPGFSCDLGPSFCPLGLYFPPCKWGCQPWLCLLHYGFGRLAQVVE

SEQ ID NO: 940501 - protein, 90 aa, Homo sapiens
ATGDARRQQLLKRQPLLEAFDPLRRGLTAPGINIKDKNKFHIPVGTFGSKDKKPKINGLRMEPNHEPAPDKTPPCFSGARLYVKTSRRGW

SEQ ID NO: 940502 - protein, 87 aa, Homo sapiens
MNDDETILDGPPVGLTFPWPPAEELSIAKAGLLTPGLVILGPSSIPRGLGFPPFLPRSGQCSALLGIQNTPSSKLNNNLGLGLAIAL

SEQ ID NO: 940503 - protein, 94 aa, Homo sapiens
ENGIPMLQDSINWGYMRDDTIFQDEDVKEAIRRLPENPYNDRMFPIKRALGLNFKPQILPKEQWPQYEEENFSPEPYLKKVIREKKKREEWAKK

SEQ ID NO: 940504 - protein, 144 aa, Homo sapiens
MCVFPPRTARFGFALVPPGNPQLRKKVFEKDFGPINPEGPCPPCQKPNRAFLPAFLPSDNTAALPPPPVPNIAYQLQFISPVRPSIVEKRFPAFGGDFMGPMYGGPPLCPPWAPAPLAPVGIPLGCPGLGKGRGEGREGGGGKN

SEQ ID NO: 940505 - protein, 158 aa, Homo sapiens
PTPVWHSWAGTLPTSSERTALCRRTPSRSPPSSPLCWTLGRCPSRRACLSSSSVRMRSPAAPSRFPALGISPRRWPTREAPARGLPAPFPDLRRRNCVRRPQHPQPRAGSANPPGPGRGPIAPKTPDRPMHSPVFAPGGLSAGRWQWKLPCATVPAAS

SEQ ID NO: 940506 - protein, 114 aa, Homo sapiens
FIFFCPFKNQGGVLLAPYLESIKKGFFFPPKGMGPVPKGMPPQCSHGKTGRVSNFSPPPVGLVVTKPVKGKIFPQKINGGFGPLKPFKTRDSFLKRVKENVPKKKKPQKKGPWV

SEQ ID NO: 940507 - protein, 86 aa, Homo sapiens
FIILTLTSIGFLLDQRPKAAIMETLRCLMFLMLYRFGHLKPLVPSLSSAFESYSVISEIGLQAKENFGELLSLSDCLTAGNHPKVH

SEQ ID NO: 940508 - protein, 124 aa, Homo sapiens
VGGPCLASGWGGGNQIFFRFPVVSSVWASKSWLMLRPKKPSSKRGRPSILCVGPLEGGNPPWVGLSGGPLMCNGVLQGVPSWGSVPWGAPNKPSVPARVFFYVKWVQAPLPGLSLTPSPVPYPQ

SEQ ID NO: 940509 - protein, 103 aa, Homo sapiens
KNPLPVTPNVVFRLEGSGLQRPKILNVGDIGGNKTVTLPQLFVPVRPGPPQLIASLDSPQLSQVHGVIQVDVAPAPGDGGFFSNAGGDSPLGKTIPMASRGGA

SEQ ID NO: 940510 - protein, 83 aa, Homo sapiens
VEPSQGQEELCEAQEPKARDVLEMAEPPDPPQSSKQETWRHVGSMPRFLADSALISVVLKKNLMFLVVFFWGGEGWAKTWGEF

SEQ ID NO: 940511 - protein, 101 aa, Homo sapiens
RGAPPIYLGLPPPLGPPAFPFLLPARFLGGIGGGKPFSPGNPFCLVSDFLPPPLGDLAPRAQNLAQGGWGGGPPPFPPFFLVFTPWGPPPPFFFVYPRGFF

SEQ ID NO: 940512 - protein, 73 aa, Homo sapiens
MAVKTAFQRVLKAALFPDGLAGGICEAAKALGKGQALFCGLASPCIGPMFAQLGEALWAERLIPLIKVGAPKN

SEQ ID NO: 940513 - protein, 82 aa, Homo sapiens
PLFGCFFVWPGGGLVNTPPPFPVAPLGPCAPVFWGSPFVGTPFPPCGVYPPPPHPPGPRFCGGDEKGPLPHPPPPRVGGFFI

SEQ ID NO: 940514 - protein, 172 aa, Homo sapiens
ADSTDAMHLNVEVTGIRVRSSFSAVMFGFMAGSDYIDGTVTFTDADNHPVDHFKVSASYALGGIAGVDSIRMDWLYEKFTEKTLRDARSGDRGAAGQRSIGSLEEAVKTRCPTERRCAARRAMAADPMSPPTSGLASREPTSCNARVNALCSQLAAAALLFRWPSRLASERG

SEQ ID NO: 940515 - protein, 107 aa, Homo sapiens
GPWLNFGERLGLWALYHLCPAPPGGPPPLLCFPRNFKDKPSCGALGRSPHPVLSQNKHEPPAWNNQLFWLLVKGRGGFSNRCGFPRGPKVAPWAYSPGYSFVPQERL

SEQ ID NO: 940516 - protein, 76 aa, Homo sapiens
SVTCNNSSKNEFSLILEKNPLVEYVEELPTPPFGGTFGGERRELSSCATATCSVGLSEVPWKWFIWRLMLHSCKTD

SEQ ID NO: 940517 - protein, 222 aa, Homo sapiens
RVSFRVVMYEGKIMADSGPIYDTYAGGRIGVLSFSQEMVFFSDLNRNVEILNHQVMKTDHKPMLVHFLELWASEPRDHFSWSFSVLASVWTPRTCDLPQENAVFKNRLSIQPPMNKTSSKHINNCFGFLLKKHLLASVRKVPIPLCLCHRAGCYCEAISEQWTQKHFQACQRREDSLELANKTTLTSSFRNTGSRGPNPKGKGHTPADCIKKIWRNWYMVGT

SEQ ID NO: 940518 - protein, 161 aa, Homo sapiens
GLVAHRAERIFVRFEPSVNSRTVSGLPIVPRTSASVEFADLQPLEQQRRGLDRGEEVPDALHVEIALLVIAAGQRQRGGQHRHGKQPETKNHRKKCAWRKHAARIPAQRQKRETGARPVSCSMRRFGFRFGVGHAARRLRRTRHGRRRADAAARAHEFGQL

SEQ ID NO: 940519 - protein, 101 aa, Homo sapiens
VKASKIEWDTDQWKTENYINESTEAQSEQKEKSLEFTKELPGYGYTKKTHLGVNCDWNTNDFDYILCLIEICCHRRSLQEDEEGFSRDSEAPTEEESEALP

SEQ ID NO: 940520 - protein, 118 aa, Homo sapiens
EEDFANQLKQYRQAKETSNIALGSSFSKESGKKQRMKGVQQGIEQRVKSFNVGRGRGLPKKIKRKERGGRTNKGPNVFSVSDDFQEGPKNLCIRRGGAFSSFNLFDGKESIVILMILL

SEQ ID NO: 940521 - protein, 139 aa, Homo sapiens
VVKNSKTHFLRSHFQESFETGYTSPLPALLPSLCQALEVHPSIISLVGPSLFVSQPAAFFFLNSNQSARLRTDWCCCISSLFSPPWLGVLRAGTVFCAWKARVQQLLTGWACTGPFLQIQKPLQGWPGSTQMLLTLLVI

SEQ ID NO: 940522 - protein, 177 aa, Homo sapiens
PPQMHTAPLFRMGIFAPNHVVAQCRFWAFGFQFKKMKKFSGGIVSCGPVFEKSPPRGKNFGVWVGFFFRSGPPHMVRENRGLSPPGGVSPCFPNMGGRPRAPAPSLSIIKVGGVSAPKFPRPGVKQFPDSQIKFPLPPRVLGRQPQPRFPPQRAPPFFLGPGPCPGVPPINSGTPRL

SEQ ID NO: 940523 - protein, 180 aa, Homo sapiens
AFDGAHGLGGWQWLFLLEALPSVLLGFAVLRWLPNSIESAQWLNADEKRTLRANLDADPSGNKSHALGKAFSDPKVWALGLIDLCVLLGLYAVSFWLPTILRDTGVKDAYHIGWLMVIPNAAAVLATLYCGASSDRARERRWHIVVPFMVSAVAQAVAASSSHGTLRTILLFSLINAGAA

SEQ ID NO: 940524 - protein, 71 aa, Homo sapiens
LHSVPYNVTAPYVSCFVLIKCAHRGCAVVVAPASQEQLLTGRTNRLRSLAPGCVGTVVTFLQTSFHFIFSS

SEQ ID NO: 940525 - protein, 74 aa, Homo sapiens
FFTSTLVVDLTIRGPIGGWAKALLSSFKFLKPAHKNQGKMGQFSGFNLGGRLLPPPRNFAKTKKKPPPPPLGPQ

SEQ ID NO: 940526 - protein, 139 aa, Homo sapiens
YLGGSPKGDVDPFYYDYETVCNGGLIFAGLAFIVGVLILLNKKFPCGGNKKAGKSIKISRNNNLGGAPPCPGANWETKHGPAFGASPFSLGFKPLSPSLPALGVKEAPNSIGPPGGIANSCLGPPHAYNKTGVKDPCFP

SEQ ID NO: 940527 - protein, 151 aa, Homo sapiens
PRPDVGSALSAALYITHLVEFDYPEKFVSTQVGHTYAATTAIYTGVSDEYRNRLLRRALDRHPDLWEQPVNKKMTYRWNLRQLMATRGMFATTDLVPLLAERGIHLSREQVFRLVTTTPQRLSLDTLAALCDILDVGVEDLIDITAADHQV

SEQ ID NO: 940528 - protein, 154 aa, Homo sapiens
ADDSTDAALEILRDSGVSPPGPARLVRAYHRSPRPGSEPPMPTPSVPAAPRLRLKPSPLPPTGFVDGGWWPASADLAAEVPALAAALAERIGPVWRVAFAVAAWLPAEPAIVSQGRLVRLEGFRSQDPHVVHVTGGSMRRLTLLVVPAGTPLAV

SEQ ID NO: 940529 - protein, 100 aa, Homo sapiens
GGPGPPKIWVTKGGGGWAPIPPPPPLGPPPPGVGGGGGFPPPFGPRGLGGGGPPPPGPLPGFGGPLGFPPTGGGFFKIFPGGGGPFWVPPPPPPPGGAPP

SEQ ID NO: 940530 - protein, 90 aa, Homo sapiens
RPALGPRPPSLGTKLHPLILPPTVQVTQQQSLLQTAPYTLGFPLPCGVWVRSIWVFYFTGAGPPPLPLYGVPSRGFPPLLPSLGLLTLAF

SEQ ID NO: 940531 - protein, 181 aa, Homo sapiens
LVLRGFLLLLLVARGVVRPLLRLLPSLLVRLVELVLEIRLLLVVCLLARRVLRPFRAALRLLQCILLLLVAECSRVCRLVRRALRRFLRILCLLQRLLLVALLRAHRTLLVVERELLLANARPLVAHLFTRLAEAGIDEELAVAIVLGHRITIIVFGGALIEHFLTGVEIRCGRGCNGGGR

SEQ ID NO: 940532 - protein, 140 aa, Homo sapiens
CKCPSSKGPLDPDRRDGHVTEGSVAVMVSCKGLASGPPSLDKQEMPLPVNSPLGSDPRKMVYQESPQDPSSWPLGGMASLPEASGSEAPFVPGGPNNMPSHVGFPQNRLMMAGPKPGPWPLSATQGGTPQQPPVNSLASF

SEQ ID NO: 940533 - protein, 100 aa, Homo sapiens
QFYEGVHLVFMPPNTTQMSLVKKVRTLRMHLFTALQLFCLALFWAVMSTASLAFPFILILTVPLRMVGLPRFFPAQKMKCLDANKAKPVFYEREGVDEYN

SEQ ID NO: 940534 - protein, 176 aa, Homo sapiens
VCVLGRKAQLTIAFGSLWAPCLGGISLSAWRKSLEPVASWAGPQGNMPPFFSPTLGPKRPVLCPPGPKRFFPPPPKLWLGWGVGGAQFHNPFLGVAGGPPNFRQKGTFGPGFGGGPLFLWGPLFGGAPPRPLGSPPPSPKMPLLAPKWVFFFPPGLGVSGGPNFCRGKRTCFWGPL

SEQ ID NO: 940535 - protein, 100 aa, Homo sapiens
GTSARAVPPARRRSLARPPRRAADRSMLPRVGPALPLPPPPLLPLLPLLLLLLGASGGGGGARAEVLFRCRPDTLSAWPLRAPAGCAAAAVAAVAGGARM

SEQ ID NO: 940536 - protein, 118 aa, Homo sapiens
GTSRSPPGVGGLVFLACLGNSGIGGIAGVGTPAAAAAAAAAAKAAKYGAAAGLVPGGQALGSSWCPRSWRSGVGVPRSWDSSCPRCWDPRCCGSGVVSPEQLLRQLQRQQIRGQARSR

SEQ ID NO: 940537 - protein, 79 aa, Homo sapiens
LRNSDEDHLDQLGSSSNGPVGPTTPFHPEAFPLLQHQVDQQHQQDQQNPLGQQDLTYHVHQGFPRTKQDQQDQPQLRPV

SEQ ID NO: 940538 - protein, 139 aa, Homo sapiens
HEAPPGPGVHWHDGGMDLASLRAAYRRIAPHTHRTPLLTSRLLDELLGKRLLLKAEHLQKTGSFKARGALAKALTLESPKGLLVFSGNHAQGVAYAARVLGVRALLVIPEEASPLKKAARAYGAEVVERGVPPSPPPAR

SEQ ID NO: 940539 - protein, 33 aa, Homo sapiens
THMAAEHCQVTCKCNKKLEKRLLKKHEETECPL

SEQ ID NO: 940540 - protein, 152 aa, Homo sapiens
PAPALSEVRVFKVQSAKCTETIPERADSTQMCTHRGQTLVYVMEVGLGNSPQAFFDGASVPRISTTAVCQVGSISQPCSGAGTLMGYIYTFQLDNVEAGGTFQYSNTSINPPRNQLVTTLGIADRHPSIALNAHKLRKSDRYDGDFSERRDC

SEQ ID NO: 940541 - protein, 137 aa, Homo sapiens
HEAPIIKPPPGVSSTSRSGSPVIINQVLRAADVLFHQVQQIGATGDKPRRRADQVHRLLHVGRLAVMEGDSLLTSLHAARRQGFFDGIADVVVGAAAAKVAAHQFLDLRGVVGTAFTGQAHRRADLPRRAVATLEGI

SEQ ID NO: 940542 - protein, 101 aa, Homo sapiens
ARAGYQFRDQGLRVDLFEVENQLRQILDRVDVVVRRWRNQGHARHCITQLGDQAVDLAAWQLSAFARLGALGNLDLQHFGVDQVFRGYTKTASGDLLDFRA

SEQ ID NO: 940543 - protein, 140 aa, Homo sapiens
ARGDPHHFAVLIGFGASAVYPFLAYEVLGDLIRTGEVLGDLYEVFKNYRKGITKGLLKILSKMGISTVTSYRGAQLFEAIGLSEEVCEMSFRGVPSRIKGARFVDIEAEQKALAAEAWSARKPIQQGGLLKFVHGGEYHA

SEQ ID NO: 940544 - protein, 132 aa, Homo sapiens
HEHGAEVVEHGTLGVRAAPVGRQVAPGQQQRHAGQRHVDEENGWPAEVRISRPPIGPSVVPTADMVPSRPMALPVLALGTVLPTKAMVSAIMTEAAQALGARGNQQPQGGRQRAQDGGKGKQRNAGQQQAAP

SEQ ID NO: 940545 - protein, 131 aa, Homo sapiens
MRKLTSLFHDIYYSSPTYFYRVYPKDQKQNWRELAGIRVEYALPAGKLDPEEARNTTRERITDTFSIGNVNFPTLWTRATPPDVRITLGGNNAGFVSLQAALAYLEAHPQQTVWVMNWDAPSRPKTMQINE

SEQ ID NO: 940546 - protein, 119 aa, Homo sapiens
MAEVRPSALCVAREENSHCWRGHDGIHHIYDMSPVINRKGPAPELQGVEVALAPEKLELDPMAMTPKYEEHVREQQAQVKKEGFSDMVGEPAAQQKQKKRKGQPPGNRGGSKKYKEFKF

SEQ ID NO: 940547 - protein, 128 aa, Homo sapiens
VSFLPRNLASGAGVGCINKKNLFVSFFFPAGFSSKQHVLGALLATQRLFPGKALSFPKVSEAHFCNTWLARAFFFLIYARAWVAGLDRALCFLSFTPPGCFSSGLGFHTDVNFERKVKGASALYCVYI

SEQ ID NO: 940548 - protein, 96 aa, Homo sapiens
AFISAQDTPALPPKKPDPPRHKPPSGKSTPVSQLGSADFPEAPDPFQPLGADSGDPFQSKKGFGDPFSGKDPFVPSSAAKPYKASASGFAVFTSVS

SEQ ID NO: 940549 - protein, 88 aa, Homo sapiens
GKNSKKSPSFPPMNRARRIIHDLAQVYGLESVSYDSEPKRNVVVPALQGEVRLSSYPPDRCALKGNAGPASPPDSSSQTSVRQKFWEQ

SEQ ID NO: 940550 - protein, 73 aa, Homo sapiens
SFHELPLFRGLFSPPGGVGVPPDKGWGPLDLVECPVFFPPGLWVSPCREIFGWVKKFFSGSKGPPPLRGCKKN

SEQ ID NO: 940551 - protein, 55 aa, Homo sapiens
MAQVTPPLVHIMEEVEENRTQDGKPERIAQLTWNKAYNPNFFFLINSLLEASFYF

SEQ ID NO: 940552 - protein, 55 aa, Homo sapiens
MAQVTPPLVPIPEEVEKNRPKMASLKKLPSCLELGLNHNFLFLINSLLKAPFYSL

SEQ ID NO: 940553 - protein, 93 aa, Homo sapiens
MSMQGEIKIGKRQVFFPVRKMKTTASKFVTELTMAIWALRSIKTVAGGDLEVQYHFSCPVMSAIRRLKELNDQYDRLYFIENISWPIMNGLIF

SEQ ID NO: 940554 - protein, 101 aa, Homo sapiens
NFNQSKWVFPVVIKSPFPHIQRARPPFGIQKYHILKLGSLENSGLGKTPFITKKASKNAFKTFRFINSSLISPFRSQNLATFGQYFLPSPPAHFFVGVFGP

SEQ ID NO: 940555 - protein, 94 aa, Homo sapiens
PLGNVFAQIAYFKISQRWNFPSPFFRLHFKIPQTHGVCGHFYAGPSDMTPVAQMPPYVKPPWTCVPAPVLCSVAGSPFLSSGVQWGREGGKASS

SEQ ID NO: 940556 - protein, 136 aa, Homo sapiens
MSLSAGKAFRQGLDASVIVSVMRFLLSDMDDKNGANGGISSVEQMTSTTEGPPWAIAACMAASKSATVSAERHIRLGNIAAIPAAICEGVNRLKLYFPPVIQLLTGDAHGMCVVVDNDECHRQPVLDRRVNLHAVH

SEQ ID NO: 940557 - protein, 102 aa, Homo sapiens
NFNSLSHGWPTPPRPPGPKPGVVAEGRNVTFPFGQKILPKKGKVVWVKGQEPLEFSYPGYLALGEGALSIIANPGNEGPYPWGGGRQQGGLTPYSWGGRGGG

SEQ ID NO: 940558 - protein, 102 aa, Homo sapiens
PGPSGNGALPCSHMAPSQLGKPGELFPLGGLCPSQTRPLFPKGALVFSPPRSPPPEMPRGPWALPRPWAFAGRGLSGFVPCGTPMPPPLPAPYGGPINPCRA

SEQ ID NO: 940559 - protein, 104 aa, Homo sapiens
VGGGPGGDSKLSPPKVQGRLEAGAGPGSKQGPPSFFDSSNRSNDLGPDVKFPPAGSKQPESIPGKAKKPQVKKKEKGKKEKGKKKGGPPLRALGRGHLTFLFAF

SEQ ID NO: 940560 - protein, 147 aa, Homo sapiens
MTGGLAPACGDYPIRVVQEGSHLGSQQAPFFLAGPLDQGPFPDVNCVGWDPQEPGVLASLSDDGGGPFGRINGLKGFWVPRLWAEEWLPRKRYFRLFPALGGPGGGSLAFLLLGSLFFRLGGKGRAPELVSFPAFYMGPSVKGFRTW

SEQ ID NO: 940561 - protein, 68 aa, Homo sapiens
GIINKGEKYQFLKEIGFKETSEKGIRSGKLSLLGFVYKLEGNMNEALEYYERALRLAADFENSVRQGP

SEQ ID NO: 940562 - protein, 127 aa, Homo sapiens
MSPVVQKWLYHQDLDVQYRSGGAPQTWACPFKPHHHPGKDCQTVGRHFPLDLNLKSPSLPWVDPGKPFALSSGPNPTNLLCDLRPMCRPFLGPSFSSYENSYLPKLCETKKKNWRKAVGQRESSCYY

SEQ ID NO: 940563 - protein, 177 aa, Homo sapiens
TLAQRPSPTGWGDANNFSPPPKDRPSKWRSAVPQISLGWPAPKGCCQHVPDLPKSFSPRARPGLALQGMAPVKDPFQACPLPICCERGASLPWGLSPGFALFLRGKRTLPLPRPGATLLPFPRTEAFGPSDPIPLNQVSFCVWGEEGMISVWFHVLFLSSVSGWVSVCIKWNKLPPP

SEQ ID NO: 940564 - protein, 80 aa, Homo sapiens
QAKTSPKPAVVETVSTAKPQQIQALMDEVPKQGTIVRELKAQKAAKNEVAAEGAKLLDLKKQLAVAEGKPPEAPKGKKKK

SEQ ID NO: 940565 - protein, 171 aa, Homo sapiens
QDTCNLDRESESKTEIKEMNVQKAKLVTELTNLIKICTSMHIQKVDLILQKATVISEKIALESDYMAASSQLRLQKHIFIELDENRQRLLQKCKELMKRARQVCNLGAEQTLPQEYQTQVPTIPNGHNSSLPMVFQDLPNTLNEIDALLTEERSKNSPFTGLNPTIVREYA

SEQ ID NO: 940566 - protein, 137 aa, Homo sapiens
LTQAETNHIGHTGYLNTVTVSPNGSLCAFGGKDGQALLWGLHEGKPPYTLDGGDIINALWFSPNRYWLCVATGPSIKIWDLKGKILVDELKPKVFSPRSKAEPPPCPPLAWFADGPTLFAGYPGNLGRVWQVTLGPP

SEQ ID NO: 940567 - protein, 60 aa, Homo sapiens
MLRYVTLRYVTLRYVTLRYVTLLFENKSRSVAEAGGFGVTLAHCNLRLPDSGGSPASLPQ

SEQ ID NO: 940568 - protein, 154 aa, Homo sapiens
LGKIRPRTVPDQNFAAHAAPLTDDAGTRRQHEPARRRVVRARAPRLAVGTSPQHARVSVHAAHGGARTARAVLAAPIAHVDEVVSVHARQQVHGRELHDVCTWRIRRTRGRTHVLDGDDGPPPVAARSACPGVGWPGLLTGMPLHGRPGVCPHP

SEQ ID NO: 940569 - protein, 179 aa, Homo sapiens
EHAIKARGRYEEYKVVGLCLPTPKCHTPPIYGMWIFEPNHVVAKSRFWYFVSQLKKIKKSSGEIVYCGQVFEKSPPRVKIFGIWLFYDYRSGTPNMYREYLDLTTASCVTQCYGNMFAGTRARVHSIQIMKVEEISASKFRRPAVKQFLDSKNQFPLPPRVLGRQPKPRFPTKRANTFF

SEQ ID NO: 940570 - protein, 88 aa, Homo sapiens
APPRLAPPPLLCFPRNFKDKPSCGSLGRSPPPVFSPNKHEPPAWNHQLFWFLVKGRGGFSSRCGFPRGPKVAPWAYSPGFSFVPPERF

SEQ ID NO: 940571 - protein, 126 aa, Homo sapiens
KNPLLNLFWPEVDEGAVLGISPLSRPLPFACSNGENWWWVPVVAPLLGAYLGGIIYLVFIGSPIPRGPLKLGDFGGYKDPGKTVLPKRGFYEPRIFPLTPVFVSPANRFSVPPAAFLHESRALEHF

SEQ ID NO: 940572 - protein, 119 aa, Homo sapiens
MGGNLTFFPPPFLGPSGKPRGFLGSPEGNPPKNILSLGGAFLFLTPGKLKIFLILKAFASKGKVLKGKDPPLNRGGVKGGPPPPPPFEEPGYIKFRQKRKGSAPPKGGSSPPPGPPGFF

SEQ ID NO: 940573 - protein, 66 aa, Homo sapiens
ASFAFTQNLDVPPRLLCAHPQDVYPVVVGAEIHVELYQELAYLKTKTESLAHFFVFVPQAKIKNKV

SEQ ID NO: 940574 - protein, 58 aa, Homo sapiens
PSTGDTENEQHTVLALMELSVWWGRQTRKQSKRSVYGDTWPQPALSQRRSRVIQYSVV

SEQ ID NO: 940575 - protein, 110 aa, Homo sapiens
VRHPFLISKGCSFAGKLLKDGCNLSENIIKRECTLHMVSVFRGKMKYLKKLTGKSITVEVKPSYTIENVKAKIQDKEGIPEQQRLIFDGKQMEDGRLFEYNIQGSSGRSA

SEQ ID NO: 940576 - protein, 126 aa, Homo sapiens
LLKASPASLSFISTLVASVPNPVRVWMVKQGYGLFVRGDPGRPNFLLVGDSKQIKGHTFCVLGAGAPWLVQGLIPPFGGGFKEGIQGFSHQLWGGGVAFLPPPRGCCFGFFLVECWAFKGVLPPFP

SEQ ID NO: 940577 - protein, 109 aa, Homo sapiens
MGQEELPRGQVLPPSCPAVDPSATVSIRGGEGDLTAHRVHGAAAQGDLISVSALIFSYFSYYFLYLLKSLCKEFMVSGETHCDKCRKTKAFFQGAEACGSSQALVMLLC

SEQ ID NO: 940578 - protein, 138 aa, Homo sapiens
RRVSLPLVMPALVSGTVLAFARSLGEFGATLTFAGSRQGVTRTLPLEIYLQRESDAQSAVALSLLLVAVAAVVLAVVGARAWRRDVVAAMSELRFEAGHSGRGVHAAFTVAPGETLAIVGPNGAGKSTLLGLIAGLLK

SEQ ID NO: 940579 - protein, 98 aa, Homo sapiens
GIPFLFGGQSEEEGSFTLNAINKGPLLKPWALPFSKGRALQAFALKAWGGKKETLKVGQGGFVKRALVRIGRRWAGGLGGWDSEKSPFPSPPFPPLGP

SEQ ID NO: 940580 - protein, 58 aa, Homo sapiens
METAYPLSLRHPFAAAYTKADDAFTVRADAWTPDAIARGGTQDVLQASRLALLSAVAL

SEQ ID NO: 940581 - protein, 104 aa, Homo sapiens
FQCYRISDLGHNTLDLAPEINWPALVTIIDNTKGQLVVHPEALKILSAITQPVVVVAIVGLYRTGKSYLMNKLAGKKNGFSLGSTVKSHTKGIWMWCVPHPKKP

SEQ ID NO: 940582 - protein, 104 aa, Homo sapiens
PPRVFFGFGVPPPPPACFLVKNPFGNGATQGVFFPPFFLPGVRPPGAGVHPPPLVRACLGMAFPPQPVRPPMVFIRVGTKPPKKFFPPPPFPYAGGPRLIFRPK

SEQ ID NO: 940583 - protein, 44 aa, Homo sapiens
MQTTYYQAITVYTGELELTYKDQRTYREGSLVRGPWLTLPAFDP

SEQ ID NO: 940584 - protein, 57 aa, Homo sapiens
SISSASEASFSYKENLSGALLAIFGHLVCSIALNLEKYCHIRLAGSKDPRTYFKTKT

SEQ ID NO: 940585 - protein, 147 aa, Homo sapiens
PQGRLYTSSFEFAQPCVFVKQLPGPILCASDCYEDPLSRSYGVNLPSSLTMNLSTPQYILPDHVCPFAVRVAVTLSLADFLGSMITCTQRFPKEVLYFRVSAQVVDLPATLITYALKALFRQCVAVSLLRLHITDTASCGILTASAI

SEQ ID NO: 940586 - protein, 83 aa, Homo sapiens
EAETGEITRAQKFQTSLGYTAKLYLYKNTKIGWEPVARACSTSYSESCDGRIARAQEAEAAVSQDCVTVLQPVLKEKKKKKRN

SEQ ID NO: 940587 - protein, 113 aa, Homo sapiens
GIYILGRRFRSLDYSWLQLTSFLYSFCQQSRRQGIIQRNRTERLSDLLDWKNLGRVGPPLSYPFLANQQVLAKGFWCRGQGLILLGTGAVPLNNEPGRSRWWVMVVIPALWEA

SEQ ID NO: 940588 - protein, 117 aa, Homo sapiens
PGGGPQGGRPRGCGRAGLLTMVANACCLPPGLSLALEKSRCPLQLVEGLCGLHLLSVERSTLAIPAPRALACDYSLVSLEPAGTVPRCVLVQIIRVARLRARSLSPPSVQIKASQII

SEQ ID NO: 940589 - protein, 89 aa, Homo sapiens
GKGSTDESSPYVMLAAQDVAQRCKELGIPPLHIKLRATGGNRTKTPGPGAQSALKALARSGIKIGRIEDVPPIPFDSTRRKGGPRGPRL

SEQ ID NO: 940590 - protein, 59 aa, Homo sapiens
MPRKMPTKVTQSSSTHTSSTGQPPTPTIQLAGQPPRVPPVDVVHLAMVGGYPCHEVGVG

SEQ ID NO: 940591 - protein, 83 aa, Homo sapiens
PGKKYLIMGLDGAPYALEGPPQYLLDLKSWIEEMPFEPLCRSPPQGAACAQFNDFLQEYGTQGGQVLGLPSPLPWEEPEPGNH

SEQ ID NO: 940592 - protein, 140 aa, Homo sapiens
QELAASLTRTLDLQEQLQSLRRELEQVAQKGRARRSQSAELNRDLCKAHSALVLAFRGAHRKQEEQRRKLEQQWQLMEAQQAEEVVVLEATARALGKPRPPLPASPSLGSTFLVVPPYPSHVLDNAKTAARHCHITCSWK

SEQ ID NO: 940593 - protein, 36 aa, Homo sapiens
GSAPSLEAGEPAALQPAVGPAATEAEHRCGAPGGPA

SEQ ID NO: 940594 - protein, 77 aa, Homo sapiens
SSVLIFWAFRKASSSGMLGQSIRRFPTFVVRRSPYEEGPGKNLPFSVENKWSLPAKKGLYFGSAFATPFLVVRPPLL

SEQ ID NO: 940595 - protein, 205 aa, Homo sapiens
KGFPGHAADYSGAPHYAHMRGQRPNMPPLGMIPRQGFALGKIPPGAMPRQQMPGQMPPAQPLENPPNHILFLTNLPEETKEFMLSMLFNQFPGFKEVRLVPGRHNIPFVEFDNKVQAGAARNALQGFKITQNNAMKISFAKKKHLFPPCPLPLFWGHPFPPWLSPLKVSPPLGAFLDPCVSEWSPHSIVPKVCPQTLHRGLLGRN

SEQ ID NO: 940596 - protein, 83 aa, Homo sapiens
LPLNLALQAHLAQENRVVAFFSLALLLAPLVETLILLDRLLYLQEQGFHAEVLPIFSPELFPKNLVLVATKMPLGTGFFCFGN

SEQ ID NO: 940597 - protein, 171 aa, Homo sapiens
SSSIPDGVYAVNGLVEHLAHVCLVVVLHRDALVLVVTLKMVGKLAETLIKAVMHKASSMSLREAVIRTAQVQKLQDFHRATLIVEWAYAGSAPRFRAVRDASTQGKDEPHGGRLFVAQLRAGSCKRFVSSFEEEDLRGARLAAERAGRQGQGAVALGPLQGGAALVLIHHG

SEQ ID NO: 940598 - protein, 109 aa, Homo sapiens
REKSLWLGLVFSLPKGFYCSRVAPGQAGAPLCLRPGKGDPCHFPAALVCSCPPGIKWRELQKLSFPKAVSVVETDWIFVLPLPPCPSLREGSYVRTPPSGIRVACASFF

SEQ ID NO: 940599 - protein, 74 aa, Homo sapiens
SLGTPPPLFFPPLETPGPVPPPGFFLGPGGGFLFSPGTPFAPWAFLGAPFNPFFPKNRVGPGRGFPGFFAPPGP

SEQ ID NO: 940600 - protein, 140 aa, Homo sapiens
KKSPGGISLWAGVFEVPPAGENFGFWVRFFSRVGPPSLSRGYRGLAPAGAVPPCYRDLGARPRARAPSFLFLRVGEFSARRCRRPAVLQFPGSWLGFPLPPRVLRRQPQPRFSSEGPPPFFLVPGPCPGVPQIKSGTPRL

SEQ ID NO: 940601 - protein, 139 aa, Homo sapiens
SLNKFKKIEIIASTLSDHSGIKLEISSKRNPQNQARTWKLNDLLLNDHWVPYEIKMEMKKSFELSGNNDTSYQNLWDTGKAMLRGKFIALNAYIKKSERAQIDNLSSHLKELEKEEQTKPKPSRRKEIAKIREEVKAIE

SEQ ID NO: 940602 - protein, 84 aa, Homo sapiens
NYKLRSVAHLPEKAFAYKAFNTFMNDVFAFIISMPTSLRLACFRDNVVYLVYLYERWLYPVHKRRVNEFGESYEKKATRAPHSD

SEQ ID NO: 940603 - protein, 109 aa, Homo sapiens
RAPPSGPSEANTCPPPGPGAFPLQLGKRGLEFPFSFFRASAPPKGAALPDIPPGWAASRGEGGPPPPPPPPPPPLNFGLGWAGPAPLRGIRLVPIIYFFNFFFNYWNKG

SEQ ID NO: 940604 - protein, 101 aa, Homo sapiens
LPHLLPALGFKNKTVPKKRCKDCYLVKRRGRWYVYCKTHPRHKQRQMETLSLQSHAHTRHRITWENGWILRKELSHQGVRGKWLETNALKVTPPGSGEMRN

SEQ ID NO: 940605 - protein, 220 aa, Homo sapiens
PPALRPPPRVCLVQGGGRAKKQVESPKLRTNGSKRVFQTKIQKFRKAFYTSTGFQIDITTEKQFRLTSLYAEHPGDCLIFKAPSPSGFKMQLLETKFSHPVGELIEVPLRGQDSIPAFLRLVTLELFNRQNRGVTCRLGGITGTPLVGLTCRFPAPPTTGWGARSAFPAPQGNSMTYKPAGTYVGVPAGAASPLSPGRPHGSRSLGCGGRPPAWVPPLVK

SEQ ID NO: 940606 - protein, 100 aa, Homo sapiens
PLPGFGVPPDRDFGGACPPQDPIQGVGEGINVFLGPGPSSCPPQGFLSRIPPINCFRERGFLPQLDGTPGEWGGGSFFQGPPLFPPQLKRALFWPPGLVF

SEQ ID NO: 940607 - protein, 87 aa, Homo sapiens
TEVWFGGHETKPRARKRTTMDVLGPFFSQVLVKLVESAMARFVISAGHPVRVCEQYSEGAFMYCEENACGHNNILFDVREVFCFCYK

SEQ ID NO: 940608 - protein, 33 aa, Homo sapiens
KTDEMHTALMEACMDGHVEVARLLLDSGAQVNM

SEQ ID NO: 940609 - protein, 74 aa, Homo sapiens
MASHGLHPGHLVRDTAVSGLDWCSSQQLLLSPSMGQPHTARGAPAGAQSLCAPSLEHVRDLWFISNEVENGKSK

SEQ ID NO: 940610 - protein, 125 aa, Homo sapiens
HNRPTIIVMHRLLTGMHSEKCIVGRLHYCVNITGCTCTGLDGVPYPTPGLQTCTARYYAEYLKTTVTQCSVFVYLNIHRKGRVKIQYCNIMGPLSYMQPVFDQNIIMRHMIAYDHILVKCPEKVK

SEQ ID NO: 940611 - protein, 161 aa, Homo sapiens
VPSLRRVELHRAARAQALPAVRDTPKARMGAELRERHLQGAPGAEAAAGGAGAGAAGGDAGSREGPAGQAGAGGGPRPELAGEGGKGGPGGDRKPRERARERRVPAALTEPGRRGGGGRRAALSRGPLPRPPGLRSSLAVSGGPDSCVAALEGRVRLQPAT

SEQ ID NO: 940612 - protein, 113 aa, Homo sapiens
DGNTIIVRDFNTPLTALDRSLRQNVNKGTMDLNYTLEQMDLTDIYRTFYPTTEEYIFFSSARGTFSKIDHMIGHKTILNKFKKIEIISSIFSDHSGIKLEINSKRNSQNNADT

SEQ ID NO: 940613 - protein, 113 aa, Homo sapiens
TPRGQFPSFSTKECFEHPQGQDVFDYNSCLLLRELDAEGWKVQQTVGSRLQALRGEEVQEHAELTAGPERRSSLHGDPSVFPSPRELEGGCHGRSPRPHTTPSRLSQIVPGQE

SEQ ID NO: 940614 - protein, 96 aa, Homo sapiens
DLEGQLLSGHLTQDQVREVKRHITVRLDWGNEHLGLDLVPRKDFEVVDSDQISVSDLYKMGEIYVFGKEMETSTATTILLTHVNGAIQQMSVVPYL

SEQ ID NO: 940615 - protein, 116 aa, Homo sapiens
CSLQGLLPPRWLANTRTPNTTGFRDSDRSLALPYYRILRCLSQVKLNKKTKQKLKAISRNTKQAVSKDQKGDQKRALREVVYIPEGRILSGGWCSTAGRPWKISGEVKLLLSETFR

SEQ ID NO: 940616 - protein, 93 aa, Homo sapiens
GHHVGAELNLPTCCLQDQHLEKVCGHCHVVLADDLVLYVGSHQASVLWADPRAQRGQGGLDRTQSPPSFQSSPSPDRVLLTSVHTCKDHRPQL

SEQ ID NO: 940617 - protein, 112 aa, Homo sapiens
PPGKRGPPPFPPWGGGWANPSGGQGPPKRRVGWTPLFAPGGGRFLGGEGFPPCGPPPALRDLLKPRGPPVSPRVFRLKGAPRPPGPVFPLKARPPFGGFPGPLPPPLPGGAK

SEQ ID NO: 940618 - protein, 107 aa, Homo sapiens
MLGFGKDGGAQRLFPIGPFPVPLGGQQVPLRVSPYVNGEIPKAEIRLQPVPRSVLVLNIPDILDGPELHYVLEIPFQKPPRGGGEVKALTVVPQGQQGLAVFPFESG

SEQ ID NO: 940619 - protein, 81 aa, Homo sapiens
ARVPFPFEGRKEGLKRDLASSDIKLVHPCPIPGNTKEFRQMAANREVPRPLSPLPMFNVHTGERLPPRVGSAQVPLILGQH

SEQ ID NO: 940620 - protein, 114 aa, Homo sapiens
MIHAKTKRSLEVASGGGAARARARAERPVAAAAPPTRHAALPGAARPAAWEPRSAAAGPALPLLAPPLPPPEPPPPPRLFFRRLAPRLASAGLIALLTQGKSGRGRSRRRRAGK

SEQ ID NO: 940621 - protein, 83 aa, Homo sapiens
AAALFKGCASCIGYPHEVIKEGFREKGTKYKSFVQTARLVFREKGYLAFYKGLFAQLIRQIPKTAIVLFTYELIGDLLKDRTQ

SEQ ID NO: 940622 - protein, 94 aa, Homo sapiens
WPTLVVPLPPALAPGFAGPPNAWVRHASGLSCPHLFPAPEVGPAANSSLGPRQVTNTAASPNSNGMGSASPGFNRVSPSQELPPGMDNKDTKEL

SEQ ID NO: 940623 - protein, 70 aa, Homo sapiens
TFCGTRQKPIRSTRAVFLLRLQVGEKVWLAVNNYYNMVGIQGFDRVFSGFLLFPDYGGQMRSSPTGLPPP

SEQ ID NO: 940624 - protein, 120 aa, Homo sapiens
EEWSQFAPWGGPTGLCLSRRRRPHGWVSHAPRVFPLRPLKGKGKGGFPKRPFKWGVFAQKGFLKTWGFPKLPGPRYFGGPFCLFRWGFFPPPRTLFWVFLGLKKPAGVSPKVMGRGFESP

SEQ ID NO: 940625 - protein, 120 aa, Homo sapiens
PAPKLSLPPGPPDLGDGSSTPGRVGSPDQLPLACSPHDLRPCFLPADARPDCSPSPGAPLDLGTWTPSWLPRRGPWHGLKNPSPQKGPSLFLAGQQGGLRLERRAFLGVGLGVINPGGNG

SEQ ID NO: 940626 - protein, 62 aa, Homo sapiens
LGGPPPRIKAELTSSAPACYALAVSPDAKVCFSFLANGFTPSPAACGGRWAGAPGGNKMFFS

SEQ ID NO: 940627 - protein, 103 aa, Homo sapiens
TVGAGRIPLGGAAPGDAAAGLPGSGAVERGLGGFRVPQRAAQTAGPGGPEQHAFREAVLLGGRPVTRPAGLLAVPPWTETNWALLSPLGGGKEKPSGILFFLG

SEQ ID NO: 940628 - protein, 67 aa, Homo sapiens
GFPKGGGAPPPAPFLALGAGGTRFAPPPLGFFSFPPGGPPFPPPRPPVFPPFSLGAPNPNIITGFSS

SEQ ID NO: 940629 - protein, 135 aa, Homo sapiens
MSCTTARSVPFRHDRIMKLPGRYNYTAVVVWAITDDVRVQEGPKLKVCALRVTNRARIRILKAGGKILTFGQLALDSPKGCGTVMLSGPRKGREVFRHFGKAPGSPYNLSKPYVRSKGRKFKRAKGRRASLGHKN

SEQ ID NO: 940630 - protein, 123 aa, Homo sapiens
LPVPTIYHALGPGPAPPLVYSVSQQPLRGAGPQGVRRFRALAGKAKDPHPIFSIQPQAMGPASSPKDPADLRASCRLGHWCPPPHAWGPRFSSKKMQYFLFPFFPFFFLRNQYFHMLSVCPML

SEQ ID NO: 940631 - protein, 113 aa, Homo sapiens
MQGRLKMQMERRLKMLPQSCSKMMIPMRSCLMRRKIPVRSCILIKGGLWVVLGVLKGPYPLAAALFSGAMMMMIFNPLNLLFRESPPFTFAWASGELLVGLHEHGHSGRMPSD

SEQ ID NO: 940632 - protein, 112 aa, Homo sapiens
GEPIWGRVPLFSRVWRELALNKLVLLTCLARGFSPREVLVRWFRGSQNLPPKKYFIWAFGQGPSRGPPPFVLPGFLGVAPGDWKKGAPFFCLVGPGALPLAFTQKTLARLGG

SEQ ID NO: 940633 - protein, 137 aa, Homo sapiens
MRHTLLWSIFLGALYKDGWSLWYSEYRFPEELPQTFMSCNFIPGMFQRLAQLRKNAFASVILFGTHNNSSIFGVWVFRGQELAFPLSPDWQVGFESYTWRKLDSGNEETQTLVRKYFFWEGAFQHVGKAFHQGKIFK

SEQ ID NO: 940634 - protein, 83 aa, Homo sapiens
QKKQLSARGKAPGLQGLSFFFQTQIPKKVALDLESGGGVQESRSSTPGSKVKNQLVGWTSIKLKVQPKRGPPGSPPIRGKAVF

SEQ ID NO: 940635 - protein, 153 aa, Homo sapiens
GPHIVFGVPPPHFGPQECLFPTKPGGGLWFSFYPGSPGEGGPLPPPFFFFWAREKLNPPGFSWVIFFGGFGGGGNPNGIWGGGDPFGFPPLGVGAGGGGPPFFPKFPRGFFWGGGAGGFLKGFLKERAGVGNFWAPLSPPGGGTPPPPPFFFF

SEQ ID NO: 940636 - protein, 126 aa, Homo sapiens
GERKVAQTMFPGSSLPLARLPYSLLWEEVISLPCPSLFLASRFHCFIRRGQVKSESFSLLRKKSKAFQKWLLPPWESLGQKQGQSICVLISKQNIYGSSSFMLGSVLRGKWLYWISQLCCPCFAAC

SEQ ID NO: 940637 - protein, 147 aa, Homo sapiens
GWAWIFLSPRGPGPGGGGDPPPSGAPPGGVPRGGARGAPSPPRGPLSLGKPVFRKPKVSAGGVPPRGGGSPPPKSFPRGGVLGGGGPPLSFWFGGPPPPPWGGAPFFPGGPPPLGGPRAFFPPPPPPPLGFFFFLGGGGGFIKGFFS

SEQ ID NO: 940638 - protein, 71 aa, Homo sapiens
PSPMGEEWVGLFNRGGGGCSPKFVPPRRAPGCVFGAGGVLSPRVAPPFSPKGGALGVSPQGGGCGGGGCFS

SEQ ID NO: 940639 - protein, 108 aa, Homo sapiens
KREARKPNFYPLPPSRGNYPKKRVALPWLVKGFFSQQFPVGWGDNGGPGKNSKTPPPGLDSGGFFFFLKKFPVAKKRGARGKFFFFSVREGGLATPKKKKTFSFFPGK

SEQ ID NO: 940640 - protein, 73 aa, Homo sapiens
TSFKFGLSGSETAIFWKRISGKSERSSSGLVEWESKNDALETLGFLNHYQMKNPNGPNPYPLKLCFSPGQPPS

SEQ ID NO: 940641 - protein, 116 aa, Homo sapiens
LDGQWHSLTSLQPSFQDITYPCKNSIAYMDQASGNVKKALKLMGSNEGEFKAEGNSKFPYTVLEDGCTKPTGEWSKTVFEYRTRKAVRLPIVDIAPYDIGGPDQEFGVDVGPVCFL

SEQ ID NO: 940642 - protein, 109 aa, Homo sapiens
RKVYGMAFRVPNAKVVMVHLTCRLKLAKYDDFKKVVKQGWEGPLKGILGYIEHQVVSFDFKRDTHSSPFEVGGGIALNDHFVKFIFWYDNEFGYSNRVVDLMAHMAFKE

SEQ ID NO: 940643 - protein, 198 aa, Homo sapiens
ATPKWPPHPRSPQRVDLFWPLGPTLSASKAKKEKEAGPGAPFLETVPHTGNKKDVRGFPAPATPPPCFRAPMGPFLKKKKKPFGPALISFIWGGGPSLGGPPPPPGPFHCFPFPGPIKVFVLSKGGSPPAPPPQHFSKGPGVRGRAKVPRGVSQGVGGGPPPRGRLLSRGFVFPVCLRVGFFFWPPPKFFPKKISKAP

SEQ ID NO: 940644 - protein, 118 aa, Homo sapiens
ILGTHLGEVASILSNEEFKTYNYPKYAEALLSHAPRLDRDGADLLTKLLQFEGRNRISAEDAMKHPFFLSLGERIHKLPDTTSIFALKEIQLQKEASLRFLSMPDSGRPAFRVVDPEF

SEQ ID NO: 940645 - protein, 82 aa, Homo sapiens
LGVFILLTVEISVRIVSPAQSKGDNAFRQHPSWHNKATQKCPSSVHDKCFPMNIGFMCPTGSASGGNIIQPLMTKVQNYILT

SEQ ID NO: 940646 - protein, 101 aa, Homo sapiens
CLLEGGLGSLLWLTSACVVTAKHQAPSLPVTWPGLTTPSPGTLLASRWVFKKLCLPHSVQKGPEGFKCGEAAEAPRKATVGFPFFPAPLCVLKINNPTFII

SEQ ID NO: 940647 - protein, 107 aa, Homo sapiens
MSEFMGLIQGHYEAKQGGFLPGGEESTSTMTPHGPDADCFEKASKVKLAPERIADGTMAFMFESSLSLAVTKWGLKASRCLDENYHKCWEPLKSHFTPNSRNPAEPN

SEQ ID NO: 940648 - protein, 101 aa, Homo sapiens
PKNLFLYNFGGGIYFFPHNFLGGLSERPGGIGVPEGNPPRKHLFFWEGHSFLQQVKINNFHDLKSLRFEGKSPNSRRTPHKPGGVIWMPPPPPPHLKNPYT

SEQ ID NO: 940649 - protein, 86 aa, Homo sapiens
ASHRGDAGFQMRVGCSWGPVGQAVVKLGPDGGFGCWEDTGCGGFSPALDLRTPLFFRQGEGDEGLQRRLAPPFKNASFVYKALKKQ

SEQ ID NO: 940650 - protein, 93 aa, Homo sapiens
TKIRGVRRALIQVPGYQFDFPRGNQYGLPWVYAEHPGDGLLRATGPWGSKMRLLEKGFSHPVGGFGVPLGGQERIPAFLGWFPLGFLTRQPGG

SEQ ID NO: 940651 - protein, 132 aa, Homo sapiens
IGKPFRPGVHLFPPLLEELALNELVTLTCLARGFSPKDVLVRWLQGSQELPREKFLIWASRQEPSQGPPPFVVTSILGVATKDWKKGDPFSCMVGHGALPLAFTQKTIDRLGGKPPHVNVFVFMGEVGGPCF

SEQ ID NO: 940652 - protein, 189 aa, Homo sapiens
LQRWISEERRRHLRPSASPYSEVNIRWVGLASLHSRLLPAGKGSALYSLEVSHQPCRHPSRQLAQLLNPRRSRAARTRPPPLQDFSSILHRKFFFPADLAPHGLFKKRLPDCTDDVKHGQSVTLVGFSELAERQSELQQQTSELPSILSAQTDLLIGFDSSVASQIQSFSHGPKPPIKAISTELFVHRL

SEQ ID NO: 940653 - protein, 104 aa, Homo sapiens
PPAFLQGLGPSPGTFSPGGSRDQGDRSQANITTATVLIRSPMQRNLVVIPKSVTPERIAENFKVFDFELSSQDMTPLLSYNRNWRVCALLSWTSPKDYPFHEEF

SEQ ID NO: 940654 - protein, 33 aa, Homo sapiens
MHFVLPCNSFYAYSYYSTPVVHFAACQNKLKFP

SEQ ID NO: 940655 - protein, 66 aa, Homo sapiens
RSKPNPLLKWLKKPEQNPSGAKEKDQDKNIEVVYSKAASVPKVEVKSDNKDAIDIDAIERDGCHLA

SEQ ID NO: 940656 - protein, 113 aa, Homo sapiens
GVFFKMEANFKNLSRGLVKVAAKLTPNKNVRDLFVALCGKVCGTLPLRPLAIKGGGVFPESDIKGLSTPSMASDTRPFGTAKWAPSGVASWACLMIEVPPNAPPTLTIKLLWV

SEQ ID NO: 940657 - protein, 91 aa, Homo sapiens
TNISYHTLYIDFESCHERIFAIDSRQFFSTLAHLRYVCTIFSLHTLPAHQSPHYWQQVASESHKSGPLLQAPYRCTIYSGINLLSYLRGFG

SEQ ID NO: 940658 - protein, 116 aa, Homo sapiens
GPSGLWDILSSTLSLDQFVRVPVNIVYTMPSIYKYTQMYTQMYTWSSPSFANLHLHPSLGPCWVWLKRSSSNPAFVPFPTHCLSLLSRPGTLGAPVCGPLSPRHSPPPMDFRVHYQ

SEQ ID NO: 940659 - protein, 108 aa, Homo sapiens
NNPKLFFGSGDRGGERIKFIGDRPEGGARRKPKFLFVSHGGGNGEKKVLHKSGHSMPKQNVVPTVLALGKVNMNVLTTLSLGARPPVFHEKDYDSLGQPGFDRLIRWI

SEQ ID NO: 940660 - protein, 138 aa, Homo sapiens
RGPHMVLRGLDTLFLLEEVSGGSLRAPVSFIWGVFFPFYHPPSGGEHVGGPPVSGGSLRGLGGNKKGAPPPPNLVPGGPGQIFVGTHGNPAFFGPHFNGRGGMVWFFGGGPPSPTLLFGGETKFFFFFWGGGHLKGFF

SEQ ID NO: 940661 - protein, 84 aa, Homo sapiens
KRTVLGWAPTWSPDAPPTWTKATLLPTPVVAGGAEQRALGSSDCGPPFSFLGVDHPPSHWAPPNTVSCPPGPGSRKTRLPSFPA

SEQ ID NO: 940662 - protein, 133 aa, Homo sapiens
VFKENTGPLSSSPSGGPPYLDMVIAEPLGMSPPAFRFTRKAVQDCEVLGQGIPAGAVLKMAVGALHHDPEHWPSPETFNPERFTVEARQQHRPFKYLPFGAGPRNCLGVGLGLLEVKLTLLHVLPKFRFQACP

SEQ ID NO: 940663 - protein, 184 aa, Homo sapiens
CPELNFDGEDGTKSCHLLCTAEPQLALVIRSRGINGVAPKVRKVSQLLRLRQSLNGTFVKLNQASINMLRIVEPYIAWGSPNLKSVNELISQRGYGQIHKKRIALTDNALIARSLGKYGIICMEDLIHEIYTVGKRFKEAKNFLWPFKLFSPRGGMKKKPPPFVEGGDAGNREDQIHRLIRRMN

SEQ ID NO: 940664 - protein, 198 aa, Homo sapiens
FRSVRRGRRLFFLLFTPHPRSVCFNPPPPLGGERGFLPAPPGCWGGWVFLLQRALIFFCPLWPPLGGEKPSPLFFSPPPLPPKAGVSSLFFFFFKKKPGGGGGGFFLFSPPFWGPGGGVSRGWGFAPFWVSRGTPLFFLKNPKFFGGGGAGLFFPLFWGGGGGKGVPPGGGGFLFPRFWGPPPPGGGGGAPLFQNLFF

SEQ ID NO: 940665 - protein, 67 aa, Homo sapiens
MATVMAATAAERAVLEEEFRWLLTNRGTLCGNNWRTFLREAFLRLILPGSGTEGPAKQENFILGSCG

SEQ ID NO: 940666 - protein, 122 aa, Homo sapiens
TPAKVATVINNGSPTILGKRSYEQHNGVDGLANHGQTRHMGPSRNLLLNGKFLPHKCALIPGGTPCPQVQADGGLNWDRRPRDDVLHGTTERDQRRSDKTALHTSRNQKRCWPDRAIQKPIR

SEQ ID NO: 940667 - protein, 47 aa, Homo sapiens
TRGPSISAVLDVDGDMSSNRSSLTLDERLYDEFIRLGGLADGYREST

SEQ ID NO: 940668 - protein, 125 aa, Homo sapiens
PPKTPGGFGALRARGPNPHCVGAHTRPLFVNAVAFFQGLGAPHDPALEGPPPRGPGPRGGAGPRPRGSGPACTQGFPAVVKGGASSVFAVLNPPPLGVGHGMWVVFSFGGGCREGGLGWPIKKAP

SEQ ID NO: 940669 - protein, 103 aa, Homo sapiens
FFSPGVGHGEGRTFSQGKPPPLWVMVCERGQEWGPSPPKQPGPFGRPVKWLWGLGGAWGSLCRGLFRHPQPRGGGSGFQFFCFSAAISGAPEGARDNKMFFRK

SEQ ID NO: 940670 - protein, 37 aa, Homo sapiens
MGLPFCRGPFFLGQRSPPPAFPNSLGVPFNPVPPPPP

SEQ ID NO: 940671 - protein, 172 aa, Homo sapiens
MRNTFGQVLERGVKLPDLHQRLAPLLDISSTFHKTTQTLAQKKWENIRSRICVGLVVVGVPLIILIVLVVFPPQSSDTSSAPRTQDAGIASGPGKLTPLVLKEKPNGCIGRFWFPEDPGVCSPLTPPSECQRAAPTCAPLLFLSCPRLALEGTPLYWPCWAPPPWSSVKTAV

SEQ ID NO: 940672 - protein, 97 aa, Homo sapiens
KREKHVAPPVAYFYISFSRWPKGTGFPPTPEVPVNRPGRNGCFYMEDPLPGKTGEEIFGPIGMGPHAKNNRDLGFPLDLDFKGQLGELSCSPDYRMG

SEQ ID NO: 940673 - protein, 117 aa, Homo sapiens
QIHLNCNSQRRRWGLVGNDWIMGAVFHAFHGGSFSCFTTIPLGAIVLKVSFHMIGLFKRLGHPFCFFGPAPAMENTGSRFAVPHDCVFPKASPKKQKLLCFLYSLQNHEPIKPVLKS

SEQ ID NO: 940674 - protein, 103 aa, Homo sapiens
FESFWFAVAGAPSPFFPLKNPGPPASGSCLAPGGFHFPRARFLLWAFLGAHLSKLFKNGVGSVRIFRVCLPGAGGPSPIKANRVSPPPPSGGGGSPRFLDPHF

SEQ ID NO: 940675 - protein, 96 aa, Homo sapiens
GEKGALSPPGVHQKIFKIGPGAPFKGGEVVKNKAPPGFFPFSQRPHPLGGFGPYGEGAQNFFLFKGWGGGTQKGGVPPPQALLGAKKRGGLGKIFP

SEQ ID NO: 940676 - protein, 102 aa, Homo sapiens
DMGPGQALCVGSFSTIPPLGCFSVCFLTHPFRGGFSKPWAKRVVGLGRAPSLPQKPQRVNLFFPLNPPPPFFSGGGGRVPNRFFPLAPLVLGVSRVIIPKPW

SEQ ID NO: 940677 - protein, 226 aa, Homo sapiens
GAPPPPPFFPPRASSWWGQKGAVDSPILGGCLPTQKKKLDLGRFAPSPPPPRAVVCYKKIGLARPLQARGNGAPPCPFLGGPPGPFTPLPGGVFSRLSFLGGAPPQGGLGPFSAPFGLLGGGPPPPLPPGARGGAPPFFVPPPPGAGPQSGLFFFPPPPGPPRGGGNPPGGPPPREIFFFPPPPPGAFSGGGGRAPGGRGGPPPLGGGGGPLFSKGAGEKKTGFFF

SEQ ID NO: 940678 - protein, 167 aa, Homo sapiens
APAKNLQSARGKLRASITPGTILFILPGRHRGKRVVFLKQLGSGLLLGAGPLVLNRVPLRRTPQKFVFAPSTKMDISNGKIPKPFFDAFFKKKKLRKPRPQEGGFFAPEKEKFGISGQGKIGQKAGGSPIFPKNQRFSSAPGVPAIWVCFDEWDFSPQIGVLNVLRP

SEQ ID NO: 940679 - protein, 212 aa, Homo sapiens
MRSPPGFFFPGSSKPFLGPFCGFRPNIGGAKITGPFNRHPFPPLGFACRVPAISLGRGHLGLEKPSLFLFLGAHPPPRLFGDSPCFPKNQETQIGFGPRGALPLGGKGGGDPLPGFFHPPGSPPPLFFGFFKKAPPAPGGIFPVPPMGVPGAPPGWWEGFPPRKKGLKKSPFFKGTILPPPGAPVKKTPPLVFLGFPVFFFPPKKKKSRGFF

SEQ ID NO: 940680 - protein, 135 aa, Homo sapiens
GGLFPPSFQNWVWRGRFSAPPGPFPLTWNAFCLFGLPPAPGPKTPGATVFPACPGQALPPNLFFSRGRLGGGGPPFPPNCPLPPPSSQPRVFLKPPPPPGPLGGWVPPFLLGPGKGGVFFRAGGVFPLKKPPAPL

SEQ ID NO: 940681 - protein, 109 aa, Homo sapiens [sequence omitted]

SEQ ID NO: 940682 - protein, 156 aa, Homo sapiens
SESGASGSSFEELDLEGEGPWGVTAGPWKSFGGAPPPPLGDPSGSGSPLPLRRARSNPWPAPSCSAVAEELSRLSSRLSNPLPPSSGGGGVPEGPDFPCSRPLAKPSPHCPLGSQGQRSQGLFSAPAPRAAAPVVSFFQTHSGASRTQNKANDLLV

SEQ ID NO: 940683 - protein, 181 aa, Homo sapiens
DRFKNRLEQIVLHLQRRLIDDQTRADVHDVFDLDQIVRAQRAAAAHQIDDGIRQTDQRRQFHRAVQLDQVDVDALGGKMFARGVHILGRHLQARATAHRLFVVEAAGHRDAQPAARDVQVDGLVQPGTAMFQQHVLAGDAQIGGAVLHIGRRIGRAHYDQAHVRPVGADDELARRLRVVGR

SEQ ID NO: 940684 - protein, 70 aa, Homo sapiens
LTIMAEGKRHVSHGGRQEKRACAGKVPFLKPSDLMRLIHYHENSMGKTRPHDLSPIGFLPQHMGTMGATR

SEQ ID NO: 940685 - protein, 204 aa, Homo sapiens
EKFSGAGHILENTKVGMTRNGMQRYALPFNFSLLARMRAVHERLQLLYWKHRLQHKKKLKKSCTRGSGVSDLLSQRLGSQSFFFGDAPASLDAFVFLALLQAKLPSGKLQATCVGCTTSVPIVPTFSVFTSPGMERYPRNARHQQAQRFEEEPYRRRNQILFVLAGMATMVGYALFSGIVSIQRNLVGAPGTRTLGMVEEDEKE

SEQ ID NO: 940686 - protein, 87 aa, Homo sapiens
GGPPPLFFFINGLLKGGAPCKFFPPRALEGGPGVGAPGGVFFPPPPLPPSKQCKFDFGGVGPFAFLKWWEARGPPFRPLGVFPSGAQ

SEQ ID NO: 940687 - protein, 52 aa, Homo sapiens
VRQWPWEFITIVSLLLLAEMEKKISGPRIKSGRDSWLVPAWVQVWQKLADAS

SEQ ID NO: 940688 - protein, 113 aa, Homo sapiens
KIGKIFGAGVPLLPPPWKELPLKKLVTFKCLAGLTPKKGLVFWLKGLKKLPRKKYFFWVFRGEPSRGPPPFFLTRILGVAPKDLKKGDPFFWMGGPRALPVGFLKKTIGRLGG

SEQ ID NO: 940689 - protein, 136 aa, Homo sapiens
RPLLASLNYRLTPHSAPHSRRSAPPSCGHPTPPRGSPGPPPVLGTIPPNNPSGGCSPPRRRPTGSLSLSRVERGGPGPPKPPEFPSRPSKNWGPLGDPPVGGGAPPSPPPGFWGFGGGPPPLRGEPPPPQGFFPWF

SEQ ID NO: 940690 - protein, 101 aa, Homo sapiens
PPLFFPKFPFWGGGVPKKILKRGFFPPPKTQPGDLPILGLKVFAPFPPKKPKKGPPIFMGTPGIFFAAQFFPGGGPPFFYCKGPGAPLFFGYPFPPPKKGN

SEQ ID NO: 940691 - protein, 155 aa, Homo sapiens
GDPGFTLIGGGLQEKCPLLQASPQGFAQDVGGMFKQFNKLIGGKAKGQSIMGLQGFFKRGMNEAFGDPKFFVGVVEPPPISLPGVGLSSQEMFGGPGDGPLGWSPHGKPSVLFFVRSPHPPSPGGLIPPPGGPPPPVPPEMVFIFGGLIKTSPVP

SEQ ID NO: 940692 - protein, 138 aa, Homo sapiens
ALVSPFLPVWGRWDPYRTDIGPQPAPSSYSISGLEGGPAIVQKSAAAPVSLHPALAHQVLGACGSKIGGERPRDVRESQRQRQRERERDTERGRERASERAAAAGRGPLPFCWGMLTERDLCFCFFSKKISSSTHVCG

SEQ ID NO: 940693 - protein, 112 aa, Homo sapiens
APRPPTTPPQLVQRPPRNHVYGAPRLLAPNNKQAGTPDPLSSRCSPFHFLEGRAVAAYAVRQPPTPSGPMNSWLGIVPLHTLITSSTHHLESQGGGIPTPAQPCWCEDWAPG

SEQ ID NO: 940694 - protein, 75 aa, Homo sapiens
PGLRAFLGPVARFPKLVASSWGRRFWRNPWQLRFRRLEFLCSGDVAGVCLTVEARNCNSEIHCYVAASTFNIGPP

SEQ ID NO: 940695 - protein, 126 aa, Homo sapiens
SPSCQSVTPQGRPPNARKFLGASPGTPNPGIPRGGPFPPLFPPPKPQPFAPAPPRMFFLLLGPGPLLFGPKGAPSPPPWALWKGFFGQAPLFQRGARVWGSLFFFFFGGPLGPRLGGGRWGLRGGL

SEQ ID NO: 940696 - protein, 76 aa, Homo sapiens
MYNKNFNNCIYAFADFPLKIITCVFDSQYSIWYQFTSLLIHVTRIVSQTENMYSSIKIWPNKCSVSTLINGYSLKK

SEQ ID NO: 940697 - protein, 163 aa, Homo sapiens
LKVPGVPGPEFVRKLDKGAKSYIRSRPQTPRKDFIQLFPGASPQVGALLEKMLGLKVDKGLRAGGALPHPFFEPFRGPGEKRGAHHPFDVSLEPEKLPGDEWKRPFSKGFVNFSPLCREGLRGPGGDKVVGIFFGGPPGPDPAQGPVFVPPKLSPFWKTPFQA

SEQ ID NO: 940698 - protein, 110 aa, Homo sapiens
HQHPAQEPAKRGARGIKIRGSPRLLIEHPPPINAQQLERGTKLRRQTHSCLPTSGKSDRLKNRRDETLQRKRGIMSSNSSARQWNVVQGRHVLHRCSMRDISQTIQSPSS

SEQ ID NO: 940699 - protein, 150 aa, Homo sapiens
GPPKPQVLSLLPFPGDFPKTRSPFSSLGKGFFSPPLPLGWGGIGGPGKNSKTPPPGWGSGGPFFFFKNPPGGKKGGARGGFFFFPFLVWGLAPPPPRKGLSFFPGFLVGGGAPPPPPGFLGGGGVFWGAPLFIFFRGPGGGFWPPPPPWG

SEQ ID NO: 940700 - protein, 104 aa, Homo sapiens
LRGPGGFKVSPLGALLIVAHPFKGGSASPPPLPSLSLDFRDLVGLPLTLCSCYKVKCPSGRERAPRVSSVRGHGQTPQSLHPPLLPTPPPFGGLFLKSKVFRGS

SEQ ID NO: 940701 - protein, 139 aa, Homo sapiens
HIKEGAPYLLPYQRDGKLMSQVPGAGLLTGLVFFLDVRNIILGKSHYVLYGLVAPMQPQMLVTFNKELRPLPVSVRVGQAVNVVGQVGNPKIITGFQRHTTPVLLAHGEREKLAPKEFFPVPPILEGFVILGKTPNYDF

SEQ ID NO: 940702 - protein, 102 aa, Homo sapiens
RVFFPPPPPARGGGGILGPPFPPPPPPGGVNPTPPPPPPRGGFFFFPPGAPGLPKGPGGPGGVLNSLPGFKPPPRGHTPGFFLSPGPFFPFFFFVFFFFFSV

SEQ ID NO: 940703 - protein, 105 aa, Homo sapiens
WCAYFVPNPPAPCIVGVQIPLFPGRAGGALWFSLIRGPPPGEVVPLPRSPPGVFPGWWAPVPPFSPVFLGQGEGAVPFRAPGVFKGDEGPWGPPVFFWVGGAPPH

SEQ ID NO: 940704 - protein, 140 aa, Homo sapiens
GQWAAGQGGFPPVFFPPPLAKKTRVKCPPGPPRVIFPPPKNWVGLGGGGGISQPLFWGGGGGPPIFAKKELFAPGRGGGPYLLGGPLFGGGPPPPLGGPPPSPEGPPLAPKGVFFFPPRLGFSGGPPFCRGKKTLFWGPL

SEQ ID NO: 940705 - protein, 153 aa, Homo sapiens
CPSCGGQLGGGHQVIKPGWKAPGPLMFSSNDKVIKKIIAKTSSGGVAANVIVHIPLHFLPFGGVGKKGMGSSHGKKREIFFPPRFCLVRPFMNNKGLKVKSPPSPAQISPALRRGCSAWPGQIGSHGGGAPPHGFFGPWENGSCSPSPAPFFC

SEQ ID NO: 940706 - protein, 43 aa, Homo sapiens
RPRAPAFTFGARFPTQQTTDIPGPGDLVPARMTVRGTDGAPAY

SEQ ID NO: 940707 - protein, 186 aa, Homo sapiens
GAVGALEGLAAGVQVHVAQQVVHAVHALPAHPASEWLHGRVYNHVGLESLLLYKGLEADVALVGPDAGVDQHVPLHVRLEGELPATHLALELLHALVAPPALPSVVNLAEAAFSAHEGSQVVVEHVVLLAAVVEGLVTLEALVEGGAVGKIESLYFLLGLEKIQAADADMAAATLMLHFVGLELAG

SEQ ID NO: 940708 - protein, 157 aa, Homo sapiens
VVGGICGQGRGVQARFVRDRAHGQAARHGGTVAGVVHHLFVGLEVHFVGLVVVVAVVVLLLRGHEVVDGERVVEGVVVFRLQVGLRRQARVVGRAQQVGRGLLLLPGGRRLWGAQRSRPLLSRKKNKAKLVMGRARVRRLGARRSLGGRPGGLPELS

SEQ ID NO: 940709 - protein, 265 aa, Homo sapiens
PTDTLRAPADTTVTGCPEDRQQIAVRAGPTNIVPTQVRTGASPLTGKNRCVTKTPGKDSVTPAPPPALIEDALHLRDPPREEFWWPPRGDKHGTTPWRQHAHLRGGPHPPWHRDNACGSANPTFFFCLCGPLPQFSPFQRRHSGVLLDSPLASDPSLGVPPPRTPSGVSLLSVPPPPAAAVCLSVVAVLLRLPPPAEEVPPRAHSSRPPKDTPGWRACERGPAGQPSVARRTTALLVGYTYRDERKCSLPKEKERKGHNAPTMSE

SEQ ID NO: 940710 - protein, 142 aa, Homo sapiens
PPSCHEGHAVFQVPRLVKDRFAGRHFYWALTNEGIRYLRDYLHLPPEMGLPPYAVAVQRLAGLGLKVWRVSALRDSQEGKLTEIPPDGVLSPLVPPKKPRLGLGQHPNSSLEADLVVDGVTPPGKIGGDSFALNKLPAQNPL

SEQ ID NO: 940711 - protein, 152 aa, Homo sapiens
EENTSRILRMRWEEEGVEMSRAAYTGVTCFGLRTSLRYAIQLITVASLVCRKRKGTEVQVDDIKRVYSLFLDESRSTQYMKEYQDAFLFNELKGETMAPPELDVIPRPPPVFPQSSDPVTLYKMVGKLPPPWVWVVALSPQKDPARVRIEKP

SEQ ID NO: 940712 - protein, 140 aa, Homo sapiens
RAPPPPGSFLGGGGGGPSFFSTPQRGPPALASGFGGVCQFFLKPPAPNPPLWGGGPCAPSKFLGPGPHFKGGPPPPPGGFFFGGAGGGGAPPFFFPPPQRGDPPPGSGPWGGGFFFSPRAFPGPGGGFFFPFTLFPPFCF

SEQ ID NO: 940713 - protein, 108 aa, Homo sapiens
PPGAGGGPKAPGALLWGGARPALFFPAGGGPPGRGPPFFFPLSRGAPTGAGGFPFWVGGRSPLGVWALPPPGWAYGFFLARGFGPRGPPPPLSGGVPPPPLFFFLGGG

SEQ ID NO: 940714 - protein, 181 aa, Homo sapiens
CQSSSPRLWAASKKGSGVSLAGLKKALAAAGYDVEKTHSRIKLGLKSLVSKGTLVQTKGTGVFGSFKLNKKAASGEAKPKVKKGGGTKLKKPVGAAKKPKKAAGGAILKKSAKKPPKKGKKAGPGPLYTKKVVKSPKKAKVGKPKKAAKSVAKAVKPKAVKPKVVKPKKGGPKKKKGNAYF

SEQ ID NO: 940715 - protein, 112 aa, Homo sapiens
GDPFSPPPFGFPGSLGGRPFFPPVARPPWGKFPEVGRNIGVLKILPPPGGGGPQGKFFPPFFFNLRKTPPLSLEGAREIPKGGTPGGLSLFPAPPLLKPAPFFFPFEIPQGP

SEQ ID NO: 940716 - protein, 99 aa, Homo sapiens
ITPCPPGPPPGPPPGQPTKVQLPRRGLLMPPPHAPPPYPPQKGVNKPGGPPGGGQGPPLQPPPPPRGQFFKRGAGGISPPLGGQNPPKAPPFKRAPGQG

SEQ ID NO: 940717 - protein, 80 aa, Homo sapiens
CASFRSSSAPMCDEPDMAEIENSDKSQLEEDINAREIIRCLPKKRLHSRSEQANRNEACAANMHCTFHKHCLVILLLLAV

SEQ ID NO: 940718 - protein, 104 aa, Homo sapiens
MTAGPHRTSWEDWLCCWRRAGEGNGMLPLCQSLEVAVQVMVGAAPPAGRPGVYYHGALCLRFQAQHIAVAVLYLALQVYGVEVPAEVEAEKPWWQIYTMDTEIP

SEQ ID NO: 940719 - protein, 91 aa, Homo sapiens
PNNVRQPFVTPPRGLKMAVTFIGNSTAIQELFKRISEQFTAMFRRKAFLPWYTGEGMDEMEFPQAESNMNDLVFEYQQFQDAPAEEKEDFG

SEQ ID NO: 940720 - protein, 134 aa, Homo sapiens
MSKPPSLGQYYLPQYSKTRRVWYNTPPIHSQPPDKTHSLPLPWTIPMRHNYNKLHLPTTNRPKIGHWILFNQPHSPCSNSHFHPNPLKVHRGSHFHNRPRGYILITILPSKLKLRTHSQLHHNPLSRASNSLPP

SEQ ID NO: 940721 - protein, 169 aa, Homo sapiens
MRPLVEFDKNKLISVQDGISRGSYKKEKFEDRSPTAECLSEKETQELMACIKNVLGSRVTNVKVTLRLDTHPAMVTVLKMGVARHFLRMQQLAKTQKERAQLLQPTLEINPRHALIKKLNQLRASEPGLAQLLVDQIYENPMIAAGLVDAPRAMVGRLNELLVKALERH

SEQ ID NO: 940722 - protein, 108 aa, Homo sapiens
TVPKTEIREKLAQMDQTPPDVIFVFGFRTPFGGGQTTGFGMIYDSLGYAKKKNPNIALPDMACIKKKRPPESHERDARTELKKSGGLPRPMLGLAKKSELEIGSPPKE

SEQ ID NO: 940723 - protein, 93 aa, Homo sapiens
TFFGGLFIILLWRTLKYLWTVCCPCGGKTKAPPFGSPGNSPNSAELERESALGPGFDEGFPWRSRGVNVVGFNYFWGKRPPALRLATPSMYGC

SEQ ID NO: 940724 - protein, 67 aa, Homo sapiens
MKKRGTLLLSGGPRGPCRWPSTQKTIDRLAGKPTHVNVSVVMAEVDGTCYEAARLFPTLKTPVSPKQ

SEQ ID NO: 940725 - protein, 97 aa, Homo sapiens
ATQALEKYNIEKDIAAHIKKEFDKKYNPTWHCIVGRNFGSYVTHETKHFIYFYLAKWPFFCSNLVKSMDCATHPCILKTGMQPPKTRFSTLLKTLQV

SEQ ID NO: 940726 - protein, 33 aa, Homo sapiens
MGNGSVIGKETETVTESESENEIRNESESGTER

SEQ ID NO: 940727 - protein, 67 aa, Homo sapiens
EHPQHTEHIVDDCSECKTDRPGRQHLDVKDVRQQQKRAGIDNRGDRSHHEIPEHLQEPVLCAVDHQS

SEQ ID NO: 940728 - protein, 98 aa, Homo sapiens
PGGEGFPMTLVESFRVGTPSVVTNSLGIADDCIQYGAAEVTDGSASSMADAVIRILTDKQHAQALVRNALSYLSKMKTLWPWDAKCRAIASPMPLAPP

SEQ ID NO: 940729 - protein, 37 aa, Homo sapiens
RSRVPLAASSFLKFMITSNTLKMGSRISWQKVRGGTE

SEQ ID NO: 940730 - protein, 69 aa, Homo sapiens
SPGVEPRFFLVSHAEDLPLGTSKPEARSPQSPAAPRCIKGVPHSESTSISSSLTLRMGGCPFFSFRGIY

SEQ ID NO: 940731 - protein, 43 aa, Homo sapiens
AHLQWGAKRGIISAPSADAAMFAMGVNHEKSDNSLKIVSHASL

SEQ ID NO: 940732 - protein, 102 aa, Homo sapiens
SLPRPRLKKTNEPGAVAHACNPSTLGGRGGRITSQEIKTILANMVKPPSLLKTHHAWLIFVFLVETGFHHVGQAGLQFPTSGDPPSSASESAVLQPGRRRLR

SEQ ID NO: 940733 - protein, 93 aa, Homo sapiens
MVDPKHHRHFVIRRGQVLREIAEEYGGVMVSFPRFGTQSDKVTLKGAKDCVEAAKKRIQEIIEDLVGTWVFGEGFSPPSGHSPKPCMSVRSPL

SEQ ID NO: 940734 - protein, 45 aa, Homo sapiens
QAATKYTDGGPGGKHTIPARSTHLKTPASGQTPTSTPAPGFATRT

SEQ ID NO: 940735 - protein, 121 aa, Homo sapiens
WPPEYLASGGIFTSSYFPPFFLEPGDLGFLEVANGVVFPFEAPFCLIITSQGVWHSWGVPPLGLKTDAIPGGFNQTLFPANRPGVYSGQCFEIWGANPSFMPLVLELIPLKIFEMGAVFTL

SEQ ID NO: 940736 - protein, 121 aa, Homo sapiens
LGKVMRMLGYNTTPEEVQKMINQVHEARSGAVDFDEFLVMMVWCMKDDSKGKFKEELFDFFRMFDKNGDGYIDLDELKIMLQGTGETISEDDIEEFMKDGDKNIAGRIDYDKFLEFMKGVE

SEQ ID NO: 940737 - protein, 86 aa, Homo sapiens
PARGETPKNPIKKGLLSPGGGFVLIKRASDSEGWGSFYHTPTFFGPKLWGFFKKGKSKKEPLGFLVWEKLGFKFFHFGKNHGGGFC

SEQ ID NO: 940738 - protein, 106 aa, Homo sapiens
IGEGTRVGTPVLAASSIRASVYPLVKQTPQFVSSFVGVCVPLRTGYCFPRGPVGFWVPTFSPNWGSRGSRPGRRGATGHSWLCLGPCTAPQPVAPPPVPKEYGPPE

SEQ ID NO: 940739 - protein, 76 aa, Homo sapiens
ASHYLHFLGVPWTHTTHQETKEHLSSHSHSQTCPCCTPHHGQPRSLWVTAKQLPPRFSVLTTSTRGPNKDVKPEKK

SEQ ID NO: 940740 - protein, 120 aa, Homo sapiens
FPIPASPLPPFRRGVAPNRFLPVYSPRSPIPKHIRIFRIRGIIPLGSPLFNRNPPNPNNSSPAFSNFGFFFSPPTTLRGGVSLPHFRGHLGVNFFCTPRFPRTSGHYGVNFPPNLVFSPK

SEQ ID NO: 940741 - protein, 86 aa, Homo sapiens
GKDDRRLGEKVEEGPKFLKSGDAAMVNMVPGKPMCVEGFSDNPPLGRFAVCDITQTVPVGVIKPVDKKAGGGGKVPKFAQKGQKGK

SEQ ID NO: 940742 - protein, 138 aa, Homo sapiens
SMHRGGSSKAVLWFWFSHKRVNGCLAGAPREDPQFPKGQWPPREICFACHNERLDGPVWEVEATLNFLKGHFSPRKIILDFPAGGSAARRDVQNVAAAPKVGMGALEVESRNLILDPGKPEMMKSPPNTNPMASMIFL

SEQ ID NO: 940743 - protein, 176 aa, Homo sapiens
VLSVCQSHSTPDIKSHYAFRIFDFDDDGTLNKEDLSRLVNSLTGKGEDTRLSAFEMKQLIDNILEEFDIDRDGTIPLFEFQQVISRFPDFASSFKIVLDNSPRVCPGPLSKNLFIVELWPRSSLCCQGGPNCPTPEVGLLHPPPGQGGPLLSGPFLTGVVIAPFGFVLTSKKGLKV

SEQ ID NO: 940744 - protein, 71 aa, Homo sapiens
KEVKNRWDYHNLVQNLMREKAKNTDKLGGEAVVQSISPQQEKETIAKCIAALKLLAKKVKPSQLCKWIYPN

SEQ ID NO: 940745 - protein, 104 aa, Homo sapiens
GAPKIRVNHVPSPLVMRFMGQAPCSAPPKAKVMLNRFPLGKFVWVGDVVNAILFLGRGPRGMPRGSLLPVEGGFWACWGPSTPLKPHAGVFLPPIPPINLFLLP

SEQ ID NO: 940746 - protein, 94 aa, Homo sapiens
GAISQIFVLCQQQSGGVGAHYYTPRWRLFLEALVDSVAQGIPFQQHQFDKNVFQLEQAFVFSKQRYPSQPRGDTVDLAKKIFLKYYPGWVAGFW

SEQ ID NO: 940747 - protein, 73 aa, Homo sapiens
FGLNLFSEVEESAIEKHFLDCGSIMAVRIVRDMTGIGTGFGYVLFEVWETNALSLSFEVPWEALTLLHVIIET

SEQ ID NO: 940748 - protein, 121 aa, Homo sapiens
SLGFGCVAKMLPGILKISWGAPGGPYAGTPPVSSPLNWGLTLNPFFFKGPVVLGGPLLPRVFGNYKFSGGFSFIRGFPLNPRGGTPFFSKKTPPKRGGGLFVPVFSQPRGVFPPNKGRGVG

SEQ ID NO: 940749 - protein, 104 aa, Homo sapiens
PLSQPLLLGIARNETSAGRARAEFYVQCSLTFEQVRKPSLSGGPEAPEFPGIFFVETQNGRRLPQMEMWGELCPSAKGAIILYTRVQGSPPGGALGSPPPPPPL

SEQ ID NO: 940750 - protein, 201 aa, Homo sapiens
PSVFPPGSLRLGPFFLGPPPPKAPPPAVWGFFLWSPRAPPSPPPGLLSFPTVGQGGGFFGPPTGGFGAPFFVFTPQIKTPGGPRGFPPGGGFLPPPPGVFFPFFGAFSPSGPPGAPGVLGVFFPPRPPLFGGFFPPPGGGGGALFFFPPPPGPLFFFFWAGGVFFPRGPFPWAPPPPAPPVSRFGARGFSGVSLWGFLGPR

SEQ ID NO: 940751 - protein, 122 aa, Homo sapiens
KAGAVGGEVRMYAKAPLVVGVLQRQAAAQHLHEHPPKLLRGHRVQERVDDRAEVEKRLREGEEDHVRPEVGPRPVVLGFGRSHDPPNLVGHPAYGQCPNNQPWADPSRRESQRKKKPSMRTQ

SEQ ID NO: 940752 - protein, 111 aa, Homo sapiens
KLFLPNPQGGRIFPPGSQKPNCFGWEGGVNSIGWAFPFGKNFYPSLLGAQMGPCKNCPPFWGFFLTPFLNWGGETPQKLGGPVAPFGQMGGAQFGLGGIFFFQAPLGGRGY

SEQ ID NO: 940753 - protein, 96 aa, Homo sapiens
SCAKSPPRNKLPQEWENTKNALLTYLEQVRMGIAGVVRDKDTELGISPVIPVDGINHNVTPAWGGDYWGFLTPGDYMVTASAEGSHSVTRNCGVPF

SEQ ID NO: 940754 - protein, 125 aa, Homo sapiens
GQASWVVVGWSPVAPGTGPGRQPGAGKAVRAGGGLNAQNSPRQRRPGRVGGWEQRIKAFFFSSAINLSGNWGGNNRHSGTLLSQAIGGCALKGPTALWGRVAWVWVRVGKGLGLLPSGQLCSPLF

SEQ ID NO: 940755 - protein, 112 aa, Homo sapiens
FPGKPSVRPNHFVAARGVPRFLNYRSPPWGSPYSVSVVETHFDPYAFLFNQGNKGPGGDFRMAPLFSQNPDPQGWVKGEIPPLLQGPGVPKGYPCFFAPNRLGHGPIGLPRG

SEQ ID NO: 940756 - protein, 77 aa, Homo sapiens
MSGFPRSEHHPGTGGPLGGALVPPFPNPFRPGVPIGVWGGGQQARLGVPFLSPYLNPFGPGFFPCLKPVPNKELIIP

SEQ ID NO: 940757 - protein, 94 aa, Homo sapiens
GVVAAINPQNVVTFNKEGPFVFVRVGQQVNVVGQVGNPKIFPGFQRKTTPGLLAPGEGEKLAPEGFFPVPPIWGGFVSLGKNPNKDFLGAPRGF

SEQ ID NO: 940758 - protein, 115 aa, Homo sapiens
KIPPQGQGLFGKSPQGEFPQVPFRQEGGGGEGLRPPGGPPGDKKGPPPLFLAPQGGGPAGAPAHALGAFPRHFIGPPCNPVGGGTPKIRGAPPRGRVPWPVGVGWGPPPRGPLGE

SEQ ID NO: 940759 - protein, 68 aa, Homo sapiens
EGFDSPLLQGRGEYKGGHGPLPQRPPEGPVVPAKGNGGVPPFRLPHRPGFPLLTRAKEPVGKWVCWAR

SEQ ID NO: 940760 - protein, 80 aa, Homo sapiens
APGFVPQKVRAPPGFNLEEFRVAGFPKKVARPLGFFLVPRRGNKSPESLQANVQGVKEARSKFFLFPRKPSAPQKGDIFF

SEQ ID NO: 940761 - protein, 121 aa, Homo sapiens
MQPSCPSAHEWVNKTCPSRQWTLDSRENERDAGTGYSTKELCGRHAAGPCLILSWEVSGVPRSVETERRMAGARLGRGLQFGRTLETGGEGGRTAVGMRFVRRTLKDGENGNFMYYFTTIK

SEQ ID NO: 940762 - protein, 145 aa, Homo sapiens
GKRREKALNFLSLGEPPMVIRVPGRPRGVKAFPTIPPWGGFRVGKLNQPVGGGFSKPGAKRVVGVGRVPSLPRKVQRVKGIFPLNPPPPFLTGGGGRVPNRLVPLAPLGLGGKAGLLKPRLGNPSQGKGNVLGAPLGFFFGGGRF

SEQ ID NO: 940763 - protein, 94 aa, Homo sapiens
PPGGKGFKTHPPPPPPNWAEGGLGKFPPPFFKKQRERSFGPPPLKVVGPPDLGFGALGPPFLGTPGSGAPGNQTGFRLKFFSPPPGGAPVGVFV

SEQ ID NO: 940764 - protein, 76 aa, Homo sapiens
ITLSPKGQSQWKVDNPLPSGYSPEGVPERGSKGSPFSPRSPLLSKADFEKPKVFAWEVPPQGLGSPVPKSFPRGEC

SEQ ID NO: 940765 - protein, 134 aa, Homo sapiens
VAALETRGPQHSGNLGGLGFGFDGSGNNKWPAICPKVEAMNKRLGSLVDEFKELVYPQIPILKGKFPEKTDNEGFGSKRPKVEYSKEELKPPISKGTLGKFPVPILKKASRASGLKSGLKKQELLEALPKPFQD

SEQ ID NO: 940766 - protein, 77 aa, Homo sapiens
AQPSGASHVRRVLSACVKMPTDAYLVCYDMHNLSAMCAASYRRIYRGQPVEECPLSGACYSEFKGHICRVSAVTAIG

SEQ ID NO: 940767 - protein, 105 aa, Homo sapiens
FTLPPLSPNGGGGGAGGGFFYPGFFFFPPVSLGTPPPLFFPPFKTPGPFPPPGFFFGPGGGSLFSPGTPFALWAFLGPLLNRFFPKTGGGPGRVFRGFFAPRGPP

SEQ ID NO: 940768 - protein, 104 aa, Homo sapiens
PKPQQKGPFPQGFFLGGGPPAGGANLGFGGGKPPRNPGGGPFPPPPPLFEGGGGAPGGPLFPPPRGGGGPLGGGGPPPPPPPPKVFFFFFFGGFFFFFTLTPFP

SEQ ID NO: 940769 - protein, 151 aa, Homo sapiens
MGLPKLNARLKDETLQPFFEGLLPRDNPRNTRFAINFFTSIGLGGLTDELREHLKNTPKVIVAQKPDVEQNKSSPSSSSSASSSQEFDSSAFYFDNSETSSESSSEKSASSSTSSHSSASANDVKKKGHGKPKSKKVDKLLRNQPPNDRAP

SEQ ID NO: 940770 - protein, 110 aa, Homo sapiens
MGVPPQGQPRGPSATSCLQQARRISGLSSVMMRSSGSDLPRASRVHVGRPWGVPRVDCRSHSSRRRCSPGGTPLLPEYPRARRALSTPTPTATADGVRGHEMDRPGRPLG

SEQ ID NO: 940771 - protein, 106 aa, Homo sapiens
LRFLVKLTPFAKPLGRNPFFRQARIPKLRVVKAVFAAGALQANSNKKAAVAGKKPLVGKKGKKAPVGVKNPKKPLVGKKAAASKNPAPEKKPAEKNPSPEEKKPAA

SEQ ID NO: 940772 - protein, 69 aa, Homo sapiens
MGEVEVVFTAPVARHPQITTVFFPDGTIVQNSLRVLRNADGAEIVFTLFQHPGVSDEAFEADATAVAAD

SEQ ID NO: 940773 - protein, 125 aa, Homo sapiens
GPFKPGLGQKTGGARAGISRVFTPGAGSFLGGPPQKMGGGGGVGLGVFYPRVPPPGPRGGLGFPPGALLGDPNLFLGLGAPSFPGPLSPGGGGAPPPPGGPPFPRGFLFPPPLFPGPFFWALSGF

SEQ ID NO: 940774 - protein, 76 aa, Homo sapiens
MTVRRRLPAVEHPLINALARDASPAELGGRLSHAIAEATLISRAEAARRVHTAADLGPRVGLTGEPIAPALAATAA

SEQ ID NO: 940775 - protein, 87 aa, Homo sapiens
KEIIPFRGPAGASAVVAVAFGMSSCPNIKMIFPSSSCHDPIRYILLPRIIEAKYLDVMDAEHRPGLADPAHAPFASPPGPPRLALKL

SEQ ID NO: 940776 - protein, 117 aa, Homo sapiens
KVGSQRFPRILVLHLNRFFASRGSIKKVQYGVDSPLQRLSLGDFASDKAGSPVYQLYALCNHSGSVHYGPYPALCRCQTGWHVYNDFCVSPVSENQVASSEGYVLFFQLMQEPPRCL

SEQ ID NO: 940777 - protein, 105 aa, Homo sapiens
AWVLPLPIMGGQRPFFRGPLFRKKLFPFFNNFPPKFLYFYLSRPRAYYFFFFFWNPPFSPLGVFSPVGGPGRKAGGGGKLFFFPPGGGPFPTSWAYFPFPPPGGP

SEQ ID NO: 940778 - protein, 98 aa, Homo sapiens
GCPCLRVIFLPGEGPPPLPFGSSPLRPARDLLELEQALGAKVPDDRQRGRGPPPPPPPCNSSCPSISSCFQWLPGVLFGGSPPLESGQGGDLTAPLLP

SEQ ID NO: 940779 - protein, 101 aa, Homo sapiens
PPFSPIGGWGVPGGGFFNQAFFFCPPVSLGPPPPFFFPPLKPPGPFPPPAFSLGPGGVSLFPRGPLLPFGPFLGPFLTSFVQKTGGGRAGVFRVFFPPRAP

SEQ ID NO: 940780 - protein, 90 aa, Homo sapiens
RAFPRACEPRFGEGDRAHLKNPMDFSPMRERLLRERSTAKEEFAVDALLVFRNCQTFNEDDFKVGKAGPIMRRFFESRWEEFYQGNQANL

SEQ ID NO: 940781 - protein, 96 aa, Homo sapiens
LNFLRPWGKKRLQEFPHKGPGRSEMWMLLLPLTGAFESSSPQNEVQPPRKSFARPQVTRAQPPGPQIRPAFPRFGSCPLTLGFAGHGKNKIAPACN

SEQ ID NO: 940782 - protein, 72 aa, Homo sapiens
MFNFYEIEDEPGIYGDKKYDSPAQWLTPVIPALWEAEAGGSGGQEIETILANPVKPRLYYKIQKISYSETPS

SEQ ID NO: 940783 - protein, 134 aa, Homo sapiens
GGASFFHPCQPHKIPDGPVPSSVVEEVFKPPAPGEKGAPQKPEKGASNSFKQEMDSLQGQMEEHALRVQKFLSLWKPLEPANASPVPPGGYAGPGGTHKNTVKAGFPKKGRESDCCGFASGGRCPKRFLSRLFI

SEQ ID NO: 940784 - protein, 102 aa, Homo sapiens
MGQVFSKSFFEWTNCEVPQLQPRTRFPHSQCPKIPLCPMITPSDGMPAMCLCVSISIYCFVVSFYMQFYVFPLCNFMFFQTWRILLHVWNLWTSKILAYCIT

SEQ ID NO: 940785 - protein, 148 aa, Homo sapiens
TYIPKDFATLYQGWGVNGPGLEHKGTLRTQARPGEFVCLELRKKLPPARPPQGPHAGPLRGETLLTQVPSRQCLLEREPKGVFPTPPRSPERPLAVPPRCPRSLPPVTWPLHGRTAGELLSRPPPSPAPALEWKLKADAPPCLTFRNK

SEQ ID NO: 940786 - protein, 105 aa, Homo sapiens
MRIPKGDLFGKQEQQHPKIQAQEAELLGAPPTNPEGMPMVKIPEMARTLDQICRGTKAKPPKDTKLVLSDEDPNAEAKDQAAEDEKKKVENEKEVLDEAEAAFLG

SEQ ID NO: 940787 - protein, 112 aa, Homo sapiens
WCQVDYSAAEGLALPLLGDLILAMLGAQFMVGEKICGAVVSVPFQEDIISIWNKASDQATTARIRDTLRVLNLPPNPIMEYKTPPASIKMPGRLGPQRLLFQNLWKPRLNVP

SEQ ID NO: 940788 - protein, 130 aa, Homo sapiens
MNDPGTIRTRKFMANRLLQRKQMVIDVLHPGKAAVPKTEIREKLAKMSQATPDVIFVFGFRTHFGGGKTTGFGMIYDSLDYAKKNEPQHSLARHGLYEKKKPSRKPRKGRKTRIKKVRGAAKANVGAGKK

SEQ ID NO: 940789 - protein, 116 aa, Homo sapiens
GFFVRGGVFLPRARLGTPPLVFGPPSGVLGPPWRRGVRFGPGGFAFFPGGGAFFPRGFVVALWPLLGPLLGGVGGRSWLGLVGPSGGVVFPPARVVFFPPPPLFFPPLPFLRKCLI

SEQ ID NO: 940790 - protein, 66 aa, Homo sapiens
SQVGHRGPMGQQGILGISGPGPMGQPGKVAPFVSLDCFGPSQWSTSPPPHKPMKGPFGGNSPPPFG

SEQ ID NO: 940791 - protein, 162 aa, Homo sapiens
GETGGKKKETRFWLPWGAQSVGSPPGVCEEREEGDFLGGYFQGPRAWAPKKVARSRPFFSLFKEMDGRPFVVRKPFNKKGETPWGPSPPNLGFCFPGSCGPNGGFVFKNPGPQKNKKGGAEFVYLLAQRMKGGKGRAPGPIGEGRRLSPLGGFSFRFGPRPK

SEQ ID NO: 940792 - protein, 70 aa, Homo sapiens
KRVTPGGDYTAQILGSLFGRDERLFCPFYTRGRGVRDPKGGGRVVSRGFFYFPPHSTKGGVFAPTKQGVF

SEQ ID NO: 940793 - protein, 94 aa, Homo sapiens
QSLFFAKPSPFRAFKAFWEHSLPMSAEGLPSPGYQREGWTKRSSPRVKATCNDPCFEYQQYQECPPTKGGGFWLGGPKGGLKAKPPSPQGFQFP

SEQ ID NO: 940794 - protein, 98 aa, Homo sapiens
PPFFFPPPPPGDPPPRVFSPQKNPGGAPPPPFFLGGGGGGPFSPGAPLPPPAPFGAPFYPVWAKKRGGGGGGFPGVFFPPPPRGNFFGGGVFFPPPLF

SEQ ID NO: 940795 - protein, 142 aa, Homo sapiens
GFSPGFSILPPPGQGGVFLAPKTTGLFKILLPPPPLSHNGGGGCPVGGFFYPGFFFYPPIPPGPPPPFFFPPLKPPGPFPPPGFFFGPGGVSFFPPGNPFSPLAFFGAPFNPVFSKKPGGARPGFSRFFFPPRPPGGGGGGG

SEQ ID NO: 940796 - protein, 70 aa, Homo sapiens
EPNGHSAFRFRPAGPIGVLGPQPGPSRKMTLYKSFPSPSPQRHGQGRPPPPLFSVSTVFDFGTPEPPRDP

SEQ ID NO: 940797 - protein, 47 aa, Homo sapiens
KEHGAKSRQAGKAPKGSWGWKGYVASGPKTTQLLPVVKPSKIGIFLA

SEQ ID NO: 940798 - protein, 95 aa, Homo sapiens
ATWPSPKAQGPLVSAVCTSSVRRQDSRSMKRAGQKTPTLAGRHVPLKIKKEAIWEQCSSYVRPGHFLFTGDYKTFVLSSLDVDAILGLSPPAPRH

SEQ ID NO: 940799 - protein, 181 aa, Homo sapiens
VPQHPPGPGQGGLIWGMASRSCTLFFGRGGQKGPHSRPEIHKKIYKIGRGSLFKGGKVFKNNASPFALFDKGITPLGGFVPYGEGPQHFVMLKGWGGGTKKGGVPPPKSFLGQKKGGGLEKIALKFFDPPPQCGPGRFPAHGGEKSIFGAPEKRPNCKGRGGLMPGTDFAGGGGSKKVFFP

SEQ ID NO: 940800 - protein, 104 aa, Homo sapiens
MLIHFLLGRGGGAVFKLVGNSFFAGIQDLKNICFTESRPAELRLLLPFPPLISKRQESPPCYVSGAPQDAVILVKVSSLSVKNMDVNVLYSLSGFRAILMEDVR

SEQ ID NO: 940801 - protein, 75 aa, Homo sapiens
KNAWDKEPVLVVSFVVGGLAVILPPLGPYFKYSVMINKATPYNYPVPVRDDGKMPEVPSHPQDPQGPSLEWLKKL

SEQ ID NO: 940802 - protein, 163 aa, Homo sapiens
SSVGDAKTSPRRRKSSRREAEPYLSSPPPDPVLAQICAEESPPFDRGGSGIAFFRNDPNGGNVFRLFNITWRKPMKVSAIALLTAFGFATAAMAAEDRGASSKAPGHEMQQDQGRMQGSPNAAGFGKKDGAGDTTGSTGSTTSGSSGSGSSSTGTAKPQLIAA

SEQ ID NO: 940803 - protein, 141 aa, Homo sapiens
QLPKPGPVFQFGQGMPGVGIMPTVGQLRAQFQGVLAKNPQLRHLSPQQQQQLQALFMQRQLQQSQAVGQTPPYQELGTQTFPFQGFLGCQPQLGGFPGPQTGPLQELGAGLRLQGPPRLLAPPGALFTGPVLGPVAPTSTL

SEQ ID NO: 940804 - protein, 103 aa, Homo sapiens
PPLKPPQKEKRGGGPHEGIGKLGGTQVRGPRAGGAQPNWGGLPSNQGGGGGGQAGWGPGGSPRFGLPPQTRRAGLRPPLGKAGVAPGKGGGGGGRAGGEGPAV

SEQ ID NO: 940805 - protein, 194 aa, Homo sapiens
GSHHSPGEEVPRASVGAQSLGFSTTRIRMMTCSFPPTAPMQQGRGTPLSTPWARAPFVGGPAGSPPTRHLPRAQEPRWGDPFPWGFLPPGSRSLAAPPGWGAGGGAASGTIWSPAPPFWGNPAPEPKAPKIAASCILGPPRAGGGGEASGVPPPSSPPPAPPVMGGGLKPKKKNPLGFFFWIFFFKKRYFFQGV

SEQ ID NO: 940806 - protein, 118 aa, Homo sapiens
QLVNERQPKARVVVLGLLPRGPTSQPTSGEEPTGERAGTGGTGWHPRAHFDADLGFVHSDGTISHHDMYDYHLSRWGYTPVCRGSALPGFCVGGPKTGAKGSPGGSRPLSILVPFPNI

SEQ ID NO: 940807 - protein, 89 aa, Homo sapiens
LPINSGLDKENVVHINHGVLGSHKKNKIMSFAASHMDAAGSHNLSKLRTENQVLHVLTNEELNIEYLRMQRWEQQTLQTGTLWVRRAEG

SEQ ID NO: 940808 - protein, 118 aa, Homo sapiens
SFAKLAKSPPRWARVFRAPPKRPSQMEHPMETMMFPFPKFGGDKGYFQKEALRVLMEKEFPGFLENQKAPLAVAKIMKALAQGKDGKVGFQRFFSLIGGLPIAGNDYFVGPMKQKGKK

SEQ ID NO: 940809 - protein, 74 aa, Homo sapiens
AFGARAFGALKVGGARLVGQLVNWVGTRNKEGAGWGKKAIRALERKPQKKFKRARVRGQTGLDFVRFPTAASQQ

SEQ ID NO: 940810 - protein, 102 aa, Homo sapiens
LPIGGVGGRGGGFFYPALFFYPPVSLGAPPPFFFPPLKARGPFPPPVFFLGPGGVSFFPRGPLFPFGPFLGPLFTRFFPKTGGGRGRVFRVFFAPRAPPRAP

SEQ ID NO: 940811 - protein, 98 aa, Homo sapiens
MGGGGGRGGGFLNQAPFVDPPVARGPPPPCFCPPEGPGAGPPPGLLPGPRGGVPFPPGDPFAPLGPFGGPLDPGWAKKPGGAGPGFPGVWRPPGPPSS

SEQ ID NO: 940812 - protein, 103 aa, Homo sapiens
LHTMIPSTTCFKLSQVGHGVLQKNFGFVFPSVFLLLTEGRALLVRVAMESTHWDACCTVLTRWLKGSFHVLVARPMGVPFRIYFRRFITYVGFSFPSVYLFST

SEQ ID NO: 940813 - protein, 67 aa, Homo sapiens
PPPKRGPPRGGEKKNPPGAPFPPPPLGFGAPPFLVPPNQTPFSPGGGGPPPPPFFSGFLGPPPPGPL

SEQ ID NO: 940814 - protein, 100 aa, Homo sapiens
GGFHLMGPPPVLKGGMSPALPLKGGGWALAMVPRWGAGGPGDPNFPGGLGGPPHGTGPLGFSRVGTRPKIGLEAVLPWGGGPVFRAVLVPPGVGLGGGPL

SEQ ID NO: 940815 - protein, 77 aa, Homo sapiens
KGGDGPQFLKFGEAALVYMVPGKPLCVESFSTNPPLGRFAVRKIPHPLLVGVIQPVAQKAGGAGKVPQFAPKGQRGK

SEQ ID NO: 940816 - protein, 106 aa, Homo sapiens
VHSSPWGAWLSARLCKWLQSPSSCRLGLAVLLGGAFVFWAGWTGGGRSPLWRSGVSGSAGPTLEGNLVGLPAFLWLEGVLLSYVRFPVVAGGVGGSTMFGGITFAF

SEQ ID NO: 940817 - protein, 95 aa, Homo sapiens
GAEEAMGRLAVGPAVEVAEVPQQLQAGPGPAAGGRAPVLGAAPQAVVGGRCVGRGLTASAGPPSVGPLVKGVCILGAGGPASFLREVSCTSPASF

SEQ ID NO: 940818 - protein, 199 aa, Homo sapiens
DFRPAGSSQGKGLEVYARPDTTRGRHRARFSAYVAMGGSHGPVGLGVKCSKKVTTAIRGAIILGQLSIVPVGKGYWGNKIGQPPTVPCKVAGPSGSVLGPLIPAPRGPGIVSAPVPKKLLMMAGIDDCYPSARGCPAPLGNFAKAPFDALFKTCRDLAPRLWKEAVFPKSPYQEFPGPLVKTPPRVSVQRTQAPAVGPT

SEQ ID NO: 940819 - protein, 102 aa, Homo sapiens
QPLRRSLGPLEGFFASGFNRAFKIKGFANTIPGHGGIMDRFARQYLMATFVNVYIASFIKGPNPSKLIQQFLTRPDQQLHIFNTLGFHLIDKGMLTSPPKDE

SEQ ID NO: 940820 - protein, 101 aa, Homo sapiens
LSLGAGPTGSPQGCPATQGGPPFFPQPRARPPWPPACHCNRPCPGPGWGPLPPQPTADLSGFPWAKGALWGGCLFFLVLGGGRDGGPGPPPPLVFFSRPGE

SEQ ID NO: 940821 - protein, 100 aa, Homo sapiens
MGPPPLGPGQEGPCPCPPYRPGVGGWGNSSPLSRGPGPWGPALPPRVGSSRGPPCGNKKGMDIGEKEEQEALFLFLPGGWGPPPLEGRGQGGGTPGGGFF

SEQ ID NO: 940822 - protein, 84 aa, Homo sapiens
VGRMPAAQGTVQTWGHPRAKDKSREEEAERTKDFFLVGKNRVLKILWDARESWALISGGIKESPSIILGINTELGLGGVFGSYL

SEQ ID NO: 940823 - protein, 35 aa, Homo sapiens
PRMTWQRKKAAPLQSKASYFSKTRPPRGPRIKVFS

SEQ ID NO: 940824 - protein, 84 aa, Homo sapiens
GPAGFKLGPKRFRKGFRQFRYQNGGGPREVFRQLGEFSPQWLGLNIRPKDQFVKMLVQKQLFPFLPRGVGARGFPPRRNVGFIG

SEQ ID NO: 940825 - protein, 127 aa, Homo sapiens
AHPPQRLPTMGLPSVRPPTPLPGGQPLLDQAQNGPPRGSPDAGSGLSSTLPHFGQRESATRPPPPSLRVRDRPATLYRTSTPRARARAFPVRPVRSRALPLRPQGAGAHRPTPTSLVYAVVMPKGMS

SEQ ID NO: 940826 - protein, 133 aa, Homo sapiens
RFGFFSPPKSVLGFHVLQKKGAAPPPLTVTRGSVDGPKVGTAGPPVPSGGELSPTFTGVPQLPDWPPPGGTTGALLGTWAGGRFLTLPAWEAQVNGPRGPVLPVSSRFWNPVQPKVGGFPVADSFPCFGLFEI

SEQ ID NO: 940827 - protein, 103 aa, Homo sapiens
TEQEATAWAPELTSSPCTDEERSHETSAQSGNRALFVTSCLSGGPVMKALPDWAQGIQKGQLVFAIVCCFSITSSPKQHWMNASRGSHNSFQDLVTIVSVPVQ

SEQ ID NO: 940828 - protein, 223 aa, Homo sapiens
QTKYAEMWARTPKPMFGYAGSTASPPTLTPLVKPDQTTNPGRDQSGAVAQATGTAAGSTRNAVAQQPFSAVPNMLTRTAVGPTAVDPSVTDVLGVESDLITVFLNGPASVAGLGVVTPFGATTLPFNIAGALTGFHTDDIVSGWAGVQSWPGAGAVPPSPFPVITNPAGGFGTLASAGLGEANTVGGLSVPPGWTAAAPAIRPAALALPATSAGAAAEAAAAA

SEQ ID NO: 940829 - protein, 97 aa, Homo sapiens
TWLLPSLPGFETSSDPQTQALPMGGDDDGLARLVGVCHSIPEQAPGHGVHASGWLIQEDEGRLSNQGDQCQCSTSACYHHRGWKGEGWVTAMVSLQQ

SEQ ID NO: 940830 - protein, 111 aa, Homo sapiens
PLHKCCLHPYGKSSTSGGEMVRPVPITSTPSTLNLSLRLKKLDLLPGVVGHACNPPPFFFKAGGSPEVRGLRPPCPPWRTLVFPKNTKISPAWWPPPIVPPPPGVEAGESL

SEQ ID NO: 940831 - protein, 153 aa, Homo sapiens
VLSKSALPFPKASKTLLCLGVQRRRNSPGSVVWNATGWTFPKVDRGFVGHWGTVSQWSVGWNPKHPNTLRVAGKKTVLPFHPVLQRPIQCAKAEAGEGVGPTPITWNCGWSKAKGTSRTQRLSSRPRFCEGPPALPVTHRAVGVSVVCPCENM

SEQ ID NO: 940832 - protein, 107 aa, Homo sapiens
MRFLPRIGHSLQQHSKRTLGNTAVDAHQRSRGEARLARRKKSAAVTISSGWPLRFNAAVGLSLCSSLQALETSVRKRPGEIVFTRTLGPYSKANASVSALSAALAPA

SEQ ID NO: 940833 - protein, 148 aa, Homo sapiens
KSDNFVNKQTRPFPPLIGASAFGEIEPVRFLLEWGADPTILAKERESALSLASTGGYTDIVGLLLERDVDINIYDWNGGTPLLYAVRGNHVKCVEALLDRGADLTTEADSGYTPMDLAMACGYRKVQQVIETHIVKIFQSKLVPGAPE

SEQ ID NO: 940834 - protein, 43 aa, Homo sapiens
FPFGPFLGPLLTQFFPKSGVGPVRVFRGFFCPRVRPRVPPRVR

SEQ ID NO: 940835 - protein, 118 aa, Homo sapiens
VPFTDFPYFKGTPLDQTLRQNPFSYKIYGGKFNFFPPTLFGPIRKAPRLLGLPPSKHHMKHPIIGRVIHFFNSRKIKNFHDLRSLRFEAKSPKSKRTLHKPGVIKWMPPPPTTHLKNP

SEQ ID NO: 940836 - protein, 108 aa, Homo sapiens
TLTPAESEEAGWHIPTLCPPGWDDTGGPRMFGDPGLTAAGWAIQHGSYYQEHRWGPHLHVTVTKTDKTLVLLMGQEGVHGGLIKQRWYENALHLRRSHTDLVCPFPSP

SEQ ID NO: 940837 - protein, 148 aa, Homo sapiens
GGGGRFTGSGFETWGAGGEYQFSARRTAVAVGAIGGALKDEGGSKKGGGAGGGFAGDGGPGGSGGTFWEGSQGFLVEWHLSGGGDSAYRGGPYAPLAFLPQHNGGHSRPPIYNMKTLIPPGKPPPGSYPYSPIFLLSLNPDIITGVSF

SEQ ID NO: 940838 - protein, 31 aa, Homo sapiens
MAPGSPPPGFPVVFGFVVIVPLQNKNCSGLP

SEQ ID NO: 940839 - protein, 80 aa, Homo sapiens
SSGNFSGWTIFMASILRMTWGPFRQDMRRPGQPLPASGPGSEGIRLSPVRLDVRVGGGVVWGWGAGDRAASWSRQAWGGP

SEQ ID NO: 940840 - protein, 68 aa, Homo sapiens
PSLQARAHGGPPASSLEAKPRMVAGQVWGASTLSWSACKMVSVKRKWTGGPCAPQGWLRGLSTSPLHL

SEQ ID NO: 940841 - protein, 36 aa, Homo sapiens
AGLLNGFISDLVDFSTKPMSCIIHRLYSQQSINKNP

SEQ ID NO: 940842 - protein, 75 aa, Homo sapiens
PPGFFGPPPPPFGGAPFVGGGGFSPPPPPLGGKITPGGPNWGGGKGPFFCPPPFPLGLFGGGQGGPRNFFSGGPI

SEQ ID NO: 940843 - protein, 118 aa, Homo sapiens
RIAFLNPIGEVFGLEKGPALGAGASARSPWDPRWVFPSHGQGPGLKGPHPPPPGWWWGLGPSFFKKSPFLRGFPATLCGKTRPCPPSGPFGGLEIFPWGAGPRVGLPCPPPGGAKVDH

SEQ ID NO: 940844 - protein, 162 aa, Homo sapiens
PLPLCPIKESWIGHHRRVHSLISPIFRGPPRPNLRQNPFPYHIHRGKFNFFPPTLFRPIRNAPTFLGLPRCIPPMKHPIIGGVLPFFNSGNFNNFPDLRSLRFEAKSPKVEEPSLNLEGLYGGPPPSPPFEEPGYIKFRQKRKGSDPPKVVSSPPPGPPGFF

SEQ ID NO: 940845 - protein, 76 aa, Homo sapiens
RLFCGGFFKNRTNQNGGPFCSAPPGPPIRKKMMEILTPEGAANTFKKVGHEFIPARLGKDIEKACPSFFPPPDVFG

SEQ ID NO: 940846 - protein, 100 aa, Homo sapiens
MCAMTPSEPKITVFEVRLRTGPFLGDTSKVIARTEEKGVPKNVILKFDACAAINSKQHGIRCSSLDWKKSYTAENKYICQKSYLCEDVSSTGTCVIRSYL

SEQ ID NO: 940847 - protein, 87 aa, Homo sapiens
MAGVDNGSIYKPEAYITEGTLGISLLEGVRCCKCLSADWLPKLLLSTPIYINGYNEILALSVETDYTFSPAEKVKAFLADPSAFVAA

SEQ ID NO: 940848 - protein, 111 aa, Homo sapiens
PGGIGFPGPRGTFGLFFPDWGPRVPPAAKKFGVVGGFLPPPLSRAPPLLQNRTALQTFPPSRGFGPWDPPAGPAAGKGGGGASGGEIQRLPLDPLPFANPNKGLNPPPGEG

SEQ ID NO: 940849 - protein, 79 aa, Homo sapiens
RAPTPPPRGGGGGWARPSLENALFPGDFLVLYGGRPGPGPLWAPLGGREFCRGGPGPGWACPGPRPGGAKGAINPFQGG

SEQ ID NO: 940850 - protein, 118 aa, Homo sapiens
LPVRDFVAPLLAQPAWSQSPPPGSNALAFIRWEFPNFNSRSKDLLGRFVLAPRHIVAAGFLIVAVPFFEWLALQFEWLEGAFLKDLLRQPVALALAQCLVPAAWAACLSPGGLSVGGP

SEQ ID NO: 940851 - protein, 109 aa, Homo sapiens
PGKTLIFWGPGGGKGCGDSPKNPRGGFFWVFFFPPRGGFGPPPPQIGFRPPKGGFGVPRLPGPPPRGPQSPPPFPPLGSGLLPPVFLFLGGTKLFPAAPFFFKLFFGVF

SEQ ID NO: 940852 - protein, 131 aa, Homo sapiens
MSPPAGELLEAEESRLQSGMQHISIRTKTTNGYAGGLSSPYGGLTSRGLSYSVGSSFGSGRGSSSFSRTSSSRAVGVKKIKTRDGKMVFQSSGVLAECQLGLPLPAFPSCVAPELGKEAALHGSFGNSSPP

SEQ ID NO: 940853 - protein, 118 aa, Homo sapiens
MKIHDMMLVLQGQWKRLCPVPRRCEVARGKNILRNALVFHLDGTTPVCEDIGRSLLTYGRRIPLGEWESRIAEVDASVVREICSKYIYDQCPAVGGYGPIEQVPDYNRIRNGMFWVRF

SEQ ID NO: 940854 - protein, 73 aa, Homo sapiens
VDKGPRETPCVESVSHNPPLGRFAVCDIRHTVAVGVIKAVDKKAAGAGKVSQFAQKGQKGEMNIIPKTRPPPF

SEQ ID NO: 940855 - protein, 107 aa, Homo sapiens
FFLGPAGGHRGFDPDPCPLPEEVVPPYSSPQEFAQDVGRMFKQFTKLTEAKAEVQSIMGLQGFFKRGMKGALGDPKFFVVLVGPPPMSLPGVGLSSQELFGGPGDGP

SEQ ID NO: 940856 - protein, 73 aa, Homo sapiens
FWGPRGKGKKPPPGPGPPGPGGGPPFLWGFLFPPPGVLFRPWGVFGEGFPPPVPGGAGGPPPISGGPPPLGDF

SEQ ID NO: 940857 - protein, 104 aa, Homo sapiens
LPLVELSKSHIPHHWASCWPGCSGCPSCPGSCGHRYKCVGGRAQVEKEGAALRLRAATVPRALMSLSSLVKPETAACVGLRSRIFSPLSFVTSRASGISFCKGP

SEQ ID NO: 940858 - protein, 194 aa, Homo sapiens
LTPMTVLHEVPHEVGDFAILVQSGCSKKQAMRLQLLTAVGALAGTACALLTEGGAVGSEIAGGAGPGWVLPFTAGGFIYVATVSVLPELLGRLRQENHLNPGAEGCSELEIMPLHSSLDDKSKTLSQEKKKKKNSIVLVCSHTAIKNCISFIAQCFGFALLKSSIFKKCTRKWQYLGSLQPPPPEAGEPLEPRS

SEQ ID NO: 940859 - protein, 168 aa, Homo sapiens
KYLGFPWGFSVLGKNAGGRAFVKDVPVFENPMGNNNEAWGRDLKLADFALLCLHGKRKPVTEAEKLPSSMAPNHPVVSRMDKVERLKQGLLHQQAKFGRNGFACPAKFCLFQFETKNLLFNDNTEGWARLHGKTTYEKYLGPQYVAGIFNLKKGSTSPLLEACEFLRK

SEQ ID NO: 940860 - protein, 113 aa, Homo sapiens
SLSPGRREQVFGQGKQQQTTAGKPFSLHPPCSNPGQALRRNSGRECPKISCPWMENRSRLDFFFFFFPGVGKYFFISQTGFNSTQVGNGVPVPPQAQSPKMRPFTWGVSGLVF

SEQ ID NO: 940861 - protein, 121 aa, Homo sapiens
GRKADMGGAVVWVQFYNVTLALDLSFPPTGKFLGGEESGVEFGMQNMGFHRKPPPGYAGGLSSAYGGLPSPGLRYSLGSNFGFGGGSSSFNRPSSSRAVVVKKIKTRDGKLGFGSFEVLPK

SEQ ID NO: 940862 - protein, 67 aa, Homo sapiens
AIVGMVPGKPMCVERFSDYPPLGRFGCWEIEQTGWVGVIKTVDKKAAGVGKVPKFAQKGQKGNEYYP

SEQ ID NO: 940863 - protein, 101 aa, Homo sapiens
DIAKFNHSIMTAHVMTTQRGSNSLQVVSQKKHVSLGPHMSLLRKDFSFYCVRLSKTQNLSSANFPKRMTGPREIETLNVGHSYQKSLPSCPKGLFDFLSFP

SEQ ID NO: 940864 - protein, 114 aa, Homo sapiens
PKTPGLFQILVPPPPLFPNGGGGGSGGGFFLPGSFFFPSVSPGAPPPLFFPPLKTPGPVPPPGFFLGRGGGYHFPPGHPFALWPFLGPLFAPFFPKSRVGPGRVFRGFFAPRGP

SEQ ID NO: 940865 - protein, 70 aa, Homo sapiens
QRSKSPSSPSQKVPCRVLKKNPLENFRILVELNPYAKALGRDPIFCQGRNPQLRGGKAAAAATALPTQSN

SEQ ID NO: 940866 - protein, 67 aa, Homo sapiens
CPRDPSPACCHVPFSKQVPGPPGKIEAGPDPYEPPGLRKRVFQACVDPPCPYGVPPFELLFGRHPWF

SEQ ID NO: 940867 - protein, 183 aa, Homo sapiens
ARPEKGRVSVESLEEGSFKASCLKAQLLRFEDGASTLYESNPLWGHLAGTCGLYGKDHQEAALVHMVNGVEDLRGKKVSLISTNYEGGKDDYVKALPGQLNPFETLLSQNQGGKPFIVGDQISFADYTLLDLLLIHGVLAPGGREGFPLLSANVGGLSARPKFKAFLASPEEVHLPINGNGKQ

SEQ ID NO: 940868 - protein, 111 aa, Homo sapiens
PHAHPIIVPQRLLQTRMPEASLDPQFSHVSVEPPPMSPLGLARVPTSSLVALIMAPNRCSLHGQPSLVLFYVLLPHPHSPAWLDSHSMVAPSPSSSRHGFHFRGFNKNFTS

SEQ ID NO: 940869 - protein, 77 aa, Homo sapiens
EPLSSVWGPAPSFAVAASGNPFPWEVDPPVFEVPNGYRVLGMEGNEPLREGNDLLQFAIQQEEEDLQRFLQLSLLEH

SEQ ID NO: 940870 - protein, 149 aa, Homo sapiens
RWLSPAGGMGMVPVVLLMSPIILSASFRGWGMCSILSCWACSANSSIRVFWFPHGDILASGSQIINSGVLEWANREKGWDLGPVPPWPFWALLGMCLGLGAPWSMAFPPGFYTALTGRSPSPLPFFPQMGAPGSKGKNPCQMSQIWGGA

SEQ ID NO: 940871 - protein, 171 aa, Homo sapiens
GPCGQGPVVVTRIIVWDIMAFNGIIHVLDKPPLGTPTAPSCWLPKAPPVSAGVGAVLSPETLLGLVAGAFYLRAQGKPTGFGFFAFQAENDVYDFSPWQKGTNPPLVFVPNPFFGNDPFFEPFDDSLLEEDFPYPQRFLPFNLRGWGLKQNACPGRSPLFFLFWVDGAEGV

SEQ ID NO: 940872 - protein, 106 aa, Homo sapiens
PQEVGLAIQAPRVQFFPLPPPGSFLLDNAGGEKPPPLPLVPPILGPRVPPDRGFPRPHYWVEFFPEKGSPFAGRNTVPRVRGGSVFNRPRVPPLGPPPPPPLVGFT

SEQ ID NO: 940873 - protein, 88 aa, Homo sapiens
HTYVVLCIPGGIMFQALLGIGSFAAVICMRDDFGRLPLGSRGLPVVNGMTGEMCAVLCVAGYVGHKHRRCLSGLSLPGNPVVQPHGSI

SEQ ID NO: 940874 - protein, 187 aa, Homo sapiens
PGGSTSPVYRRGGGGSSFFPGTRFASRPFVGPLYTSFAQKRGGAGSGFSGYFFTPGPGFRGGPQKRVFFFPPPPKGVWGFFPPHQKRPPKKGGAPRGFWGLGPPPFPLPGGVGARPPPVGFFPWGVPGPPPGGFPFSPGLRGGPFWFPPPRGALFPRGPPGGGGGAPPPGFFFFWGAPPQFFKGFFL

SEQ ID NO: 940875 - protein, 150 aa, Homo sapiens
LFACCVKDSPPQVLLQWGIPLAAVSQASPREFKTNIPQGLGPWEVRCGVRFPPGQNKAELQETRFPFLTGPAKPNGFPAGHAPQVLKGPKAPPEARDKGSLFAPQQVLPPRPDCINCQRNFVWGKVPFFFPPRLWPLREMFFFALGGFFP

SEQ ID NO: 940876 - protein, 103 aa, Homo sapiens
PPPGLLVQVPHGGRPRVGGGAKGSRVGAVPLPKPCTFNQASPVLGSRGLPGNSPRGPLGFEVPALLPSALVPSSLLPGWCEWGGVWAELFFYFANINKGRRFS

SEQ ID NO: 940877 - protein, 154 aa, Homo sapiens
QPPLSLGPAQTHKETIQPLPPKDPGPPPNKFWFWPKRCGIPHSPPWEIRGSPCVFPVFLELGAPPPKTKPPVPPIIGFPLGFGEIFKFWEPPHPQGGFVAGIPLKPFLEFGPNGPPGFWGSHPPMGILGGPFWVPPPIKGPLFFFPKKHKILGG

SEQ ID NO: 940878 - protein, 128 aa, Homo sapiens
GGPLGLGPRGFPHGGGGGGRNTQIGVWRCPYPPGRKITFLWRNESPQCRAPHPNGPGGGQWVLPWGGTTGNIFLVAKRAIIKGAPGARGGPLGVSKGAGGGGKKGALPPPKWFPGGGPTRFPGGGRFY

SEQ ID NO: 940879 - protein, 133 aa, Homo sapiens
IPGPKDRRFAYPPPGFDLLPFGFLGFGFADFVLSPPFSFVPITPIVFQILPLLKWGPPEKPTPGFAPPPNLAPVFYILKAFCPTPPPCSPLGPFPYNLRGGFPLAPRVPNSQGYFPYYCNGKICGLEEKGFSN

SEQ ID NO: 940880 - protein, 164 aa, Homo sapiens
TESWVIAGLSDLGQVGAHEATVNKLNIPPFSFGVVIQQVFANGSIYTPEGLDIQEETLHSRFLEGVRNVASVCLQIGYPTVASVPHFIINGYKRVLALFVETDYPFPLAEKVKAFLGDPSAFVVGPPVGVPPQGAPVVAAAPAKVEPKEKSEESDEEMGFGLFD

SEQ ID NO: 940881 - protein, 136 aa, Homo sapiens
PSLSKKMRTSLADPRRLHVTGQPPEATSQLEPFDLINHLLQVKMRKRYSVGKFSATPGYRSTKRGWTSQSWRGKWENHSSRIKVTLRWEQFSTKHPLPGFGLPPDRDFGGACPPQDPDMQGLAEGISVFLGPVPLS

SEQ ID NO: 940882 - protein, 114 aa, Homo sapiens
GGPLGGGPPFPFFGGPGPPGGQVTPPRVFWGPPPPFPGGGPPFGGWGGALPPGGIGYFLKPVLGGGPPPPPLGGGFLPPGPPGFFFGGNPARGEKKVFFFFFFLGVFFLNPFFF

SEQ ID NO: 940883 - protein, 152 aa, Homo sapiens
MGRGIDTFELLPMFGSPEFFRSKVDEAVAVFPGPHAKKKAAPKGGAVVVVPFFDKGKPVPKPNNPFWDSTQGLKASWVVLWAPPPGVSNCQFYGAFWVQGAILGALGFFHYTDMVFGVWWGPAGGNFFFFGGFGFFPPKLGFFGGPRFLVFP

SEQ ID NO: 940884 - protein, 119 aa, Homo sapiens
GFSPESVPKQGRKGGPFRLPGPLRCGKTGFEKPKVFALGVPPQGLGLPVPKSFPRGGGLGGKGPPPVPGFRLAPPPPLGFGPFFPGGPPPFGGPRVFFSPPPPPPLGFFFGNVGGGWIN

SEQ ID NO: 940885 - protein, 141 aa, Homo sapiens
AKALNVEDFPDPVAPASAMTVWPPIRQRRSARSTTARARATTSSGIYPSDRSTARVSRSIRSARSTRCRLIVPPDEARDPERPPVQRPQRQGPACSLVTALFWQAVPRLRDPDNGFSSPDHCETLAHLELKSWLGEVAGSH

SEQ ID NO: 940886 - protein, 83 aa, Homo sapiens
LMEPNPKRQGSFLWWDKKGFYVPLGYKKPQKQFPPWGLPKGEPPPRGFGGEGGFRAFFGFGNKLGGKKKGGGPPPPPPQAGDF

SEQ ID NO: 940887 - protein, 116 aa, Homo sapiens
DATVVPSVRWVPPSFGGVQASKAPLVRSKRLFYRGPVLVAWKANNPPLGGGGAPPPPPNKGTKGGGAAVFWAWGLGGGGPPKGPGAGFGIKGAPGGRQGPPQKVFGFSPPPPPPGG

SEQ ID NO: 940888 - protein, 103 aa, Homo sapiens
HTEPTGLEHSKIRELLLGAGPQSRSCSLWKSKTMTTSEESLGLLQMTLSVCTKRRHGYTLVEKNRKLSKVALETWDATNGETEVQSVRQAQLRDPWAASTNVS

SEQ ID NO: 940889 - protein, 35 aa, Homo sapiens
MIPPLMPCLPPFQNDGPAVAAPVGRSPTAFNPDVE

SEQ ID NO: 940890 - protein, 52 aa, Homo sapiens
MADLTASKADRVVLGPSLPVLYQALSRAARPLLGSNASVVLSKLDPPTQAEA

SEQ ID NO: 940891 - protein, 86 aa, Homo sapiens
GDPGGPLVCKDVPPGIFSYGTKKGPPPGVYIKVSPFLPWIKRPMKPLYPQAGDYPSFGPAPFWAKGQNPPGGARRGCRPVINGFLG

SEQ ID NO: 940892 - protein, 98 aa, Homo sapiens
LRYDVPDTRQLFLEGGRDADVFYRKCWSHDKVVRSIHGVNCTGSCSWKIYVKEGIITWESQQTDYPSTGPDMPDYEPRGCPRGASFSWYEYSQVVAGA

SEQ ID NO: 940893 - protein, 60 aa, Homo sapiens
MGGALAVTGGNACAERIATYIPTHYNWYDMDVTTQDWHIDPDNHFSNNPDFVDSWPPHGV

SEQ ID NO: 940894 - protein, 37 aa, Homo sapiens
SSSGLLMTSKPASITSTNSSRLSPSQEKPDFSSSSID

SEQ ID NO: 940895 - protein, 59 aa, Homo sapiens
TSVYSLLPSWEEMTKISVSLLCLVKGFFPNDFSVEWENNGQPGNKIKPHAFHGGFRGVL

SEQ ID NO: 940896 - protein, 104 aa, Homo sapiens
MLMLLTILTQRYRCSLFHSKQMTLTEMINNWCILVTLSIYYVDENAPEFSMQGLTAGVIAVIVVVVIADVAGIAVCVISRKKRMAKYEKAEIKEMGEMHRELHA

SEQ ID NO: 940897 - protein, 127 aa, Homo sapiens
GGCLWRVFCSVVVGVFCRGYVLWVFVGDVGARVSRLASWERVKGHEALWGVFMGACRGAGFGLVAGYVVRGGGGGGPPLSCVGFSQGGGRELLWAWGWAVGVPQKVRVAGLGLGGARGKNRGPPGGV

SEQ ID NO: 940898 - protein, 81 aa, Homo sapiens
MAPSQNTGQRLTGPKEGMFLNRLEEILDGFDPSRICEDHGTLFPAVGKCVPATLSVGDRALLLDRDPPGLIRATHEILPFF

SEQ ID NO: 940899 - protein, 74 aa, Homo sapiens
RKGQEESGRAGGPGSTPRGAAHCSWPPTCGRANPLGLSLTWQELHDRNHSNKWQTLRTGHPSPPTPLVVLVMPM

SEQ ID NO: 940900 - protein, 46 aa, Homo sapiens
VVLVVMATATCRGSAGVQQGYVEHMAAAATEQGIEGSQETSSQEAA

SEQ ID NO: 940901 - protein, 71 aa, Homo sapiens
SGVGGDAKTVVLDMNSKFLFKESICQYGQSLPFTFKLNFLVKQPFSITCSTLTHFNHLLHPDSFRFPSPPT

SEQ ID NO: 940902 - protein, 128 aa, Homo sapiens
PPAFDSRGSPVVLVVMTEEKLHQLQDGANRRQLDELMQQLSATMRQFEQPFSEAQSALDQADARSSELHQQLGTEFEQHEQAHKDALAALPGCMRFSPHAKAPLSLAEALESVQEDARRNRAEQGHRI

SEQ ID NO: 940903 - protein, 132 aa, Homo sapiens
MTDQWDAGRLDSDLEGVGFDTLAVRAGQNRTPEGEHSEALFLTSSYVFRTAADAAARFAGETPGNVYSRYTNPSVRAFEERLAAMEGAEQAVGTSTGMAAILAVVMSLCSAGDHVLVSQSVFGSTIKLVREV

SEQ ID NO: 940904 - protein, 80 aa, Homo sapiens
GSSVCQVTAIGVTVIWLYTSRACNNLFISFLRQEESIFYPPTHNTTLSKGVTLTRDSWYPRGIGSRTPENTKIWMLKSLI

SEQ ID NO: 940905 - protein, 117 aa, Homo sapiens
MPQTPAVTQVTDTIDTTTATLTASPSVTEGGVITYTVTLSNPAQTPVTVTLSNGQTITVEAGKTQGSVDFQTPANDVYNNGSTVSVTIETATGGNFEQLTPNPTPAQTTINDSVDTT

SEQ ID NO: 940906 - protein, 83 aa, Homo sapiens
LTERRYSPCDVFDVVYEQKVMDGKVVGTGNILSARFTNRGKTYTAVLYTNKQGNSTYYTADGNSLRKAFIRTPVDFARISSRF

SEQ ID NO: 940907 - protein, 44 aa, Homo sapiens
MNSKACPVGSRRLIGSQRANEEVFNPPFANGLSLSGLLKPQKKR

SEQ ID NO: 940908 - protein, 176 aa, Homo sapiens
SPLTIVGEVTARGLAALLASARSPFPVIGEVAWVGFLGAAALAVSLLVLRHVVSPCDGVAGRMNLCHAYASEPLNDESAQWLCRQLTNGTKLRHAHSTERPPPRSAFRQWHQSARSPLPRVALESADRPSGSVAHPAPRLPPRYRSVTICAESRKSKSRLIAYSGIREWSTEPCEG

SEQ ID NO: 940909 - protein, 34 aa, Homo sapiens
LVRPSSGRARGPDSNVLLLRLPEKVPSAPPQEVT

SEQ ID NO: 940910 - protein, 40 aa, Homo sapiens
HRPRHRFAGFGIRQGKYPAAELAVLKCLAVALFQLAANLR

SEQ ID NO: 940911 - protein, 147 aa, Homo sapiens
FRRGPGRVWNSESILAHCANEHEFGGRSLPICSNNRRGFGHKRRVHSLISPIFGVPPRPNLRQNPFHFYIYGGKFNFFPPTFFGPIRNAPRLLGIPRGKPPMKHPFIGGVILFFNSGKIKNFHDLKSLCFEGKSLNSKRTPHKTGGG

SEQ ID NO: 940912 - protein, 169 aa, Homo sapiens
QLIDHLRVAAFRVGVLHRPTLQGYHVQTRVSQLLGHDRAGPAEADDHGIHFVQHSRHASSPLAGNRYSRKRVRLVALDPVHEVGAGAGETDLGPADHAFVATMDRVAEEPFTGVLHQQAEEHLGRNGIEHQLACLDLAENTVSGSAILRSKRLPAVGFAPAVHGSDAQA

SEQ ID NO: 940913 - protein, 94 aa, Homo sapiens
MKLALVVGRVAQQVGNTEVHAAAPSEHLLANRTAMAVGIIRCMLFGKVDADLIGPPVCTGFSPPNKFLPNGTRAMTSSYSSLNCFSLRTACKRC

SEQ ID NO: 940914 - protein, 52 aa, Homo sapiens
PNFTPSLRAASSVVPGMIELGAIKSPSSASGALVTLLNAAWNAALRLAYQPA

SEQ ID NO: 940915 - protein, 35 aa, Homo sapiens
SSTQGNGENSTEAKAVDSNNQSKSPLEKFMVKLCT

SEQ ID NO: 940916 - protein, 104 aa, Homo sapiens
PQRLRKRVGYPGGLVSFIGTPPRKKGGQGQLLDSWKLWAHKDQEIQTLKSQIGGPPKALEVSKGEEIQQKVQDLETRNSELEHQLRAMEPSLEKARAKRERGRV

SEQ ID NO: 940917 - protein, 209 aa, Homo sapiens
MDGAPKRLHTEVLWNQWCGADEMIAFIGVPQAKGYKGVTSGWHHRELPRQPPPGRRKGGLEWGTAFRLGALFVHAGGQEGSPRLEINKKIYKIGPGSLIKGGEVVKNKASPGYGLFDKGINPLGGFVPYGEGTKDFVMVKGWGGGTKKGGVPPRKSLLGQKKGGGLEKIALKVIDPPPKVGHGRFQTMEEKKAFLGPLKKGRIAKGEGG

SEQ ID NO: 940918 - protein, 69 aa, Homo sapiens
YRRHADEFTPTMTALVKMKTRGGEQEVRVFSLRGAICFGMFARTERAKAFRRKVLDVLDEQARQGQSLG

SEQ ID NO: 940919 - protein, 113 aa, Homo sapiens
IRLLIVVIPPLFPRVCGTSRGVFGHTWGPRVLCPGFHVIWLSGSFPGNALLGVLGVWVEEGPSALMYPLFFPKAPRAWFVEGFDQWGPPWPCLCCQNVPGGWGGVSPGPPPFF

SEQ ID NO: 940920 - protein, 59 aa, Homo sapiens
MAGLMDSVNQRTQLVGQNRLELLLFRLEGPQLYGINVFKVEEKVLQCPNLTIMPKSSQV

SEQ ID NO: 940921 - protein, 41 aa, Homo sapiens
MRIASAICDRHELPVQSTKTRFMRCIEPLSWVPGAIVLKTV

SEQ ID NO: 940922 - protein, 54 aa, Homo sapiens
PAVSLTSSPPSRPHFFGVNGIGLKVVANAGAGFSWRDPDPGGLNSQTWWDLAVH

SEQ ID NO: 940923 - protein, 118 aa, Homo sapiens
RPPVFFIRGPPGWDCGFCPTKRALPGGVPVGGPQRESILCPKASPLMGAAPAWVFGVEGKKGPLPLFSNKGSWAQREKGGGALDVFPAFLKELVPFPFFFFRDPGRGPSPLAQTWGAL

SEQ ID NO: 940924 - protein, 75 aa, Homo sapiens
VPLYETCGKKYVSPTLAELANAITDSERPPHEKLSDREYQTLVMIASGKTLTQIGEELNLSVKTVSVYRARLLEK

SEQ ID NO: 940925 - protein, 38 aa, Homo sapiens
GNQVVSVSAQGGLTVTDRVEQETKVGTSDLTVACGCAV

SEQ ID NO: 940926 - protein, 118 aa, Homo sapiens
KGGGGGGGPPVAPQGPGGERKFSPKPPPPPFKKGGGGGSQPGGFHGPLRFGGKKGGKKTPGGVPPPRGGGRFGGPPGVFFWGGGGLGNGVLKPGLFRGAPRPQNWARDLGPPQKGERG

SEQ ID NO: 940927 - protein, 146 aa, Homo sapiens
MVQALLVHPVGDAVLLVLQATLTIAETKAVSGTLPLQPERQDLLVEGIGVGLHGPGLFGQPALLIGRQHRELGISVLLRLDHGSAGIRDFLVKLDALLGAGTAAPLGLLQCRDLGLVAFVTSAFCCSMIAARWAAYDSCEIKPAFC

SEQ ID NO: 940928 - protein, 68 aa, Homo sapiens
LSRAFLNVLDNAAKWSPENGTVTMTMQQIDDDRVEITVDDEGPGIPADERELVFERFCRSVESRAMPG

SEQ ID NO: 940929 - protein, 112 aa, Homo sapiens
MKAASGGFQGTGGANHFWPCCGGVTEAVPATKDMLLRVLGKQKAGDVNPVSVGFGWGGAGGHGGARGRGWPEGRGSTRSGSGRGSHVMKSRHPPPCRWESQGICHMQSKSGR

SEQ ID NO: 940930 - protein, 82 aa, Homo sapiens
MNKSDQSYTVTPDTAATLRVDLTDAAAARGDVACASHIGLRHETNQDAALGIDGSGHHVVLVVADGVSTEGAEECARVASHT

SEQ ID NO: 940931 - protein, 89 aa, Homo sapiens
VLFTLPSRYSSTIGHQGVFRLDGWSRQIHAKFHESHATRGNPTPVPRLQLQDSHPLRYAFPDASPSRNISHWPILRQQNHKAPTTPHMQ

SEQ ID NO: 940932 - protein, 75 aa, Homo sapiens
MTAPAIRIEHLVKTYPAGSGQTKRANDATFDIPAGQIVSFLGPNGAGKTTTLRMILGLARPTCGSQNLGHDRLEH

SEQ ID NO: 940933 - protein, 33 aa, Homo sapiens
SSPDLSLDENDGMSSHSCSASPRNVFMGDSSSI

SEQ ID NO: 940934 - protein, 69 aa, Homo sapiens
RITKRIISDQVLAIYLSLCILAEFPTRELGQQRYSKAQKPLSMKDQRYLQDAEVPSPELKSQQLTLDKS

SEQ ID NO: 940935 - protein, 42 aa, Homo sapiens
PGQVLAKFDVETRQVVVLFECVRRIISLYGNAQFAPVGDFVD

SEQ ID NO: 940936 - protein, 38 aa, Homo sapiens
DGQPSEFGYVIVWFVRTFGSYHLHHRNLADAQIAWVLY

SEQ ID NO: 940937 - protein, 90 aa, Homo sapiens
FSTLRLTDGWKRSPPLYGPMALLIWMRYTAIDLHLALVIDPGHAEQYSALGLDHALEDAGLQVVRVGFKEWPQGAQHLFHRLVEFRLARV

SEQ ID NO: 940938 - protein, 46 aa, Homo sapiens
GVKDLPAPATEIEAAFEQFWKLYPKKKSRKDAQKAWVKLSPDADLQ

SEQ ID NO: 940939 - protein, 41 aa, Homo sapiens
CKEIVDRFDHGRHLTEEFGLIGFSRMFKEPIAPNEGEMSFF

SEQ ID NO: 940940 - protein, 30 aa, Homo sapiens
GHYRFSEEELMARQWPCTLKKFLTSPTISG

SEQ ID NO: 940941 - protein, 132 aa, Homo sapiens
AFAEHELASSIVASRVSGAYLLGKVVIRIFDLLSKQALGVVQGVGDQGALGSLEQRGIQLNNADQGGEAQLTGLEDDVPGVHPLEVVDLLLRHPEADLLALLVRDEVQVVQSPEPVPGAVHVLGLHGQASFR

SEQ ID NO: 940942 - protein, 31 aa, Homo sapiens
GRFGKQDFIYMAVSDEFDAPGQMLTRCVPQW

SEQ ID NO: 940943 - protein, 151 aa, Homo sapiens
LLTSFVLWYIPCRYIALYQEFPLFSTNNLELGNRELSKVMRCFCRLAVAHRYTKGMPQMSQEIERYLQAGTRANTRRSYQQALEHFEVTWGGFLPATSDTVVRYLVDHAATLSSNTFEDAPRGGGAVALQAKAFPIRTKIRLSPDSQGHSY

SEQ ID NO: 940944 - protein, 103 aa, Homo sapiens
LTVVADRGYYKGPFDGHKRPGSGTVGYNVQTAVDDKRHLIIAHEVTNVRNDRGQLSNMANQAREEIGAEALTVVADRGYYKGPEILACEQAGITTFVPKPLTS

SEQ ID NO: 940945 - protein, 115 aa, Homo sapiens
GLGVGANTRPLAHSRTVGVAWEEAAVVRVLATATVQVDTPQGLGIDTKTNGAFGEAGDVVELEALTRFAVVCTAVTVVVVEVHGARAERQFAVFNETGSACLLRENPQCHGQSQG

SEQ ID NO: 940946 - protein, 39 aa, Homo sapiens
AQDQVVVDGFFLTPALLKTELDTDENSMVTAEIPGGRLA

SEQ ID NO: 940947 - protein, 124 aa, Homo sapiens
MQLSRLSRNASSVRMRALRSSRQAVVISPHCAAVSLLLGAERLNACLMFSSGIPVRCATLIIASVRSTSEEVAALVARRTDAGDQPLGFVEMQRRHRHATAFAHSATGSFLRVVNAMRVDLMSS

SEQ ID NO: 940948 - protein, 136 aa, Homo sapiens
STQVTDEPGTPGNEGDIVKVTITADQVSVAENVKPTFTVHVNQPLDHDLVVTLSNNATVTIKAGETSAPYEHAAQGDDVYQDAGEISLGIKSAVDATGATFENLQLGGDASVKVTDTIDEVVAKLTATPSVTRGGE

SEQ ID NO: 940949 - protein, 42 aa, Homo sapiens
RKLRLNNRLRGLIDNALASHQLLSDNSDTHLNTTQQALEIQA

SEQ ID NO: 940950 - protein, 112 aa, Homo sapiens
ADAILTQAANLAWATCGIELTPMNSPSFPKHVEGLLLAVVSHSPPGQDQPSESNFRPSGRNSPFGETCRYNVCRVTPNSSHRSPTTGSGCPIAAMAIAVSLRHLERPPAVSA

SEQ ID NO: 940951 - protein, 32 aa, Homo sapiens
MGGHKRCQLCCTLAPITATSTVGSAQKRSQCH

SEQ ID NO: 940952 - protein, 59 aa, Homo sapiens
MIELYWFIRPMYWTPASDSACPFLSCGATERRAEFCVYIPGCVRLRLSKGEVLVLAILA

SEQ ID NO: 940953 - protein, 145 aa, Homo sapiens
GSPLTTPIFRLYWVFTSNGECNYPDHYSSTDWSELATRFPKGWRDHDYYQWLHRSHISKVFEPDDPYSDYVEYEDEEAGCLEQRLSGLLARLQTKSGQTVEEFRHWMFSAVWVDVPALRIVESCWRVLMIIMKKGAMGALIHYAL

SEQ ID NO: 940954 - protein, 64 aa, Homo sapiens
NVGDNEEISGETPIQIMYELHEQDAQVYENIFKAIPEGLHLYGRELPHRCATLQLFRLTFRLSD

SEQ ID NO: 940955 - protein, 130 aa, Homo sapiens
RSTLVGDGAERTVTSRIRGLRHADLALSRARAVVLNGVEVHVDEGDAGEHHDHDGDEHPVLNACGREHALIAFVCTLPTGLEPFLRDDRHEGQCEYPAGYQYRPDAVVDDPGNQGQVVLQVVGREKRHGS

SEQ ID NO: 940956 - protein, 33 aa, Homo sapiens
RPRRLGGRKDKEDSSDELEEGRRGVSEGEPDPA

SEQ ID NO: 940957 - protein, 30 aa, Homo sapiens
NKKRPGRRISLLWNVLRRARKHNKLRFLFA

SEQ ID NO: 940958 - protein, 90 aa, Homo sapiens
TRSSIKHLYGNLQNLLDCKDIGEPGIIRVNRDLKRYAAVLGDLGINVETNLDKPRKPHQDREKEILLAAAAIEKGRSKIGETKVSISAVA

SEQ ID NO: 940959 - protein, 37 aa, Homo sapiens
RKLKIRNGFEHLLGMQRYNGSFGLWSSDSEEEYWLTA

SEQ ID NO: 940960 - protein, 53 aa, Homo sapiens
MLAVGHCVTYSSVLVHVFQHVAANESQPQRRSALVGEQVQPHSQTNGAQACHI

SEQ ID NO: 940961 - protein, 47 aa, Homo sapiens
PKPPPPPMLKKPPPPLLEPEEPGDDDNITRGAVMKCVLSHTDSPSLY

SEQ ID NO: 940962 - protein, 109 aa, Homo sapiens
GNAQESAARQDVDLIKRELEAAIASDVEMASGAYENFRIATEGAEAMAQNEAQMQRAYELGEADLQSLLLSRRQAVTSASNALQAHVDTLRTHLSLLIDAHWIWGLDES

SEQ ID NO: 940963 - protein, 32 aa, Homo sapiens
QAKSLPVWMLDPVGSCFKGFHCKTLKIQEGLH

SEQ ID NO: 940964 - protein, 39 aa, Homo sapiens
DPAQANTLLIISVVIGAPFFVFFGWLSDRIGRKPILMLG

SEQ ID NO: 940965 - protein, 98 aa, Homo sapiens
ARDQLSDWIDRNFGSCLFCVFGGVCLICGYRVAGLLMDSGELSITGDESLFFGHGQGRQQQGRQDEDAGNTHTVGHLKLPSCGASANEDGGKSPFNAT

SEQ ID NO: 940966 - protein, 69 aa, Homo sapiens
PVRRSGLSDGGEESALSLLCFGSVGGTCSLAGRIFKACANQRVEVLERLGADQQRKLEGASGGEVPFDG

SEQ ID NO: 940967 - protein, 64 aa, Homo sapiens
LLMEMKLSFRRDELRFSGGTHICTLTGYLVLCHELDLGVDVPQVGDFILGHREADEEDLISRDR

SEQ ID NO: 940968 - protein, 60 aa, Homo sapiens
DQRYTEHAGHHHCRRPLAQEQRHDPDHQGHCDHQGQFHFVQRGADGLGAVLQHRHLDRGR

SEQ ID NO: 940969 - protein, 110 aa, Homo sapiens
MALTIPPPTEWSKPNGEPMASTHSPTLSFSHITQLHDRQVLALDLQQGHVGTRVGADQFGLQLAADRQADDDLVGVRDHRVVGQHVAFLANDKPEPRDCASRWTTPCGEL

SEQ ID NO: 940970 - protein, 40 aa, Homo sapiens
EEPMDVLHHHDGIIHHEAHRDDDGHQGEVVQAETQYVHQR

SEQ ID NO: 940971 - protein, 100 aa, Homo sapiens
EERQLAADRGKNRPLIKHGQHDDRPAPVTQEAVDMLQQPEDRLGDEPQEAVVDGQFQAWGQLFQLGLNLRAGVQHGAGFDLAASRHADYGAGVANDVVTL

SEQ ID NO: 940972 - protein, 137 aa, Homo sapiens
GLEGLAFELLGNEGPVDQVPERLDVLRTQVAVVDVVGVFPDVAGQQRGIAAGQRAAGADGAGQGQGTVSFLDQPAPAGTEVANRSLGEFFLELVEGTESGVDGVCQGTGRLDTGVRGQAVPVEGVVPDLSGVVEDAA

SEQ ID NO: 940973 - protein, 92 aa, Homo sapiens
MPMRGRQKIAIVGAGLGGAAAATLLQQAGFDVEVFEQAPEFTRLGAGIHIGPNVMKIFRRMPEQKLELMGSHPDFLVSRDGHSGDYLSRIPL

SEQ ID NO: 940974 - protein, 103 aa, Homo sapiens
MVLFRGNIPPMNYSVAGDVRNIRRRSQLGIGGLFMLAQLPPALQSLHLPLRLKLWDGNQFDLGPSPQVTILVKEPQLISQLTHPSMDQLGTAFVEGKLELEGD

SEQ ID NO: 940975 - protein, 77 aa, Homo sapiens
VTGLVMVGMAERYRIGSRRFMFGEAMSILARSTRSPSLNSPAFMRANRSRFSSTLRSRNGLFLPGSLRVPRYSLSYS

SEQ ID NO: 940976 - protein, 37 aa, Homo sapiens
LLRARDQGYGVPAEALKKASERLLRYLQERNLIEVDY

SEQ ID NO: 940977 - protein, 78 aa, Homo sapiens
WYQPLRRLKATRHQLSALESRICLRFQPTTLNLDNQRQAWLTFSVPPSNNWEYRNIKPVSIDYAFQPRLRDRLTLRRI

SEQ ID NO: 940978 - protein, 57 aa, Homo sapiens
GAGEADEGTGDDKHRDVQTKSGEGSCPTGVAVQHRNDDWHIRATDSGDEVEAEEQRG

SEQ ID NO: 940979 - protein, 80 aa, Homo sapiens
VAGLAAQNSPEVPDTKHPTCPLHRLPLNPGPSPLTFPPRTLRALVLHLSPWLHSPVRNTRLAPAQPSFSTASSGVSPEDA

SEQ ID NO: 940980 - protein, 87 aa, Homo sapiens
FVWHEDGTSRAHVLKREYTPRYYDMMKALEDLTGNGVSLNTSLNRRGEPMICSPTDALNMFFGSDLQYLIMEDILVVKDGAAAYDQP

SEQ ID NO: 940981 - protein, 57 aa, Homo sapiens
DDFERILQEPHASLTEQYQPPLKTEGLNIAFQADGIKRLAEIAYQVNEKTENIGGAI

SEQ ID NO: 940982 - protein, 37 aa, Homo sapiens
TSTCLACPFSVKVTRGRVKESITRRRRAPLVGNVGSH

SEQ ID NO: 940983 - protein, 74 aa, Homo sapiens
MFVASADDKGFDLKLSSEVQDITRNKDGFWHVEYKNLKDGTESATDAKFLFIGAGGGALKLLQKSAIPEAKEYA

SEQ ID NO: 940984 - protein, 76 aa, Homo sapiens
FRKAAAIAEQYQAVIANWIARQGSTQAKAGFEASISIKALHEACALPSRSQGELLPSTAGRLSIARRRPLGVIGVI

SEQ ID NO: 940985 - protein, 79 aa, Homo sapiens
KIDTPPIRGLPDDPHDAAIARAIIALGRSMQLTIIAEGVENQAQQRFLAAEGCEQIQGYIVSLPLPPDEFAAAVLRIAL

SEQ ID NO: 940986 - protein, 53 aa, Homo sapiens
MSTTPATPKVGFVSLARPKALVDSERILTQLRMEGYEVVPTYEDADVVVVNTR

SEQ ID NO: 940987 - protein, 34 aa, Homo sapiens
KADGYIDDLLAEISKCVKKKNRVLVTTLTKVSAE

SEQ ID NO: 940988 - protein, 112 aa, Homo sapiens
SADHHFDDVGLLVDHRAPGPSHHHQAVAEQEGNDAGHHRHPPLRDNRVQLVAWVAPLAKVPKTMVTAAEKVMVSCGTTAARPAKPPASRVSVPLMFALLGGGDGHRHPRCGY

SEQ ID NO: 940989 - protein, 115 aa, Homo sapiens
RARGAFMNNRTLFGLSLLTLSVSTGQAAMAAGEKGYGFIEGSSLTILNRNLYFNRDFRKRQSSSSRRGYSEERAHGAIGRFESGFTEGTIGFGADAFAMLGLKLDTGDGRTAAGG

SEQ ID NO: 940990 - protein, 93 aa, Homo sapiens
PLHPGKCDLLVSPCRRPSDGRDPAKDALAYIPDTVWRNRVEFPRGRAEVQAVLTRKWNHELEYRLIKELWAFTGNRIAVRYAYEYHDDSGQWF

SEQ ID NO: 940991 - protein, 74 aa, Homo sapiens
DGAVTSRFSDYQGELLDAAAEACKGRRARSHIVSYAEDGALLTELFTRGGGGTLVSQEQFEVVREASIEDVGGL

SEQ ID NO: 940992 - protein, 105 aa, Homo sapiens
GLDDRYRGVRGQREVLFANEADIIRLGFQPGQKVDIVSLWGDEHVRRVQGFTLLPFDIPAGQAAAYYPEVNPLVPLESIGDGSHTPTSKFIAIKLERARDDGRIL

SEQ ID NO: 940993 - protein, 86 aa, Homo sapiens
NFFRHLLKKQQVFFAILAPHAYLQVKGLSLRQGTIVDATIIHAPSLTKNEEGKRDPEMHQTKKGNQYYFGMKAHICADAESVLGHY

SEQ ID NO: 940994 - protein, 48 aa, Homo sapiens
SLGDTLFEHKLWNESLIAQVRSGELEPHYYWQLEQQLLVTGAEKVIFG

SEQ ID NO: 940995 - protein, 92 aa, Homo sapiens
NVAQGSAEWHALRAKYFTASEAPAMMGVSKYQTRTELLHQKKTGIAQEVTAAQQATFDRGHATEELARPIVERMIGGDLFPVVGTEDNLLAS

SEQ ID NO: 940996 - protein, 103 aa, Homo sapiens
MDLDGHADRGSAFEFSFTPGAMGAIVGERFVRAANYALEHRCPMVCFSASGGARMQEALISLMQMAKTSAVLARLREEGIPYISGLTDPVFGGVSASLAMLGD

SEQ ID NO: 940997 - protein, 44 aa, Homo sapiens
VLAAWVFAHWGWVAVCGLGMAISAVALGYWLWLQRARAAEAALP

SEQ ID NO: 940998 - protein, 70 aa, Homo sapiens
VAKGLRNPAGPGSGTTGSFPGQAAHPSMRRLPTAGTQHANGGCAAVGSRRVELVEDHVHARQQRVVAQPH

SEQ ID NO: 940999 - protein, 78 aa, Homo sapiens
RPRFYEPDVHTMAAPLQALFDAVNVRFVQGTACHIDEGARRVSYRTPSGTLCALPYDRLIMACGSELNRPDRVGIEHA

SEQ ID NO: 941000 - protein, 117 aa, Homo sapiens
IRSQGVRDAAIIALLYGTGMRPPESDIDLDQVDFQARSLQVVGKDNHQLVKYAPPWAFEKMQACLDLRRQDLSAGAEDDPFLFNSIRRGRHITRARITKRAIYYIFPQRCALVGVYI

SEQ ID NO: 941001 - protein, 41 aa, Homo sapiens
MKQILIIGAGFAGLWSALSAIRQLDLNGSKDVEVTLLAPQA

SEQ ID NO: 941002 - protein, 86 aa, Homo sapiens
PRPPCNCMIDLRIASPKLVPPSNRERPAPTRENRSNKRDWCSAAIPGPRFSTASRTSLPARSIRRSTGSPSGLCRMALLNRFDSAR

SEQ ID NO: 941003 - protein, 123 aa, Homo sapiens
MTPYIEGGDVVEPLGERVLGRVIARDVFKPGTEDVIVPAGTLVDEQWVEFIELNSIDEVIVRSPINCETRYGICAKCYGRDLARGHHVNIGELSAVSLRSDLVSRYPAAMLRSNRWVAADLEG

SEQ ID NO: 941004 - protein, 166 aa, Homo sapiens
MQPEMPKPRISLRTYCHPCRNVWLDAITSGLRGPTGLQFDKATFGPGLNALFLLLLIPPLTELVVQGKDSGVKLFAAYHRWERSRYSVIADGAIGAGAPIMPTYCRDLTDMPVGLQDLRDHIVDLRRILGTQPEALMLSSAFSRSLARPNPYPSDMPLLLFRGGLG

SEQ ID NO: 941005 - protein, 107 aa, Homo sapiens
LMNSLLPKAVRRALTDVQERQRRRRAEEALADVEARAWIAIDAAGMGTWYLRPQEGLLCWDDRCKTLFGLPTSTEMSLEVSSVVYPDDLAMVRDAVEYAMRPESEGQ

SEQ ID NO: 941006 - protein, 169 aa, Homo sapiens
VIVLIWVLGKVVTAEPKAASWQAVKQFTRSRPSWSSAYIFPSMMLLASVFTPTVLPSGSTGSMLLPFTGTQPAASGFTFFFCRVRLPKRSFLPFVSSITADPLPAEISVSLKNGSSTSSGPSGVWSSQTSIGSSTTSADLDRWGVGESGKSFISLGLTSVGSKERTDAN

SEQ ID NO: 941007 - protein, 84 aa, Homo sapiens
MALTPFRRSSLSEAYINPHSTSSSSSPLRWAVGRPILWQMLRALSQDSPSRLCPVASRQTTSLPNTPPKPLQGTSNEAPCPFRL

SEQ ID NO: 941008 - protein, 77 aa, Homo sapiens
LVAKADHVHPRVDIDVDLGLAVAQSGRAVDAGLGVDVDVPDRGVDQQVVGDHVVHAQLAGDPDRVLQFQVAEALLLA

SEQ ID NO: 941009 - protein, 120 aa, Homo sapiens
PDEVSDQRRLAAEQACEKGAAHFLQAMQRSAQPVAAVIGMLHISAYLREPGWLVELFAGQVARYRPSAHADVEVQEAAAPLLVKYGLTPLLELPQSLPAGLGARLHEQGESARDYWLRHA

SEQ ID NO: 941010 - protein, 92 aa, Homo sapiens
DPSVGQAAAWLIVTYSRTLKAPPYRVGDNEGTVTEVGMFNTTIRTGLGEVLTLSNLMITGSVTRNYSRVVQGQGYICDTVGTIGFDTPLRQG

SEQ ID NO: 941011 - protein, 69 aa, Homo sapiens
PGLFFTENVTETAQLSHCLQDEGCGDVQEAAWGTVAGSRRVGWTQCQGQDAPSLPCSTCSEPLLFPLSE

SEQ ID NO: 941012 - protein, 101 aa, Homo sapiens
MTPCAFDFSTISRNGVMYLDWERPPFWLWLKRLESERFKTSPDATDEAIVLTVQELNWLLDWFDLWRNSPASGFDAAIRRLIRIIRGMISMPEDLADDPVE

SEQ ID NO: 941013 - protein, 73 aa, Homo sapiens
MTSTQAAAERHHPGHYCAPTELPAPAGNSRERNENSVPTAVLTIMPKMIRHITSPSSGDTSLAIDSIGMGRSA

SEQ ID NO: 941014 - protein, 34 aa, Homo sapiens
MGWIYVVVAVASGAVFIGEAAQLLRRANSGLRDA

SEQ ID NO: 941015 - protein, 49 aa, Homo sapiens
MELLTLTFGDGALTRMMTIFTKAALTFAGHTAVLPYYQAVGHYGWLTPT

SEQ ID NO: 941016 - protein, 38 aa, Homo sapiens
NRRRDSFGLGPHCGENENNGGPQKPSTPRNLTTYNGTT

SEQ ID NO: 941017 - protein, 79 aa, Homo sapiens
QACACQPHTAHSTLLAMKQQNPIFLLPGRREPMHQAASTITMAGHSSNPIQYSMKTFQLIMGYLKLITCQRPERWQVIA

SEQ ID NO: 941018 - protein, 53 aa, Homo sapiens
IEHLVSQERGVVFFQNSHIPPVHELKRDSDTWENRTVKATPAIQRDRRLQLIV

SEQ ID NO: 941019 - protein, 49 aa, Homo sapiens
TNCRRHTDHQCGNYSTGQGVTDRCRRTARLNLRHGFSAMDRPGQHYRAD

SEQ ID NO: 941020 - protein, 33 aa, Homo sapiens
YGDNILAIMAKRQKKTIMEQVMPSLAITMPRLL

SEQ ID NO: 941021 - protein, 118 aa, Homo sapiens
SYGDLRDELGRWNLFFLVLMVRSTKSQFQIGIDGDGKVDGFVKMVREEFFSVRNASLFKTVTGKFVVNGTIAVEECIRTGVVLDNHAQIRRNLRKDVGPASLKALESISALKGPSSDF

SEQ ID NO: 941022 - protein, 83 aa, Homo sapiens
VLAELPKDYRVTVDHHGLAFLYQAALFEVLEDAADHFPRATDDTDLRVILICMPSGMVMGSGCLPVSSRQVLERHKNASCPTF

SEQ ID NO: 941023 - protein, 90 aa, Homo sapiens
DLQLPVRDQTLFQRADNIENGWRAAQPFIDAWAQGGDVHGYPAGEDGPEAGNELLARDKREWHRLGKDFCKFCAGPFAAKAAPTGIPLPL

SEQ ID NO: 941024 - protein, 158 aa, Homo sapiens
CSGTDKNIIAGGTGTMNALNYEVLRNTEKLYYKDQYQAGANTQVTRVHSDGIELQSTVAYPEGGGQEADMGTIELPIGTVRFIWVKKLYGSPIRLEGFKGGKLGGIIIHSLHPDLHLLDVTAGMPGPVTIDIERCERLTLSHSAHFLAAGIGLARRVE

SEQ ID NO: 941025 - protein, 94 aa, Homo sapiens
HRAMFHSDNAYYLVDATVHAHRCKTNTASNTAYRGFGGPQGMVAIEQVMDHIARHLGRDPLAVRKANYYGKTERNVTHCYQTVEHNMLDEMTAE

SEQ ID NO: 941026 - protein, 136 aa, Homo sapiens
QAAAPLGQYLLAQAGDIPALLCFIDKCLQQRLMLRAAGEVLPLVRVAAQVIELAGVILAVHELVRAADHHQRADGAFGHVFADHFIVTALPLQMADKRAAVQVQAFIQQTRRQFDQGCSRSQVDTEELTRPAAKRL

SEQ ID NO: 941027 - protein, 68 aa, Homo sapiens
QGLEWLGGIIPMFGPANYAQTLQDRLTITADESTKTVYMELSSLRPGDTRFFCAKHDYYDTSGEFPLD

SEQ ID NO: 941028 - protein, 46 aa, Homo sapiens
LGLLHQESWALLPRTLIDGPGFSSPGFSSPGFSGLGPLGLWLHPGL

SEQ ID NO: 941029 - protein, 53 aa, Homo sapiens
WADELKDMIRHSEDFRPWSLYYMPPETMSWKPVAGLTLAGDAAHVATPNGEGV

SEQ ID NO: 941030 - protein, 128 aa, Homo sapiens
VCCPQQRFCKAEGGFGPGALEEDFWERGWRNGHLGAVGRGLDQRQAAEPEAWEVGLRALCPHTLRASEWELAAVSLLIAASRFVLTGQNLKEKVPGPKGWALACLGPRTLWGILKSDLKHQLGLAAFT

SEQ ID NO: 941031 - protein, 80 aa, Homo sapiens
VWPVALSGRLPVVALVSHYLTNKLIGRGLILHRRSFPTSKMPWRLVSGIRPRFQGLSQSEGQIAHVLLTRSPLIPSRRRF

SEQ ID NO: 941032 - protein, 49 aa, Homo sapiens
MEGLVLKGQALPLTLVHPWLPKKNGRSINLRGALTLDGHLRPHGDAWEG

SEQ ID NO: 941033 - protein, 95 aa, Homo sapiens
CACQSEPGVVVYACQSEPGVVVYACQSEPGVVVYACQSEPGVVVCACQSEPGVVVYACQSEPGVVVCACQSEPGVVVCICQSEPGVVVCAWIPGY

SEQ ID NO: 941034 - protein, 68 aa, Homo sapiens
QTTHQALSLNRITVHSEMNQNNQSGISPTTPPPLAWPHQRLPPILHKPSQSPIPNYSKGPGVFPSCCA

SEQ ID NO: 941035 - protein, 77 aa, Homo sapiens
DQGTLVVTRVSWPQQILATMGELKLFGMKAANDEIIKVAVKRTHEPQQIVGDLLQAEISEKQARSIRYQMTIAKLPW

SEQ ID NO: 941036 - protein, 132 aa, Homo sapiens
PKTVTLDVQNMTCGLCPITVKKSLEKVSGVSDVQVNFDQKTATVTYDPDKAQPEALTEARAKARVDQWIEWIHEPHLLKDRAAYRGISGEQFHGSKASKSETDERIRQALKYVAQPRIGLLAVDLGSTKLDI

SEQ ID NO: 941037 - protein, 152 aa, Homo sapiens
HTVLVGLQRNNGDDDFDYLRQDSIYLDNIQYSDFNSPKEKSWQVRYDLDMESFGVPGLSMTRYAQGWDADYSKANEVYMRRDDNGDPLTNQKRWERDIEAKYVCALDALKDMSFRGRQMTTSRERLRSRIWMKSADEVPPGKSLTLGKPGRE

SEQ ID NO: 941038 - protein, 98 aa, Homo sapiens
IGGKNIGETVEGLARYPINVRYPREIRDSLEALRNLPVVTESGQQIILSSVANIQITDGPPMLKRKIPALVGSILMKDRDLAVVQDLKHTIDSQVKLS

SEQ ID NO: 941039 - protein, 96 aa, Homo sapiens
MTLVLAAVDWLRPGIALACCTAPDSAQHRRVRKIDAKAFCLYRHAGQIGKLRKPAVKQRIDHEAFVGVAGTDGIEAQPSALVILHEAGTATLVDCV

SEQ ID NO: 941040 - protein, 120 aa, Homo sapiens
PLSGPPRKPTGVRYTQNDIDTWANVVARSIRAGGGRKGDKVHVSYGYGLFTGGLGAHYGAERLGCTVIPMSGGQTEKQVQLIRDFQRDIIMVTPSYMLNLANEIKRQCTDPHELSCAWHF

SEQ ID NO: 941041 - protein, 124 aa, Homo sapiens
QRHWPQFCRGGWILMNRTGRALTLCCLLLLQPLLGLAEGGNSVLIPATCRCTLNVQPEDLANALKACEQTATAGDAQAQFELCEYHYTQTPKKLDIALDWIQMASLQGQADAQYRLSAMFFHGE

SEQ ID NO: 941042 - protein, 34 aa, Homo sapiens
LVAGCRTGGAMIDVDALVSRGIDGLEPNGHANHP

SEQ ID NO: 941043 - protein, 34 aa, Homo sapiens
MIGADRRGTKGIGEVRGCQGQAVTEMMLATGVVA

SEQ ID NO: 941044 - protein, 30 aa, Homo sapiens
NADFAAPVCVLLNVLDFRNTPKRRHRGRNF

SEQ ID NO: 941045 - protein, 54 aa, Homo sapiens
MLVAPRDVKIHRSYYPVGTCCRYPLGVGYSASIDRCVHRPHQGQYSVSVGFRDL

SEQ ID NO: 941046 - protein, 50 aa, Homo sapiens
ALRAFHHHEIHLGPNGWIIAIHPQHPHHGTDHEKEAVPRIGAVTGTEHVD

SEQ ID NO: 941047 - protein, 69 aa, Homo sapiens
MPGQAGYRDNSAGYNYDPEAAKKGLDEAGWKKQGGHRVKDGKTLTINYAKLTGVPTSENEGALFKQDMS

SEQ ID NO: 941048 - protein, 91 aa, Homo sapiens
KSFMQVEAQRLRVLFDDVQVLGIQFVDGIAQQALANTLATAGRCDEQHVHPPVGDPGETADPLAVLAANQHHCVEVAAQHVFAQQQDVALW

SEQ ID NO: 941049 - protein, 45 aa, Homo sapiens
NNLNWIIRVVFSSGVLPVMIPLGVIGSKKNSLAVLIINDASLNVV

SEQ ID NO: 941050 - protein, 130 aa, Homo sapiens
RKGCRVEVPTGTNILELAHDHHIEMESACGGVKACTTCHCIVRKGFDSLEEADELEEDMLDKAWGLEAQSRLGCQVVVADEDLTIEIPKYSLTTLPKHGTEDLYMSLKWVDVLEIAIQLAESKPVVDPES

SEQ ID NO: 941051 - protein, 142 aa, Homo sapiens
AEERSIIQIGHAQGFSLRGIACLINRSPSTISRELRRNRDACGGYSARVAQQQMQARRQVCRPKQKLLPGSERFELVAHMLRERLSPEQIAGKLRSMNIPSLRDAYVCRETIYNAIYALPVGELRKELIICLRQSKTMRRPG

SEQ ID NO: 941052 - protein, 54 aa, Homo sapiens
IASTPCLLYPRLPAYALLASFLRKRYVNSLLSYSNKDEQSQQRYARMTPFGPQY

SEQ ID NO: 941053 - protein, 104 aa, Homo sapiens
YLDAHGGLARRHARRMQQRLNLKYAVDIDIGAHIAPGLRIAHLPGVVITRHVRIGRNFFIRQNCSIGIKTLGLEEYALRIGDNVSMGANSCIVADRIDIGDDVV

SEQ ID NO: 941054 - protein, 93 aa, Homo sapiens
YISGDQFETWGWRLPFLLSIVLLAISTWIRMSMHESPAFAKMKAQGKISKSPIRESFTSWPNLRVVLTALFSINAGQAVTFYTAQFYVLFFMT

SEQ ID NO: 941055 - protein, 106 aa, Homo sapiens
LVRKVVEVGVVGPHDGGVQVDPAITGTVPVTVFVIVVGQLVVARVEHPAARIDHTTVQASNGHRRLDGRTRWVQAAQHAVEQRPVYRVAQFGIGLEADAGNEQVGV

SEQ ID NO: 941056 - protein, 71 aa, Homo sapiens
MPPAVRPLSDNADGVPPQLRTDLLKLHQLADEVIQVRIREHVIATNDMRLFGLHLLGQASLRMEQALWPEE

SEQ ID NO: 941057 - protein, 85 aa, Homo sapiens
LNAYKRGTAPAHRFEGLDLTQARNNPELLGIAMTPDNLQIDKEVLEYAQHGCSPIDSAHGFHSRWLRRFALKGYLGNAMNRHTLN

SEQ ID NO: 941058 - protein, 116 aa, Homo sapiens
CGESRFYDGALEYRNIAQHRFPQVLDWGLTYPVTLSFGTEYRYEQWNQSLAFLASYNGMTGGAQGFAGFSPLNTVHANRNNYALYAGLEWSSVSICSAGIGRAVQALLLIGNQTSG

SEQ ID NO: 941059 - protein, 48 aa, Homo sapiens
MIFYEPSDGLPAYRPEKCVNENHDIPSSFLNIDTDRYGSAWLAFSSDP

SEQ ID NO: 941060 - protein, 62 aa, Homo sapiens
AINDNAIRARSPPEIHPPVQRHDLKENIYPKSRVWIGLVLAAQGYGNDQAIVPRAVIQPCAV

SEQ ID NO: 941061 - protein, 111 aa, Homo sapiens
MIGGHCPIMMPQCNHDDSGPVTVGIMIGIPFKDDSIVAHSIYSFGSFNDDFIHVDLVIPFDFFDDDSLSSLDDSIQIPFEMIPFKPIQTFHSILFNDDSIHVDLVIPFDFI

SEQ ID NO: 941062 - protein, 87 aa, Homo sapiens
MLKALCQSLCLALSLTASAQPASVVFLNPGLSTETFWTSYTRFMQAAADELCMTLRVEYSERRADLALSHARAILGETQTPDYLVLP

SEQ ID NO: 941063 - protein, 46 aa, Homo sapiens
ASRRHHAGVIPVHFDPGLPIQAPNAQCVLAGGRNGGLALKRRQIEL

SEQ ID NO: 941064 - protein, 42 aa, Homo sapiens
KALTALISFVYRETVWDTPERFAKRQHHCDVASARGRRRGTG

SEQ ID NO: 941065 - protein, 46 aa, Homo sapiens
PRATVGIMIGGHCRPSGPALRSGDIGVTSSYQAKANVHQPVSPPGV

SEQ ID NO: 941066 - protein, 44 aa, Homo sapiens
MPALVRAASLTNYLEVSRHLGLNPHALLAQVGLNAALLDDPNRI

SEQ ID NO: 941067 - protein, 52 aa, Homo sapiens
MRVSTLMIAGCGCSHLALATIPAYRHTYCAVNYGSPAPCYLLFPPPATFPAT

SEQ ID NO: 941068 - protein, 108 aa, Homo sapiens
TFALEPQCCGRCNNIDSIKCANLNKAFLKITQNTKIPSKLPPDSSSHFESSRPSFSTTAIAHMTDSFYGYDVIVIGAGHAGSEAALAAARNGAHTLLLTHNIENHPVQ

SEQ ID NO: 941069 - protein, 127 aa, Homo sapiens
KAVKIRRFCQLFRYIERLFNNDGHMASFKSKSMQEGEAHNTIRSASRAWRLTGVPAFPSKLLRPARHRQGAFHAVTEYVDRHSRCQRIRPVGHPGPVHGPYRTLRSPPDGHGYRRDPGHLDARRGGV

SEQ ID NO: 941070 - protein, 138 aa, Homo sapiens
MTKATAWFRRVPAQAEKLPQRLLIECREAHVPLTSHLVEPSAYADSFCVGTVRNTSRIIEEMKGITMIANTKPALSVADSERWSLKQRAISGRIADVDHGNGVECYSGHRVTTNSPHAGKKLNGIPPTNSNCIANGAC

SEQ ID NO: 941071 - protein, 101 aa, Homo sapiens
MNAVLLGYRDEPIHHTTYTPPMSQRFRGYLPVVVDVETGGFNWNHHALLEIACIPIEMDDTGRLYPGEVTSTHVIPAPGYRYRPKSLEVTGIILDHPFRFA

SEQ ID NO: 941072 - protein, 67 aa, Homo sapiens
ELLTYMMEDDRNITPCIHLLFMAKNLERIGDHATNIAENVLFLLNGEQMLPPREKCDNTSNVNQIEF

SEQ ID NO: 941073 - protein, 101 aa, Homo sapiens
LLKLNVVPEPSERCTMLILVSGRCNPGLALMIAASFHLIFPRKISASSGPVRRSLPGSMLSRLTTGTTPPMADGNCPRPLGSVRCQVGLSERTKIDWLGGF

SEQ ID NO: 941074 - protein, 98 aa, Homo sapiens
ETGRSIQCPDLGLDAPVRFQALNQFGARRLHVAAHQGFVATFAHGIDQFRRQALAHQVGLDGLRTLPRNLQVALAVANLVGMAVITILPTLGVLSKLV

SEQ ID NO: 941075 - protein, 57 aa, Homo sapiens
MSGQCSPQPLEPPSIPRLLPSTPNSLFLCWACCTDALKADLMLPVECEPRCQYQGGG

SEQ ID NO: 941076 - protein, 107 aa, Homo sapiens
MAYWSVEWIVQFHKYSGPKVSWGQEWLPINGWLLALQRNLVAMIRIANRERVAIGAFLLVRTCARVDGKVYIYAYVSQYGYQRTLHSAQRSRKRCACLELAVDINTH

SEQ ID NO: 941077 - protein, 35 aa, Homo sapiens
IAPVRSLVTRFPNQYLGVLKILNGGQLRSLEERFA

SEQ ID NO: 941078 - protein, 99 aa, Homo sapiens
RVAAAEEELRDLGAVDAEGPDYGEGAVTLPRFPLTQSGKGFDRRCRIVGSRRCAEIAAMLAWKTAGTFVGKWASIDRGRPLVNPPLNLNGLARLTKVPL

SEQ ID NO: 941079 - protein, 67 aa, Homo sapiens
QVTAAPFDRKLVRQARDDAAAFVASDGLIRGARLEAALDSLRHNCARHSVGDLELAEAILCPITTPD

SEQ ID NO: 941080 - protein, 78 aa, Homo sapiens
IKLFSSILLGFLRNPKLGSAISNDYVISRMATCDADNLCDYQSVLTSTHTNCLIRFVKERLVKSFSSQPRRAFYAFLR

SEQ ID NO: 941081 - protein, 75 aa, Homo sapiens
CSQRGDDGIIQSLLTLAFGAGGHSVNEGHGDLIILQAAAFLLVLGEGSCLALRVLFIELSLKPGGGAAMAMFKER

SEQ ID NO: 941082 - protein, 35 aa, Homo sapiens
AAVCTVDGPCIGFNKERTSFKERKEDPHTTLKTPT

SEQ ID NO: 941083 - protein, 37 aa, Homo sapiens
SSTSQSLGTSESGSAQAGVDLLAGDPTPSQSAGIIGM

SEQ ID NO: 941084 - protein, 116 aa, Homo sapiens
ICQEMVMLQGLCTWRCLPLECGLPALSMVVFSSLGFRKRPFSETALSNTSPSIGSLEVFEALFERSGLIIKMKGPTSGIYQKPGEQDLAGWSWFSLPDWDMQGPGLKIKAGRITLL

SEQ ID NO: 941085 - protein, 68 aa, Homo sapiens
LNRFRTWMFAVAAAIVGVTVAVCGVVGFIGLVMPHITRLCVGADHRRTLPIGLLLAIFTVLADLAPEW

SEQ ID NO: 941086 - protein, 73 aa, Homo sapiens
ISLLPLAIQTYVSGKMTGSYRISNTISSHALNLTGAHFKFDTSRYAYMTFISISNCKHTDIFMKSTARVKMRN

SEQ ID NO: 941087 - protein, 199 aa, Homo sapiens
ILTVSRALYGMLEGTAVTMFMVVSDSNTNDTLMCDPATVLQLEECASSLRHIHRCSGQELGLTIQVSNDGCADSEDDMADIDEDSGPDLANLHYLGHCDVLIWLRLIQNRGLGEASSYHLVQQHFTGPVRARPDEETLQESLYRLARRQSAEHMLLVNGYRQTPYLPEDYLITTHAELVVELCKMSGMPKRSALQVSQQ

SEQ ID NO: 941088 - protein, 70 aa, Homo sapiens
ISLLPLAVKSTIYVKRKTYLSNTITQILSVMAHRYHGGGVHTIDASKSEEHDHPHALQFLRKDCTNVNGE

SEQ ID NO: 941089 - protein, 45 aa, Homo sapiens
MRHSVSVMTDQELLEMDTDPSITHENMDAYLMRGKIGRGTRHRGN

SEQ ID NO: 941090 - protein, 35 aa, Homo sapiens
PRLVLLLVRNNSEKLLLIPYDDVSPKIYRPRMSPR

SEQ ID NO: 941091 - protein, 118 aa, Homo sapiens
LVLPGFSAELDRTSHDPDHTTPAGLTCHRFSLIRFRSPLLTESRLFSLPVGTEMFHFPTFPPHALCVQTRVTPHDWCGVTPFGNPRINARLTAPRGLSQPPTSFIGSWCQGIQGALSE

SEQ ID NO: 941092 - protein, 91 aa, Homo sapiens
LGEHGDPVPRLLPMPDRAIARRLDRLRREGIVSRLQFLQADDVGAVLGQILDQPVEPGLDAVDVVGDDLHGHRCRAKRPYGNTVRAERSPG

SEQ ID NO: 941093 - protein, 68 aa, Homo sapiens
ILVELHMRCCSVPRGIALHALSTLETELEGGGESGFQKRGQLMGNLLSFPLLCLVNYITFKFCVPIEH

SEQ ID NO: 941094 - protein, 81 aa, Homo sapiens
LVLPGFEAYTGARLDAQLDDQARAFLLKSPEKNRVDVATRTVYLGPIFVEFRDYINDFGGSEAAVGKYVRAGSTNEVQGAL

SEQ ID NO: 941095 - protein, 32 aa, Homo sapiens
MVNPCGEAVAKASPNRAISSRTPKTRSRVIYP

SEQ ID NO: 941096 - protein, 68 aa, Homo sapiens
FRASASVLVQLAAFATGVLANIYEFHLYTRSSTNLYQTQAKQYEGNSVVEPQAFTPDLNGRLRALYAQ

SEQ ID NO: 941097 - protein, 126 aa, Homo sapiens
TSSPAGNLEDPPQISFHSSFADLGVREDIQALEGVGIVSPFPIQAMSIPIAVEGTGSYWQARTGTGKTLAFGITILQRITLPGDEGWEELTTKGKPQALVMCPTRELALQVSKDISTAASVRGTRV

SEQ ID NO: 941098 - protein, 122 aa, Homo sapiens
GNLQDPPQISFHSFRVGESSVTLSFDDGYRAILTGPAVILAAGKVNLPMDERAEHALVNLSGTVLLHLARWHWGREDGYRVSEIEQIDNEREDALKNNNGFSEDQSDYDGDQFDLDARSTRV

SEQ ID NO: 941099 - protein, 75 aa, Homo sapiens
MGLANTLTGVAIPGRVGAINVLLMATAVRAVPPSVLDAATVDGAEHVVEDSPHRMANIKGSGSVVAVFSFIGAWD

SEQ ID NO: 941100 - protein, 35 aa, Homo sapiens
RKFPSTRSHLARSRRHVAVVSVLSEAPAPSCFELD

SEQ ID NO: 941101 - protein, 74 aa, Homo sapiens
MSPGITALRRDPSLGRHAITMLMGILGGDDVEDVTEQPPELIVRGSTVQAQYRGDATVVSTLDPATLNTAEHLL

SEQ ID NO: 941102 - protein, 68 aa, Homo sapiens
GTLILLYPGTHLLSLSSIYCTEWALCYPGTHLLSLSSIVTVQNSALCYPGTHLLSSSIATVQGVPLYP

SEQ ID NO: 941103 - protein, 153 aa, Homo sapiens
SSWACVISGQTVDVSDRNFFMAAAKGKNVAEPLVSRLDGAFVLVFAVPIYDDNHAIIGVLLASVEASALSHDIEDIIVGKTGYCYILGLTGTTIAAKDFARVKAMENVIKMAETDKSLASLAAFEKMAREIDEPSISFYTYKGIHKIASYATM

SEQ ID NO: 941104 - protein, 147 aa, Homo sapiens
LGLCYLTLGLCYLSRRLECIGTILAQCNFCLPGFKRFSCLSLQGSWDYRHVPPCLANFCIFFVLQFLPLMFPGSGESAGPRASLDTQKSTHLMEKWSDCSPHSFQSSILLTGQGCLTWDARKTILPLHDHFNQKQLGSLAGCGASCL

SEQ ID NO: 941105 - protein, 110 aa, Homo sapiens
SSWACVIPNKEVKVGVTIGTELDLAALNIGDSLSDIHGDSTGLRVRHQATRTEHASQTANFAHHVRGSNHGVEVQVPALDLGDEIVVTDLVGARLAGSLGLLTGDNTGPR

SEQ ID NO: 941106 - protein, 152 aa, Homo sapiens
ILGLCYPTAAQPAVSQVSLGFARLSPAVDFNGPDGPADLIFMIAASEDGGADHMKLLTKLARALVNPEFVEQLRQAPDAQTVVDLIGGVVEPKEEASTSSATALPAPGHAAVTNAASDTPRIVAITACPTGIAHTYMAADYLRAAGKNWVLR

SEQ ID NO: 941107 - protein, 180 aa, Homo sapiens
SSWACVIEGDDSRYGHDPDGATKSSTDELAPGKSGLLRADTPLLGEFLTISGIRIDRMPLLDDLFVTHNLFGPVDARDAMNSTASPAHSPSAKVATGSRSRLGTQVSEGDDSRYGHDPDGATKSSTDELAPGKSGLLRADTPLLGEFLTISGIRIDLDAALDDLFVTHNLFGPMDARDAR

SEQ ID NO: 941108 - protein, 94 aa, Homo sapiens
RIGSNTRIRHSHTGNNLGNAHSLRTGHGYRLGSTESRRSGPRRKIAIHIHAMINISDLTIQRLERCTHTAVTTALYLIHRRNQHPLRTYCRTTA

SEQ ID NO: 941109 - protein, 58 aa, Homo sapiens
RTPRRTELSAPFQPQPPRLGASTWQKSSALQRLRGIELDAAFKSMLKDGFNSLFSRKS

SEQ ID NO: 941110 - protein, 29 aa, Homo sapiens
WGRRVRASEHKQDDDTAGSGDQVVEHVPH

SEQ ID NO: 941111 - protein, 32 aa, Homo sapiens
FDKTHKSETDTREVNSGFFYKSAEREKLIKAE

SEQ ID NO: 941112 - protein, 109 aa, Homo sapiens
KVTVRLWRTWRFRAVESSQQNGAKEEDGDEVLPSKSKAPGSPLSSEGATGEGVRTLGPAEKPPLRRSPSRTKKQEGDRATEEAQNGEKGPESKEVDGPQPGPKGGPGIA

SEQ ID NO: 941113 - protein, 32 aa, Homo sapiens
DGCCKIILPLREVVSIEKMEDTSLLPHPIIVS

SEQ ID NO: 941114 - protein, 31 aa, Homo sapiens
MKSKDLALFCTSLYRSPQQEPESAGFSPAPI

SEQ ID NO: 941115 - protein, 35 aa, Homo sapiens
EQHMTHSSPELYTTNFVTRNTGLLVLNEFERDTPD

SEQ ID NO: 941116 - protein, 70 aa, Homo sapiens
VGRGGKAGAVTALGSPSSAPINTPCVHQTADGRSSALPTVQTSPKYRSKKVASLSSTVCFLAAWPLFLEN

SEQ ID NO: 941117 - protein, 108 aa, Homo sapiens
EGPTDRPTRSQPSRLSVIPIRRTAISLGNSIAAAAFMPAADERFEGEQDMDAITEGSPLSDPNKKPAALRSLLGRTSRDWWPEALSVDILHQKGVSGNPDGRRLRLSL

SEQ ID NO: 941118 - protein, 67 aa, Homo sapiens
SQHLSSARALAMDPGVMLFDEPTSALDPELVGEVLQVIKQLAHSGITMVIVTHEIGFAREVADNMDD

SEQ ID NO: 941119 - protein, 65 aa, Homo sapiens
IDSKNPDSVELGQLGDKHAHGHRVGHKMDLVVLSVEAGEGKYSTMGVMVNREARELDPIIHLQWG

SEQ ID NO: 941120 - protein, 30 aa, Homo sapiens
VRELFEMARTKKACLIFFDEIEAIGGARSD

SEQ ID NO: 941121 - protein, 34 aa, Homo sapiens
SAFPAAVDTCFQEVSIIDGIQTHARLLIPADPLS

SEQ ID NO: 941122 - protein, 34 aa, Homo sapiens
FPYCLLLGNKCDMEAKRKVQKEQASIKARAGSKE

SEQ ID NO: 941123 - protein, 47 aa, Homo sapiens
TRGSPDVLAPGPRDLGQLPPRPPQPLRRLGRPAFYPELGPYSSRDPE

SEQ ID NO: 941124 - protein, 40 aa, Homo sapiens
EDPDVCSDRNISASYPAAHSLQTLGAFYPELKPYSSRDPE

SEQ ID NO: 941125 - protein, 29 aa, Homo sapiens
QLRDPKISAKLPPAASLSPPRGSAPASTK

SEQ ID NO: 941126 - protein, 66 aa, Homo sapiens
NGQQCAKLCIALAGSDSKKDPPSSISKQAGFAAKNTGVVGENLPLKGQNWGKGKRLISTLVVIGTR

SEQ ID NO: 941127 - protein, 33 aa, Homo sapiens
ADDGAPRPQPRKQTRRARADRRGNRDRPTQGRN

SEQ ID NO: 941128 - protein, 35 aa, Homo sapiens
CRALDSPEIFPTISKTLSVWWIISLVSSSGIFLCG

SEQ ID NO: 941129 - protein, 58 aa, Homo sapiens
GPPDIAHAGGNLDDLPWLVMTRECEGGRMWQEGKSHYRKPVFPFESRDTWTLKAGVSP

SEQ ID NO: 941130 - protein, 192 aa, Homo sapiens
VCCLIMSVVHFTYLSQTLCRSLSDNHVMGPSPLPAEYIISCHPGGSDEEPLQFMDTGTATSATLTGLTRGATYNMIMEALKDQHWHKVLEEVVTGGNSVNEGLNQPTDDSCFDPYKFAIMPVEMSANECLNQALNCSAIAQALEVVIADVIHLYGAMTDGVNYKIVEKWDRQGENVQMMSCTCLVNGERHMR

SEQ ID NO: 941131 - protein, 42 aa, Homo sapiens
SRTSSWIRVSWSSCCRILGRDQKDGNSQEYQCKELHGGDLKI

SEQ ID NO: 941132 - protein, 56 aa, Homo sapiens
SAYSLSSWTSLSDSFNCAHVSFQQYQLPYGLLYCRLKSALLPLENPSGFFFCDGGY

SEQ ID NO: 941133 - protein, 33 aa, Homo sapiens
SAFSERAFGKYSTHKETVLGAIQSFQLLKVFPG

SEQ ID NO: 941134 - protein, 135 aa, Homo sapiens
SSGCSKVPRSRTQADHGGTPGSPRVALTAGLVGEPLCPDGGFLPCGLLPGPREASYSCCRPLLDKWPTTLSRHLGGPCQVDAHCSAGPFLHLYRAQGLPVAAPSQRPWHAGMAITAAHGASTAVQTGDACFQRSG

SEQ ID NO: 941135 - protein, 233 aa, Homo sapiens
DQPSDFVHFTYSFYGPASHGDPGLQPDKNARQQPKRNFLDRNSEPRAKQDKTKREERKEPKQQASHQHHIQAGAGKAAAAAERAQEAQAEEKTHTPTRRAPTRQQKTTRQGTREHKKKASPARQQNRQKAPTPKKTTTQKGERNKQRGKQRRKTKNGPNQKHREKEKQKTKTNKKQQRKHKKKKPEEPKKEKQTQKKKTTEKTENNHKTRKNEKRTKENKEHRQNKQKKTRKT

SEQ ID NO: 941136 - protein, 34 aa, Homo sapiens
FSIFQQRVCRQNTGVVKTTPTPHGKGKDLYQHCR

SEQ ID NO: 941137 - protein, 50 aa, Homo sapiens
MMELGSPSSPWLTSSSSLPLYSYSVSSFSPRFFRDRSMWLSWMTCRSVGW

SEQ ID NO: 941138 - protein, 96 aa, Homo sapiens
GFRMTPLPYACSSTLRSTNHVPPPTLCRSLVILVSRERIVEGGFYLKSLPIKSYILNLNNIILYFFSLYFNFSKILYLFLTNFFFFFTLYFSTFLF

SEQ ID NO: 941139 - protein, 70 aa, Homo sapiens
MKSGPTPRGEEGGFGVIGRSFRFPSLNLNSACASGPFRLAGRSRSSLHSKGPVNTRFPPIQGGINRQGKN

SEQ ID NO: 941140 - protein, 111 aa, Homo sapiens
GFAFEFSLMMYALRLRITQPMCRSQTLGVTGKYKLSGRCGVRFLKVGLIQKRRPQTLPLGAKPKRATATAENSEKPPAQKARAAKGSWGPRPVSPGARYQAPQRAENRFFR

SEQ ID NO: 941141 - protein, 67 aa, Homo sapiens
MLTAVLSYTPLAYIGIVMESADGVTHNVPIYGYALPHAILRLDAGGPDYYLMKILTELRLASTYHWL

SEQ ID NO: 941142 - protein, 78 aa, Homo sapiens
PLLLQNEQTLLAFSSSSAASLQAGAAGFSGISSSGKMPPARSLFRIIFVETLSVLRRGALAGWPFQTALKLLVSTGKR

SEQ ID NO: 941143 - protein, 47 aa, Homo sapiens
QRKARSEAGTRTESQTSDEPLAQDGKADSKAERPDIHEMRNPPGRNT

SEQ ID NO: 941144 - protein, 81 aa, Homo sapiens
MVSGDPVTTLTSTRRYSPHAILRLDLAGRDLTDYLMKILTERGYSFTTTAEREIVRDILDECVYVVPGSFDAFDDGHGLSK

SEQ ID NO: 941145 - protein, 143 aa, Homo sapiens
RRNRGLLTADDTGMDSLGNPYALREEEGPRVISLPDHTGQTDQHVRRAVRAVEQEGQGEERPQQQDKNGAAHTVREAGDPKTTQDTENESMAKDAQGTNTQAAPGARQRQNSLQGAPSTNRQARAELAAEGNSDKLTPSHRHT

SEQ ID NO: 941146 - protein, 41 aa, Homo sapiens
QRSANIRERHMRWERHMRWERHMRWELGMWERHMRWERHMR

SEQ ID NO: 941147 - protein, 67 aa, Homo sapiens
LEDPPTHVPLPTHVPLPTMCRSQRMCRSQRMCRSQRMCRSQRMCRSQRMCRSQRMCRSQRMCRQPGP

SEQ ID NO: 941148 - protein, 37 aa, Homo sapiens
RHHSEHFSGRPREDRVPHSWNSITLSNLTLGTEYVGR

SEQ ID NO: 941149 - protein, 104 aa, Homo sapiens
DGADDTHHAHRFAGNQAKLVVRGRGDFVVDLVDGFGSPVDGLGRTWDVDAGGVADRLAHVQGFQQRQLFDVLAQQAAKRIKLGLALGRSQLRPDAGVEGVISAI

SEQ ID NO: 941150 - protein, 67 aa, Homo sapiens
RIPSDAQLTADPPEQELAGVFCGNRLERLRNGVIDPFQMIPYDCQCVLSDCDRFHYDVSIRGIRAKW

SEQ ID NO: 941151 - protein, 119 aa, Homo sapiens
VLLALSTDDSCTDLDSVRIPHRMCRSLDLYGMITEVKAHHEEMAKCSSTEAEACDQTKIETLQAQAGKHGDDLRNTRNEISEMNRAMQRLQAEIDNIKNQRAKLEADIDEAEERSGTSV

SEQ ID NO: 941152 - protein, 156 aa, Homo sapiens
HCETDVAGYNRGGCTIIPGSCSNGLRSFPFWDGRQETCEWVGGEEDQGEEAECNQAQDAKDACAQGGWEGVGTYGDASGPSCQEQYPEEEGSFVGTPHGGRAVEGGSSEWEFSATYWTEKSLPRKALEQCECASEQLKLHIAGACNGIKPCGGLGA

SEQ ID NO: 941153 - protein, 100 aa, Homo sapiens
MLQLTEGDRPGLINNYTTRVNSANWLTVIKTQKGAWETAKSTGNKWVPPLPEANCFLGPPMQDGGKRRCAAGGRPCAHSSSPVLGPQIPSCMTQGPIGLA

SEQ ID NO: 941154 - protein, 47 aa, Homo sapiens
MPVVPLEDPDKPIDWLLDHILWVKVCNPEKDAKHCDRQEANLQIRYP

SEQ ID NO: 941155 - protein, 36 aa, Homo sapiens
TSLSAPWAPLTGPSVPPPSSERISEELQQPHLLADA

SEQ ID NO: 941156 - protein, 185 aa, Homo sapiens
MRCTCVHVQTAYLCTCVCPGNICTCVSVEAALSVCVSRQHICVRVCVRTAYLCMRVCVRTACLRVCVTRQHICVCPGSISAPVHVCLEVCVQAAYLHVCACPDSISVHACVCVSRQYPACVCQGSIICVSGSILARVCPDTILCANRILCVCVQQTFGVPYVKHMSWMSGCLSCAALAFGPADIV

SEQ ID NO: 941157 - protein, 55 aa, Homo sapiens
HNQSGVPYPAPYVNHEDGAPTKKCWDSFSQAGWHLGLLSGTRYFPCLNSMSPPGS

SEQ ID NO: 941158 - protein, 33 aa, Homo sapiens
DIQHVRLLPVVLQQGVDAGTIHSEVERASSWFK

SEQ ID NO: 941159 - protein, 122 aa, Homo sapiens
GFLYTEGIISSASDVKEIILHQCNQAEVILSEDVQVRDDAFDRHSFVAFSCGVCGKRSIEAVLDVMARSITQAQSRSDYQGLPTIWDKIDECFFLDLPERLRAKQANFDSTGGIHAAVYLIR

SEQ ID NO: 941160 - protein, 35 aa, Homo sapiens
MYKRQTYVKGTDLPACLDLGSQGSGHLNSGPKQKH

SEQ ID NO: 941161 - protein, 96 aa, Homo sapiens
SRYPSLCQFALLPPGPCTTVWKALKSVSVTSAFSGHTSILSTTLSASKSSWFTSPYARPVRVLLAGVRHHAVVVPTDRDSVIVCVVVACITLCFVD

SEQ ID NO: 941162 - protein, 36 aa, Homo sapiens
PLPTGIQESLNPTPGDLEEIVKKPETQTDKEVAIWG

SEQ ID NO: 941163 - protein, 33 aa, Homo sapiens
SSVYRGPAALATTSCKCPLDPDTERAITACVYN

SEQ ID NO: 941164 - protein, 68 aa, Homo sapiens
MRGIVGCGKGKPNGPDPLTSRELLKSCLVGPQLLFLLLTVQMPPLSLAREMQNNVVWDPLRAIVPQFN

SEQ ID NO: 941165 - protein, 106 aa, Homo sapiens
RYPDGADDTFRLWNTYRLPGEWDKLLWVGAVNWNSKSTLQYARYNSHVTQDDYFVTSLMARYRINQNLAATLNVNNVFDKKYYAGMAGSYGHYVCTTQRYGVISAI

SEQ ID NO: 941166 - protein, 78 aa, Homo sapiens
IYPAYPLVAIQTSPNLNLPAHVECTWRPALQMKKFWPTRVLLSARQKSIHVKLESCSCWWPSHLIFFYIIYLVEGSQS

SEQ ID NO: 941167 - protein, 74 aa, Homo sapiens
MALMTPTAHGTRLGHARFDTAYPPVGLHIGGVPFVEHVFHVGVHLHLVAEAVAHARVGHGVAVDGIAFGVISAI

SEQ ID NO: 941168 - protein, 166 aa, Homo sapiens
MALMTPRGVLPDQGADGPQPFEYGLRPVVAGVETVNTLLLREPPRRRVSLSSRLLFLRVVSHVTYAFELRNTLEQGAFDAFFQGDVGLATALAATTELQHGNAVVNHVHQAHLAAWLARPGLISVLQVIIYTSLIGLSLDIGTLAFGALMVNLTTIPLGGESNFFK

SEQ ID NO: 941169 - protein, 150 aa, Homo sapiens
MALMTPPCPVPAPCRCPRAAPAPLGHSSGSRCRTSGHSRRCGTAAGRGAGRSRSVPERYRCSACRGAPVSARLRALRRWPATGVGTRPGSGRGTACAPTRCNMPAIIGKQLRLRISLFPPGGWSPGLCAPSVLNPDWNVQGVISAIQGIL

SEQ ID NO: 941170 - protein, 78 aa, Homo sapiens
NPAKHYGTAISEPHRDAPLLLGEIYGHVFKNHMTLCRVYFCHRQGTLKEEGNREKWATMGRSYRQSWTTISSSYPKAN

SEQ ID NO: 941171 - protein, 80 aa, Homo sapiens
MALMTPCVIFKLCVTPPRDSFATYARKLAALITMNRSWQASTMSRSNPRYGLSMFLDLHVRLACEADLDALFALGVISAI

SEQ ID NO: 941172 - protein, 39 aa, Homo sapiens
PITNYWGDRDNLRYFKPLWIRIGGDNRDNFKPLRFRIGS

SEQ ID NO: 941173 - protein, 165 aa, Homo sapiens
PDGADDTGHRHGLDSSQYRNAARSVDILLDYLPGWLEEGYQVLVTADHGMNNDRSHNGLLAEEREVPLFVFGDAFSLDPAAKPLQTELCGTICELLGAAHDKTVCRELLKMNGGARGRYLALLLLVAVLFVIFKSPRWLVNNLSDAGDQYKDSLQVYLRNETWIF

SEQ ID NO: 941174 - protein, 121 aa, Homo sapiens
MALMTPEAAAKKWIKDNPGKLDAWLAGVTTVDGKPGLEAAKAKLTNNEPRNSATSGQDRACPGLISIYAGGSSLIMLIDQKIPLGQYIASFVEWLTQNGANYFDAIAQGLEFMIHGVISAI

SEQ ID NO: 941175 - protein, 47 aa, Homo sapiens
TIVTTKANLKDSTCSPGMVRLSKSTVHNSRPIKTGTTLPDDMITQRE

SEQ ID NO: 941176 - protein, 41 aa, Homo sapiens
FLVPLEDSGDGIGTALTPGAHLQPGLQTAAEAGLGARNGAG

SEQ ID NO: 941177 - protein, 56 aa, Homo sapiens
MRADCIRTVSSELRCRLAYSVYCMVPYVLHCASGTHSAYSLGFQYFFGRYNKAGPC

SEQ ID NO: 941178 - protein, 48 aa, Homo sapiens
HCSDSHLLTVLLKLFSYCGKVKVNRQQLAKLEMNTLNVMLVTLNLALV

SEQ ID NO: 941179 - protein, 62 aa, Homo sapiens
LLFQMLLKRFRASCRRVSWLSSRMTMFELLLATTEDDGMHIVEALDSLCGFIALATHTNCGG

SEQ ID NO: 941180 - protein, 35 aa, Homo sapiens
DSRGSPYQLRRFRSKHIIDGPHGVSIFYIALIRLN

SEQ ID NO: 941181 - protein, 58 aa, Homo sapiens
SCTRMVWNGGVREAGRRAWPVVGFGRGSTCGHSLSDVDPGAHNVIRRHGQDQLPIGVQ

SEQ ID NO: 941182 - protein, 31 aa, Homo sapiens
LSTEAIPKLTFYRQFCTFVEKCVTSLIRLSN

SEQ ID NO: 941183 - protein, 33 aa, Homo sapiens
MSRISLRLKTGHFIESLHGKDPASSLPTQSREQ

SEQ ID NO: 941184 - protein, 37 aa, Homo sapiens
LDKLDEGEAEAAKMLGEALSKNPGYIKLRKIRNASVD

SEQ ID NO: 941185 - protein, 74 aa, Homo sapiens
MRLCGAHEGAVKSAQLLLQVQHVAVALSVVCCLRLDELVEAVQVDHVSATDSLQQETGHFCLPIKLCLAHAELM

SEQ ID NO: 941186 - protein, 68 aa, Homo sapiens
KVHAADGYDGEGAAWHASEKPGLMLRPFRAHGGGLCGPIHSGRVRWEDRLAREDEAAVNSNPATALQV

SEQ ID NO: 941187 - protein, 44 aa, Homo sapiens
IRARPYQLRRFRKRARREPAHALQIRYRRRIADPQLIAGIASVD

SEQ ID NO: 941188 - protein, 67 aa, Homo sapiens
MPLSTEAIPYQLRRFRYQLRRFRCQLRRFRSNIFSRSAVISNVINPRSLLSLGPVKSSTFFSRSAIR

SEQ ID NO: 941189 - protein, 155 aa, Homo sapiens
NNTGGVDQVQQVILLLVLGVREPGAFLCGTQHLLEHLNAPQLLAEARLPHRLLVMSHGSAQVGLPQLSALLIILQCGQGCQPLWHVVVELGQALLLVVQIRAWLTWWSMRRMASEVMGQGRVVVGLTAKLAKSGCSYRRLAHGLRVAVGRPLHLK

SEQ ID NO: 941190 - protein, 34 aa, Homo sapiens
RIADLPKILLNDRNGRSEIVWLKATKSRESPQLI

SEQ ID NO: 941191 - protein, 192 aa, Homo sapiens
FQHLISTDHFINNIGIVGVALLACLVISWALRKLPVLRDHLNEYSSFQVNKVWMALVSVVAPLVLLSLWITEIITVASKGYGEMPRNFVGIFGWGMSILVVVLAIVLSLIPWPHRSAIHHELTHEEELACENFQETEEGALSEHFSDHHDDQCDGHGVGRTNLRRSRSFDLNRTDVKAMNPSRLGRQILMEK

SEQ ID NO: 941192 - protein, 50 aa, Homo sapiens
PYRENYLWGRSVIATETNARWQGDRGIQPNSTTQAGGQNQPFQPESPQLI

SEQ ID NO: 941193 - protein, 31 aa, Homo sapiens
SRYSSTSKGGKYRFIPPEIQGGLTPKRNIVE

SEQ ID NO: 941194 - protein, 41 aa, Homo sapiens
MREHGHTVTRVTARKPWTGKTHEALVFLNTKPFQPESPQLI

SEQ ID NO: 941195 - protein, 35 aa, Homo sapiens
VLWCYRGVTYEAKVHLFGREVNQTAKPLVKKHHST

SEQ ID NO: 941196 - protein, 32 aa, Homo sapiens
EFELGPPLDKLDEGYEENEEFLRTHHPLLEML

SEQ ID NO: 941197 - protein, 39 aa, Homo sapiens
APLIRLSNGQHFQQRHDLHSLQPPSPGSKQFFPLIRLSN

SEQ ID NO: 941198 - protein, 81 aa, Homo sapiens
LSPWGFHKKPRGPVSRKLKQGHTDGTSNMIQRVVRGEKASNYGQSEPPQVGIALIPDRACSFVQCVLMEVEGLLGGTLPKA

SEQ ID NO: 941199 - protein, 45 aa, Homo sapiens
MFIWAGVRSVMSKKILLLLLVLEGVPLRLGVKPSMAEGSGVETYL

SEQ ID NO: 941200 - protein, 40 aa, Homo sapiens
QGLRSPDSGRAIAIKVRLPLFRVQCEGARYGFPKHSRFYR

SEQ ID NO: 941201 - protein, 76 aa, Homo sapiens
KVTHSRLTEVKGAAWGSFREEMQAQLPELESKILTHVAEMQASRQGKPRLLSLTAAERSVSLECVTLGERTFLSSI

SEQ ID NO: 941202 - protein, 34 aa, Homo sapiens
MIGRHTHSKSDARLLNALAANAALFSFCCVLNLL

SEQ ID NO: 941203 - protein, 33 aa, Homo sapiens
MSKTQLGDLSACPRGQDAGLFEHVILAEAYWWY

SEQ ID NO: 941204 - protein, 39 aa, Homo sapiens
QAEALVSGISSFSSESRSAAAFVPTSSLRRDNAWLLLLL

SEQ ID NO: 941205 - protein, 43 aa, Homo sapiens
RLRTLDSQAVLRCSASAAATPRWWSSVCPPPSPPPNAGSDLGL

SEQ ID NO: 941206 - protein, 43 aa, Homo sapiens
APDTLPSAPLFPSPSGVSCPTNGQDSSDLLLQTKEKVLWSLQS

SEQ ID NO: 941207 - protein, 209 aa, Homo sapiens
RFDVEKISRRFLNDSQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGGVGVEKAASAAGLSIHVPFAPGRVDARQDQNCNWDVGALEAIVSVSEILALVGRFPPV

SEQ ID NO: 941208 - protein, 172 aa, Homo sapiens
MAICICNNQRHSGCVEIRLDGIATGQQCQRRSQPETTAEAGTRQRTAILRQLGRRLSSSPHQQYEDELRQNECTNAAFFTGNKTGRQPGATNAHQHPDRLRPQLPEMTPLTRNYTIRRVTDKRQRRCDCRQQQQQRQNRINTEISHGKLLRSPFLVQVAGSHFFAFSPSQEG

SEQ ID NO: 941209 - protein, 33 aa, Homo sapiens
RTLAEELFNSVGKTLWITEEALMDAVTAVSGSG

SEQ ID NO: 941210 - protein, 66 aa, Homo sapiens
STARLSRGMYRTFPREPARSHENSTVHLHRPGRPTPGRDQGHRVWLTRATPPWICVGPPCPQCTHE

SEQ ID NO: 941211 - protein, 129 aa, Homo sapiens
QRYPLMATASLCVYIGHADTRESDIKALNRDIARIVARQAELRKQIDAIVADLRGADLSGQGRDMIKPRAFFFGGIDREGVRQRSRQRLATCTLRAVSVISKKLFMPAAAYQKTLRNAAASLDVVAVSL

SEQ ID NO: 941212 - protein, 157 aa, Homo sapiens
SDWDVAILVVFNAVQGFLDVLDAGDRLPLTVELGVKAGISLMVFTFSSALKRASNRGSSFCSLSIRAYSGSAARSASISTVSALNCFLKRCMGACNTVILLSSGERSPHRYVFVAIGELAARGCRKIRPIALCSPSACWRQLANSVICAWLSGASSQ

SEQ ID NO: 941213 - protein, 54 aa, Homo sapiens
MIELVHRVTDLSDAPALLVTGTGDLFDQAGHLLHLGHHVIHGLVCRIDQSELFF

SEQ ID NO: 941214 - protein, 35 aa, Homo sapiens
SLFHWGPLPWATYSFLSVAFAYFFFVRKMEVIRPS

SEQ ID NO: 941215 - protein, 144 aa, Homo sapiens
DESQAAARLAEINSLQQRQSNISAAQIRIRHDLCMALSIDAEALPFAGELIQVRKEDARNWEGAAERLLHGFGLTLLVPDAHYKAVATWVNNQQLQGRLVYFHMRSRNTTHDAALHAQALVHKLIIKPELPHYTLLQQELQRSC

SEQ ID NO: 941216 - protein, 73 aa, Homo sapiens
RYLDESQAAARLGETLLSRKSTLLAWIGEQEMTVRKAVAEPYPAVSEVFQHALGGHKLDCYSIYGLPKGTVTQ

SEQ ID NO: 941217 - protein, 93 aa, Homo sapiens
ESQAAARLVNGDGIVEVFFGCPHLQRHREALQHFVHTKANAVNTDNLLFRSNAHQLHAARLAVSGDGGIHRGERGFIHFHLIVAILLARLRFR

SEQ ID NO: 941218 - protein, 157 aa, Homo sapiens
NMTFQVHIWGARRMDKSMIGSTTVSARELSDRAPAVKRGLVDDHAQLLRLFGVSFGISIATGVDLDKRCANLCRSFDLLFIGVNKQRNLNPGICQTFAGIAHFVTLPCDIQAAFGCYFLTLFRYQAAMWLRLNGDRQHLFGHRPSPDFMRVSRLTQD

SEQ ID NO: 941219 - protein, 29 aa, Homo sapiens
MKRNIYPAGFPTVYIALLRVSNWCYPPLY

SEQ ID NO: 941220 - protein, 165 aa, Homo sapiens
HASSGSPYDPPGDTLSITRPHANCATLKLVSVLPLPWCAKYSHLPPPYPTAADVVAVTMRCKMRSAAQLIRPASPNNLRLALTPQYLVSTLMQRTAWLNIRFALKLVLGDRADFFASAHQMARECLDALTSLLALVGLLLPHPGAASVIYRHITWLILAHLIRTK

SEQ ID NO: 941221 - protein, 154 aa, Homo sapiens
VPLSLLSLPLRLFGGMLNGHRINFRSSAGSTSPYGAPCRLSAASTPEFLELVSWHLLRGFFVNKSELIEHIAQQADISKAAAGRALEAVIGWCAYHTEEGAPSLVGFGTFAVSTRVARTGRNPRGDAIKIKKAKVPKFRPGQGTERPRALTVTK

SEQ ID NO: 941222 - protein, 169 aa, Homo sapiens
TVNGRVCVTVLRRLDAVLEGTKDAVLERKKFLDVHQVAEQDGALRMAAGQAFYNVSEFTLAKLKASAAGQLLRDDFIAYLDGFSLDVQEILTKFNFRNQIQKLVDSHVLGYLIEDFLDPEVNLAPLREGCRRRIKLPALDNHGMGTVFEELIRRFNEDNNERRGINSNE

SEQ ID NO: 941223 - protein, 32 aa, Homo sapiens
AQRPDRKGPCVFIARPYRYKMPGGNRDFKSSV

SEQ ID NO: 941224 - protein, 82 aa, Homo sapiens
TSPNHTPLFVACQSLIVGGPYARAHVHTLQALDLVESCDVDTLYVLLKLGDLLLQQVCPHLDVLHHTLNLQLSDTVAHGHQL

SEQ ID NO: 941225 - protein, 29 aa, Homo sapiens
MKGDKLLYERGSSVCTYFPYHRTHQQKST

SEQ ID NO: 941226 - protein, 38 aa, Homo sapiens
SGHMWGTFRLERPDGSHFDVRTPSFFLESNKDESTTNS

SEQ ID NO: 941227 - protein, 34 aa, Homo sapiens
PALYGRCTLVGGALVTQAAFGDTTFDGQGCANVR

SEQ ID NO: 941228 - protein, 62 aa, Homo sapiens
SRTVFERKLRVKSSFVAPLEKSYGTRPRILTGNPRVDLQEINNWVQNRGKELLVGAVDVRAL

SEQ ID NO: 941229 - protein, 75 aa, Homo sapiens
MCRSRAKAVLVGYISYDAARYIERLPPLAVDDLQLPSMQFFVFDDVAIYDHQTDRLHLLAYADEGEVGEAERHIR

SEQ ID NO: 941230 - protein, 38 aa, Homo sapiens
MCRSRKNAVTVVPPRKCPLLPWLLSANKQTRGSERHIR

SEQ ID NO: 941231 - protein, 65 aa, Homo sapiens
MCRSEHNEFVLVHDGRQVQLLRCERSEPRRTPYVSHPALRGSSLNAPRTSGTSWVCIRIRERHMR

SEQ ID NO: 941232 - protein, 74 aa, Homo sapiens
NACAAPLFRDGLLLRRSLGDLAIALLRLPDSPGFSSLAASWIAAGQSPRKPPSPEPSEPRSRRRHRPSPERHIR

SEQ ID NO: 941233 - protein, 101 aa, Homo sapiens
TDVPAPVESKKSRLRELQIDEILVGNAKDLHDTGELLLLVLARKDREPVYISAMMHPSDHICEGEKSISFPQGHSRAHGSAYIDRHVVVLTQDDLGGAAMR

SEQ ID NO: 941234 - protein, 121 aa, Homo sapiens
MTLSVPPRRCAVTSCSAVRGQGRRAKDAEVVPQLRNRVALKKNNEARRATANTWQQLLEKTLGQLFELKTTNWLSFFKNDDQYRPEKLSGGPWERLRSYYDRGYINDIASTQVSRQWGTEA

SEQ ID NO: 941235 - protein, 44 aa, Homo sapiens
PGRYSARSTPKWCAARNRVALKIKINEGTSPPSSTSTSWHNVSR

SEQ ID NO: 941236 - protein, 45 aa, Homo sapiens
MCLLLNPNTDLIGPECEAVSDEPQGWETRMESFAARFRTSVAAPG

SEQ ID NO: 941237 - protein, 54 aa, Homo sapiens
DVRSDHVFPTMIDLKKPSFLCLACGARLYRVDMGWWVYYCLVEIQSPFGSGTCV

SEQ ID NO: 941238 - protein, 58 aa, Homo sapiens
LATRSIIFTSVSVKFSPLVVVVTVLLLDGDIDAVVHEVVLVAVLIHWPVVHLVRERHM

SEQ ID NO: 941239 - protein, 121 aa, Homo sapiens
RIANLGETTQETLNAQQFAQQNGQQPMQQYQAQQSYATQQYAGQPVNNTQPVTRPVPVLPVNAPAPISADPCRTGESALESRQRVIAECKAAAWLLTTVDPDDLPPGTALSRGWCLMELNR

SEQ ID NO: 941240 - protein, 77 aa, Homo sapiens
RNGETTILAPVPQGREFELNARKEKRNARFGVCDKAFFVCVFGLHATRLDGHGCDRAWQVSPKLREKEIFAYRLSAK

SEQ ID NO: 941241 - protein, 76 aa, Homo sapiens
MHDMMPMQSQGGSGGSMGGGMMDDNMRMQQPNQPGQTGGTGGMQPQGSMGQGGASGQMGGMPPQGQSGSMGSGTAL

SEQ ID NO: 941242 - protein, 98 aa, Homo sapiens
PSIRQPELRQRTVQTYRRHTETKVDVKLERLRRREERDLGCTCTDEVSLRQRRLVVGQHGLGADEHNVSAIPLCPKRLRGPYPRDRRTDNRLRHSSST

SEQ ID NO: 941243 - protein, 122 aa, Homo sapiens
LFSSPGFWRGKKMYSPDSEAYLKNPAFWVKMNNGWDDYSIPKEVARAVIAMHVKRGDSIYFVTGRSQTKTETVSRTLQDDFQIPAANMNPVIFAGDKEGQNTKTQWLEKKNIKVVYGDSDND

SEQ ID NO: 941244 - protein, 113 aa, Homo sapiens
MPLVILTAPGQAGDAPMFPILMGHLRVAGSGPGRPRTRPDRVRGDKAYSSKAIRGLLRDRGITAVIPQPDDQVAHRKRRGSTGGRPPAFDAEDYKGRNVVDAAFNDQTIGRHR

SEQ ID NO: 941245 - protein, 108 aa, Homo sapiens
AHGEREVAYPDGSRKLVKSGVSTVQNGAGQKTTHLMALNTLALQVLATPVEADEVELRFCFTHDPVAPGSFEEQMIKAQIAGTCGQTGVEGDIPIWAHKIHRVQPLLC

SEQ ID NO: 941246 - protein, 101 aa, Homo sapiens
GDQDAIPIDDILGRVQGEQAADEAGRRVGQAGVVVQRDLGLPVRRIDEVEIRGEVLDGAEEDFSRGQLDLGANGHWSPYIGALRELCISDYSTTSVVTESR

SEQ ID NO: 941247 - protein, 139 aa, Homo sapiens
IDGMAALRFHIRKQIVAKKTALSIKSLEDDIHLQGQISSFYDCDDQAKISGHWNLFEDLNRFPEHGRLKFESRGMRSQRMIMFALSRYQKGTVNRCARRQTLIAIFGPQFTLSRLREINSTPRGPAFNGIAKRERGFPF

SEQ ID NO: 941248 - protein, 63 aa, Homo sapiens
MRCGNRSRTRSVLTTIGNTASTCYCPLRTREWSGAHHAHYGEEMAITTGTGVNRLLDGACTFG

SEQ ID NO: 941249 - protein, 108 aa, Homo sapiens
DDEDHEQPEEQATAAGECLDVLVLLRVVQLRGGGVCALAAEREEREDEEDEGEGEEHVAHEGERCDGGEHGRYAPFGLMRSDGCHPHSALEIMRNVREWCTGGLQHLL

SEQ ID NO: 941250 - protein, 54 aa, Homo sapiens
AVKVLVETFAKIVRPNIDVISTPICIGIQPFCAVVWKYVGIITYTVEVGVVPFA

SEQ ID NO: 941251 - protein, 51 aa, Homo sapiens
MAIRRVHCGSIAALPRGSRDHEDLSLIIHSSRFDRLVVRFIYRDGAVEQQH

SEQ ID NO: 941252 - protein, 67 aa, Homo sapiens
MLPWNPMIQPSVGAVTANAQAATYTFSVHDRFSVVTMSPITAMELILADGALGSGVEEGVGQRGDQL

SEQ ID NO: 941253 - protein, 52 aa, Homo sapiens
GGERREDAAASAQIEKFSLWICEEEDSGLEQVIADAVHPVARSAQEDVVVLD

SEQ ID NO: 941254 - protein, 68 aa, Homo sapiens
AGYAVVTSDEFEGDPASVVTEFDPYEAVSLAPGQVATCLSHERRCGGGSPTILVWTVSVSAYMHGLYG

SEQ ID NO: 941255 - protein, 101 aa, Homo sapiens
YLITAGTTKSEQHTWRNTRDRAIVGLFMVAGLKVSEVASLTVNCINLKDGPWINIRYPDSQISHRTRPVEWAVQLLKDWLAIMAAAGTDGDLTFSTDDASR

SEQ ID NO: 941256 - protein, 83 aa, Homo sapiens
MVVRTASSRPKPLCQIADRRSRDITHNLEHKIFWLLDRKRGLFVTPYADRILKADVTARRSNLIRRIFCWGRRRGHFIHRGNQ

SEQ ID NO: 941257 - protein, 129 aa, Homo sapiens
MLRAIRQTRKGAEILEGWEFSGEEAADGQDGGYVTWLGRRHARRVLREVASNGFALLVGFISQQHREMAGADNTSETEGQAADTGDEVTITPAPAPEALWKGSSSGQGQGGNRDMRSLQTDEIMPRLGT

SEQ ID NO: 941258 - protein, 82 aa, Homo sapiens
QVPVRIIRTSNTVAARFHSEEPVSLRNLQVHEKSRKYAPYGFHDGCDGGGVCLGAQAQSSGETAADRSRLTVGVGAATLPDY

SEQ ID NO: 941259 - protein, 159 aa, Homo sapiens
GSEQPENKVLQAQLKSLESERSVATLLDDAYASGRANAAIGLLASAEYRAYFRKSATLGSGRSGCSTGKIPAAPVSLPQSDEAIDAELLDIFLTEADEVLAFVQHTLPLSREDADNQEHLTSLRRSFTLKGSSVLVGLTVFGEGWNIEQVMNLVVVQIL

SEQ ID NO: 941260 - protein, 29 aa, Homo sapiens
MYDAAVFSGLTVTSLTPALLYLLARLGIN

SEQ ID NO: 941261 - protein, 95 aa, Homo sapiens
RLEDPPMNHPGEIAVLASVALPTVVLVNNAQREHQEFMQNVRAVAEENGAAIRALPADGIAVFPLADDYADLYLLARKGMAEKLLPVVQIRYCQR

SEQ ID NO: 941262 - protein, 62 aa, Homo sapiens
NNRDKCFLITAIEGGMLETAQKTNVLLGDLGAMQGAMLMTMKANTEVTSANQVLKNNEASKS

SEQ ID NO: 941263 - protein, 173 aa, Homo sapiens
LAVTDLTTGFTISMGWIECQRQMDRAARRGNIRGEALMVFHVTGRQIITVFTFKLSEQILRHLAQRVDQHIQAATVCHTNHDLFDARSPARWMVSSIDRDKALSAFQRKAFLTNIFCMEIAFQSFSGCQAVQNVFFLFLQKKLVWNGWIPISCCIQRFCRIADIHKFSTDRTG

SEQ ID NO: 941264 - protein, 92 aa, Homo sapiens
DNTHRTLHGALMDAELLAEVYINMTRGQDSLLIDSDASESGEGQGTQEVVAIDFSAFDLPVIKPTDDETEAFEKSLEAIDKASGGKTLWKSI

SEQ ID NO: 941265 - protein, 144 aa, Homo sapiens
MFGWRANPHFGPFHILSNLLIFGGFIMLASAWRVLYLAQQQHRLATGGLYTRMRHPQYVAFVLIMLGFLLQWPTLLTLIMFPVLVWMYVHLALTEELRCAGRVRPGIRSVFERTPTFHPPLEQWCVEGVVSDHRHPPVSNNPPA

SEQ ID NO: 941266 - protein, 41 aa, Homo sapiens
MAVSSPWGPGIEEDADGLGRIFEGHVQVAISGTAMDSNNPP

SEQ ID NO: 941267 - protein, 77 aa, Homo sapiens
MYAKRTRVDGSLPYRMATPDPARLESYAPAKREQWWRERLERCYSRALLTSFCYIEYVVSVDVTIVHGACTYEPAHY

SEQ ID NO: 941268 - protein, 113 aa, Homo sapiens
ALRAPFSMMVTILGWWVTTLFHFLILFVCLPTRLGTSHPPVMDFHHRNHRGHVSRHGDRFGCSRAGGPRTHRAVVPQVHDYKSGVPPLTNLPMDYLSTLCAASLTVTLGCWAY

SEQ ID NO: 941269 - protein, 34 aa, Homo sapiens
STLEDPLVSDDTVRYHNDLKAPLLCANVIDQPRM

SEQ ID NO: 941270 - protein, 102 aa, Homo sapiens
STLEDPDTVPDVSAIPSTVFLKCRKMVRWLQVRDELNHYRAHFVVKSFKHGFARCFGNVTRLIDRHIWNGGERQKSSRGFSRISGSRTQWIWEQCRHSPTKD

SEQ ID NO: 941271 - protein, 69 aa, Homo sapiens
MPMPNRSVAVEHLDDVDGAIDALDVFGHRRCRASMGVGIRERSQRCKVLRLQGFDGGTLLVLENAVTSL

SEQ ID NO: 941272 - protein, 49 aa, Homo sapiens
MAKKLEQIEADAQEIVIAAELIRLGARMQLLEAEVVLSRDRLMKLYKQV

SEQ ID NO: 941273 - protein, 126 aa, Homo sapiens
QNARGSTGSCGPRTCRPHGARCTHFHSGHASIGARLLVRHGDAAAVVPDRDGAILVEGDDHSVRVARHRLVHRVVDRLPGKVMESGNPGGAHVHSWPEARRHQALEGDDVFCTVLIFIGHLSMSRH

SEQ ID NO: 941274 - protein, 79 aa, Homo sapiens
RSPPVCPVLRRCRDARDADERDLLGTPQSGGHEVYLEVAALVTVFILLGRYLETRAKRQSGEALRALLELGAKDAVILR

SEQ ID NO: 941275 - protein, 53 aa, Homo sapiens
ITMEPLGPMVRHGDDQWFDIVKLARFAMLNAEESGVTQKNVDEMAKCRGLFDA

SEQ ID NO: 941276 - protein, 68 aa, Homo sapiens
RSSSVPSPYGFTTAITTSSSRFPRVLRRLTLRSHCYGFRGNHHWRILLCRLATNPGRDGVSRHCDRRL

SEQ ID NO: 941277 - protein, 103 aa, Homo sapiens
MRASQTALDAFLLGQQPGHVCRVRPAAGAVAGYNVADLRVGSSEKYFSSGKRVLTAGTSVFRAIQPPFVENPSIGGSGGTFQATEQATIGLESCTGTYASMTI

SEQ ID NO: 941278 - protein, 50 aa, Homo sapiens
CGDLCTYDKAKAKELYAKAGGYKGTLTIAVNGDGDHKSWSQAVCNSWKND

SEQ ID NO: 941279 - protein, 42 aa, Homo sapiens
GVKFHVINEDGTTSGGPMYYLRDGLASIGKPTLGRVLASLFA

SEQ ID NO: 941280 - protein, 45 aa, Homo sapiens
QPRSPGILIDLFDRERARRAHPVDGLELPPSECTSSEPSPLCTRS

SEQ ID NO: 941281 - protein, 47 aa, Homo sapiens
IPWRPIVICLPSAFGDCRFTDLGVPRSALAELCISSCTQSDWFWVSS

SEQ ID NO: 941282 - protein, 31 aa, Homo sapiens
MIVSVIPIAKQTMQLNLLQYHLYEVKLEQES

SEQ ID NO: 941283 - protein, 163 aa, Homo sapiens
LADIGGGDHAAQHQHTQRHHEPENSSTMIATMTNRPARRQVSNGPSARHHASDNPPRDRAEGLIARPRHAPIVSPSDVCLVVRYPAILRLMRPAKMSENRSSTESSAISLMSSSCPSPAMTASIMADEAARSADPRMTSSRSRANPIPVCCGALMGARKRAHT

SEQ ID NO: 941284 - protein, 34 aa, Homo sapiens
RAIGIPFRPGPVRVQQQLTLVLSPCRFGDHLQRA

SEQ ID NO: 941285 - protein, 51 aa, Homo sapiens
SVYPGQAEALQLAATSLIGGGRNENNSSGEAKAARSTTTGSTVPKLETFTT

SEQ ID NO: 941286 - protein, 55 aa, Homo sapiens
FTSNNPRHLALAEKLSSVAETVYMMQECTTVFPGRVEDYYRKSPVMQDYFSRCHQ

SEQ ID NO: 941287 - protein, 80 aa, Homo sapiens
APCGPAQNRVLLHTNHEEVNVAREVDKASTGFSGQHAGLDLDMGMLISERLDDLVESFEGLVVHLFGVVTRNRHCEQLAA

SEQ ID NO: 941288 - protein, 113 aa, Homo sapiens
RGVVAGDRGPVTVPPVVVIIVDLEGGGRPRGVRGEQIRGDREVADDHVVVVSQTGTTDGADIHSRGTVCGVAGPLGAERIDVGVSTRRPLRREGLRGAGVSAEQEAHRCGATR

SEQ ID NO: 941289 - protein, 40 aa, Homo sapiens
RHPRCGEAGSAGAYHREGRAAADARLAGLVIFLSLNRVSF

SEQ ID NO: 941290 - protein, 41 aa, Homo sapiens
PQVARVIPNTTPQAAAGGRLMGSFRGVSYAFWAVAGAVISH

SEQ ID NO: 941291 - protein, 90 aa, Homo sapiens
PAVRRKAGRKVTSRPLTNAPAPPASSASCISVDPGNPSHYSLVLKNGTEALLVHEPLFSSADGSRAFHVDHPDLFVVSIYDPLIIWLKPD

SEQ ID NO: 941292 - protein, 61 aa, Homo sapiens
QGGDDPLDREPGGLDARLDRGVHVCPCRFLASVDLIRDYQRYRDALVAIGGAGQSLDSNGI

SEQ ID NO: 941293 - protein, 68 aa, Homo sapiens
RITTRRLVQPWRTATDCDPATAPPLAQLNTRLASPPNGSQITVPVQNNATGLTFQFYNVAGNKLTVST

SEQ ID NO: 941294 - protein, 51 aa, Homo sapiens
AIAHLEQAQHPAYNGIVMKPVNRKHTPLDIPHEEPKCSLEWLGVKTGVTTT

SEQ ID NO: 941295 - protein, 98 aa, Homo sapiens
RVIRRDCLSIASLLIVSCSTSGFAAQGGDEIPTDKYQSRASLSILGRSRFGDVDLSAGPHGSDKSQLQLLARTVRAYNAVSDKPCAGISVLLCYTILG

SEQ ID NO: 941296 - protein, 48 aa, Homo sapiens
MRGTSYLSAWRHTVSELGLHALLAVEDGDGAVEHAKGALDLDREGHVT

SEQ ID NO: 941297 - protein, 144 aa, Homo sapiens
DAETGKTLSVGAGQGRHRLHRDHHDVRRHHEKANPSSAKLDRNGVPRSISSLLYDLGEEIDNALALAAKAVAGREEEGKVAEYYNDLTTPPYDDSAAPGDQPLIVLNSVPIDVRFFRTDLSKATRLANPFTPTRDCSVYRGAGF

SEQ ID NO: 941298 - protein, 70 aa, Homo sapiens
RRKLWKRQKMCRDAPANGNANEENGELEAANEVDVEEETVIRNRRLKRKREFTDSGDKAAGVRGGGRGAR

SEQ ID NO: 941299 - protein, 54 aa, Homo sapiens
PKANPTESPTSAHPTRPARNRKPDPPTHGKAGGNHKATPEGNQNRRKADRKPGR

SEQ ID NO: 941300 - protein, 41 aa, Homo sapiens
PANMLLHFGRGNSYNGFDYVFSLYPGGPTFARKTLGPTEFL

SEQ ID NO: 941301 - protein, 102 aa, Homo sapiens
LGWNRQLLVGGLIHEDVGVAILIEVLHATIDLSRFNLDVGVEGAINDFPAQHVLELGAHDSVALTRLMVLEPDDRPQLAVKVENGAVLNVIGGNNHRSGPFG

SEQ ID NO: 941302 - protein, 42 aa, Homo sapiens
ETDTLNGQFMVGFIHIKGSGPLNSNHGYCSVEIVSQFHNIPP

SEQ ID NO: 941303 - protein, 102 aa, Homo sapiens
TFCGTLAKNSTTSSVCRTVPVGLLGVHRKISRVRSVIAADASEVVMILQRRRDRGGPGDLGQDWVGLEGTATERSTSAGEMHELAGYLRDPTPTVTLTFTPK

SEQ ID NO: 941304 - protein, 31 aa, Homo sapiens
VSICSTLPDHINNIGIVGVALLCLIFCALRK

SEQ ID NO: 941305 - protein, 58 aa, Homo sapiens
RGPGWHYPTTTTKKKARGQEGQHPDGTAIAAGILVCGVSTYCLDSWALLPSPMQENDQ

SEQ ID NO: 941306 - protein, 176 aa, Homo sapiens
SFPACLVAAILRATLLMDSASATEDPPFWTTRVIAPPACADTAVEPLLTDETGTTSPSTDIDGQNRVLPHGMFRHREQFGRTGLEPSASLTVSPGAPLVGAFSMPFSTWQRGIHAVNGDRTGDFIMVDGRITAQITCEQLPGLVGLGGADPPQLTELHTFLMERVLTSCARRASAC

SEQ ID NO: 941307 - protein, 157 aa, Homo sapiens
LGELGEWVIRDVASTPLIPGIRRSMRTTSAWGACLTAPSPSLASPTTSRSSAASRIWRTALRTSVSSSTSKTRTGSMATSYDVYRLQIRRGTTVVYWKRAGMIITARDVHMDVEQIVITVVKAAPSSSDTLGDPPKPPGMGTRPTSPSTDVVRRPVM

SEQ ID NO: 941308 - protein, 117 aa, Homo sapiens
NVKKYFFAERLIALIRLNPAAPRAAPRLFYISRISVMSRVKRGVTAHAKHKKVYKAAKGYYGRRKNTIRVAKQAVEKAGQYAFRDRKRKKRTLRALWIQRINAAVRPFGMTYSVFIN

SEQ ID NO: 941309 - protein, 98 aa, Homo sapiens
MTDVMSGSPYAPTIGADPMLAVTAANGVWLQLHDGEHRHEVIDAMASWWWIHGYRNPVLDEALNRQSSQFSHVMFGGRTHAADAVIFLRLAPGPLRIL

SEQ ID NO: 941310 - protein, 73 aa, Homo sapiens
IFHKKFICEWGREGIVQRHFAQLDEGGIEDILARLVIPRIFIINHGVALVMIRGYRSVRMYGYLAASDRKHRM

SEQ ID NO: 941311 - protein, 113 aa, Homo sapiens
ISQLQNPFLNALKLVTSSSNREHKEGISSHRHFRLANAHGLNEDDVVASRLHDDHGLASRTGNATKVAPRGWGTHKRLVTISQIAHPGATKNRTTGSRGIDGKNRDLVAKLID

SEQ ID NO: 941312 - protein, 90 aa, Homo sapiens
TYDGKGFRGSRTEQDAAERAYFADRFHLMRVMPPEGGHAVGTAATREFAGSTVVGHVDTSHNHAAETFYSTVGAVGPSSVVIAGAGIIGL

SEQ ID NO: 941313 - protein, 46 aa, Homo sapiens
LILKSSWDNIQGHRRSFKTFSSLLQGKKGSSGTYNALFPRGPNIKL

SEQ ID NO: 941314 - protein, 104 aa, Homo sapiens
KALCKNFEMLSHVDRNGKTSLLCSLCLTTSYKVKQGGLNCPSGPCSFCRRKLSEPCYYNKGDRTGYQFLQAQLLKQFQRQALRGASTELALMYNLFSGNLKLGL

SEQ ID NO: 941315 - protein, 37 aa, Homo sapiens
NIWYCDGWGVPDRIQVTTDLYQVLLPEGYQLECRGVV

SEQ ID NO: 941316 - protein, 64 aa, Homo sapiens
EKSFCSEGCVLLYKQDFTKKLCLCCINLTYLSQNFQRGSTQQLVGSTWVFFCEDLEYKNPLGYS

SEQ ID NO: 941317 - protein, 43 aa, Homo sapiens
ETPVFICATAGLKDLLSVFQAYQLPADDYTSLMPVGDPQSITI

SEQ ID NO: 941318 - protein, 34 aa, Homo sapiens
MRMVDARNGHRGGARSFLTPRATPAVAHIKTGVL

SEQ ID NO: 941319 - protein, 41 aa, Homo sapiens
RYPGFGLVGILVSVCIVCMKLNDVLMTLFAVNLCKIVLGFI

SEQ ID NO: 941320 - protein, 34 aa, Homo sapiens
MRTFRNSAPHPNPSSPGGIQGLRPVPGFRRLVPE

SEQ ID NO: 941321 - protein, 119 aa, Homo sapiens
GGVCWSHFWVGKFKSISIDEDKNSLCWPGTVAYPCNWPSFSCFRDEVSLCHPGWSSVVQSRPSLVGAPSGALPDPPGWRCVWESRLQGLRTQDKLGIGWLVSPSEKWAIWWVPSGAFLL

SEQ ID NO: 941322 - protein, 51 aa, Homo sapiens
TLDAYESGKLVNSAVSTTGKLADLSAQSAPIYVGGGFAGGEVGACYGTLRE

SEQ ID NO: 941323 - protein, 36 aa, Homo sapiens
ISLGPWVLLAMETVVNLVLLVVSVLLVLEAQEVLVA

SEQ ID NO: 941324 - protein, 71 aa, Homo sapiens
MCQLSRQAESKDRPAPAFRVAVKMRDRRPDQDLPPWTRPSRPAGRARHTPRASTSAVEMKKLQQNALRAVE

SEQ ID NO: 941325 - protein, 76 aa, Homo sapiens
CKYAIAIDGGSEVREEFGAAFERDTDDKIVVNKNACKPDVVAHACNASTSGGQGGRITRGWEFETSLANTAKPCLY

SEQ ID NO: 941326 - protein, 106 aa, Homo sapiens
QADEGDASHLRVSPMDFGRGLAPPVPPSPVTNLRRDASVRFAEAVDELIRLAPDRLVEDVQAVIVGRVGDGCALSVEDETGGLDLLAELGALDAAQAFDHCVGGAR

SEQ ID NO: 941327 - protein, 46 aa, Homo sapiens
HPAGQRRVRREIAKALKSFTMHSLTIHMESPVDHYPDCLFCEDPAF

SEQ ID NO: 941328 - protein, 88 aa, Homo sapiens
VHGTELAPSRAAVHPLIHPFTPPPIHTPTHPSIHTSIHSPIHPHIHPSIHLSVHPSIQPPIHSPTYPSTHPSTYPPIYALIHRFIEPA

SEQ ID NO: 941329 - protein, 46 aa, Homo sapiens
RSPTVSREGLPTLNTTILYPNVRAGMSGSLPGGSVISRLLINAEPC

SEQ ID NO: 941330 - protein, 60 aa, Homo sapiens
WNWTCKDLLLQALKESQSYLVEDLEGTEAPFQQHSGQPLAIPPNHPEFDLFIPHIRKASL

SEQ ID NO: 941331 - protein, 138 aa, Homo sapiens
MFWPLAQAADDLAGGRVVLALKEGHTLTAICDASKACVSALLSESCSPWMRQSCSKSPTSTQGPLEKVEIQANPGLCQSFPAGLAGPSKGPNKVNPRRPKFLSPMAFLSVGAKQAQVSAAREHSPRPAKEPMEQEPAL

SEQ ID NO: 941332 - protein, 145 aa, Homo sapiens
MYTGAPHHPGDPECYFFFNKQQKAWGVTPQRKKKTQPSGGLGPLLPPPLQTPTEKEKGWVVGVGEFSQFYNRFFFFGKKTEPKVGPLPGLFFPRGKSHTCSFLLSPGKKRGCGREIGVQVWGGGKKIFIFEPLCPFCIKLKEGKV

SEQ ID NO: 941333 - protein, 43 aa, Homo sapiens
AKPFLHFCAKTLPLDQEFLNYAELVRATPFLLHKLYPASCSLF

SEQ ID NO: 941334 - protein, 135 aa, Homo sapiens
YQFPHVPESPSLLEYRAGARRGRMLGWCSPVGANRGRLGWAYEGHGGGSCGEGNKRHWDFGRGWEKITPLYHREILLFKRCPFQSRGSNGMPSPSPVQAVGLYPPPASSPFSYLFSLLVAKRPWAVPCPSLPNSQ

SEQ ID NO: 941335 - protein, 43 aa, Homo sapiens
VISIVMPPSARATQTVSLRKPPAVNGRTQPGPAPPAISLPTAP

SEQ ID NO: 941336 - protein, 184 aa, Homo sapiens
MEVDGLNSRTDRGGDSIGETRLLEPVKEIGGMKHQLSQMGGSTPVLTPGKTPIGTPAMNMATPTPGHIMSMTPEQLQAWRWKKEINKRIRPLFDEELDVRFPEENRVLPPPAGKVPIGTPARKLTATPTPWGGMTGFHRQTKDRLMKSVNDQPLGIFPFLKPDDIQYFDKLLVDVDESTLSTRR

SEQ ID NO: 941337 - protein, 67 aa, Homo sapiens
SAPQAFMEMGSGAQQGQKNGIQRSPPEPRRPGAQQQGSPSERDPPLCTQQARSPLPGKNQTRNRCVL

SEQ ID NO: 941338 - protein, 81 aa, Homo sapiens
MWMFLLPPRGGFGPAPPQIRCRPPKRALAVPQETGPRLPGPKFGQPLPGLGPALLPPALLVLGRTKLVPPAPNSIKLFCGP

SEQ ID NO: 941339 - protein, 81 aa, Homo sapiens
PASASSSNPSSSHDDDSSKDSGFTIVSPLDIYHSAQSCPTGIQPPFSGPKARLRLIQWRTFLNHCFLPGMHFALVQPFETP

SEQ ID NO: 941340 - protein, 87 aa, Homo sapiens
RAGFSPSPRFPAPPWKQTGFFMEGHPPLKPGEEIFGPPGLGPHPQNHPGLGFPLDLGFQGPLCELSCPPPHRMRLGPAPPPPPSPGG

SEQ ID NO: 941341 - protein, 103 aa, Homo sapiens
LAKGNILAEYTFFIDILLATIRDEIAGCIEKAYEKILFPEATRILFFNPPKKMPFPKKRGWVLGPNNFYSFASQQQKPEDPPFPSPKLAKQVIEYARQLEMFV

SEQ ID NO: 941342 - protein, 57 aa, Homo sapiens
ENQIESKAAYVLFYQRQDVGRRLLSPAGLFGAPASPACSSPPSFEFMDVNLEPWVLP

SEQ ID NO: 941343 - protein, 54 aa, Homo sapiens
STSLAPTRPCFYDIDLDPKQNRRMDYSKQITIHLQEATLKVWPEFRKDPFVPMH

SEQ ID NO: 941344 - protein, 135 aa, Homo sapiens
TLALPSQSSQVGYDKVKAISSWLSIFPFRCRSSMCPSVTQQAGPLLSGTLSHSSHSGHRWSLEGSKPWGLQTSLERESPFSPPRKPRPAFVILFIFTFEPCKACRWGRSVPATRCQQRSAGPLVWPEPGEGTGHA

SEQ ID NO: 941345 - protein, 71 aa, Homo sapiens
LAFEGAPPPAPPPPPKSFRAKLNRFREGPFMPAKKALGPGKNWASGKKMFVLFSDYVTNPSKTSLLKAPSL

SEQ ID NO: 941346 - protein, 103 aa, Homo sapiens
KIGPLFPGPELPGEPRSPALFGNPQKGIVMGFPSSMSISPPARPFGVGAKLPGFPPRSWAGPCPFLWRPNQGLSPLLFETSRRAKTPPPFASFGFFNKKISWG

SEQ ID NO: 941347 - protein, 40 aa, Homo sapiens
AGKPPLPGVFGLPEDGWAGPRFKFFPGPRMEIKPPPLPWG

SEQ ID NO: 941348 - protein, 118 aa, Homo sapiens
MVIQRAFRRHLVQRFLKHASFHLPQQAGSGLSEEDAPEREGLIAYVMSETFLPDPLAHPSSSSISSTSFPPSYDSVTFFNFQNCTMTSRRGEESRKKEGRPDIKCQMLSEEIEPFSPS

SEQ ID NO: 941349 - protein, 147 aa, Homo sapiens
PGPPKAPPPRAGAPVGPIPEKAPVCGGGPPPPPPLPPLGGLFKKSGLCKRGGGLPLSVCLSLAHAPPPPGARGPKKSALRGWPTGPPPCLRFPLILGGGGPPLSRTGPGRGVGNPTKRVGWGLQWGPPSGPPGGPPPGGATPPAPFC

SEQ ID NO: 941350 - protein, 112 aa, Homo sapiens
SGGGQRPAPPGATTCVLFVYCCHAVSTVQRQTITQRRSREGSREPHAAWGATGSLTCAGALPDSVRLLAQECRNVVRVDALFLQCCHVSRRRLTRAAPHGGGVEVAVVRRGR

SEQ ID NO: 941351 - protein, 81 aa, Homo sapiens
TAKAVLNRKVYSYKHLHPKKKYLCKILNKILANQNQRHVKKLFILNKWDLSQACKNSSTYTNQCDRAYQHNEEQNPYDDFN

SEQ ID NO: 941352 - protein, 166 aa, Homo sapiens
ALQARLKAPRSPPPPIGMANKGPAYGLSRKVQQKIEKQYDADLEQILIQWIPTQCRKDVGRPQPGRENFQNWLKDGPVLCELINALYPEGQAPVKKIQASPMAFKQMEQIFQFLQAAERYGINPPDIFQTVDLWEGKNMACVHRTLINLGGLPPMVWGFRKISLFI

SEQ ID NO: 941353 - protein, 121 aa, Homo sapiens
PSSWRMRTKVCQLHFPHLPILGTYDLKSVLGQLGIPKVFNNGADLLGVTKEAPLKLSKAGHKGVLTLDEKGAEAAGAMFLKAIPMFIPPEGKFNKPFVFLMIGPKTQFPLFMGKVVNPPPK

SEQ ID NO: 941354 - protein, 73 aa, Homo sapiens
SQSLHIALTTFMQLKVMNLTFWKSDFYTCMCDYADVFLVPLYTELLISCLVSVYTMSVPLSLHSPHNPSQCNI

SEQ ID NO: 941355 - protein, 100 aa, Homo sapiens
GRVTIFPREPLLPFGPFWWPHWTRLAQKPAGSGSGFPGFRSQVLPFFFKPSGLLSIFWAFVFGLARRWGHFVSFFVLALILVFSLYCFLYFVNYKNPGQR

SEQ ID NO: 941356 - protein, 154 aa, Homo sapiens
MVFPVGKPHAEEKQYYMWGHPGGFHTFKSEVPSGVTKGVVKLFSDPITVTVPVKVSRKNPKFMEAVAEKTLQEYPKKPREELNLDVAFAPTGGIKSSSPQNEVQPPKKSFARSQVNRAQPSGPQIRPTFSRFGFCTLTLDFAGHGKKKIGPACN

SEQ ID NO: 941357 - protein, 66 aa, Homo sapiens
WALRPLAEPSLCSHPPQLLPRLQSGPGGTREGEKEMQEPRGSRFLGKRVPIGPLALDEPINQTLAP

SEQ ID NO: 941358 - protein, 113 aa, Homo sapiens
GPGKAQEGYSPQFPPKCHRQGRIEFAYIGPPQVGKRARARIAKGLRLCRPKAKAKAKDQNQGPGCSPSFSFSSGSQTYPGPYKGFKVDIFANIRTKGLVRPPPPAPGVPFAWE

SEQ ID NO: 941359 - protein, 71 aa, Homo sapiens
WLQPRILFPLGHAAMLGLKYVYWTQLNMVQTLKYLAILGSVTFLAGNRMLAQQAVKRTAHEFQKKDGNFEN

SEQ ID NO: 941360 - protein, 56 aa, Homo sapiens
PPFGPPGGHFSKGACKGVWDWASSSPALETKALYAPPYEALFPSYFPFPNKGSQVI

SEQ ID NO: 941361 - protein, 103 aa, Homo sapiens
PPSFGKRGFGKPKVLPWGVPPRGGGGPPPKGFPRGGGLGGGGPPPFPGFPPPPPPPWGVAPFFPGGPPPLGGPGVFFPPPPPPPWGFFFFLGGGGVFFWGFFS

SEQ ID NO: 941362 - protein, 154 aa, Homo sapiens
NSHMPPVSRTLFLGGPSVFFSPPKPRAPFLFSGPLRFHGWWWALTPKTLRLSFIWSWAGWGCIIPKQNPGGGRSTARSVWLGSFPFFPRAGLIARGSSARFSPKPFPPPFRKPFSKPKGSPGVFRLAEDVLAVPRFHSFPGPRLGIKPPPLPLG

SEQ ID NO: 941363 - protein, 111 aa, Homo sapiens
GGPPPPPPPPSVWEKGFWETPGFPPGGPPPGGGGPPPQRFPPGGGFGGGGPPPPPRFPPAPPPPLGAGPLFPGGAPPFGGPRFFFPPPPPPPGVFFFFLGGGGVFFGGFFP

SEQ ID NO: 941364 - protein, 39 aa, Homo sapiens
SSRKGTERCWREASAIRRRQGKSSGAFLYNTPFFLLFFK

SEQ ID NO: 941365 - protein, 68 aa, Homo sapiens
ASLNEKDTNYTLNPDSLDWALYDHLMDFLADRGVDNTFADELVELSTALEPQEYITFLEALKSFVKSQ

SEQ ID NO: 941366 - protein, 145 aa, Homo sapiens
LSGMFAWHRAGDSKIDPQMEAAGFTAQVIILNHPGQIGAGYAPVLDCHTAHIACKFAELKEKIDRRSGKKLEDGPKFLKSGDAAIVDMVPGKPMGVESFSDYPPLGRFAVRDMSQTVAGGVFQTGGQKGCWSWQGPQVCPESSEG

SEQ ID NO: 941367 - protein, 124 aa, Homo sapiens
QGCVVAPNRGFSSVFPPPLSPIGVGGWGGFLQSLFVAVAGDAPRCFCPFKTPGPVPPPGFFLGRGGGTNFPPGTPFLWAFLGPPLTPFFPKNRGGPGRVFPGFFAPRGPPRGPPRGPPRGPRFF

SEQ ID NO: 941368 - protein, 104 aa, Homo sapiens
MGILFTGELWEFLSFERAPAIIYNILLFGLTRALGQSFIFMTVGYFGPLTCSIIPTTRKFFPILASVILFANPISPMQWGGPGLGFLGFGLDAKFGKGAKKTSP

SEQ ID NO: 941369 - protein, 163 aa, Homo sapiens
GLGNQIVPDAPKDHAFKWLRQVPKIEGVPGTQRVPTMFLSLLKSCSPARPGALQGMATVKDAFPACPLPICCERGASLPWGLSPGFAFFLRGERTLPLPRLGPTMPFPRREVFGPWDPIPFSQVFFWVWGEEGMISVGFDVLFLSSVGGGVRVCMKWNKLPPA

SEQ ID NO: 941370 - protein, 113 aa, Homo sapiens
NLEHIRARGPLFAPPVGGVGPERVGNVNVLGTRFKPQGSVGSLVAGVTGIAPGKVPYLGIPAGAQPGPPPFCCDQNIGGGNQGLEKGGPLFLDGGPRGPAVGLHKEDLGPFGG

SEQ ID NO: 941371 - protein, 94 aa, Homo sapiens
LWNGSQQCQDTRLDIPPRGLKMAVTFIGNSPAIQELFKGIEQFAMFRRKAFLPWYTGEGMDKMEFPEVESNMNALVFEYHQYQDAPPKKEEDFG

SEQ ID NO: 941372 - protein, 102 aa, Homo sapiens
PPGGGGSPPFFRGKGGFPPPELGKNGFLWPFNVGGGGGAPLMGLGGAPPPPGGGGYPFTPLFVGGGGGAFFPPGRGFPRGGGVLGGGVLGPPPPPKKRPGGR

SEQ ID NO: 941373 - protein, 119 aa, Homo sapiens
GTGRGPIPDTAVARLYLGAVSPGRLETSMWSKQGLERGGLALTKKMRGVSAFPPWPQIKRLWGQEGVKHVQGRRPVQGPTLRPQNLTSSKAPPMEGCLGDSVPPPYNVWLKIKALSKVA

SEQ ID NO: 941374 - protein, 87 aa, Homo sapiens
LAKVQGLGNGKRKAKAPPRFPPDFKSKQLLLETERLLGKASSNWSQAKRVLQEVREFKNLYKQMDLQTPVSPLRQTPPPSQYRKSLI

SEQ ID NO: 941375 - protein, 103 aa, Homo sapiens
FWKEPKPLCLGGSQPPLTGRHWQNRPKTKGVFMVSSLDAKPNFWWIPKASCLGKGQDVLRPGTHISMCFFTKKGVFFLRVGQGGCTHRHKKGGEGFLGAKLRL

SEQ ID NO: 941376 - protein, 128 aa, Homo sapiens
GPPGAHRSPANSGGPEVAGLPRGPPGEPLQGFFKIGGGGLRSPGGGRDCMVCFESEVNAALVPWGHNLFCMECAVRFGRGRTQSVPFAPSQPRKPSEYFPKPRAPASGAPSTGPPLDLFSPKAFWKAV

SEQ ID NO: 941377 - protein, 70 aa, Homo sapiens
LPPRGGFGPAPPQIRCRPPKRGLAGPQETGPRLPGPQFRPAPPPFGSRPFTPGFAGPGEDQIGPARPLFH

SEQ ID NO: 941378 - protein, 111 aa, Homo sapiens
GGGKPPEKAPPLFFLGVPPPGPPPPRAFVFLGPWDPGGFPRAPKGPKGGPPWPLWGGTPGVGGKNPPQIFSGGGGGKISFLGGFFKKFGPPPGGIFGFFCFLKKAPPPFCF

SEQ ID NO: 941379 - protein, 129 aa, Homo sapiens
FPYVLSIGAGFALIEGFIPWFPLFSGYTLGQTYAKIHFTIIFMGVNLTFFPQPFLGLSGMPRGYWGYPDWIPPMKHPIIGRVIHFFNSRKINNFHDLRSLRFEGKSPNSRRTPHKPGGVIGRPPPLPPI

SEQ ID NO: 941380 - protein, 112 aa, Homo sapiens
MPLNKNGPPPGPQYFPRKNKKETHFLKNRLSRPFLRFFGGPKKIWNRNKLWFLPPAPPPRFRKRFPPYFGFQKIFGVETFLKGFLKPLKTAFFFPAGTPPPGFGSNKFLENP

SEQ ID NO: 941381 - protein, 220 aa, Homo sapiens
GGGRPARFKFYGFWALGLAGQGHFPKTRGGRGLGFFCATYPSRTLARAQVESKTVGAPPSSSSPIYEPLNWTRSVVARELYPQEAQVQWKVGYSPSIGVSPESVPKQGSKGGPFSLSSPLAVSKAGFGKPKVFAWEVPPQGLGSPVPKRFPRGGGLRGKGPPLVLSSSLAPPPPLGFGPFSPGGPPLLGAPGSFFPPPPPPPRGFILVMLGGDGLIKGFF

SEQ ID NO: 941382 - protein, 89 aa, Homo sapiens
LECSGTILARCNWCLPGSSDSPASASQVAGIIAVHHHAWLIFVFLVETGFYHVGQSGLKLLTSGDLPASASQSTGITGMSHCAWHFFFF

SEQ ID NO: 941383 - protein, 129 aa, Homo sapiens
PPPPFVEDSFFFAPPPGGVLKFCPRGFFSPPGFWGGRRVVGFSPSPPRERFPPPPPPPPGGGGGGWVIEFVGDPPPGALFLEKDPPPRFFPGGLFFGGGGGGGPPGFSPPPPRTFTPPLFFFGGFFFSL

SEQ ID NO: 941384 - protein, 99 aa, Homo sapiens
PPRGGAGGFFFGVFLGFPPPPPPPPSSWFKGGGGGPPFFVGPSGDRGFFCPPRGVVGRVFLPLGAPPGGGPGFPPPFFGGVFPPLFFPRGGGPPKNYTR

SEQ ID NO: 941385 - protein, 109 aa, Homo sapiens
MGPPLRGGGGPPPPPQRGPPGGGGAGFLGLGPGGGGSPQGSPSRVPLWGGPGGKPGAPPNVFWVPPFPPPPGGVVGGGSRGGGFFPPPGFSALFPGLFGPPFFFFFGPP

SEQ ID NO: 941386 - protein, 105 aa, Homo sapiens
SSPPLSAPGWCCGKGGPGGIRGEKGALMVCGGPGGMFKGARGGTKGGFLGGRGMAPGGFGGGKKGGPGGPPGPFLDPMGGKKGGRGGPGKMDKGGPRPGGRDGPL

SEQ ID NO: 941387 - protein, 104 aa, Homo sapiens
MPFPIIFGGVNLTFFPQPFFGLSGMPRRFSGYPDAYPPGNILSSVGSFISLTAGILIIFMVWEAFALKGKVLIVEDPPLNLGGLFGCPPPSPPFEEPVFIKFCP

SEQ ID NO: 941388 - protein, 158 aa, Homo sapiens
HPSLEAGLCFWGSLFFQGVPFPGLPAAVGVSPFPTPGCFSGAFLGNLPWLRGPLARLGPGGVCPPSCLVFRGRLGLGRLGLWVLLEGVGGGQTPLVGGCRVVLGFSPFPGDVLAWRWGWDLGAGSTLFLEVAFVVFPLGGLGAPLSWEFGCWASGFPL

SEQ ID NO: 941389 - protein, 82 aa, Homo sapiens
STVRSGYLFPAPKRLGDRIERMVCLSLNLAPDAKVEEEAKKTLKGPPKPPPKAQGQKIKKWMWGPMKKKNPQRDFPLKKMDC

SEQ ID NO: 941390 - protein, 171 aa, Homo sapiens
GRQHTPPGAPGVSPQLPARAGDSVWSLVLGQSAPSRNPSPFSGGPCFRGTQGFNTRSVGSRPTGLRRKKPRGGGAPGVFLKRGPQPLGGAPPRAPRGPGPRGASPPAGGGRAKGGWGPPKKIFGGGGSPKTPPGAGLGRNKFLAPPAPPPGPPGGSPGARAPPGGGPPPPT

SEQ ID NO: 941391 - protein, 62 aa, Homo sapiens
LKTPGGGSPPGVLPWARGGVPFFPGDPFCPLGLFGGPFKPGWAQKPGGGGPGFPGFFCPPGA

SEQ ID NO: 941392 - protein, 28 aa, Homo sapiens
ESVGEVMASQDDTRQPNSFPTTGGTNRK

SEQ ID NO: 941393 - protein, 112 aa, Homo sapiens
MLVFYERGPRGQVQWFAPVIPAPWEAEAGGSPGVGGSRPAWPTWQDPVSAENTKIGRAWLCTPVIPAAREAEAGESLEPGRRRLQLTEIAPQPFRLGGKSETPSQNPKKKEK

SEQ ID NO: 941394 - protein, 50 aa, Homo sapiens
LPQLLHQYPPFIINGYKSSALSVETDYTFPIAEKVKAFLADPICLCGCCP

SEQ ID NO: 941395 - protein, 101 aa, Homo sapiens
GTSPDESGQPVPFHSTQVLQGQSPCTLFGLVIWEFRWDAHSLLQRPHQFLGHFPVCGSSCGPLRVHAWEVLWWGLPGGLAHKALRNRGSLIGINHTWSPPA

SEQ ID NO: 941396 - protein, 81 aa, Homo sapiens
PIAQQNRVLQLAKKLGSLVENNERVFYPKQGPYGGYFQDQKDGSRKNEGYMPPGGYPQQQFQTAYGAFHFVSRLGHPPLKS

SEQ ID NO: 941397 - protein, 106 aa, Homo sapiens
CFRRKEFKGKWAELEQWAARRSGSACNPRTLGGPRQVDHEVRSSRPAWSRDQPGQRGETPSLLKIQKWPGVVAHACNPSTLGGRGGQITRSRDQDHLANMVKPHLY

SEQ ID NO: 941398 - protein, 61 aa, Homo sapiens
FFGGPKKKRGPTRGPVFPPPGPVGGARGKFWPPPSTVKGPGPPREKILGGPPPPGKKSFCG

SEQ ID NO: 941399 - protein, 103 aa, Homo sapiens
PPLPLGWGVAWAVYINPGFFGTRWFCWPPLPRVLAPLDNPRGRFPASDFSLGGGRFPFFPGARVFLLAFLGSPFGPVLPKNPVGPGSGFPGFFCPPGSRGGGL

SEQ ID NO: 941400 - protein, 177 aa, Homo sapiens
KRTHTGERPFSCEFCEQRFTEKGPLLRHCANRHQEGRPPFCQIFGKTFKTVEQLRVHVKRPKGVRKFECPQCGFKFSPQAPLRRHMEIPGRVKNFNPRQGKLRNLIIEDEKMVVVALQPPSKLEVGSAEVILESLAQGGLASQLPGQKLCAKESFPGPGVLEAALIIPTAVPQGCDT

SEQ ID NO: 941401 - protein, 105 aa, Homo sapiens
SLQRVTSTGQPASGMPLLSSFFRHRGPPSIQLPERQLCTPKEPPQTPASGQQPLLALRTSLLLAACKLSQNTPVGSDPMPSLLLSSLLRAPSHHPCLPVPATHVG

SEQ ID NO: 941402 - protein, 111 aa, Homo sapiens
RPEDHPPERNQPGKRAHDDAASRSLRVCRFQMTLQCPQGYSIFIDCNPASLLTGPEPPSSDCGAKEGPRAPAWAPSLEVDMAVGGSENQPTHHKKTQTGKHKFLGGQGSSV

SEQ ID NO: 941403 - protein, 183 aa, Homo sapiens
THSFVFPTLPPSMPGALVPLDEHQIFVQGSFGAPHLFHVGGGAGETPGLKNKALGLWQGSNGLSPRFFPWGPPLFPTTGGGPSSIKLGFFAAPFLAPPFFFGPPPRGRAWMFLGPPPRPPWVVGFGPQPFTREGGFPPPYPPPPPVFGPPGFKMGEGVFGRLLFLPLFRCFPPLLKNKNAPGG

SEQ ID NO: 941404 - protein, 64 aa, Homo sapiens
MQLGSGARAWALRAALYLLRARLPCSPSASLFVRSCPPSRVAGNRGGLVAGFQKDAPAVRGGHA

SEQ ID NO: 941405 - protein, 88 aa, Homo sapiens
SSSSSVQFEMVQKNTFKTPSCDMTPKQSKVVKAILWLLKIKKRGKKELPARAEAIIVSLEENPLVKTLLDVNLIFCVSCPIFIWGYFA

SEQ ID NO: 941406 - protein, 78 aa, Homo sapiens
MSNSRPRSRRDAGGGAGAAGRDELVSRSLQSAEHCLGVQDFGTAYAHYLLVLSLAPELKHDVKVSVLFSHLLADPTSS

SEQ ID NO: 941407 - protein, 160 aa, Homo sapiens
VKSAMALRQPYSAESTSGGQLVTCPGGAHLSMKPGALAAIGAAWRPAAASSGAVQGQRRLRRVQHEELAPAQAQQRHLVGHRQLGKKGPGGTIFLLPLQPRRQLAHVVDASKGATYNPLPEVFFSSKKNVSAQQLRDQFGHRLPREEVSAARHCRQRRRG

SEQ ID NO: 941408 - protein, 66 aa, Homo sapiens
LFNPRAPFGPPPPFPGGPPPRPPPAKFGPGGFNSPGAPPPAVGLFILGFETKRDFPPGGGPPPKNP

SEQ ID NO: 941409 - protein, 72 aa, Homo sapiens
GPMRGDSGRKEKPIPPPVLEDGGPHHPGEGGNRVFEYRPRRGVGSPIVDMAPYAIGGPDQEFGGGGGPVGFL

SEQ ID NO: 941410 - protein, 91 aa, Homo sapiens
ETLRDGRVKSTNPWANQDEREGGVGGRAKTKAPPSPQAIFPIPEAPAACAPHHPGQGNRRKCNFRLSARLPKTASSCPGLFPPPPPSKDNR

SEQ ID NO: 941411 - protein, 112 aa, Homo sapiens
LVTVVPGPFLKRGIPSPEGDGPMRGPEPEGADSKPFISVWTQTPWGMTDSFNPMSAGDGAVPGQLFGVWWGPAGPAVPASLGANRVPWEKTWKPFNEAGDLGGFLETQRNGP

SEQ ID NO: 941412 - protein, 66 aa, Homo sapiens
PRNVHGSTQPTAGLCQSMAHDKNPKFFNVFKARMKSAHKRETKRVVPKALEKLQFLNGKKKKPTCK

SEQ ID NO: 941413 - protein, 67 aa, Homo sapiens
ADPTPFPLLEHFVQLCMEPVGLQCQTVSQATGAMCITGAGRQGPHSPSETGPGARVFLGPGGGHFSP

SEQ ID NO: 941414 - protein, 67 aa, Homo sapiens
AVHRVCRRRSQLVHMGSCLSLHLAVTDLCLIYDLHEDVVSGHSVHLLHNVFASLVRTPRDDSQIGLA

SEQ ID NO: 941415 - protein, 102 aa, Homo sapiens
LAGNASKDLKVKRITPRHLQLAIRGDEELDSLIKATIAGGGVIPHIHISDWRKGQQENCLEGCFTRPSFLTLSLVLVTWDKRENKWGICWTFLDTQVKMEKA

SEQ ID NO: 941416 - protein, 53 aa, Homo sapiens
RLNPKALTLDQWLEQHKGDFNLLGPARLAAPCWDWGGQRGIGKNTPIKPLFSQ

SEQ ID NO: 941417 - protein, 90 aa, Homo sapiens
KSETAVCDIPPRGLKMAVTFIGNSTAIQELFKRILEQFTAMFRRKAFLHWYTGEGMDQMEFPEAESNMNDLVFEYQQYQDAPAKKEEDFG

SEQ ID NO: 941418 - protein, 129 aa, Homo sapiens
PPNPPQEIGGGVFLNPPLTPPPPPGWKEGEMAPPPPPGPPLGGAPPPPNPFFPFPGEGQEGPPPFLGFFPPQRGAQKGGVPRPGFRAPFGGAPPILGPPPKIFPPPGGIPLEKNKKRFFHGTNTHKKHT

SEQ ID NO: 941419 - protein, 69 aa, Homo sapiens
NTVGPLLAAATGAPAPLYLGGLPEPMAVQPWPPAYFGCIRRLAVNRSPVPITRFVEVPGAVGASGCPTA

SEQ ID NO: 941420 - protein, 105 aa, Homo sapiens
MQNRGVALMLQAHWSMTKMKGKGGVARQQYVQRDLWLTRKAVHATAVPAYSEGRGRPLWERGGAAPSGRGEGPPPLGEGRGRPLWERGGAGFCFKSFKTLKNICV

SEQ ID NO: 941421 - protein, 124 aa, Homo sapiens
ALAETHPLQRSLPPGQLLLRAAPTAVHPVRDYAAQTSPSPKTGAAPGRIVAVIGAVVDVQFYEGLPPILNALEVQGRETRLVLEVAQHLGESPVRTIAMDGTKGLVKGQKVLDFGAPIQIPVGP

SEQ ID NO: 941422 - protein, 144 aa, Homo sapiens
PANPVSLSFPFQPLVAAGCNTFPRKIRCRPCLRAGALGPGGGGGDPTAGREGSPELAPPTPRVEPHPVPFQALAMIPQKARLHPRPRASGLQVLGSGSPFRPSTPSIPVYGPPAPPCFIPEDPSPWPLSVHVLRLINGHLVFSF

SEQ ID NO: 941423 - protein, 142 aa, Homo sapiens
PPLPCCQGRTLHNQRTPLFSIGPGGVGAPPPPRAGVVLGRQGNLPGFGHWWVGPQNPNRTKGVGFGQPLWLEGSPWPANFPSPNPVSCGLVGGSQPPLDCPPRLFKVKIVFWIFTQLSRSPPPKKTQKKTPRGWGAKTGKNL

SEQ ID NO: 941424 - protein, 147 aa, Homo sapiens
LWALFEDPPQKNRYILALFSKRKALSRELYEYCIKEGYAAQTLVAKWKKQGYENLCCLRGIQTRDPNFGTNCIFRGPKNKLEVGRIIEGPPWGCCGCFGLGWRAPPWTLDFAGFCLSPPPLSGSNEQCPRPELEPGFYGEGFPVYQL

SEQ ID NO: 941425 - protein, 79 aa, Homo sapiens
MNFIHLHFSMWLAWTGDLERCGGMDPLEPRDIRSVPRKECTGLTELQLTVLFLAILCCLFLGVDFVRAKIFHSEEIKAQ

SEQ ID NO: 941426 - protein, 117 aa, Homo sapiens
EPMETESGDTSFEGPAQVYLPGRGPPLPGEELVMDKEAYVLYHRAQTGAPCFSFDIVRDHLGDNRTKLPFTLYLCAGTQAERAQSNRLMMLWMHNLHGTKPPPSKGSNKGPGRGKKK

SEQ ID NO: 941427 - protein, 188 aa, Homo sapiens
GSARKLVCKVMALSLHFFLAGRQARPVQERLQVSDLEAQALGQGKAGKGTVPKGSGVFDPALSAAGLSKVFLWRSPRLLGSLCFQGPAGKTAQWETAGPPGWGAQTFVPIVPTFSVFNSPGMEVRDPRNAKHQQAQRFEEEPYRGRNQILFVLAGMATMVGYPLLNGIVSIQGAKPGWAPGTRTLGMG

SEQ ID NO: 941428 - protein, 143 aa, Homo sapiens
ADAREELRAAGWSWLDTRGHLRLAANGLLVDANVPAAMRAPRRREPFAGQVGIELASAMLLTPDRVVSIRPLATQIDRAPSSVSDTIAAFRDANLITPAGHPRTPELFWELASRWKPTDFAVANEPREGGLLNALRMNLDDFD

SEQ ID NO: 941429 - protein, 83 aa, Homo sapiens
KLLSYHPQLNSSQRSGVPHLLTFSAMPFCCLTAFLFIIFICSWSLGFGVYMGTGYGGVVGQRATFWVRKQKCLFPVRAMGLQA

SEQ ID NO: 941430 - protein, 89 aa, Homo sapiens
VVHTVVYPVRCGTAGDPGLVDFSHWLVCLAGSLTGCHTFLHCSRKFEQKQDRRRRIQALCLLGVTAYRRDPCTLTITRTMQKPVRRKSQ

SEQ ID NO: 941431 - protein, 53 aa, Homo sapiens
KKGATPGKAEVATPDKKGAAIPVKGAKNDKNAKKEDSNEEEDDDSEEDEEDDE

SEQ ID NO: 941432 - protein, 86 aa, Homo sapiens
GHPSVAVQLRGFGRTYRALVGQRTVAIHQSQLELLLESRPGSAFVLVELRVSPHSHLVGCSEPAVVGCTAYRRDPCTLTITRTMQK

SEQ ID NO: 941433 - protein, 42 aa, Homo sapiens
MTVPEQLQRPCGCTAYRRDPCTLTITEDYAETSPTTLLVRRK

SEQ ID NO: 941434 - protein, 99 aa, Homo sapiens
KFQKRGSPGNFESGDKKSCREIIPQSGERHLRSGSRIVRRNLGVQKFDLGIICVDNKNIQHINRIYRDRNVPTDVLSSPFHEHLKAGEFPQPDSPDDYD

SEQ ID NO: 941435 - protein, 68 aa, Homo sapiens
VTFGTPEELFVGLLLVWCLASFAKFACQHWGHCARPVRPEAAPRRKGATRSELEELVSAGKPTLRAYE

SEQ ID NO: 941436 - protein, 70 aa, Homo sapiens
RTCRPATKHAIRFQVIKQVPSDQSPPMLTHSHPITVLLRVESKLDPVKYVVPYLFVGSQRGVYSLAMDSY

SEQ ID NO: 941437 - protein, 86 aa, Homo sapiens
ECAPSAEKETRVGYSSPQAGHTVICPSLDESRVLVGSRGEEVQADWSMGGHGWATPGVVAHTCNPSTLGGRGRWVPCQEFETILAN

SEQ ID NO: 941438 - protein, 157 aa, Homo sapiens
KAPTKVGTYLSVTSSSTHIAGRVSPVKLMHRSPVPCVPFGSVAFRVTKPSASGLAGSGTSASTLPLQSPRRTSISPCARLAFSKRRLVFVVGQLEVVRNAARADLHAADAVQLCLRPAPARLEDVDIEHRTRSLARAVVFQAQHQALRAHAAEQLIA

SEQ ID NO: 941439 - protein, 116 aa, Homo sapiens
PSFPHAPPYRVQKLSPQPQPLRVHVRSIFSSLRQDALFLARGGDGPPSRVWSTLSRLLRALGICPFTFPKGWSHTSTLTFGHRKCCSRGPKSQALSCFRQGPCFRIWSAGQKRPVQ

SEQ ID NO: 941440 - protein, 41 aa, Homo sapiens
ADYMYGREGTTMLVVDEPKRDYMEGRRNVTRNYNYWLYWVG

SEQ ID NO: 941441 - protein, 71 aa, Homo sapiens
IASANQSFRLGVTRVLSSVPFQQCTGNKRAGLGKGLAAAGRPLLFKPRAHCWLLWAPVWAGAALFSLLAFL

SEQ ID NO: 941442 - protein, 44 aa, Homo sapiens
LVCLKNIISPDAHQKRSSERNTDKSKRNEVEREHQEREPDETED

SEQ ID NO: 941443 - protein, 114 aa, Homo sapiens
PSGPNSAGYALYWIATELTIACKFVELKEKIVPGSGKKLEDGPKFLKSGDAAIVDMVPGKPMCVESFSDYPPLGRFAVRDIKQTVAVGVIKTVDKKAAGAGKVPKFAQKAQKGK

SEQ ID NO: 941444 - protein, 136 aa, Homo sapiens
ISTGGTGEPSKAKAMLEAFTVSGEVPDPGEGSALFSVVDEVAAWPVGAKADGVEGAAQLRLVLGVAGQAAELVDAVCELALVPVLTGTVFLKGAAQLRLVAAGVDLAAPGLLLGGQQPLAPFREGAVSEAAVSRAQ

SEQ ID NO: 941445 - protein, 66 aa, Homo sapiens
FQLLLSEAVSRAAKAAGARSLTSPESLSRDLEVPEVQESYRQQLRSDIQYRQWEDPATVPSAPPHR

SEQ ID NO: 941446 - protein, 80 aa, Homo sapiens
PALHLAFRKGDVVLAQLLIWYGVDVMAPDAPGNPALTYGRQASSQECINVLFQDGCPHECVEYLFYLAAVSLGPKPNGEN

SEQ ID NO: 941447 - protein, 34 aa, Homo sapiens
TPFPHVVINVETVTYKSVKFNVWDVGGRTRSGRS

SEQ ID NO: 941448 - protein, 48 aa, Homo sapiens
DGEFFHALSDPTRLKLREFILAAERTSGECVEHAGISQPRVSVHLSCL

SEQ ID NO: 941449 - protein, 38 aa, Homo sapiens
GTLSRLSIKPINMQAPHMLHNGALQILQHQQQSITWGY

SEQ ID NO: 941450 - protein, 47 aa, Homo sapiens
LRGITKYAAHVKHWIHCGVIALAPTSNMWKLTLVTLKLGPKDSRSQD

SEQ ID NO: 941451 - protein, 109 aa, Homo sapiens
GEHHPPVFHVHPQGGFPQDQLQHLLGRIQKAGTEVVKAKTGAGFSTLSMGYAGARFVFSLVDAMNGKEGVVECSFVKSQETEWTYFSPPLLLGKKGIEKNLGIGKVSSF

SEQ ID NO: 941452 - protein, 36 aa, Homo sapiens
TLVHALLWASVEEVMLSCELDITYQEPHGTQPAHEQ

SEQ ID NO: 941453 - protein, 34 aa, Homo sapiens
DKVIFHMFDVGGQREERCKWIQCFNDVTAIIFVA

SEQ ID NO: 941454 - protein, 77 aa, Homo sapiens
MNKRRGFSEIVSVRRFGRSFGGSRFAGTLGAGSQPCQPALSRQRNLKWTLWKIEAIAPEFTNRNPRNLELLSVARKE

SEQ ID NO: 941455 - protein, 71 aa, Homo sapiens
RTGLTGGPDSNYTTRATVTKTAWYWYQNRDIDQWNRTGPSEIMPHIYNYLIFDKPEKNKQWGKDSLFNKWC

SEQ ID NO: 941456 - protein, 38 aa, Homo sapiens
MANPLVNSACEGSRHGSLLRNLTKCRAKVRVGFTPWQI

SEQ ID NO: 941457 - protein, 124 aa, Homo sapiens
WKAGGKRVGRAKKLEAFCREPRTKDGNARCTSEESGTGTPMADDQTCFAWLGELGHGKNTGLAPAQAQPPLGHGGEPAPGPPGRSTSIIPGASPCLTPKSMSNTFSCVHNSHVVQRRRSITVSR

SEQ ID NO: 941458 - protein, 104 aa, Homo sapiens
FFPPPFGDFAPPAQNFGPGAPFPPPLAQKVDPPPPPPPKKKGGFFFVAPPRAFGPLGGVLKGGEGKKKIGVFFWDPPRPLGPRGGVFNWGGGVPPFFFFSPWSF

SEQ ID NO: 941459 - protein, 70 aa, Homo sapiens
YDYGDDIALLKQAQKVKMTTHARTICLPCTMEANLAMRRPQGRTCRDHENELAEQTECSCSFSRPEWENT

SEQ ID NO: 941460 - protein, 48 aa, Homo sapiens
YTPVLCHTTLPPHFGPRLKLLLGRVSSCRYCALNGYLNGGNNSINQES

SEQ ID NO: 941461 - protein, 40 aa, Homo sapiens
KNIPVIEAARNPHKYRMLIAMVDLIYADVAQPDQNRIVAL

SEQ ID NO: 941462 - protein, 74 aa, Homo sapiens
FLFIQDRIIVPPLTGADSEIFLCVDCFGKCHLFYIGDWWGLVHVLLYRSSMLPLLLVATPLNLCGVEGTYLTFF

SEQ ID NO: 941463 - protein, 57 aa, Homo sapiens
ERKKAKDEEEEKRKPKKNKQEQMQTTHSIRLGLALNFSVFYCEIQNAPEPACLLAKQ

SEQ ID NO: 941464 - protein, 57 aa, Homo sapiens
GSGVYSEQISGKVVLNLRFPSKDFLSEQIQLVEEQDHRDECAAICMFQMLYEEVQSL

SEQ ID NO: 941465 - protein, 118 aa, Homo sapiens
QYPIPPDNKYLGVLGSPRIFGKRLSLLSRGSLMCTPARSPVPRLDGQVQMYPKTLIPHELPATFLDKISPTSLRALGKNLSNTLFMLPPFSMGESPVYESSLTSTPNQGRLFYIVVPQ

SEQ ID NO: 941466 - protein, 151 aa, Homo sapiens
LGWKFPHVSGISAGSSLTANYISRDPERTRLSFTDFAADPRFGNLGTWLAGRGYFDGEYIYQRTAEPHQALPFDFLTFCASSQAFRIGATRTSDGEQEWFTREDMKTMDDLMARIRVSSTMPGFMPPVTIEGVEYVDGALGTQVAFLSTAL

SEQ ID NO: 941467 - protein, 77 aa, Homo sapiens
MSIPCIAGAGIPRLLTDRNVKITFFNPAGRGHRILYQHLKGTTRQRELEILTPPSWDQTTIKALTATDKTNPRDTYA

SEQ ID NO: 941468 - protein, 174 aa, Homo sapiens
AAQRMPSPCCSHNVHTFDLKLVWVDPGQDGCTFHLLTPEEEFSFCAKDSQGQAVWQWKVTWAVHQALHGKKDFPVLGAGLEPSQPPDCRCAEYTFQAEGRLCQATYEGEWCRGRPHGKGTLKWPDGRNHVGNFCQGLEHGFGIRLLPQASEDKFDCKCHWREGSMCGYGILCGS

SEQ ID NO: 941469 - protein, 50 aa, Homo sapiens
MSGKLGSAGMGTMLPGLKNTYPTPILKTILNLSPYPEVYTLPGQASFVAE

SEQ ID NO: 941470 - protein, 40 aa, Homo sapiens
TEVTMLLTILCLAEQKLADSDHINQQCPQRPEDQHPSVNK

SEQ ID NO: 941471 - protein, 170 aa, Homo sapiens
GSSQANGGLSERVVVKAKNWAQLAQGREDSFLSYEQVTQMEVHYARIIIVANKDRANDDLSRVFDKGSVFHTTRPKREYEIDGGIYHVSSREKMEKDIQAHKFIEAGQYNSHLYGTSVQSVREVAEQSRACSEPRSCHCTPAWATERDSVSKKKKKKKYKNWPGAVFSGL

SEQ ID NO: 941472 - protein, 115 aa, Homo sapiens
GGGKGGGFLGPPWGPLFGAPPPPKGGGGGVYPGGGGSPPPPRGRGGGTPPPLGPRGPLVPAPPQTRGPRGGGVFSPPGPPPWGGGGGGPPPGGPPPPGGGFGFFFLKGNKTGGLF

SEQ ID NO: 941473 - protein, 106 aa, Homo sapiens
ALRFFFQGGGGWGFPNPSKPGGLPFFPKGGGLPPLGVIQTFGVRGPRGGFLGVPIKGTGGPWANYGNRGWPRAREAWGFNPPAWFWPRLAPPRPAGPDGLRKLFPL

SEQ ID NO: 941474 - protein, 97 aa, Homo sapiens
GGVRQKVALVAFGEKKVAPWILVVPVEFSKVPLVETKVASLVARARTKVAFVEKKKVALGGPPALFWNKLEEKKEALGALEKLIKAGPLRSPKIGPF

SEQ ID NO: 941475 - protein, 84 aa, Homo sapiens
NERQRVAGDLHKAHQSLEPYPVQNSKSCWRPTVIENSDVSPETESSEKETMSVSLNQTVTQFTQLLQAVNPTLPKEKEPFPGLE

SEQ ID NO: 941476 - protein, 115 aa, Homo sapiens
LIALVPKTKGPTVASQFQCLGELGGPSQTLLFFKAQPAGGGFWTLRPVNFQPSGRVFGPLQEIRPAFCVPPTIYTGFLFLMEFCTFFFFFLQKPLFTRWPFFCLWASQKSPGFGP

SEQ ID NO: 941477 - protein, 144 aa, Homo sapiens
PPLLSPHPSLPGVQPVPPQQAGDGLARCGDPTGQPQPGRQAPREVRSQHCLPASQGPVTGKAPHLLHPEWWRPERSPANPPVHRGTGAGGRGRPAEQPVPGTPRRPPRVRAGLWAPLLVEPGSASSVSAASVPGASPTRTPRLG

SEQ ID NO: 941478 - protein, 108 aa, Homo sapiens
RKGGGRGLANVEGKGAENLTSHLLRFPGQLRGECGQGECGQGECGHGECGRASCGQAECGQGVWARQVWARRVWARRVWETLGLRHRRREPEKLLGEPAPKQSARKRL

SEQ ID NO: 941479 - protein, 109 aa, Homo sapiens
FGPGVHLLPPPWEKLAFTKLVPFEVLGTRFQPQGRFVSLVPGVPGVAPRKVPFLGFPAGAQPGPPPFCCAQHFGGGTRGLEKGGPLFRHGGPRGPSVGFSPEALGPFGG

SEQ ID NO: 941480 - protein, 152 aa, Homo sapiens
EGGGGEPGVVLLPPRGGCITHPGALLLCVGVFFSPPPLWVWGGVGGRGKNIKTPPPRGGRGGAFFFFLNPPRGKKGGGGGGVFFFSRGGGGLGPPPPQEGLFFFPGVFLGGGGPPPPPGFFCWGGGVVGGPPFFFFPPPPGGFLPPPPPGGG

SEQ ID NO: 941481 - protein, 79 aa, Homo sapiens
GFPTVGGAFGAAPLFGVTGGFQGFPSTLCCPGMAVGNCITWVLSPGSVSGPLFKSGPQWGVFVSCFFGAWKERASGGGF

SEQ ID NO: 941482 - protein, 34 aa, Homo sapiens
SPPGGLFSPILYREWIIRDPPLFPSFPYKKGVPL

SEQ ID NO: 941483 - protein, 109 aa, Homo sapiens
PPPPKSPPAGGPPKMGGYRGGPRAPPGFFFKIFFPGVGGKFYQGVPPFNTPLMNPLGFPLGPGGCLPFWGVFLGGFSPLLGGGLFFLFFPFLGPFGGPGGKKKGFFFFL

SEQ ID NO: 941484 - protein, 129 aa, Homo sapiens
GSPPGPGGATSSPRRSPSGPRGAPTSPRDAPSGPGGPPPTFRGPSVGSWGPPSASGGSPLKFWGAPPNFHANVEAPISLRAREHTSPSPNQLRRCSLPQQAQGQVVLPFPPERRVLFCTAPRSLNSLPQ

SEQ ID NO: 941485 - protein, 111 aa, Homo sapiens
KPPIYPPPRPQDCGLWEAPLKCLAPPKVGMGPAQGGPLKFTPFCGTKNCFKGAGQPVFSPPWEGGPGAAFNGPPAPGFIFFGGHPFFGFLGFFIIQPGFAGLMPIFPENKK

SEQ ID NO: 941486 - protein, 111 aa, Homo sapiens
RESGRTRGRSPFPQQSLMTPQTSEKLLFPGKQKILQGCPLSDPRSCGIAHGRHPSGEGTYGSSGHRRRSDGSDVSLPPSLLCSCNEHILVGDSSYICKVPSEYTPESRFIW

SEQ ID NO: 941487 - protein, 81 aa, Homo sapiens
YGQIFPLPQGLVTYISAGDRRMPSGWALVIDQVPPTLVTRLDGPPPLPHTAAPARAERGAMPPPAQPGTGCPGAEVPFVPG

SEQ ID NO: 941488 - protein, 67 aa, Homo sapiens
PFKPRALVELVKPKPKAPKEPLKAVMDVFPAFVKKCCKAADKEPCFAGGGKKLVAASQAPLGLYPPI

SEQ ID NO: 941489 - protein, 70 aa, Homo sapiens
NLVALQVAGRRWKPGGLAIGGQAVGGLAIGGQAVGGLAVGGLAVGGQAVGGQAVGFLVFSHSQSEDKAEA

SEQ ID NO: 941490 - protein, 108 aa, Homo sapiens
PPPNPPRGPGGHLGSPPGALAKKGRAGPRPHQNQNPGINKGAPLGGWGEISPPFWGAREGPVTFKKGGSPPAPHPPKGFFLSPGVLGPKGGIFAFPPGGFFFFFFFFF

SEQ ID NO: 941491 - protein, 117 aa, Homo sapiens
ELRADLTLITHMSLPQSYDAASGVDPIDADAYFVFGSGVNEDVESPELTSRPLPKILLSGAPKVETPALNIQNKIPGQAKSPEEDKEKVPLFGSERKMGPAEEDTNGYFEKPSDRLF

SEQ ID NO: 941492 - protein, 207 aa, Homo sapiens
LKGHGASRCCQMRETVVGHADLTPSKRPRALHLHREIAEGGEPWHVSKGPWAIADEKKAKAVLPPRRGKRLLREGACEGGCCQVLDAIACLKNLMKEQLWSPEWIQLDKQITPLLLNYCQCKLVVEEYYEVLDPCFSILNKFNVKAFFKRGKAPAVWNAQEAQAYFSKVLELDPALAPVVNPKLRALEARIRQKDKDKARFRGIFSP

SEQ ID NO: 941493 - protein, 106 aa, Homo sapiens
ASRNPRPGPAGGPGGFPKHPPVMWAFQETSVESAVAPPFPAGIFVRLEFKLQQPTCRKRGWKKPGCKVGPNGRKRKCLACIKLGFEDKVLGGLVPCPIKTQVLGGV

SEQ ID NO: 941494 - protein, 115 aa, Homo sapiens
NPPRGGFSNFPGKVGSLFPKKRLGWGGFGGPGGRLGPMLGPFFFSKKNPNPGGGPPPPGGGVGAGVLVFIFPPPQLGLFPGLFFPGGAPQGGFIWVGPPKGGRFPPAPPAPGFCP

SEQ ID NO: 941495 - protein, 95 aa, Homo sapiens
SFIMAALRNGYRPFPACLVEQPPRGAFAEQEKALHGAQTRLRGTFFSLLFPPTRPKYKQGNVWHSGFHELKTKPHGEKCKTRRMGEKWSPALMLL

SEQ ID NO: 941496 - protein, 99 aa, Homo sapiens
FVNDYLDGPCTFAQLKELPDERGHKMFVINRSKPLFPKGSGGGAPLFRPGTGGGAGTPRAPPGRLRDPLLGPRARGLRGRRRLAGAASRMLRQYKVEAA

SEQ ID NO: 941497 - protein, 30 aa, Homo sapiens
RGQAGVMGFPGPQMCLGEPGKAFLITIVFA

SEQ ID NO: 941498 - protein, 82 aa, Homo sapiens
GVHPGPGPFLFMGWNRFGEARLGCAPRFQEFPRAYKAARAAPLPPCEVALHKGLGAGEGLEKEGWAPCFGGDGAINKNSVPP

SEQ ID NO: 941499 - protein, 125 aa, Homo sapiens
QPWGSRAPFVPRSPGGQSGAVVPPPWARSTPLAGCLGPPQQEGGQTGQGGPLNPQPLGGPPPLGGMELFLPPPARGRFALEKDPPSFFFLVFDKPRSRGGLIFLGETPKLVFLGAGAPFPPSKPD

SEQ ID NO: 941500 - protein, 86 aa, Homo sapiens
LLDLPGPIKLAQALLLSLPQRNDSALRALTLPIVFKKYGPEALAGNQAPSLLEAQEDVLLLDAQAQVKGSEDAAKVEGGGQTQQLS

SEQ ID NO: 941501 - protein, 72 aa, Homo sapiens
LPRVFAKGRLFHPGVFIPKGTLPFSFLGGGPQFARVCFPIGPTVGPGPPFFFHGGKKVLGLFWGRGFPLPPF

SEQ ID NO: 941502 - protein, 136 aa, Homo sapiens
EELESRFQLVDSRSQGRFLGTDRNLDTVGLDSGHIRGAVNMPFMDFLTEDGFEKGPKKLRALFQTKKVDLLQPFIATCRKGVPACHVALAAYLFGKPYVAVYNGSWSEWFSRAPPKNRVFQGNFLKGLNRDLFCFL

SEQ ID NO: 941503 - protein, 74 aa, Homo sapiens
AREHTLRDYYPHCLRSTYLGLWSGVPSVPCTSGTPNPLCTQPVSHGAHNHVAGKPDKRALPDPPLPPENQPLGH

SEQ ID NO: 941504 - protein, 149 aa, Homo sapiens
AYTRAPPRPGFRLWRQPKVLYPCAFPAGVFQRVQLRQVGVATLSGTLGILAGHVAPFQVLRPGLVVGHFKGRPPPSQYFVSSGSIAVNPDFLGQLLAQKAVTLDMLDLGATKANLEKAQAELVGATFKAPRAKIQIRIEAHQALVKALE

SEQ ID NO: 941505 - protein, 140 aa, Homo sapiens
NKALGQGDVSADARGGPSPPGSRRSGAPDAVHSLAECYFHQPEAIEEFPVPALHHPVFQQESFTRQVLWKLLKVVKFGEVIFSTQLAALAGNPKTARAVGGAIKGNPVPILIPCPRVVCNNGAVGNYSGGLAVKEWLLAH

SEQ ID NO: 941506 - protein, 110 aa, Homo sapiens
GFPPGISRAPFFIGGPPFFFFFFGPPPPWGPPGPGGGVLPPPPPPWFFFLGGLPGGFLGGGPPPPRGVPPGFFFSRGPPPPPPGGGPGVFFRCFPPPPPGGGPLFPFFFF

SEQ ID NO: 941507 - protein, 151 aa, Homo sapiens
LFKEGVMVAKKDVHMPKPPELADKNVPNLHVMKAMQSLKSRGYVKEQFAWRHFYWALTNEGIQYFRDYLHLPPEMGLPPYPVTVQKLAGLGLKVWRVSDLRDSTEGKLAENPSRRSVGPPGAPKKTEAGGGSPTEFQFKGGFGCGGGHPPQ

SEQ ID NO: 941508 - protein, 113 aa, Homo sapiens
PFPPPGPQILWGWGGHQGPPWENFWPPPPPLLGTPLGGPPKNPGGGVFLGFGGPIPFQGFPEGAPPSPKKFFFFPQNLFFSPAPLKGFFFFPPPPRGFLGELFRKKKTGVWAP

SEQ ID NO: 941509 - protein, 104 aa, Homo sapiens
QFLTQCPGPCSELNPLQQSPGKSPWKTCNGNLHPEARPFPCYPTVNRTPCVVGCTRVLGFWIPWGLETPFSTNNPCVPRSSQLAGKEFNPTKDKGPYYDGWMLV

SEQ ID NO: 941510 - protein, 70 aa, Homo sapiens
VFREVFCGKNRAKKVFLGGNRKKPQTRHGARGIELGGPRGPKHNFPKRVFKKEGEVKNKIVAVSGAEKEG

SEQ ID NO: 941511 - protein, 190 aa, Homo sapiens
HQRVEVLRTWGYVTVGTVKLAGRVACAMSSHELLLTELMFDNALSTLRPEEIAALLSGLVCQSPGDAGDQLPNTLKQGIERVRAVAKRIGEVQVACGLNQTVEEFVGELNFGLVEVVYEWARGMPFSELAGLSGTLRGLGSPAFNAWVKRVPPLGGAAPLVGKPVLGAKMETAATLLRGDIVFAASLYTQ

SEQ ID NO: 941512 - protein, 77 aa, Homo sapiens
HRAALHCFPSTTAILSLIGCVLSTIHSHRPNEKQEGAPCPKNPKCLFPLQVDSDIQSCTAHLGLLMTPGCPTILSDL

SEQ ID NO: 941513 - protein, 125 aa, Homo sapiens
AILVGGRIILPLVHAPPPALSLLTQGPCWGSGMLRTSSSPAPALGRPLPVPASLVLPPLFLDPQWLSHGYILWVGAPHRTAGRFVFSGIPSLGSPGSPSFPAPRGWGMFAIKERFVAPVLAGLSW

SEQ ID NO: 941514 - protein, 225 aa, Homo sapiens
GKPFSPVLFVLKAPSPQVKMGWVFEAFFLAFGGDPIPFPGENPSPFVPRGGVPLFFRQGPPPGGVFLSLEKKSSPGGGFPPFSPPPPRGWGLGGGPPPIFFGGVFLFLKRVGFFFPPPSPLWGFLGGVKNSPRGAPKKNPFPPPNWGPPPSLLGGGGFFGGGFKTPPPPFFARGKPLLGPPRGFFPRFFNPFLGVFPPPRGPGFFWGNWVLSLFPPRFFKGGWGL

SEQ ID NO: 941515 - protein, 102 aa, Homo sapiens
QNQPGKGQVKRWGRRGVCWRVSAVERATRRGRRVWEGGGGGLSPREGSVFWGLKGHGPGMGALGWLGDPGSCGSRGIMFYLPYLGGQQVISPVFFRELPCWG

SEQ ID NO: 941516 - protein, 157 aa, Homo sapiens
PRGSLATGEAGNLEEVIQDLRALRALVKEQGARFFPLEDQLGRMENGDGRAPPPRPLFFLRRPLPPQFLPGGGPGLVGCPKPLGQGRGRFPPPPVPGPGRSQGPAFPPVPGGDVSPPAGPPPFGGPSPRPRPRPLPPPPGGGGGGLYFFLPKKIFFL

SEQ ID NO: 941517 - protein, 90 aa, Homo sapiens
FAIPLPPWGRPWTRQGPVPSPNPTHAPWSSQTNETPLGFRCPRLPGNGSANPMAKWGLPPEEEPGSRAFLTNSQVCPSPQETHVLLGGHV

SEQ ID NO: 941518 - protein, 34 aa, Homo sapiens
MGKSGDCSRSELQGEEAEWSEGGLLKEGVKQEEF

SEQ ID NO: 941519 - protein, 165 aa, Homo sapiens
GAPGGRLRCFQQARAVGLAGTSAAFLSSRLQDLSSIVRRADRQAVPIVNLKDELLFPSWEALFSGSEGPLKHGARISCFEGTDVLRHPTWPHKSFSHGSDPNGRRLTESYCETWRTEAPSATGQASSLLGGGGPQRGLLCGQSAASCHHAYIVLCIENSFMTASK

SEQ ID NO: 941520 - protein, 97 aa, Homo sapiens
LSRPGEDVEDDLIFTSKKSLFGKIKSLPPRGLLMDLGLQGPAEDILRRPRHGPVRGTACLTCLLTLHSTFASLRRFGCQHPATPTAGNLFIVALSDV

SEQ ID NO: 941521 - protein, 151 aa, Homo sapiens
STVYIMAMAMQMATSPINYKGPPFMESLPENKPLVWSLALSLLAIIGLLLWPLANFNSQFGLVDIPVEFKLVIARSCSWTSAWRSWPNPRGRVPDQVLPGDPEAESAFLDGSAGTHCPPWLPLGGNPNRAPGGNPAPNPPQQGCTVSPLED

SEQ ID NO: 941522 - protein, 119 aa, Homo sapiens
MWVSLLLSLQVLVCSEGTFYSHYPHASVNGHLYVVRVSIPNHGGGGPQRMPPKHSERSLKGWPQPHVVCPGGLGWSEVGTSIYTRAQGVPEASFTELSNDPISLSLFFFLFFFVFFWQR

SEQ ID NO: 941523 - protein, 104 aa, Homo sapiens
SNLEKKGEYLWQLLQVSPEALKFMCKDAFCSNLSVENAAEILLADSNSADQLKLRQWISSTIMLRMSWRPLGGSQWWCHILTWWRRTALSLQHSLLFCDLYAHL

SEQ ID NO: 941524 - protein, 131 aa, Homo sapiens
PLPRPLLWLFLTGNPWDKPCSVQAPALLSPGARGGGQVASGANAVGAQVRVCWSPELPSGVKGSWHPEVRFVHSPRVPPGALGYHQAPSWALGAAPGAWRGSWASLSRAERGRRPLGAVPTPTRLVPGDAV

SEQ ID NO: 941525 - protein, 169 aa, Homo sapiens
GQLNLGNGLLVGPCLRVPLFSPWRKNLETVANWAGPPGIMPPFFSPTLGPKRPVLCPPGPKRFFPPPTKLWLVWWVGGAQFPNPFLRVAGGSPNFRPKGTSGPRFGGWPLILWGLLFGGAPPRPLGSPPPFPKMPLLAPKWVFFLPPGLGVSGGPSLCRGKRTCVWGPH

SEQ ID NO: 941526 - protein, 108 aa, Homo sapiens
NPSGIRKRWVLANGPCALPPHPWVGPLVPIALFPEHPPHRMGASPLACLCFSPNPFKWGGKRRRGEGACPLLRHLGGPRPPGLYPSLRALSPAPLFKSNLNKTPSFIW

SEQ ID NO: 941527 - protein, 224 aa, Homo sapiens
PLHPLVCFSAKGNPKEFKKLRLKRKERRRGKKQKRPEAPRGNKIKTRIREFKNQPQEEGKGAKAQEKGEEGKGNKPGEEKGRGGPRRRKTGRAGGAKRGRDGGGKDDGIEEGGRRKGQKERRRSWAVGFQTETRGGGEQETQELASKGLDQNKKKDVKQNAKGRFHKIAEEGAGGTKSRLTQTKAEAAENSDKDGLTSKNTRSGAQAAQSRRRQAPRRAAGRGA

SEQ ID NO: 941528 - protein, 77 aa, Homo sapiens
SRTSAVSAVKATVGVHFPVNTRKAHPGEQLHQCIEGGKSFNKHNLIGQQKIHTVAEMVKGLAMSKFSRSPPKLCGAG

SEQ ID NO: 941529 - protein, 134 aa, Homo sapiens
GGGGKEKQSEENGRRKERGQKKGGKARSKKEERGGKGKAAMGGKRKEETRAQKTLAGGPKQGEEGERKLRTENKGRKKEQGSARGAGGAPAQQQGGGGEEAAGSAGRGPARRAPDDAPAARAGETPGCAQAPRA

SEQ ID NO: 941530 - protein, 111 aa, Homo sapiens
GHKKGGEQGGKERGKEKPKEDKKKKAKARKKREAPGDQGPGSKKAIGAKIKQKATTKESQTNPPPKRKKKIDVKPIHPSTQVPESKGDSSKSELNDRQKWRPDTTVWRKLR

SEQ ID NO: 941531 - protein, 76 aa, Homo sapiens
PTPPPPPWFPPLARGVKWVFLGPGPLLGFFFIPPLGPRLLGKEGWGLVGDPTQNLGLGPGGGRLGAFLGWFGFGFF

SEQ ID NO: 941532 - protein, 134 aa, Homo sapiens
VEASNTSFPRSEPPTGCLIPKHECLPVTPPPADTHRGVLSSVVDVHEGGSMTLMLNVRTRTAATLLDGSPTMSSKPSVSFPRGLKMAVTFIGNSTTIPELFQRILEQFPSMFPRKAFLPWYTGEGMDQMEFPQA

SEQ ID NO: 941533 - protein, 42 aa, Homo sapiens
PPPPPPPPAFSFPGKVHGRSWGNRYPFGFVRITRNLKTQKGF

SEQ ID NO: 941534 - protein, 122 aa, Homo sapiens
RVIIKKYYTRLGNDFHPNKGVCEEIAIIPSKKLRNKIAGYVPHLIKRIQKGPVKGISLQLPGEEKKKKAHYVPEVSPLDQEIIEVDPAPKEMLKLLDFGSLSTLQVPQPPVGMNFKTPRGPV

SEQ ID NO: 941535 - protein, 126 aa, Homo sapiens
GPPPGAGLGSRLRAGGKGPHGGGTPPSPHKARGAGGGQGANPGAGSPYPAPPLGTPGRGKWGGPPPSQLGAGQGLAWEKPPCRSPAFGAPPPNHPNPGPPSFPPPPPPPPRFFFFQKFFFFFPVFK

SEQ ID NO: 941536 - protein, 197 aa, Homo sapiens
RFGPKTGVGRGPDFRDFRAPPVPERWVRRVGSRTRGRNAGPVFFWAPKNPLPVVCSPLPGGSVGDMYFFPFSQNPGLVLGLFGGDGADFPVFLPPAPGFFGFSSGARPHGGVSWGQFRGGAPPVRVFFYPPRVFPRVGGGPFAPGVGAFLPWENRGLAGFGPRGVFPPFFFFFLPAPPPPPFLGGSVFWFWGVFGSL

SEQ ID NO: 941537 - protein, 115 aa, Homo sapiens
REGIEEPWASCLWEHQPGVAVATEAVQPHLGTNVAFPSRSQHYRSVAHVHSEAIQGQDSQSRTDFAQGHLRSQQARSGTNGVPEAVLLVEGVGRWGPFPSNACHTRKGNGNGLFS

SEQ ID NO: 941538 - protein, 129 aa, Homo sapiens
KGLLALMTFWMGLQLMAILILKKRALFIFSPIALLGRFTFYSESLHIPLVFLQGPEPLGQMLYLNLIPYSPQLDEGNIEVRIVIIIPFLGRFRQLSGLAQSNQPPAFLPTSKFYGNFFGFFQFFNKCLS

SEQ ID NO: 941539 - protein, 114 aa, Homo sapiens
IYAFGATPTDPSQRGPRPSWKIFEPLLGPAQPRPPKTFWLCWPEKPLTAVRRTKKGGRRSLLSSPLSLSVGPARPAPVLGNHGFPGGGALVRNPGHFHQHGLRLGADRGPPVGL

SEQ ID NO: 941540 - protein, 195 aa, Homo sapiens
VHPLPRGGAPPRGTMKVLPLCLFRCGGGRPSRLSWVLWFVPTPRCGVRRMAGSSPAVDLGGVWVTQGGGPLPPKALPPPRGKKAPFFYPGVWGAPFKTAGFGGCPRGAPPPRGKTRGFFGAPFFLFFFHPPPRGLGGLGFFSEPIFWGPGGGLFFFPRPAARERAPPFFFPPFFFLGGGGNPCGVFFFGFSPPPP

SEQ ID NO: 941541 - protein, 105 aa, Homo sapiens
FLWCQTLGRNFQMKQIDSYCSWIKEKSSGSPRRPWAAPPKPYNILSVGCRGGFSFLSNLTALLNHCLHLPMRWLALPFKAGPLELKLKGGVQQPGDPLFLLCLPC

SEQ ID NO: 941542 - protein, 71 aa, Homo sapiens
TDLFPPGVSWSARSQKARRTSPVEESSFGFGKFLEEAQHGGSKEPQNSSRPKDPEHEGKKRRKEEAQVSPK

SEQ ID NO: 941543 - protein, 69 aa, Homo sapiens
PPPPPLPFVWAPESGGPRVFFPTKGGEEPRGEGTLFSLPWCGGPVSSFINPLKRARSVFPPPPGGVPGC

SEQ ID NO: 941544 - protein, 55 aa, Homo sapiens
GQHPAPHQAGGHRDPGNGSIQSHHRHPGAALKRTQDIEIKAHPKPRMTSQDPPLH

SEQ ID NO: 941545 - protein, 115 aa, Homo sapiens
KEPETTDKPGRATAPTKEATSGTAPISSETTPNHRNSNRASHRGSICTLIPINHIKLDSFTISNSGAEIVRHQKEGSLMDKDIFIGGSSINKTRAISDVEPFDRAKDFGARTFFT

SEQ ID NO: 941546 - protein, 206 aa, Homo sapiens
RGRVSPVCGRGLAGSSPPRRGCSFRFFWPGYNRRGGCARGRGIQKWGAPLFFFPPLVAVEFGPLWCGRGKIFPPRGQGRWGGVPPPIGGFPGGCPNGGTRGGPFPLSGPPWVGKRGFGKPQLFGGGVPPPGGGVPGPKRFPRGGGFRGKGPPPVPGFRGAPPPPLGFGPFFPGGAPPIGGPPGFFSPPPPPPLGFFFCFGGGGGIN

SEQ ID NO: 941547 - protein, 112 aa, Homo sapiens
GPPPPKGLVGEPSPPPLGAARGPPWASGFFSPRRAGPGALGWGLFPPGFCGPPPGGAFLPTREKQGGQGPPFFGPFFLAPPPPPRVFFFVFPGPGGGPVPGFFFAGGFMAPW

SEQ ID NO: 941548 - protein, 149 aa, Homo sapiens
PRECHPIRGAIILAKLSIVPVGKGYWGNKIGQPPPVPFKGTGPFGFVLVPLIPAPRGPGIVSAPVPKKLVMMGGIDDWFPQAGGALPPWGNLPRPPFIAFFKAYRYLAPGLWKEAGFPQFPHPGVPGPLVQTPPQVSVQRAPGPPGGPT

SEQ ID NO: 941549 - protein, 107 aa, Homo sapiens
FGGPLKKARAVLLLGGAGEGPGPCSPFNSRAGAGKQPAPPFGLKAPPPKRCAGKKRPRPGDLGFKGPFMPVNVPWVGRGWFPVFQCRNFWLCSPFPFFRNYRSLGFF

SEQ ID NO: 941550 - protein, 131 aa, Homo sapiens
TNQGKPPNPEKFLGVSPEKPNPRTPEGGPFPPIFPPPKPKALVPVPPGMFFLLWEPEPLLFGQKGAPFPPPWAPRKGVFGPSPPLPKKNQGFGFPFFFFFVGDPKGPGWEGKGKGFGGGKNGPPVFKKKIS

SEQ ID NO: 941551 - protein, 106 aa, Homo sapiens
NVLNPFPKFMGYCMLGGLFGYLHWLLCQRGHHSLVILVSVWTSHFPQCIKEPSMDFRGALRFPIHPRVINVYKYSVHDTCLGGSPWCLREGAHAASGLQGQCCWKG

SEQ ID NO: 941552 - protein, 136 aa, Homo sapiens
GHTSFKGILKQPAPQSDPYSRLALGNGGLQTLHQATQDQGKEERHQDRALPINKQVLRNFLKDSKRNVSEKRQSKKKLLDQRAQNVGKPKNIRMLTGETEATKEKKRGGGGGRRSKKAGEFHEFDNEPLMMTCLPP

SEQ ID NO: 941553 - protein, 109 aa, Homo sapiens
KEKGPTGQRKRHEEITQKSYNFKKGTAQPVGKTLTFKNLFKPSGQSPPTPRVEGTKVARWHWGCGRDTRPHQSVAAGENCPLPEPAWEFWIHGERCGHLRQSLGTWKTI

SEQ ID NO: 941554 - protein, 81 aa, Homo sapiens
ETTEQDKAQDTNGNRETWRGQQEECRRPKQTREKTIAKKGLWNLDKARPPATYKSSRGLRSICLPSHKPVPRYGPKFKNLL

SEQ ID NO: 941555 - protein, 90 aa, Homo sapiens
KGKGPTRPRKRHKGKPEQTTKGGQERRRPQKRGEKATNQDTENKGIKRQQKGGETAAKAAEAELEGAESQQGRTSPGRPSREAHQRIHSR

SEQ ID NO: 941556 - protein, 96 aa, Homo sapiens
KGQKNTKTTQWKKEKQREKVKNKSNRAKRRRIEQNFEDRGKGRQSYRYVLVTGVKTYEERFNMNGTLEIGGRNLKPKDCFLKPQIIECILGKSFRV

SEQ ID NO: 941557 - protein, 135 aa, Homo sapiens
RGPQKLLEALSAFSCPWESWVRAARCVSRGFWRQLALDCPAPWGSSPWEVRDASPGHTHSRTPGAHCSQGISSWAAPPWAWCPSGQSPHPQPASSLKSLGHGDDVGRQAGLGDGLKLGAGPGDFLLPNFLLCAPR

SEQ ID NO: 941558 - protein, 144 aa, Homo sapiens
TGSPGRVGAYNMYRIRKGTNQAPHKDHTLTCSRICDAEHRVASANGAQGPLGILGNLGYTGYWGCRSSLNPRLRVHLTQLASVPGTFDWSCGALHGGPVVAGVAPVCGVCARRLETAGHAPVGPSVLHVHAPPVQGPELTVGIS

SEQ ID NO: 941559 - protein, 126 aa, Homo sapiens
PPGGSPVSWKSLKGTLQKSVWNLGFLALELPCRAPGPKPRSGAGVVFSKNNGRPVLPSLAPWGETKHASFHGPPKSFWAPLFGPLMGVIIIVILKWSFALFPRRRLQGAEIAPLPSSLGAEKTLSP

SEQ ID NO: 941560 - protein, 35 aa, Homo sapiens
LEQPLSYGKLCCDGLGPLYLCEYRFINRLINLSKV

SEQ ID NO: 941561 - protein, 30 aa, Homo sapiens
ACYESGLRLCGNGEEMSLSKTKNKLLGEKT

SEQ ID NO: 941562 - protein, 82 aa, Homo sapiens
GKVFPKLDLLTKVPQRALELDKNRPIGTAPVSFRTLVGSAWNGTCSGQLNRVALCRGEPLGSKTVNVEDEDAAWRYMQFYSI

SEQ ID NO: 941563 - protein, 124 aa, Homo sapiens
LSEFRRRRGHWSIHVEPQIQQQAEKVTVGTRCTAKCPLAVPKRNPTLSLAKLGAVNAVFLFCCHPEDSHCNVTPLSFQVQAQLQVDSAVAHARRRLHPHLAAHAPCMMLPAPPFGMPLPALAAY

SEQ ID NO: 941564 - protein, 88 aa, Homo sapiens
ELGKHLREAGPENRNRVFPSGREGDSPGLQNLQYSPPRSTALGCEGPLWPCSLAKKAFGVECCSQKQHVYLPIVFHGSNKLQIKLYGN

SEQ ID NO: 941565 - protein, 77 aa, Homo sapiens
KRKGRSRNPCLSARHVVQRRRGFGCEESAVQSPKPLGLQNGRAGVDRPQGAEPRRGGHVTRPVRMTLGLRKRASLYF

SEQ ID NO: 941566 - protein, 108 aa, Homo sapiens
WQPQAQPQACPPFLLSGVVGTKSLGPPRVLFSQVLFFSLVFPPPPPIKGAPRPGAALEGLGKECFEEGGGLKLRVGARMGWSEGVFKVWAGCFAGKLGAGLWLLTAPL

SEQ ID NO: 941567 - protein, 43 aa, Homo sapiens
QGASGSIFSKFTSKFVRRNLNEPESKDRRGDAQTSRGEAVAAT

SEQ ID NO: 941568 - protein, 95 aa, Homo sapiens
GPLARIEASLSVQMSRRVRALFGAMNFWAIIMDNLVSLNSLKFTEVVARGLLLTGFPQTTLSILFVPYWGVQLVKGGERPLALGGGQKRGKEKPG

SEQ ID NO: 941569 - protein, 108 aa, Homo sapiens
ASPKRGPRGVHTFTGLILSPWVLLFGLWIRDGANVSNFPFAPSTIIFHLGHAAMLGLMYVYWAQLHMFQTLKDLALLGSVTFLAGHRMLAPQAVQRTAPLFPKKDGNF

SEQ ID NO: 941570 - protein, 105 aa, Homo sapiens
PPGFSPRGLKGKVLKGSNFTPRPPLFGGGGGFPLKGAFWPLPNFWGGGEIVSFPKNPGGAGLLGSPLFSPPFGGVGGGVFLGPKFKTPLGQFTGPRFFFKKFWAG

SEQ ID NO: 941571 - protein, 112 aa, Homo sapiens
CECPGGFLLDASRARCVDIAECRELSQRGLLCQSERCVNTSGSFRCVCIAGFARSRPHGACFPSAAAVPAAPALGPAFGCPLRVFRELGLASAPTCGSGPGTFRARRPSRRL

SEQ ID NO: 941572 - protein, 95 aa, Homo sapiens
PRGCGDQSLCDREGLSFQGSDQRGENSTEEAAEHALRSSGDNSSAYEHEKRTQSQEKNQRKKGLVLPVARIPHQLEIVPVPTSQTEKLQKSPGIE

SEQ ID NO: 941573 - protein, 105 aa, Homo sapiens
CSQVPRGQVGSPSHPNMLQAAFPLSGSFGKQGPICPSVAVWPEWVRRPQHLCSLRHFGRMFGASPAGGGASRAGGPLRPTAPRGPPPFGCEVAFSPSACKGPICH

SEQ ID NO: 941574 - protein, 190 aa, Homo sapiens
FSRMSPATVITHTRCDWKCMHLASASSRYVSVHTLPIHPSTCHAWILGQHADPSVAVWTGVNGQRVSLQELNPEMGTDNDSENWKQVHQMVVHSAYEVIKLKGYTNRAIGLSVPDLIESMLKNLSRIHPVSTMVKGMYGIENEVLLSLPVIPNARGLPSAINQIVKDDWVAQLKKSADTLWDIQKDLKDL

SEQ ID NO: 941575 - protein, 79 aa, Homo sapiens
RIRYRPTCNFSKVSGYKINVPKSQAFLYTNNRQTESQIMSELPFTIASKRIKYLGIQLTRDVKDLFQENYKPHLPSPAA

SEQ ID NO: 941576 - protein, 105 aa, Homo sapiens
SLGRGRVVGAWGWPRGAPWRGYVLVFGAGRLLGSGGVFACGRVGVGGGGGGGVGGPSPPPFLRPPPPFPGGFPPLPPLPGPQPVGPFGKWCPVGFPLGGLFLGPG

SEQ ID NO: 941577 - protein, 171 aa, Homo sapiens
PSRWVFSPTGGEEVLPPPLFVGPPGGGGGGGGPPFFVGPPPPFCFLLGGGGGLPKMGAPPPPPPLFWGCFPVGPPAPPPPPSVGGGPPPGGVGVSVSPTFLGPPPPVFCGFPPPGGGEGGGVFPPFFSLAPPPLLGGGFFSPFFFPSGVFFFPLFWGGFSPKKKNQQNKKT

SEQ ID NO: 941578 - protein, 111 aa, Homo sapiens
FCHGNPLKSVTLNDGNPFNSGQEKIVYVFPGVALEFIPGGIRPIPNEIFLLTAEQIAQEVFEQHLSQGRFYPPLSTIRKVFFRIANKVFGQGGKTQTGFSLPQALRTRRLL

SEQ ID NO: 941579 - protein, 70 aa, Homo sapiens
AEIFLEIIQSSFPEGVSLSVKGPPEEAFKGRFKVRPNWEKFVGKVQAPPVPPFMPAGVILRAKKKSFWGG

SEQ ID NO: 941580 - protein, 36 aa, Homo sapiens
QEEYLVHLVPVAENLGGRWIWGCSPPPVFSTPQFLL

SEQ ID NO: 941581 - protein, 30 aa, Homo sapiens
ATTNTPRSRAMAAAGSSAARVCGVGDAERP

SEQ ID NO: 941582 - protein, 117 aa, Homo sapiens
SHRRVTTGFEKQGRPPNFRDPPPIPRELSEPDATRQPRELSWEAVGEPGQHWCPCPQREEQAGERGEAGMHCSPHHPPCSTSGELESGNVPRRPSMIAQGKEKGWGVIRSTALVSSH

SEQ ID NO: 941583 - protein, 74 aa, Homo sapiens
NLILEPKIMLVAIDNRYIRAVGVPVLGFSPKPDNLCCCTTTITGWHKAVFLRGVDIYTRLLPALASVPALPSDS

SEQ ID NO: 941584 - protein, 95 aa, Homo sapiens
LELETETSGPKRPPEKPRKHDSGAADLERVPDYAKEKEIQSSHLETGEKTGKKSPSRREDLELIMTEMEISRAPAEPSLREPMGNVVKALIALTH

SEQ ID NO: 941585 - protein, 114 aa, Homo sapiens
KKVLGQAPWLTPVIQHFERLRRADPLSQEFETSLANMVKPPFLLKKQKLAERGGMPLSSQLLGRVRQENRLNPGGKGCSEAEIAPLHSNLGDRLCFQNKTNKQKDFIKNILLTQ

SEQ ID NO: 941586 - protein, 179 aa, Homo sapiens
RLRDPAADAAGRPDADAQPAGAKAAALVGLQEAGALSPHGGPRRLRWPQSLGRSVRSLAGAAQVGVHHSGPGDDLRSREGPGITKDSQPSGYPSAPGTGPTARGRETMGSSGCAISSASVRGGLSLRRSHPPRARREVPRELPAGTGRRPRWRHARREQGLLGRRRHRVNVRLDVGARP

SEQ ID NO: 941587 - protein, 170 aa, Homo sapiens
MLKLERTIKTIINTFHQYFVKLGHPNTLNQGEFKELVRKDLQNFFKKENKNEKVIEHIMEDLDTNADKQLSFEEFIMLMGRQTWAFPQKKCTRVRALAPPISQALGRAPPKTTVAKITVATATATFMVATATATNQEARPPCLYPTRAPGPVMSNFFGCGVRGWGQKKFF

SEQ ID NO: 941588 - protein, 125 aa, Homo sapiens
DPEDEASGRENKTAVVVGTITDDVGVRRYQTEGMCTAGDKGSSILGQGARSYFGPAALDSLKAVALSCSRVLAKAREGYRHFGKAPRTPDSHPKPYVRFKGRKFEGAKGRRANRRFQKLPWVLLF

SEQ ID NO: 941589 - protein, 210 aa, Homo sapiens
RTPTPTAPGDPGPPGQGPSYPTPLKLAQNLQGTLTGPVKVPGVRAPGPAQGPNPNRRGGHGGPPVDPPSRPLPAGRAVAAILGLGLVLGLGPLAILLALYLLRRDQRLPPDAHKPPWEAVFRAPIQKEQADAHSTLAKFDLGPPRWTLGPARLEPEGFVGRAGQVQAACPPTFLGQFCPVLGADGCLRLFAYVCHAYLLPRGTPIKPLAA

SEQ ID NO: 941590 - protein, 78 aa, Homo sapiens
GAGRTFPRTIPLIQQLLNATELTQDPAAYSQLVAVVYTPERAKFATGVERQWMELFIHTFKLVHRDIVGDPETALALC

SEQ ID NO: 941591 - protein, 84 aa, Homo sapiens
QLVHGPIFFLTLHIAVKCLLASSTFGQSFFPGEAVLAVVAPLVDREHVGIGRAGEQQVPHLEGLQSPQPPAFARAAEALQAAEA

SEQ ID NO: 941592 - protein, 105 aa, Homo sapiens
MLEMLFEPTVAMTEERSSRPKIGLFSRRPNPKRFGKVRVREILPCCRPRGGHTLQKAFLENKGVSKHFAPPLAFFYFFNFLGGKGFLKSLSCKGFKKRKKSFSPL

SEQ ID NO: 941593 - protein, 109 aa, Homo sapiens
GPLGFRVFKNPSWFPNGRFRDFGSLRGPKGGYYGGFGFGPPHWGFFESRVFPLWVPIFLVGRGSGFFFFPPGWFFWEALFVVPFFLGFFFLPKLANLKRFFFFPPLFLR

SEQ ID NO: 941594 - protein, 57 aa, Homo sapiens
MTNVTLQKGAKIRKGFEREEFHVSKLGPQLVENAEKRPPGGAGRPACAQEAHFLFLF

SEQ ID NO: 941595 - protein, 150 aa, Homo sapiens
MPCLLISLRWTSLPPTQKHQGLQKALEQPAHLAATSQPAQRRLSQFRGSSTQLELRYEEQLLSWANVQNGLEKRNLLRTNSRFAPSADSTKHFRWGRLSLVLCCSPLSSPQCLPVRPSLPGGPKAASREALCSQFAPFISWPLRGLSRTA

SEQ ID NO: 941596 - protein, 215 aa, Homo sapiens
DDIAVNMDYILQVSLLALAGATKGLSGVDIGVKYSKQERNFDDATMKAGQCVIGLQMGTNKCANQSGMTAYGTTRHLYDPNHILPPMDHSTISLQMGTNKCASVGMTAPGTRRHIYDTKLGTDKCDNSSMSLQIGYTQGAQNGQVFRLGRHIYDPIMPPGTIGRGSLRHRRPGPGEVLNSPYYQEEARYELQLSPNLSEFLIPYLKILDPFLNIY

SEQ ID NO: 941597 - protein, 70 aa, Homo sapiens
CQKESHSARSVDRSTGAKGQWQPGSPRYCSTVGGGEKSNRTGAEGDEGKITKVLQRNIIGCLKEDPGADK

SEQ ID NO: 941598 - protein, 90 aa, Homo sapiens
MLQYPPEIPCPAASGISCPVASALCGPSQACHVAPYYEPPGLPITFCSSSPDLSMLLRPLEPPCLGGAGSQPHMLQSEIRPGLSQGGVRR

SEQ ID NO: 941599 - protein, 98 aa, Homo sapiens
RFGALNLPFSPAVATYCCEAVAISACVPSSSSSAFCTASALPSHCLLSMVPPLGLKPVSPHSFLALPFTVGPLARILAISPTFLWLPRAPHYQDRVHG

SEQ ID NO: 941600 - protein, 85 aa, Homo sapiens
ILWLNQFLWDLKQSLNQSMAVYKLNDNPKSDKHVDVRVDGLMLKCVIPSEVNSECPPYPPRAISIQSPEMIATLYGAVQAVDLLN

SEQ ID NO: 941601 - protein, 34 aa, Homo sapiens
PGESYDPGALGCQPCSSLWGGKGSRRYPRYRSKF

SEQ ID NO: 941602 - protein, 30 aa, Homo sapiens
DQDLDPSDLTFFLVITRFLTSMPSLQPVLC

SEQ ID NO: 941603 - protein, 80 aa, Homo sapiens
CVTCTSILKSLLKDIKQAVRKPELKFHEKSKEETFDKITWHYGEETEYHGRPFKIDVQVVCTHEDAMVFVDYKTHPVGAN

SEQ ID NO: 941604 - protein, 67 aa, Homo sapiens
PQCAWIRGAQGQRALVRCKKGGDSDPKEESEGGFVGWAWHFEEAEVGGSLEQEFETSLGNIARPHLY

SEQ ID NO: 941605 - protein, 91 aa, Homo sapiens
GPRICRSRRAISKPSVVSRIVASRSRAVGDSGAWYISRQTDSALPRPTRPLNWWSASPKRSACSITISDALGTSTPTSITVVATSTCSRLA

SEQ ID NO: 941606 - protein, 102 aa, Homo sapiens
RDGSHLPPDFEGLQTVSQWLRTLSGMSASDELATHSAQSCRPEQLHASTVLILTRALALAQKGKSEAMAPGPLSATQAVVIHTTHCLQLPVWCLSLVSELWG

SEQ ID NO: 941607 - protein, 133 aa, Homo sapiens [sequence omitted]

SEQ ID NO: 941608 - protein, 134 aa, Homo sapiens
MGKKTSRKTENSKNQSASPPPKERSSSPATEQSWAENGFDELREEGFRQSNFSELKEEVRTHGKEVKNLEKRLDEWLTRITNAEKSLKDLMELKTTARELRDECTSLSSQFDQPEERVSVMEDQMNEIKREEKF

SEQ ID NO: 941609 - protein, 124 aa, Homo sapiens
ECTCIKRVVWFLGGFPDPLSIMERRWTPVQISLEGGLCLMGRQSLSPGLASAGFWGALQQGRHVASHEESQGDSAREAASLAQAWLWCRASWGAAWGQGVAFSLPGCPLRGVKPSRTSVLLSDF

SEQ ID NO: 941610 - protein, 146 aa, Homo sapiens
MYLSISCSSKCHTPRGSEGVTISVSPQHLSTVSQTIQGRPFAWERKSLFVRVTQVYAYCPVIIYAPSFAVIGVGLEQSPYLAHTYYSQSTLVCRLPSPKPVPKGPFSPATLGAPVIFPTPLVRARVGSKCLKQGLQQGPFPERLSL

SEQ ID NO: 941611 - protein, 116 aa, Homo sapiens
VKKMCQDYLSNSGLCSQETLEINNVSSVASASPSAGCHSTNALSTVNQKKPIGHHTLRTNPDTDALPDALSSLTDSIAPALGEKHCCLCTPFTGELSPLQLSLQPALATTSFPTLS

SEQ ID NO: 941612 - protein, 316 aa, Homo sapiens
SRTALTQPWRRRLWKPCGASYENSRPLQGVGAALGSGVSSDYWHLGMELSVHSSRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPGTYQPSDRPFIPYELYTPATYQLTEEGTFKVVDEEAMEKVPWIPLDPLAPDLARYPSYSQAQALRCMVRAGEMLYLPALWFHHVQQSQGCIAVNFWYDMEYDLKYSYFQLLDSLTKASGLD

SEQ ID NO: 941613 - protein, 110 aa, Homo sapiens; identical to SEQ ID NO: 791515

SEQ ID NO: 941614 - protein, 615 aa, Homo sapiens
AVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLPRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPAGLPLPLSLTVKDKLTPPSAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 941615 - protein, 304 aa, Homo sapiens
CKHVEKPINNSSLVSPLQKIYSSVKSHILNKYRNDFDDSPFLPQEQKAQIREKPCECNEHGKAFRVSSSLANHQVIHTADNPYKCNECDKVFSNSSNLVQHQRIHTGEKPYKCHECGKLFNRISLLARHQRIHTGEKPYKCHECGKVFTQNSHLANHHRIHTGEKPYKCNECGKVFNRNAHLARHQKIHSGEKPYKCKECGKAFSGGSGLTAHLVIHTGEKLYKCNKCGKVFNRNAHLTRHQRNHTGEKPYECKECGKVFRHKFCLTNHHRMHTGEQPYKCNEFGRPRRVDHEVRRSRPSWLTR

SEQ ID NO: 941616 - protein, 49 aa, Homo sapiens
WEDEEEDDEDEDDDDDEDDEDDDDEDDEEEEEEEEEKPVKEAPGKQKGK

SEQ ID NO: 941617 - protein, 220 aa, Homo sapiens
DSAPAAPANSQAPRPPAPPGRPEQHTTHRGNPEPTHAPRKGKETREEDRTPGPQGAGDEDKNRRRPAGGRARQRSRAGRKRPRTRPQRAGRRQPGRRGRAPPAPPRQGRAAADSEPNRDPPKNPHRGGPPGAPPGARPAKEGGPGEERRGKGEAEGTPPPPPPPKPKTQRPQTQSQAHQRGRPGREPPGAKQRPGPPPGPQPPTPRPKKEPAGGKKQQPN

SEQ ID NO: 941618 - protein, 127 aa, Homo sapiens
SVLSPFLSSLSLLFVLCLPLVWCVRRRGGVVLVVALCVGLVAGVPFFSFVGFVWGVAVVCPFFFCCLVFLFFLWLFGGLRRFSPSLAFLSFLFGLSSGFVVLGVRSCFRGALLVGGVGLLSPRRSFF

SEQ ID NO: 941619 - protein, 115 aa, Homo sapiens
GGSPGGRFWSLAFKPHQGKHSMNCPAREKYPEDQQRTIIPSPRNFPCLAKGDTKSEWLVQQYHAVGGTFPRSCRHKPLLSLPSHASVIHLGHSALQTFTRAEANLGLWRHLEKRR

SEQ ID NO: 941620 - protein, 154 aa, Homo sapiens
DSPATYRFIIVNFVETILPKWVPGSDFLLGVSVHRIKKTLPSTVVSEGFQKILMFLPKVSDPLSIIHPTPHPQCSPTDPPCISFQFLSGVDAWCKMCSEGGLPSEMQDLLAIHHHQTLYEQVTQAYTEVRMEGNHGSWACLHVGGVMRALACAL

SEQ ID NO: 941621 - protein, 43 aa, Homo sapiens
YIRAQKECGRCISLPCRYRSGNYPAYFQLFAIGHSLVTWLRLT

SEQ ID NO: 941622 - protein, 32 aa, Homo sapiens
IRAHAGEEFIRRPAPAGADTHSNHTKRERLEF

SEQ ID NO: 941623 - protein, 34 aa, Homo sapiens
MLPGTFDLDDDDDDDDDVYPGFPNRDLQPSQFSF

SEQ ID NO: 941624 - protein, 35 aa, Homo sapiens
MDPVNLNDDDDANREIPDGSRQASKFPLKGVDLKL

SEQ ID NO: 941625 - protein, 103 aa, Homo sapiens
SSSKEGDNKEIVINIHRDCLENGKEDLLEERNNYILSLIPYFFLLEERNKELMKEYNYLKEKLLQCEKEKAEREVSMKKTINFWKENLNISFWLYVEPSSIYK

SEQ ID NO: 941626 - protein, 276 aa, Homo sapiens
NSHPGPGCTASPPAPPGWPFSQRGPGRWSTTELRKEKSRDAARSRRSQETEVLYQLAHTLPFARGVSAHLDKASIMRLTISYLRMHRLCAAEELQDALTPQQTLSRRKVEAPTERCFSLRMKSTLTSRGRTLNLKAATWKVLNCSGHMRAYKPPAQTSPAGSPDSEPPLQCLVLICEAIPHPGSLEGFVMVLTAEGDMAYLSENVSNHLGLSQLELIGHSIFDFIHPCDQEELQDALTPHLNTSSLLPKPQGTVSFLAPSYPVPRSFSPHLPPWWP

SEQ ID NO: 941627 - protein, 109 aa, Homo sapiens [sequence omitted]

SEQ ID NO: 941628 - protein, 449 aa, Homo sapiens
MGQGPRAWKGRWRLTQRSRSTGLQEFARRFLCSGCYSRVCDLPLDCPVQDVTVTRGDQAMFSCIVNFQLPKEEITYSWKFQEELRTQDLSYFRDMPRAEGYLARIRPAQLTHRGTFSCVIKQDQRPLARLYFFLNGGAGRGRVSERGRERGGARCLADVRAPAVTGPPPRAETELQAPFREVLRWAPRDAELIEPWRPSLGELLARPEALTPSNLFLLAVLGALRISECDSVGVVSSGDSGAPASSSPLSQIPPRSLGSQQPPTQEVRLSVPPLSDPRVQVPAPLYSAQESKFPAPSSLRSKSPGPQPLLPQTQESRSAAPPPSDPGFQAPNPYSFRPRSPSPQSPPPADPRVQAPGPPPPSDPGVQAPSPSSLRSRSPGPQSFHPQTQKSMTLAPPPSDPGVQDPSPLLPQTQVSIQAPGPSSLRPRNPGPQPFHPQTQKSKPPAPPP

SEQ ID NO: 941629 - protein, 124 aa, Homo sapiens
LTPKASDRGSWNEIAYGTSSGAVREIVQHPQTVGTGPQLFRTFTVRSPETESMLSEKHLVSVSADNMSCPDVDSNTIHGKDLYSSGTPLAFKILFLEETEDGSYSSGNDIGPLGERYQHGFIQR

SEQ ID NO: 941630 - protein, 197 aa, Homo sapiens
SQMVGSWAKALLTSQTGRPGRGAPRLPHGVAGQRRSSPPRWGGRAEALLTSQDGETRKRRSSPPRWGGLAEALLTSQMMGSWAKALLTSQTGRPGRGAPRLPHGVAGQRRSSPPRWGGRAAALLTSQTGRPGRGAPHFPDGAARQRRSSLSRWCVIREEALLTFQMIGSQRKRRSSPPDDGQQEKGLQMEERTLEVQ

SEQ ID NO: 941631 - protein, 130 aa, Homo sapiens; identical to SEQ ID NO: 742619

SEQ ID NO: 941632 - protein, 127 aa, Homo sapiens
ITHPGDDRPSCGRRFEYDGNLSLSPPLLALGTRPETQDLGDGHRRAAAVSSPWVTSASRTANPLSTTTGVQACRLNTSPRRRCRGRVRACQARITPDYRYDLARVTKIARPQLATSQMMVLPVSARG

SEQ ID NO: 941633 - protein, 592 aa, Homo sapiens
TRAVPSPPPPPIVKKPLKQGGAKAPKEAEAEPAKETAAKGHGQGPAQGRGTVVRSSDSKPKRPQPSREIGNIIRMYQSRPGPVPVPVQPSRPPKAFLRKIDPKDEALAKLGINGAHSSPPMLSPSPGKGPPPAVAPRPKAPLQLGPSSSIKEKQGPLLDLFGQKLPIAHTPPPPPAPPLPLPEDPGTLSAERRCLTQPVDPAEQRPGGASPGLVCVTALQGRMAGLGWLDFVLDLISQTEDLGDPARPRSYPITPLGSAEAIPLAPGIQAPSLPPGPPPGPAPTLPSRDHTGEVQRSGSLDGFLDQIFQPVISSGLSDLEVVPTKEVFYPRENFSHPYYLRLLCEQILRDTFSESCIRISQNERRKMKDLLGGLEVDLDSLTTTEDSVKKRIVVAARDNWANYFSRFFPVSGESGSDVQLLAVSHRGLRLLKVTQGPGLRPDQLKILCSYSFAEVLGVECRGGSTLELSLKSEQLVLHTARARAIEALVELFLNEFKKDSGYVIALRSYITDNCSLLSFHRGDLIKLLPVATLEPGWQFGSAGGRSGLFPADIVQPAAAPDFSFSLSRGVAGTRVSCPTGNQGWLGGTGPQR

SEQ ID NO: 941634 - protein, 878 aa, Homo sapiens
MLGRFEAEALEFIETEEDVTSLREAKEVLKGEKPGKEDRYRSILKTKFWQMWKTWPGDLKVVHIMAQRYKMLIPFSNPRVLPGPCPHTVVLHGPAGLGKTTLAKKLMLDWAEDNLSQKFRQAFYLTCKELICLGPCSFAELVFRNWPELQDDIPNILAQAQKILFVVDGFDELGAPPGALIQDICGEWEKQKPVPVFLGRLLKRKILPRAAVLVTTGLRALRDLRLLVERPIYVRVEEFLEKDRRAYFLRHFGDEDQAMCAFELMRRNAALFQPVSAPMVCWIMCMSLKLQRLEGEGPSPTRTGLFLRFLCGRFPQGAQLWGVLRALSLLAAQGLWAQMSVFRGEDLARLGVQEFNIRPSLDRDILRQDIVSKGCYSYIHLSFQQFFTVLFHALEKEEEEEEEDKDGHAWDNGDVQKLFSREERLKNPDLIQARHFLFGFANEKKAKELETTLGCLMSPISLHLNAVDIMLFSICLKHCRNLQKMPLQAAKAKLPENVTVSESDAEVERSQDDQHMLPFWTDLCSIFGSNKDLIILEINNSFLGATLVRILCEQIASDTCRLQRVMFKNISPADAYRNLCLALGGHKTVRYLTLQGNDQNDMLPALCKVLRHSKCNLQYLGLVSFSTTTEQWADLSLALEVNQSLTCVNLSHNELLDEGAKLLYTTLRHPKCFLPRLLLENCHFIEGNCKNFAAVLVVSGELTHLCLAKNPPLGDTWVMFLCKGLSYPHCKLQTLVLWDCDITSNGCCYLAELLQEKSSLMCLDLGLNHIGVTGVKLLCEALKKPLCNLRCLWLWGCSIPLFSCEDLCSVLSCNHSLVVLDLSQNPLGSSGVKMLFETLTHPNCTLQTLRLKIDDFNVELDKLLEEIEENNPQLPADN

SEQ ID NO: 941635 - protein, 225 aa, Homo sapiens
KASPVAESPKVMDEKSSLGEKAESVANVNANTPSSELVALTPAPSVPPPTLAMVSRQMGDSKPPQAIVKPQDSPPTSLKALLSRKEQNLSRWVVLKLLKESEEATTDWPSDRAGLENQSVGPLGKWDSPICWRLDKEGRNLLKCEYCGKVRPRKKQVFVAPKEEFCSMELALKRYNVSLLAIKFPAEEGKKNERKFQRKPTMARRSQGRWTPAAAPPGQLPRAKD

SEQ ID NO: 941636 - protein, 519 aa, Homo sapiens
MVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRQQDRVCSAGFVTDLKQDYQAVRNEVPEEKLYKVYTFNSVRKSMSTVIRNPNGGFRMYSKGASEIILRKCNRILDRKGEAVPFKNKARDELP

SEQ ID NO: 941637 - protein, 120 aa, Homo sapiens
SSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSSGRICNGCVSS

SEQ ID NO: 941638 - protein, 142 aa, Homo sapiens
FPVKWAHCYLLHRAAEKKGDRRIRTQKALSKCCFPPSPYTKRLKATAAARRAELEGGRSRDFLGNRAASLGYLSAKHSLSRAAPGSLSGPGGASDPVPLQSYGDRKAKQSCRRGSIRCPPVERRSSKPNPNLNSVRLIAELS

SEQ ID NO: 941639 - protein, 233 aa, Homo sapiens
MPWEVAGAQTLPSWLRLNLGSICPLGAPGGRADFDPELSCLISFPGGTSLSFLVLVTGCTSVGRIPDAEIYKITATDFYPLQEEAKEEERLIALKKILSSGVFYFSWPNDGSRFDLTVRTQKQGDDSSEWGNSFFWLRPWVPCRGWALGLLQRVGPGSPAEGGPWLASEALTSTCTTPGLWGTSGELGPRPALSTMRGKLTLNSLPPPTPGPWNVLECRFGKETCARHGASCL

SEQ ID NO: 941640 - protein, 148 aa, Homo sapiens
GGREPIPLAPTNAGAGLSSQVTSRQPRVEAAEASARPSRGKGAWGGGRGGRYPPGVSAPPLPEVGRSARGSAGRGGVGFQSAGDSGRGPGAGILPAAAAAERRLCSLQEGRARRPALSDPSSSAKLQRSARQPRAFRGSADPRDGTKE

SEQ ID NO: 941641 - protein, 205 aa, Homo sapiens [sequence omitted]

SEQ ID NO: 941642 - protein, 151 aa, Homo sapiens
GPPEAKLMRQSGLSRPGVCSFAWAPGPALPPVGLSRPSSSSRQPLQDQTVVKEACPGTAPASRQTLQAQVVLKSASPGPAPASRRPLQVQKFLESVSPGPAPPVSQLASFSPAQLMPPGGLPRPPFDFPRPLQAPNLTSSRPLAWASGPKG

SEQ ID NO: 941643 - protein, 33 aa, Homo sapiens
RAYYYYAAKKTTEWRGPFGQLPRQGTSFFHTCP

SEQ ID NO: 941644 - protein, 127 aa, Homo sapiens
DFFFSNFMFTANISCSVPPHVHRSPIITIPHHSGTFVKIDKPTLTHHYHPKSIVDVGFTLCICFGFGQIYNGHISSIIVSYRNNYTALKNLCSVCSSLPSPQHLATTDLFTVSIDLPFSECHIVGTI

SEQ ID NO: 941645 - protein, 56 aa, Homo sapiens
SGGLLCWRRRRQKGKETWTHCPLRAFPTLIVMSIDNFHHICNVVLIRPPYLSISAH

SEQ ID NO: 941646 - protein, 663 aa, Homo sapiens
ALSLGVRDFHLGRVQGPGDSPDSGCRANLPAEAHPPSLMACSLQKLFAVEEEFEDEDFLSAVEDAENRFTGSLPVNAGRLRPVSSRPQETVQAQSSRLLLLHPTAPSEALGLPDLDLCLPASSTPSADSRPSCIGAAPLRPVSTSNCLNSSHSATPLGSLSQRSTVQALQPLQAARGTIQSSPQNRFPCQPFQSPSSWLSGKAHLPRPRTPNSSCSTPSRTSSGLFPRIPLQQQQVGGFEGPEQDEFDKVLASMELEEPGMELECGVSSEAIPILPAQQREGSVLAKKARVVDLSGSCQKGPVPAIHKAGIMSAQDESLDPVIQCRTPRPPLRPGAVGHLPGSNHLVQLVTAASRTPQQPTHPSTRAKTRRFPGPAGILPHQAALKQLPRNKVPNMAVMIKSLTRSTMDASVVFKDPTDWSVFSFLRNHYLNVTPNNLVHIYSPDSGDGSFLKPSQPFPKDSGSFQHDVAAKPEEGFRTAQNLEAEASPEEELPEADDLDGLLSELPEDFFCGTSSGDCPNAGQPTMSRQLWARVWSHPRGRRRPSFAVGTRIRPETGSPANKKGLSPLPWVSLSCLSLILEDIGPGFLVPSYPSPWTAEEMKGATPQQWRPAPPHRGEARSGFLCFVSSDLWLLCSSMPKVPRCRTEVWPIVPCSEIKHLLL

SEQ ID NO: 941647 - protein, 121 aa, Homo sapiens
ENLGQHTIHSLLQVPGGDHSMTLQRLIPCKQKKSERCLLVCLHLNLGMVHIQKKANQEAPSPNSDDFNRESPSYPSPKPPTRMFASTFFMQDGTHNSSDLWSSSNGMSQPGFGGILGTSTF

SEQ ID NO: 941648 - protein, 30 aa, Homo sapiens
VPEGLLVACINSLSDSQSKDERPRAVFHEE

SEQ ID NO: 941649 - protein, 112 aa, Homo sapiens
GSTSCGKELPTVRLLNLLGQPSCGKERQPSCRKELPASGLLRAVLPLNKALLHLAKPPFVRNTSSPWTQDKNSGPAWRCPQQNPHTVHLVQPHAEPQLCWRLELPASLQQPD

SEQ ID NO: 941650 - protein, 50 aa, Homo sapiens
LGNYNSTFCFYAFDYFRYLMLTEGRQAQMENVFFRPLYQYAPACRAPPCA

SEQ ID NO: 941651 - protein, 186 aa, Homo sapiens
MDSLLREGRSLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAGLSQATGHLPKRGRPPGAPSQPHSFPGGTSPELQSM

SEQ ID NO: 941652 - protein, 102 aa, Homo sapiens
MPLVTKGRPGGGNHRRSPGQAAPHPSLRTARGCWRESLQKSCRRDLEDRSACVFLGCSLRRGWFSWRAEPLCSSGRHLKTCFGSGIGPQPNGSQVFFDFPWH

SEQ ID NO: 941653 - protein, 132 aa, Homo sapiens
QSWPGQLPGRSPEAGIRGGSSSRKKPQEEETSDRSPARQRGIPASGVRGRCAGESPQKWSPCDDEHRSACVPVGGPLTGGSQSWRAEPGSFRGCLREGVPCCTCVFVMGVCVCVLGGVRLCVCLCVCARSAC

SEQ ID NO: 941654 - protein, 70 aa, Homo sapiens
SEECLCPARPIWEVYPKLRRDSDHREQAMMTMAVFVEKKRGKCGEKKDRSDGYCVCVERRRHRRHHFVLY

SEQ ID NO: 941655 - protein, 49 aa, Homo sapiens
WTLGLNILRALNGFCQTNQLTQDMSTHKAIQTEKDLQIQTVCETIHNLV

SEQ ID NO: 941656 - protein, 43 aa, Homo sapiens
MGGWPAGPDQAEPDQTGSTSARSITLSSFTLLAWEAPVPRLDP

SEQ ID NO: 941657 - protein, 76 aa, Homo sapiens
LLSRQDAQRKGAAYGLMACRRAFAPIAEAQEKMAALTDAIQDKMNFRRREGALFAFEMLCTMLWNYSEPNAVYVLS

SEQ ID NO: 941658 - protein, 73 aa, Homo sapiens
MGMPPTRLAIMNATMQEGQAIASEMTLILPMANLVTQLPNGEPGYTPLAGNLNPPGMYSVPGPKKTYIQILGQ

SEQ ID NO: 941659 - protein, 198 aa, Homo sapiens
SNPRFPNQPAHPDFSLSSGFIKKSARALAFTSEKEKGNSQNPKGPLSRRVAGREKRSDYSELASPRETPSSAKSLSPPESRSHEVVFPPPKRSCPSSTLPPRERSEFYSGSNELSKPTRLEDFGVPSLSGVSKSVPSRVRSDEGSAGSSLNGLGIPSSSLPTRGRTANPNFIPPPLTPIENPLFPISTENPFLEEKPP

SEQ ID NO: 941660 - protein, 100 aa, Homo sapiens
MFVSKIVTQNEREFPPNNYTNNSPRTTYLRKRTSFPGGPTRPTTARIDLRSADLPRNPNSTTLNVSLAREADDFTRVLLYYKGLERGRILYPLPCVSVFG

SEQ ID NO: 941661 - protein, 82 aa, Homo sapiens
IQSKVSQIIPHIHTTTTTTTTNNKKTTNQSPPPNPPPKPQFHTTPHLNQHLTTSLRLIQAEKVQLFGWGGTSQEPTTNISTV

SEQ ID NO: 941662 - protein, 81 aa, Homo sapiens
IQSEGSQIAPHIRFRLLGILSRPLSLVFGGPYKGGRGCSRSTRKKGKTFESCEAECRDDKAERRILGFSPISSLLYLLSDG

SEQ ID NO: 941663 - protein, 191 aa, Homo sapiens
PSKNLLTNPNPRFPKSPAHPKRYRTLRGIRYLTLPSSLLLTCYPVDPKRAPTFNSTDANKGLTEGLDPRHLPYPIILYSERSEHSSKLPIPKTITIRNDIRRKTTKAQKPTRQLLLLRLNGGDAILRKIAFNNVPAILLVSIDYFLFLVLIFSVVEEEFYSCNHVYPNIEDERQIRVSRVIVSFLLESAEL

SEQ ID NO: 941664 - protein, 143 aa, Homo sapiens
TNPIQVPKSPAHPTPLYKKDRKPVTDVLFADSSAGNAGVVPYSFLVPIQSPTPRARKSTSRSPPNRLLNPSENPSRKGVSKKNPGKTPELQTEIREALENYYRVESLGRVTRPALLYSPDSRRSYFKTLITVCRRGVFIRNVV

SEQ ID NO: 941665 - protein, 38 aa, Homo sapiens
MGARTRARTKGVESGFNYNRGCSIALNGSNGLEVSRFL

SEQ ID NO: 941666 - protein, 80 aa, Homo sapiens
NPIQVPKSPAHPKDPDVKPRPPDRPRDERDDRLTYPVGYESTWKVTPPDVGTRSYLYSPSISSPTLCVYPRLNPSYGTRR

SEQ ID NO: 941667 - protein, 114 aa, Homo sapiens
MKYNSLKPYEEEKALDYPATEFIGGDSGSRAVTTGRVRGSLLHAVPDGTYFTDVNDVKIPHLHEILQTLTYLCPRVNCYRNANVITPPPTIPKKKKHLLSWYLPSSEAYSPPPA

SEQ ID NO: 941668 - protein, 171 aa, Homo sapiens
MQSKVPKSPAHPRSLNSYLPRLWSKRSVEGRGKLGLGEGAGIRIGGDGGEANFWDYGAPECAIRVGHDPLDRRSEEVYASSKLRYIERFLGSGFADYAGGVNLIICDNVSYLGPNNVPRLSSINYRWLPIFLGRARPREVGGSPPSEAFEEIRYEYYEVILGGKFRGYFRR

SEQ ID NO: 941669 - protein, 147 aa, Homo sapiens
FGLAPTGRSGPPRPLSPAGGGAGTAPPEPQPPPPRRGGGVGEGEGEKGKGQRGGGGRRRSRGASELGGQACRAAYNSAAVGGGGCPPAAAAGAEGGGCTVDAPSRLPPHAPAPSLAHRASLTGSAVLPHRRLPPWTLIPFTEPRAFV

SEQ ID NO: 941670 - protein, 104 aa, Homo sapiens
MPIHGFPNRPHIQTGRNYRQKEVKYNLESRLSTGSFSEMFTVSPRGFNGQLYKDKVDSEEEPLSSSNPRLLQSNPLAPTTSKFFPNKLKKTKNKIRVKETPFLE

SEQ ID NO: 941671 - protein, 164 aa, Homo sapiens
MQSRFPNRPHIHLLYTSGPKKDEGVRRNAPAFYWERETEVNELASTNLSLTKARSRNRGRLLEGLKDMIFDKTTVYLNLALKIVLLVRRGEVSEKADDVSKEKKKDDGGSIIKSDSRYRDFQGDLLLFPSLYDPKLKTIEDLRLYKGKGRPLPSTPRALPGSTN

SEQ ID NO: 941672 - protein, 225 aa, Homo sapiens
VGSPEKLKPVGEKVQRMTMYRWTKLETGVHKCISLSSYDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLES

SEQ ID NO: 941673 - protein, 88 aa, Homo sapiens
MGIRVAVLYDRGEGAVGYVTSKIDLDGACYSISVLAYLESDGSFAELNLKEKRGENFFLKRQWRVRELLRILRKGLLTAIGIEVTSTF

SEQ ID NO: 941674 - protein, 41 aa, Homo sapiens
FKKRARCLSYSAAQSSGSRGSAGLIPTIRMMPPDAIAVAAG

SEQ ID NO: 941675 - protein, 103 aa, Homo sapiens
IQSKGSQIARTSKLLNLNFDLNCNSVFAGGLINPRNLRGRKEGRKIRRSSKALRTMYRDKPTNKRKYPRSHRLTSHKPFYAKPLERLPEEGLEGVLASLFYPD

SEQ ID NO: 941676 - protein, 97 aa, Homo sapiens
MASVLDAPVTRPGTPPSQASTGATELPGGEKKTCRWEKKKKTFPGSAGLTGKSIERLTRPALYLRPLLFSSFPARVTLEALPGGVPKRSASRMPVEL

SEQ ID NO: 941677 - protein, 108 aa, Homo sapiens
MTYRLNASFSDLAMVSCLMIFECNVFGRVSLTSGFIVVRSYVRAVGGRLSSFGAFVKAGRYPERCTERYMVRDSWTFAPNPLEPTGDEWGSYASGYDAEWVIEPGAEN

SEQ ID NO: 941678 - protein, 200 aa, Homo sapiens
ISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKERASRRPSEKEPAHNETPLKKVGSGLTVWLPSLVKKVALEARKFHFLKAVLVTFLTILGICWGKNRNIGF

SEQ ID NO: 941679 - protein, 72 aa, Homo sapiens
ECQSKVPKVRPHIQGECARGYGRTRARVPGGMYGMVWTRTFVLERLALFALLFRFVRKRVYAAFESGKRPSD

SEQ ID NO: 941680 - protein, 70 aa, Homo sapiens
CQSKGPKSSRTSNKGRLYSDHIISPVPYRIRLYRSYEELIREPVSCTLAEPSTGPNNLILVIAQRRCLLW

SEQ ID NO: 941681 - protein, 203 aa, Homo sapiens
EKRVNRNEQSLQEIWDYVKRTNLHLIGVPEKDGENGTKLENTLQDIIQENFPNLARQANIQIQEIQRTPPRYSPRRATPRHIIVSFTKVEMKEKVLRAAREKGRVTHKGKPIRLTADLLAETPQARRELGPIFNILKEKNFQPRISYPAKRSFISEGEIKSFTDKQMLRDFVTTRPALQELLKEALNVERNNQYQPRQKHAKL

SEQ ID NO: 941682 - protein, 113 aa, Homo sapiens
MPIRRLPKSARTSILVFSEGLIRRGPERYRRPSNILTGQTIKDLCINECGLPYLTSGLVFTLLSNSWGTKSENLRDYFISNCYLITRGMLARERKHFYASLLPAYALKRIDSN

SEQ ID NO: 941683 - protein, 32 aa, Homo sapiens
MTRLRLMRALLCVWILFAEFDLRSENYRLNSG

SEQ ID NO: 941684 - protein, 191 aa, Homo sapiens
TTNPFLGSQIARTSNKTRINNYKAHTRSHNKQSLTRLRNTKQNSNNPQNPTRQTSKISTTTPKRQTKSKTPDQTITKTSTVFTKLRSLNITGNRSLGRALAGYARPLGTVRRFRARGNILLPSLRSTLPFLSLRKAPQLRFRRSMFSRLQSGLLRQISTVTSRKGTRRECGGLRGLLRGDFSLIGVPSYDP

SEQ ID NO: 941685 - protein, 93 aa, Homo sapiens
CDKMLEQLDMRRDVQEIFRMTPHEKQVMMFSATLSKEIRPVCRKFMQDVNTLLPSLPPLPARCLLPFLALFLRLPCHSSAKKAACAQLGVMTP

SEQ ID NO: 941686 - protein, 114 aa, Homo sapiens
KSESKVSQIVPHIHKHINGGLDDVRSRIGLGTKVIYLCGKFLFAIDCRCVLTFNKSIYLFLRGGVTRFELSEKRVLEIELNMMVYYLPPIVYTGSRTAGGFDCTLWREQPPRVR

SEQ ID NO: 941687 - protein, 120 aa, Homo sapiens
MGCLRLWGLKINYNVITRSCDLDALKNQNERVAYESKIRSRPNRRNRAPSLLGVRGLTNYNNAYLCSQLLEELEQRGHGPKDENYEILESRRYDPDLNSEARALILGGGGGGGTNHLWGK

SEQ ID NO: 941688 - protein, 86 aa, Homo sapiens
MPSRQKRFWTRRLTSGLALDSNVFFKKGREPFALGDFTVNGGGKPVCAFRNKRLSCFRKTPFAKLRVGGFYPPPGALGRRAQAFGA

SEQ ID NO: 941689 - protein, 222 aa, Homo sapiens
NYECLIQGSQISPHIHLGIFSDESRTRGYKRYLLEANVTYLYNARIGRGLRCLFDRITGSNDRYSRHRLNILLRRTVRIPHRLNRITTFKNDGIRPDIHDYFHFDAKGPIVRTSQIPKINRPKTPIRNITNYSTSNRRYYTDEDVEPDTLSMNDTPSENSNAKIYGRFGISVYRAYFLANETDGNGGLRCPVVRCCAPAASDRGVESFTAALGGGFHSGRCF

SEQ ID NO: 941690 - protein, 47 aa, Homo sapiens
MGAPACALALCVAVAIVAGASSESLGTEQRVVGRAAEVPAPEPGQQE

SEQ ID NO: 941691 - protein, 60 aa, Homo sapiens
MFVKRFRNSGWVRGILLRFRDRSGKGENSLCIEVSSLRPLMAESDVGRFFLVKVSFKRYP

SEQ ID NO: 941692 - protein, 75 aa, Homo sapiens
IRSLIRRFPNQPAHPDKLRGRERRVNDTCGSRYVGKLRNFLAYALLISLTVLPLVSLRFLVDIVFYCARFRGFYL

SEQ ID NO: 941693 - protein, 82 aa, Homo sapiens
GPGLGLGLGRTGEVRVTAPQVRLLQGGSLGARPWVGGQASDDKGGPSQPKLQAGAVQGPQQVKAPGVESAGPWAKSVQGTGD

SEQ ID NO: 941694 - protein, 110 aa, Homo sapiens
PATCPTACPHTVPKPLAAPSRLSPLMSLSPWPLPAACPTACPHTVPQSPSRLPSNLPPTLSLSPLATPSWPAPSPPLRQLLGGLWLCLPQVTMGPVFASIDVKICQEKKK

SEQ ID NO: 941695 - protein, 57 aa, Homo sapiens
MVARDRDLQQLRLGLVVPAAQPPPSWQQRQEGFDNYLRLIYGSGLLGMQSGRGSQQW

SEQ ID NO: 941696 - protein, 116 aa, Homo sapiens
GSRADVWRAVAAARNGGFPHIPGGGGGQTTVYEFEPAAVRTRVSRETEAAACIEGLVTVDFLNDIISTPNVDHIMDGLRNEGIEVRLERGENYDEETVRWADAVIAAGGDGTLLLA

SEQ ID NO: 941697 - protein, 102 aa, Homo sapiens
SFLVAKPRLEASSGGCRKPPMSAALPPGHKQVVKRGGVGAGSAQVRIPVYLEGLLRVCAGGRRWWQADYLPFSCSAAQEREQPPVRTQLQDTPSSWTLLPAL

SEQ ID NO: 941698 - protein, 88 aa, Homo sapiens
IQSKVSQISPHIQTVRCVLGNLIGVRYYSFRCSISEIEGVGATRYGLFRIGLGRKIQLRRKGDVWRVDFFGILFYVGKGGEFGWIVGV

SEQ ID NO: 941699 - protein, 48 aa, Homo sapiens
MSGVSACLCRRTFVTVRGGWVEWLSGGTGERDAYSVTRVSDALIVRRR

SEQ ID NO: 941700 - protein, 83 aa, Homo sapiens
EKNNLKVKEPVLMPAKSLRITKRNTPCGEGSQTQDHFQTRIHKQLVDLPGPSWIVRLIALLELSCEPRLTSPLQMLKPSVLIK

SEQ ID NO: 941701 - protein, 89 aa, Homo sapiens
SNPRFPNRPHIHRGCLLYRKIPKFSLAPALSPFDRTSNERVVGFKTRFSLREGAYRLTLQEEFRLALMMRCLCCILKCRVWGSGGVWGA

SEQ ID NO: 941702 - protein, 76 aa, Homo sapiens
MSYTLRSDLLVLFYKAKGKTFRYVSLARRPYRPYESPDLEPDIKLYYVLSRISLVRTSSPTLIKAYYWIVSLNLMA

SEQ ID NO: 941703 - protein, 163 aa, Homo sapiens
MTVTRPSTTARSRSVSSSSFKTRPSTPNNNKDPKTYPTLKAGDYDSSYTIRSLVFYESIGGAKFIFNAALVVLLSLTTFDIVDIISCLVLTLLSIAVDFEVCGSIVRTMRGSRRNRPLRDLPKHERLLYPRGLSVGCVGTTDNTRRRNPRARWFIFFLMRGSN

SEQ ID NO: 941704 - protein, 99 aa, Homo sapiens
TPTNANPRFPISPAHPKGTRHIDVCYNLLSSPGLTLTTCLCPPTYSTAEAPSAVPPRRIPAWVGTSDEYAYPYLEIEGSEPYVSKSVMLRGSYTTEPKP

SEQ ID NO: 941705 - protein, 111 aa, Homo sapiens
MSSLVVDVPRGLGERSRAWIYNFEGTRTGLGVCEGEGMKIGLSIIEDSSIDVAFEGESPERIANLGCVPNFLCYLRFCRRKRNLNFRKESFSVRVGYLPYRRHLFPRFLVW

SEQ ID NO: 941706 - protein, 119 aa, Homo sapiens
QSEYAKNTGLPPKGSVMFIGPWSRMESIMKSCKKLKLLWKLDDMTQKHQCALRSPGPGPHATVQNSGCRTGTHGCVQPHPPLSPNCKPAHFPQRRSWIMQALGSEDVLEEVASVNPKPS

SEQ ID NO: 941707 - protein, 167 aa, Homo sapiens
NNTHFHSSGAQEPWAEARMFAPGASLVVRSGAQELRALHALYALFPGASFPGASSFHVGVQQSRSRAFSLCAPHLLMQVMAFRAHLGTPRIHLYHRMREHSQVLGIRDRTGIPLGTALPPTTVPECDAHNGQHIQRPQEDLGWLEQDLVPGTGGAGDSRQRLDVYLK

SEQ ID NO: 941708 - protein, 74 aa, Homo sapiens
HCPGSLQPSTSQLPRSQGGDCQVHIGQRRLGVGRAWPNDQMGSTGCNRTQLVWPTAISPYLPGIQIVTPGPLGI

SEQ ID NO: 941709 - protein, 102 aa, Homo sapiens
VNPSRTLAAIGGLLDVDCSEEEIKHLIMAVRGQVSTDELAAEVKKRNRLKLMLPWLEAHIQEGCEEPATNNALAKIYINSNNRPECFLRENAYYDSSAAGRY

SEQ ID NO: 941710 - protein, 218 aa, Homo sapiens
RGPPCGSVRERGLQVLRSPWGPWDVHAHTQTRMGVIQAHIHKHMCAHTDPGIRRHTLTGRCVNTGTYRQAGICTHGHTWMHSGMYTRVHSYMTCTLTMRVHTFPGFSPHPTSHRARACLSLVAFAVWLPAPEAALVRTGWAMLRKQPGLNPQRLRTARAFLAPVACLLVGALPGGVAEGCAFPSVPAAGRGKRARWSHTGHLQLCWQRLLALCCSTSL

SEQ ID NO: 941711 - protein, 29 aa, Homo sapiens
ISILEEPSKALLGVTLDSRLLRLSLDGNP

SEQ ID NO: 941712 - protein, 112 aa, Homo sapiens
MIIKCKILLFLLDSCYIMIIVLQFIVHNMKNNYDSLQSGQGEAAYTTSAVRGTCGDSSGVAAQGALERAQHPCCPPAEPVLRECRTDADALGEISSIERKGVSVLLLFYDGN

SEQ ID NO: 941713 - protein, 77 aa, Homo sapiens
MEEKGAKRGLEAAGKAGLATAGPGLLPRKPPGLAAGPAGTYGKAVSPPPSPRASPVAALKAKVIQKLEDVSKPPASP

SEQ ID NO: 941714 - protein, 65 aa, Homo sapiens
MRLRQLGVAKNFGVLSDNFKGKRIVLVNDSIVRGNTISPIIKVLKESGAKEVHIRVASPPIKYPC

SEQ ID NO: 941715 - protein, 54 aa, Homo sapiens
MTDTFPKLYFDLCDLVGDHWDDPPDIGDGCRSPGGRKRTRLYDFYVCPGHTVPI

SEQ ID NO: 941716 - protein, 41 aa, Homo sapiens
MDPRKVKELRAFVKMCEQDPSVLDNEEMRLLREWVENIGGE

SEQ ID NO: 941717 - protein, 74 aa, Homo sapiens
RLRARPAAPGLKARAVRRGRLSHRGFGTLVREKGEREKRAAVLSQPQKVLASLRGLSRIPRQSRRRYLTCPKTT

SEQ ID NO: 941718 - protein, 58 aa, Homo sapiens
RGKLGLVGDNLTLDGVKSCLKPRLGQEATVVKATGFLKNFLIEPLVPHSEAEELYVWI

SEQ ID NO: 941719 - protein, 54 aa, Homo sapiens
TFMRVPSLPTKMSSMSTRMERANGRDRRFERKAMSTMTSLAQPEIQAEDQYALE

SEQ ID NO: 941720 - protein, 200 aa, Homo sapiens
MQSKVSQIARTSTGSYEFRLAIGIITIGYNLREHLRRTKLPSRNHTSTLNRPRRKRIYLTNANRRPPARALLLEGPCNHGGPLVSEAVVGGVLNRTICRLTLVFALLFINRGVFRVSDKEGTPLRSPPSRRCAVVFGAFIVVRLFGRVGTHGVRNRHGIFSNVFQGPVFYAVILNAFTVRVKVIRFKKGPFDYSPLRLSR

SEQ ID NO: 941721 - protein, 159 aa, Homo sapiens
NPNPRFPKSSRTSYFIPTQTKSRPVSPRCRRPKRRLPGFTFSSRSRKMNPNPTNPGEPIFVLKRPSPPPTTAPIVPGPSDLSTSATTLDRTHLQYGDVNTQRSAPEPLSTDQNHHLKNPESPTPRGSETSSDNNDNNNDKNHITRIDLYLYPIPRRRNE

SEQ ID NO: 941722 - protein, 33 aa, Homo sapiens
MSLDEYSYLTRINDQMDLSDTTNRLISPGDYVA

SEQ ID NO: 941723 - protein, 83 aa, Homo sapiens
KSNPRFPKSPAHPKGPSPTYKTKEGFPKGDQAPEDTNLKCLTLKDPPTESNAAPSLEGAPSLRRLDPQNRDLTRQIEKPNPPE

SEQ ID NO: 941724 - protein, 106 aa, Homo sapiens
MSSVASVSSFLTISRGRVLRSIGGYIVTLRRGSISNLSHATNTVQNQTTQIVRMIASRVSGCRTEDLRERNSKDRWTTLRRDRTAFCYTDEDDHKDPRLKPYPTRK

SEQ ID NO: 941725 - protein, 89 aa, Homo sapiens
MKIVLFTLLIKTLPFSSSGLHRLLRGIGQNIFRVPRFVPPSYRDLLEKVAQDKTQGGTRSKTGSRASLMPEQRAQTEPIPKTDPYHKMT

SEQ ID NO: 941726 - protein, 119 aa, Homo sapiens
SKWKDILCSWPGRINIVKMTILSKVICRFNAILIKVPMTFFAEIEKTILKLICNHKGTRITKPIQTKKNKAGGITLLDFKIYYKAMVIKTAWYWYENRHKDQWNRIENAEINPHVYRQN

SEQ ID NO: 941727 - protein, 48 aa, Homo sapiens
QKAMSDSAPRAQALTRGKFLSEIAGTIWTPLRGTDLERDGPTGLEERT

SEQ ID NO: 941728 - protein, 78 aa, Homo sapiens
VNSRRRATRPTICTYNVVPLSQRTGVREWCTGTVPIGQFLVNNEDGAHKIYRPNDFSAFHCQKKMMEVQKKSFEDKYE

SEQ ID NO: 941729 - protein, 70 aa, Homo sapiens
RFFCLGLLSSWDYGCARTRLGDFFVFFNRDGVSPRWSGWSRTPDLMIHPPQPPKVLEITGLSHHTQPKHF

SEQ ID NO: 941730 - protein, 308 aa, Homo sapiens
MARRLWPLQTRRGFRPRGGCIFNESKRRSFTKEKRNRNRLDKYARQGYSALYQLETERYSACPEEAADALERRKGELRSAEEQKKKKKGEELRQLEEQTWSLEEEKEAVNKEVRAPLEKKDSGEVQEEAKDKGPREHKGKTRKEPVEEYQREAQDKEQFDKKELKLPNKKHPEVHVRKEPGPNTPHKPETSQFFSFQPRGHLEIGEILDIIRQKRLSHVSGHRSYYLRGAGALLQHGLVNFTFNKLLRRGFTPMTVPDLLRGQCFEELWDDTKCNPSQIYNIDPARFKDLNLAGTREVGLAGYFMDTP

SEQ ID NO: 941731 - protein, 273 aa, Homo sapiens
VCQNNQRNFLEKKLMLMSDLDCEYQISNDYDKVYSYLKSGDKKEEILVLAETQVPVFIPHPWRWTHRRPTSELHVIVESDFVKYEGKFANHVSGTLEHSHSRRRSRLNLGGQQPRREPVFTSGTLNEAGGGFAAAHQRRCRENKKSDKHCASSSVLAGKESGPVRFDTEDHKMQKCVISEHMQVEEKCGGIVGIQTKTVQVSATEDGNVTKDSNVVLEIPAATTIAYGVIELYVKLDSQFEFCLLRGKQGGFENKKRIDSVYLDPLSFESLQS

SEQ ID NO: 941732 - protein, 211 aa, Homo sapiens
VSGFVFFISEIRVMELFPRPPGGFPGIFPPPTDEDIPGPRRRDEDKSLSSSGAKEARLGRGARGGSPREAGGLRGARPAPGAAAPSPPHPGRRRRRPARPAPPPGGGARGLPLLTTPGPAPAPGAAAEGPPKPAHSQGPGIWPRPPTALNWGVFEAPAGAPTLGRGAWEWRERTPHLGPGQPGVAKMDYGSFGFMRAEGGACVLVNRVLRR

SEQ ID NO: 941733 - protein, 146 aa, Homo sapiens
KVCSFIQPAPIQCTGKPRPPPPAPREPKNQQTPQVGGPKKGKGGLEGPPFKKKQKKKILRPKTQEEFPLQNLHENNANTPPVWTWERTGPFPLKKSGGAFEDGKGQPLTKQPKFGKTKKKTTMCQQRPPPHYEPWGLPPPTRSRHP

SEQ ID NO: 941734 - protein, 158 aa, Homo sapiens
MDVRRPPQRDDDIERRIPLNIHQNPIRGRVADVKNHVIPGSKNHHMTRRQRMLLDAHVNVLDPLIGELLTVLATSLNELQFVTPPHTDIDDESVPQQREKTYHDEVRSQTTAPGRQSRPRPQSGVVEAGLQQWVGAVDEGGGGVGEMTADVSVSRDHP

SEQ ID NO: 941735 - protein, 256 aa, Homo sapiens
LQNFLEKRPSKAWPIGPIGGGGGHCPPQQAKRHKIQLNMRGVARSQHLLGPWHAFRAGQLTQIWKSKKALLTKVVYEDRKKVLLRRIIIWILPFVTGLKIMVPPMLLLVLLRPFLSRRENKQLVAAINNAQGSSLLILLIFRTYLVMWIFPPLILFLFPISFGFVFIFMDRCFTVAKVNKKVHNKIQPIPFNTRGIPILVHRVQDDQQPMKTVSQYMTKLNNKDKLGHVPFDDKFTSTFGFWTGILSFAFSKTTSS

SEQ ID NO: 941736 - protein, 329 aa, Homo sapiens
SRKTTVLGLANWAHDTCGAGKETSQDQVARDVDGQGVPVVGSAATSVPGRDHVGDPWEAGSASPPTGDVGLVEERQSGGGPPCSPCPTTTGVVPPNPNRRIDNVKQAVRWKVHNLARVHHRKINVQTAMVKSEDDTHGPTYKHYWDYHQKMREVDHDILHPNIRNRDIIVVIQNRTIRLHLKVNYQNQEWFNKQFQIQLHPGGNRLQKVRILRRQVQDHLQPITKHVIVINNEDHDQIHNDDLGTQLNLNLNLHRPGTQHVINLVHHITEQYHVIINNNDAQFQSSYKQDCRRIWDHRRTGRSLDTTEPQMEQVNARLDLVHIQVDQTR

SEQ ID NO: 941737 - protein, 201 aa, Homo sapiens
CKKKIFIFLHQQTALKKKKPVLGLQSRENKGKFKKSTLTKGQFLTLKDTSQKPTHLTLTQALAGVIFFPPQDFQTLVDRGPQGGGDPVPQGQLATPGKTGGVTGEGRSPPPRNAQLNPTTGGLPSPNVNSVKFKPPLPWGTQSPFYEPPSALWNSENTDFANGEIPFTRRFNLINITYQKQWLTVSVNMFPERINLTINSE

SEQ ID NO: 941738 - protein, 278 aa, Homo sapiens
QTQLKKPLPTWYPQTTTLQPTLASLGSEAVPGACPAEATRVRRSDSRGLTGPQGWPRRAGCVVCEPGATGAPPQDPGEPRPQQNRGPRPPLAHGNGTWRPLPFPSRGPTTPPSGGDGSQPRAEPKPPGSGGSARGTASFSSRRSRYLWRRGAESVGQWFGLLPVNKGIVSPTATVVTSGGACRASINVASPSASYLFRWTETITLTTSPLGFLLFTQMNRPTVEQRRKKKRLPEKNHQTQWELLVPAPAFVTSQLHLVLVLTFLQGPIGRKGPGGQFL

SEQ ID NO: 941739 - protein, 53 aa, Homo sapiens
MYPTRLQGINCGPHFTPSFANLGRTNLNTRGPPRGGPGGELPRGPTGLRPRRS

SEQ ID NO: 941740 - protein, 206 aa, Homo sapiens
MAQGALPGPCSRTWGGLLPFCAGLGRGGIGSIPPFPQQQRGRHPNTEAQIAGGRGGREREKEIPRQFKRSGKNDPKQHYRAGGGLPAQGLPSVPPPVPPPPPPTQKIPLNPQEGSREYPIIRGQEQEKPQRRGRGLGESSGEQISQARGGPKGAASRGSSIPPGPPPPQSCPRGPQLSSTLLFGPQGFQGGEVGRRQASAGKVWIP

SEQ ID NO: 941741 - protein, 58 aa, Homo sapiens
RSRIPGIELTRPIEIRLPLVRESLQLLSLWLFRRHMFGLKTGMERMPSLAENYQGRGS

SEQ ID NO: 941742 - protein, 77 aa, Homo sapiens
YRVNPRVRSIISYKGRQLNLNPRYPEILQHVICKDWINLAEKNYIILNMTENIDCDVFRQHRGPQLLALVEEVLPRH

SEQ ID NO: 941743 - protein, 98 aa, Homo sapiens
MAGGFLELEELLVQAGTVPVAGTKHQQDQYDQEAEEQPCGQGAGCFELSGAVRGCPALLTVAVPVAVTDPMSMAFAWTFLCPQEIHTLASMVYTHQGR

SEQ ID NO: 941744 - protein, 180 aa, Homo sapiens
GMKNSLFYQKGEELGQYNIQAPNQKCSIQMQEKPERLGQGQGGELGPLDIQTTPAKKLGPGLFCLHWSKEKKDWVASPGLEPQQSGQEEKWHKGSGVWPGYTTRFCTGLAQPFPPKGPNTQENSALAGRRSKHFSVPKRAKPSSQKTEQNWDQTAPPQQEHAHEEAFPEHKQGPPKAVGN

SEQ ID NO: 941745 - protein, 247 aa, Homo sapiens
MDDDIAALVVDNGSGMCKAGFAGEDAPWAVFPSMVGRSRDQGVMVWHGLKDFYVGDEAQSKRGIFTLKYPIEHGIVTNWDDMEKIWYQIFYNELRVVSEEDPVLLMEVPLNFKANWEKMIQIMFEKFNTTAMYVAIYVVLFLFASCCTIGIVMDFGEGVTHTVPIYEGYALPHAILRVDLAGRDLTDYLMKILTERGYSFTTTAEREIVRYNKEKLCYVALDFEEEMATAASSSSLEKSYELPDGQA

SEQ ID NO: 941746 - protein, 120 aa, Homo sapiens
MGPFPSASTSLSKSGNSASGGVLTQPQESPKSLCGEGAIAIFIKKGEGFLEFSNVSFGQLNSHGASQGRKNRGSEGGCPSPGAATAGVPPMLPLLLLLQRRSVPNAAAAACAAALFRVRA

SEQ ID NO: 941747 - protein, 154 aa, Homo sapiens
MVKGFFSHSSNYSAYLSEMKTENKFTKQLIPNRVLEAVRGSPAPNRPVLGFPPDKFDSPRFSVFQNTKEKCGGCVFRRKIGPLLDGGGTATSPPGGGGPRGAVGLGGPPARLARAPAGGAPDILPKSLGGPGCGGRRAPSGPPAAGGQRGPCVP

SEQ ID NO: 941748 - protein, 178 aa, Homo sapiens
DGILPGWSQTPELKQSSCLSLPKCWDYRPELLDLAGSPIFNFLRNRHAVFHSACTILHPYQQHTGFQFPHVLTSFVFFLCVVLFVLFVFVLDRVSLLLPRLECNGMMSAHCNLRLLGSSNSPASASQVAGITGMCHHARLIFVILVEMGFTMLVMAGLELLTLDDPPALASKVLGLQA

SEQ ID NO: 941749 - protein, 244 aa, Homo sapiens
LGLRGRRGGLASYAETPEALARAAKKRELRLLLINTPPGDQEKRGNGAWGPSPGEKGPFERDCSRPCGMGIAEGQEVEFSLQGCCGKRRPGVFGSFPRGMDMIHLKAGRIPQEAKRIAVKAEMEAVFLENLRHTAGVLAQEDLVGLLEPINTRITDPQYFLDTPQQATHLTEDRKTQPPIKMDIFHWQIMDGNLTGNIREFLPIVGHVQVAQVPGRGELSSPGELNFPYLFQLLEDEGYKGFVG

SEQ ID NO: 941750 - protein, 114 aa, Homo sapiens
GYGSPFIFPYTMTCCWGLMFSQNSRKPKVVVISSNNRELRTKKNLHKSKMNRFKGVNANRFQLKASNSPRCSGQRNQQRKETGSYGLDFPTLTEPQEKRTGSCQPLEKSQNTQP

SEQ ID NO: 941751 - protein, 133 aa, Homo sapiens
QLLPIDLTSEIDSNTLIVGDFNTPLTALGRASRLKVNKETRDLNYTLEQMDLTDIYRTFHPTTTEYTFCSTVNRTFSKMDHTIDHKMGLNKLKKIEIMSSTLSDHSGIKLEIDSKKNLQNHANTWKLSKPALD

SEQ ID NO: 941752 - protein, 85 aa, Homo sapiens
GEEFIRNVFHLCHAFIFQAKRSPSSAFSWLQYEIAKVIWCLHTKKQRRDLKSQGEELQKTKPKNSPLRSPEKLATTFGLLEAVMH

SEQ ID NO: 941753 - protein, 109 aa, Homo sapiens
AHTCTYARMYSHARTHAHTHPCVCVCVCVCVCVCVCVCVCVCVCVCVCVCVCVCVCVCVCVCVCVCVCVCVCVCVCVCVCVCVCVCVCVCVCVCVCVCVCVCVCVCVCV

SEQ ID NO: 941754 - protein, 300 aa, Homo sapiens
CLFYWKQDSSQRQGPGEEARRVQSWVTLWASRGKRGLKIARTPKEAPLKQGKENKKGKLSQGGERKRAPTPQTPPPPSSKFPPPASRCQRGGGFQELTTASKLQGPAVKSREALTLGGPKQVFQNPTVHQSPPKKVPEKVKSRVFTQHGHKQQSSHEVSLGWSGILSCHSWGPSVVALRSMLPVLRSCVQVVGSGGPRSERLEEHLKVEALAEEPAGLGGPQSGVSGRLNLVRNPWLGLRSLRGAFSSGGFPYGSSWTLARLAGTREQDGDSGAGSRAVADAARSLENRMARPGTFLSSL

SEQ ID NO: 941755 - protein, 86 aa, Homo sapiens
EVISTAPVKLPTAESTGMTPEKVPVSEVMGTTLAEMSTPEATGMTPAEVSIVVLSGTTAAQVTTTEWVEKKDREININENEGKDER

SEQ ID NO: 941756 - protein, 62 aa, Homo sapiens
VPEEAAKLVACLLLLLLNGRDNCYSVKAATRVPGLPFAASQAPWPLALDSFLLVAFVQYPGR

SEQ ID NO: 941757 - protein, 204 aa, Homo sapiens
YGNKYLLNFPYKDALKRPKTQAKGRKNKGKARPNFPHGPAGKPVTQKSPSPKAAEGAGRPQPRGILNWSRPPRTARMGVTGPVPPACRRTVFPPTPMKGLEVNPPAREDGTVGPPMPYLPLAQASLPRMAALPRPHVACKPEVVDGVPGATVDTCVRGEPAQDPQQSFTHLIRSPFIELPAASHKQGVTCEHGRGLRASGLAHE

SEQ ID NO: 941758 - protein, 164 aa, Homo sapiens
QARILKRKSQGKAKTLPRGTQKRKTHGVGSCLYLKDMAGPRGPCVLFFHLLSFPGPPPPPHQPQIHTGGALLGIGGREVPPPGAGGRHAKNPPLREGEARKGKKATIAIGLGIKRSGPGAIFSPLLKQKEETTGPQQAGGGLSSQWAICFPGACFVCSPKSRKE

SEQ ID NO: 941759 - protein, 55 aa, Homo sapiens
MALDFGEADPSLPAFDSPRGPPPPPPGGRRDGEDFLPQGGFDAQQPLEFIVLPPQ

SEQ ID NO: 941760 - protein, 259 aa, Homo sapiens
MRRLLLNRGPECTALGHKLPSGPHPQGQVAGVGPPFLSCFGSSPLLFPFLKVPAAQRSFGALSCWEKIKGTQQPSFKKNSESPFWGASALGKFGVCVLPFEHSLLLPGGEWSGTARPGRPKADKRQGDGGVVASGNQLTVGKILRPVGGDDLPCFPRRWVSVGDSMKNLYHILIYEGFDSGDIGGIHQEGDCLPFPNLHCPFEHLLVIITGSKSGNGHHLWNSTEVKHTLVSEFEREEMTSGDVVQCIGYKFIQALPGQ

SEQ ID NO: 941761 - protein, 201 aa, Homo sapiens
MGNGGTRAKCVSAHRLSSVCVFVCVPPPMCVVSGGPMGVLVAEAGGGGSPGPWPPPSQWGLGSLKEVGPDGRQPSRGARSGKTLSRGPCPPHHHPSRWVQANAKARSLSFQGCPTPSTPSGQAEEKGAGGFSSGREGKAGLGKLVLHSFKEKTEEERLRRRTGGHRDMKGEWGALPSQGLPRLKASKFFSTPPINSTNASI

SEQ ID NO: 941762 - protein, 118 aa, Homo sapiens
GKERKFVETGFGEGAGGTAGGFPKRTEGGASARPGGSGGLATDPISGPAFSFPSASWGPRPDSGPSTCTCEFGASHKLPIHLTHGAPVVAGGLEAEAVALGVACALFTDDLGLEEGWE

SEQ ID NO: 941763 - protein, 48 aa, Homo sapiens
MVRSLGIVWILTRAEENCARRVIQWGRSNPPRRLGVSASDALNSRRID

SEQ ID NO: 941764 - protein, 161 aa, Homo sapiens
LKQVFRQKGDNEFIDMLNNVRVGNLNYETIEAFQKLDRQINYTDGIEPTQLYPTLKEVLMANQAKLNSLPGKVYTFQAKDPENPFLVSMLDNNLMVDKVLHLKTGAQVMCVKNFTDELVNGTLGTVLFMATRKLYMKFLEQYVYIDAEDQAALAEMRFVCN

SEQ ID NO: 941765 - protein, 159 aa, Homo sapiens
LPSQFFLGGFSFSSSRPRSFFPNFPSRGLVVFRVPGVKGEFQNDPSPAPPPGEWSLGWFGMFPWFLGFPGTGSPFPGKLGGSRPGPPGGNVFLIGWFPGPFFSPPGKFGGGPSPRWWGVPPRPGFPGGFCQPGVLRVLAFGPPNKGRPRGGGGNGGGPA

SEQ ID NO: 941766 - protein, 175 aa, Homo sapiens
LSEFMNLFSIFFSDGVFGGFCQFPKCHRLFSLVLDVLACVALSLLALDFLGPILPFPLCCRFPILNPCQSYLLPIGPGPLFAFPFLPSLFFRAVVFSGIFPFPGSSLVLPGAMGSCFLCCDSCFGWGFSGTPGSRGALLPAQVLLSVWGPSPGGVGSGGVPVSWVAVFWDVSSSE

SEQ ID NO: 941767 - protein, 322 aa, Homo sapiens
GLEGLGGVRFSAEDFAVPKGTGNGACDFGCREGDGRHSYFLYRFFLPVSALQDLRKSILRTLLDKIKDKIKERDKEKEREKKKHKVMNEIQKENGEVKILLKSGKEKPKTNIEDLQINKRKAEEDKDTQRNDKRKRPTLYSQSIQTICSGLLTDVEIKPPKRILPDNLPPYVGKPLATKTYDSPIPETREFPFVSLKEPRVQNNLKRLDTLEFEQLIHIEHQPNGGASVIHAYSNELSHLSPMEMERFAEEFVGLVFSENENSAAFYVMGIVHGAATYLPDFLDYFSFNFPNSPVKMEILGKKDIETTTISNFHAQVKERIL

SEQ ID NO: 941768 - protein, 162 aa, Homo sapiens
TPNIFFAMLSNLFQNSPPGTVWNRAVILAQEMVPKIPPPPGPALSSPPLNALPTINLPTAPPPHCEPWMGQRDVKATWVPPCPWESLLPQNRDLLSPPLLSSKGPPDRPMADCGQIPQSPPPPKAKPPAAEPPGPEARARGDPPRALLTATIPPPPDNPGHL

SEQ ID NO: 941769 - protein, 167 aa, Homo sapiens
MSPPPPPPPPPPPPAPPGPRPWHWEPPAPPPPPPGDQKPPSPPWGGAQLGELGAPGPPQPEDTEKKDLKAQTKGPPPPPPPPPAPPPPPPGGPGGGPGPPPQLDGGGLFSRGDRGFPPPPPPGLSLSPQFVSPPNPGPPPPREPLRGPPPPPPPAPPPPPLFPPPTH

SEQ ID NO: 941770 - protein, 66 aa, Homo sapiens
ARCVTRVAVAERVERDGWQAAASPGRGVPQKLARGRLWDDDDATRPSQFGGGPALMEEMEAEPQAA

SEQ ID NO: 941771 - protein, 145 aa, Homo sapiens
GRQCAGKVRQEIVDDHHVGAVFQVAALDLPRVPRWRESARDPRRIGNVNQPPEGAPDRTLVLVGQRCPGDAQTGQPCQRGLVVSDDRIQWGIDAPAAQVLELIDVVAQLPTDRRALAIGRLRPPSHAGCYALPRSSPVRIVARSP

SEQ ID NO: 941772 - protein, 288 aa, Homo sapiens
GKRFAHCDLPPATVARWASSKAQFKFAPERQEPPLLLDTALRILQAVGNLRRCAAAPRCNPGATPLMTALCMGKAREPVLIQAFVSELAVERLDVGILRRFASLNQFQGHAAGVCPLVQRSARELRPLVRAQALGEPLKRAAWSSARATYKPEMAVVYDNVDRFFREVINDGQALQATPIGQRVHHEVYGTDLVSVRPAEPVARARHITPWRRRRRRTAKPASRYNLVYAFVIRVQTLALQQNVQSPVTKAPTLMRQSNHPRFEYLVSWRSLRFVMQHAAGQPDKPAG

SEQ ID NO: 941773 - protein, 206 aa, Homo sapiens
MGISFYSSTPSLLIKHRLCLLSIQTFDFSVGEDTGEHHHAERHFEDEDEGEGQGGSSGHDGPEQGQAEQLQGRYQVHTEGADIFYVIDILVVFWRHYHIHPLIKLSAFKGGYSHFQENSKNHGQGDLPEQIPDNYGEAHKQGNQQPRHPLLLDFLNLGLVPRCHSLAHDSERVGVTEKMDSGSSQPGQAKEGTDAAHCHDDSRSRW

SEQ ID NO: 941774 - protein, 121 aa, Homo sapiens
MRKKIKNYKGGLGAPEGKRLGKWGGGEEEGGNQKGTDPAARCPGPQTGGAEERPRGAPGTGHQPLGAPEKEKNQACGGLGPNMAEKGAPKDPGGGRERLLPGGGGEGGGGAGGGGGGGAGP

SEQ ID NO: 941775 - protein, 156 aa, Homo sapiens
GAIWAFCFQFGGKLELGLGLWRRIAGEPLGQGWEKGSLQEAPRFRLERGGLRLGVKKVIGLVGEKLCFAVGEKGGGGGERGGGGVEIGEGRPPVCYGAARRIGEGQREEQAGGRGGGGVMGEERGKLAGAPRRSGENSVKGKGRMKRSKPGAPLIG

SEQ ID NO: 941776 - protein, 109 aa, Homo sapiens
MLDFLKINPMKASGGIPQSKAVFIGKGEERPRALFPRGLFVVGDLLSHLERRWRNEENPPGKKRLYRGEEEPQDLRREEDPLLLKNPFLKLQIENLQNQSREENQKEND

SEQ ID NO: 941777 - protein, 60 aa, Homo sapiens
YIIKTITSEDVAEMHNILKKYHQYIVECHGITLLPSSWHVRLNVDGVGIYVIVTRNVFSH

SEQ ID NO: 941778 - protein, 75 aa, Homo sapiens
CPPELPLCASVTLLWGLTAGYELARISGALLALHLDSWLTCSYQEVLAGSLLPGALLASLVGGFLIDCFGNDCYG

SEQ ID NO: 941779 - protein, 192 aa, Homo sapiens
GQLKSNTNINQPKIREKRKKMKETNEKKKNIKQKVKKFKQQYGLDKKKKKTYNISYFGALNEIKKQEIQGVVHKTCRPTKRHPETPNGNGGTEKQDCPELVFPLQRPTALNKGFANNFFLYFFLFSFFFFLFSFKAKNNRGQRNETKPAACPFEKQTQLLPNFHTNSPKNPKHHGILHALQPPRCKKGIVQE

SEQ ID NO: 941780 - protein, 67 aa, Homo sapiens
MVLWLAQNAQLGDAEAQATCNFPPPELNELTHVDVCLPPGGKAEMLRSPLQTGSPGWGERAPPNFAT

SEQ ID NO: 941781 - protein, 130 aa, Homo sapiens
GYDSVRTGPLLRRPGMLASHMSALSQSQLISHMGIRSRIAQQLPITGGEQVSDPLPSSSTHEEELEVHFKISGERRPETDPGKTAQNPRTRTQKDPNEPHKPVSACALLFRDTQADIMGQNPRATFGDVF

SEQ ID NO: 941782 - protein, 129 aa, Homo sapiens
MPPFVRLQFQASQPKRGALLTAWLGAEQVVSLGWQAGAGRQVGGLPSSREALIPKVKPYQKTLILVPVADIGEESRPSGKRVEVPLQGALLTPLVTQPPEQGKEGARVFTLALHSHFGTYSPWDVREAG

SEQ ID NO: 941783 - protein, 110 aa, Homo sapiens
MTGGGGGNQRPPALGGRFPPALSRPLWGPGQALPVLLFLPLPQGRPNPVKFGSLCRVFIPADLPELPPMGGNAWWGGWPPLPIPPSFPSPFWGGPPRVPPVSPVPPEALQ

SEQ ID NO: 941784 - protein, 72 aa, Homo sapiens
MPVSLGTSILGTGPEHMPWTVLPGFGFLPCAAGESERHDDSIAGHTLSRGAQQGLGRQSWPCWEHCVEALEG

SEQ ID NO: 941785 - protein, 134 aa, Homo sapiens
MGLPGTISTMAASPDFKNLGPSSSFLPERRSIFSFSSANLHAMWAREEIQYRGIAGAYLAWMVQDNHLSREASSFHWWVIFAVTTNVATTKNLDRHILDIEAHIVPRKSFTQSFKVHFDRIYFRCNVDWSKGEH

SEQ ID NO: 941786 - protein, 126 aa, Homo sapiens
SLPQIAEPGNGVGAGAFAVTASEMLASRFSCKVMDETSYWSPVDSFVGASMAAVILCILALVGANMLLLLASGWILAYGGVLFLGFGGSSWTSYMAINYYMTVLGVAAQLFAMVLLVGMDRTLIVD

SEQ ID NO: 941787 - protein, 85 aa, Homo sapiens
MTHILASSISNDRNTKAPCILRHLVHCCRLGPPTGQLFLRDAEGATPHPHPLEIHTCINEVLGLGSSYHIASNDLEIRVFVFYVL

SEQ ID NO: 941788 - protein, 33 aa, Homo sapiens
MRKKRTPAAGCVTVFRNSGYRKSVLDAEIVRIE

SEQ ID NO: 941789 - protein, 143 aa, Homo sapiens
KKTYLFARPGGGLGVRFRALGPKRGPGGPVGGAAGPRGTAGPEARPPAPAVGGTRGGGRARARRGGAPRVGPAPPGSPGAARPSGAGGPGGPRGPGGRPGGRAPWAARGGLLPCRGAGGPPPPPRSGGPGPPAVSPGAGLGPP

SEQ ID NO: 941790 - protein, 100 aa, Homo sapiens
MGLHNTYYVVAHLHDVLSIGAVFGIICGFIHWFPLLSGYTLDQTYAKIHFTIIFIGVRSNFVPTTLSRPIRNAPTLLGLPRCIHHMKHSIIWRLIHFSNS

SEQ ID NO: 941791 - protein, 34 aa, Homo sapiens
LLAAASVVNSIRPDRWIPSNYPITENFRAIYLTL

SEQ ID NO: 941792 - protein, 168 aa, Homo sapiens
MTVSKGLPTAKGEGNPRVSWHGLSPHYLMSVPPNKKFEEAGGEDLTTSYRACKGKKGCLCGFPMSRKPGDTGQVAEAPNSVKTRRLNAQVQEKQKWDFGGGFFVVLKNKHIIHLLVAPELLAWPPDPSPLPTKPKGVGREEEDEKFQGWGMLQSLEIDRDSEPGEPWE

SEQ ID NO: 941793 - protein, 99 aa, Homo sapiens
QVNNGSWTLADVLSLLWTNMEQTTTLDENIEKVLMKRKTEDEEAKSEKLEKDKEAKEGSEPAEHEDLQETDEEGSKNDASMTDYSLTADNMLTNRAPEQ

SEQ ID NO: 941794 - protein, 33 aa, Homo sapiens
MTCPQVTCTGFSYTSKHTGHVNRRNIDTSPIVR

SEQ ID NO: 941795 - protein, 88 aa, Homo sapiens
MVDRVNFCCRNVHILMFFCLAVEWMLAMLITMIRPKPGLCTKKRLTCTTELTDSCNTDTDCTELHNSYFYGCQNKSMDSFLQKKCMDP

SEQ ID NO: 941796 - protein, 91 aa, Homo sapiens
MARHDTLDRVTFSCRNVPILMFLCLAVEWTSAMLITMIRPKPGLCTKERLTCTTELTDSCNTDIDCTELHKCCFYACQNKSMDPLRRSAWI

SEQ ID NO: 941797 - protein, 91 aa, Homo sapiens
MPSSACFQREYGFVKKGCNATQSESAYKHLRGTMEGPDSSDSCLLIHICWKVDSEASDGAADHTEYLRSGGAMILIFIVLGARAVISFCIL

SEQ ID NO: 941798 - protein, 101 aa, Homo sapiens
MAGGREKVGSGTATEPGVTREAAPVVRGGRRGERPGAQKSSCTLRALSTSFLPVKNSLFLSPFSGSRRWFWFSSATAIIFLASFSALYSFMGSMLLSSPAA

SEQ ID NO: 941799 - protein, 78 aa, Homo sapiens
QASASCASASEYINEILLTERDYAGTLRFLQSAFLHRIRQNEADSVEKGLTEENVRVLFSNIQHILEVHKDCLVALEY

SEQ ID NO: 941800 - protein, 169 aa, Homo sapiens
KNGMLLYLFRRAASITHATQTWQKRFGENGLGTLKLRGPGEKVLRQKPGVQGGPRARHCGEGNAGESGPTLQLGTRGRKERGQANVPLPQEQTTGPQEGLQAARSLPSAGGSRGRKGWRAAGRQPSTKRGRPGRHGGKGELAGHPGPRQSALQFAGLRPPQSRWGQRWL

SEQ ID NO: 941801 - protein, 48 aa, Homo sapiens
MSGTEGGEEEPPVYGQRGNTVPKFRERDSGEKSLGLPKPQLLFCKTLE

SEQ ID NO: 941802 - protein, 258 aa, Homo sapiens
YIVKTKIICLRLANPWEEAQNAGLSFMLPWAPTRQAGRKKLAKELKIFGSSAKEQQALLLPKPKPANTGLDCSQEGGPAKIPKKVRQKDLFLELPSLPSPALSKPRRTENLGQKLGPSEKDQTNSCEAVSVGPVSPVKKPPGQGRPGSPPGITPCTQLSAGHSAGDRDGQSLFQKTTVGETCMAAGLSLLQPPFMGSWLGLKIVGPQLSVVQKNTSSSKKPLKLGARLGTGLWKLSQGCYFKALRTASSFMGHSQGAL

SEQ ID NO: 941803 - protein, 330 aa, Homo sapiens
PRNARPVPCGDAQRIQPRAASPALRCPALRCPAPGARPERRIHVRCDMSAYPGSCDELCWGESSEPENREGFGPVIKESGPRVVQDGSSPGECGVTMNKSPEGEIRICWQRRTTIWTERMAYVKAWSTTPHSGRSTQSSSPSLRKRLQPLPPSRPPPEPEPGTMVEKGSDSSSEKGGVPGTPSTQRIGRRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRSGRMAAVKNAESR

SEQ ID NO: 941804 - protein, 88 aa, Homo sapiens
RPLARLSLRFRFKVRTFSRTSCQNRCLAYISCSQDIHGAILRCSGEKPALAFKNHRKQGCVCIQMLSLAAEGPASSIGPQSEVSSTEP

SEQ ID NO: 941805 - protein, 213 aa, Homo sapiens
MRERHTEKAAAESSSSSSDTDTAAAQREREQQQQQQRRAAAAAEQQQQQQQQRCSCAAQRQRAERDTAQQHTHTESAAEREQQRQQQQQQKNNSSSSSSSSSSSSSSSCCSSGGAATLQQQNKTEQQQNNTTTAHSSSSSSSRTAEQQQKKNKTTTTSATTTEQQAAAKKAAAAAADDSITHTQRARERERHTAHRERDRDTHTHTHIHTHTE

SEQ ID NO: 941806 - protein, 65 aa, Homo sapiens
PAPVMQRAESQRRELEPHAQPEAGEGLLPYYHHSPYKHAHIPAYAQHYQSYMQLIQQKSAARRGQ

SEQ ID NO: 941807 - protein, 49 aa, Homo sapiens
HADGRSKALLSSDRLPEVASLAAIVLSNSTTLAAARRGQRFSYERLRFE

SEQ ID NO: 941808 - protein, 173 aa, Homo sapiens
NKYLEDELVPKSIWALGLSSGVSHPWAPRRGAWVPSHPEIKKRNGELGAGLQCAPFLGPSPAIYRKGVVGKKKTGISRRKGGRAVVDYTWFCWFPGGESVCGGGRGPSDLLLEPVVKDQPEGAPHAPEEEDHAPLKKAFPPAALRIFLQQWGEPVFMMLAPLRPGCIIMPRRP

SEQ ID NO: 941809 - protein, 307 aa, Homo sapiens
LQHRHRFQEAWRGVRPAVGRFLFGPRGHPHRALALRPRCPPPPRALPAEVPPVRSPALSSAGRIARAGAARKLDGLRTALFLCSGLARPRVAAGEMMQEVSSSLVSLADESLSKSEEEPERQQLLSGKRGGGKLRRGGAGGLRRGARRKGWGRRRRRRAGSPAQGKPGKKSAGCGGGGGAGGGGGSSSGGGSTQSYEELQTQRVMANVRERHPPQSLNEAFAALRKIIPTLPSDKLSKIQTLKLAARYIDFLYQVLQSDELDSKMASCSYVAHERLSYAFSVWKMDGAWSMFASTSRRTPHPLSRAG

SEQ ID NO: 941810 - protein, 307 aa, Homo sapiens
PQTTLMTQGEGGAGRGGTLGGGGGGRLREPRRALAAGLGQGGAEQERRAQAGGLRQSGERGQTGRCPPPPPRPQHSKNKKPPFTAQTTQGSPAPQPGAPSREEEPGGAGRGPPGADTAPPPTLAPGGRDRQRGTEETKPQLPPNPNAGWAIQAGTAGPRDFSPHQTFVLPQAGSLAETAPRGAGARGSEAQGAWETGKSVVPKFFPAQASALASRKQGQVRAGETQAQRGRVVWLQTRCSVSTVVEKVELAGVGGGVVVVSVEVLSLVLEEAVTQEGYHHHNAEDQEHCDIISTEPVLGMGIPASGQ

SEQ ID NO: 941811 - protein, 113 aa, Homo sapiens
MWASPEGTLRSQLASPKLKNQLKSKEGPKNKKNAKVSFQTKPGKSGTNTSASLYWLPKPTLVQSEGTAQGCEYWASLGPSWRWTTKETNPCLPNPAALAFGPQDKIEWRLPLG

SEQ ID NO: 941812 - protein, 31 aa, Homo sapiens
MRLEFYYYENKFSEKKTNWAFNYTNLNDKTP

SEQ ID NO: 941813 - protein, 107 aa, Homo sapiens
MSGLPVGFPNKGIPSANLYKGGTKTKAKETTTKIGSSKTILKEHFSILKKAIPVSNESKPARSCGPIRSSPNCATTPSNPPLKVLQPFKRYFTAKKKGKNNRRSSKK

SEQ ID NO: 941814 - protein, 282 aa, Homo sapiens
PQLTFLKGPKKPGQNFGQVVANKKNRFEKPKTKNRHTLKRKPKWPPKHSPSPPKVLRRFVIINQSFTTNPKGPMETNCPETGPPPPIKRGGAGIRENNHLPPRASRADLVAPPPPAAPQPPALMTPTTTARPTPRTANAAQRRKAREAPNTHGPARHHINNGSLSRIQEFRAIFQLFTRTAINLFLQLSKLACHVSSVEIQYRGIAGAYLAWMVQDNHLSREASRFHWWVIFAVTSYVATTNILERNILDIEAHIVPRKSFTQSFMEHFDRIYFRCYVDWGK

SEQ ID NO: 941815 - protein, 302 aa, Homo sapiens
EQKRRKDRPGIPGCENNTKKTKIGKEKNQIKIVVIGNVDSGKYKNTGNLSNKNGGIDKRTIEKFEKEDAEMGKGSFKYAWVLEKVKAERERGIIIEIFLWKYEKSKYYVIIIEAPGKKDFIKKMIIGKSKDDCAVLIVAAGVGEFEAGISKNGQNREHALLAYTLGVKQQIVGVNKMDFSEPLYSKKKYEEIVKEVNTYIKKIGYNPDTVAFVQISGWNGDNMLEPSANMPWFKGWKVTREDGNASGTTLLEALDCILPPTRPTDKPLRLPLQDVYKIGGIGTVPVGRVETGVLKPGMVVTF

SEQ ID NO: 941816 - protein, 141 aa, Homo sapiens
AFNGLTFINFNISSARAWGKGLGSVGIGGPCWERGGSECPEFSGLGEKFGFHASGVLLQGDGDSRGGEGEQGGSAAAPPGGTLGLGPGVGAAAAVEGGGGVQLDPERKLAFEGDKERGELQGEKPEELLGFVLLGRAGQKQ

SEQ ID NO: 941817 - protein, 141 aa, Homo sapiens
MAKRSKAPAAIRRSGNCPVTNPIMWVTSLAPTTVANSPTARPASPPPRPNSGGTSPQKLRPLPSPARRLICFPAFPRRRPAFPKGFFRALPNPKNPFPLSKKPSRATNSRRILFVPPKIRKKRRSRSPRSTPGSFMKPIPP

SEQ ID NO: 941818 - protein, 227 aa, Homo sapiens
GVAQFIGKTGTERGERRARKPGAGAPFHLKNFHWTLKASSQSLTEGHWQPEVQKGAWRGGGAPERRAGRGRGGGRAGVRSAAPPREGPAAGALTSLARLLRLLRRLGELAGAAALLPHVLKNAKGQRLPQVAHGERPKSGYWEKLSKKKGFPGTISTMAASPDFRDLGLSSTFLPKRRSIFSFSPSKLAGDVGCVAVDDRGVAGANLPRVVQDDDWGGELSTSCGGS

SEQ ID NO: 941819 - protein, 109 aa, Homo sapiens
MCKTLSSPPPPNPKTKNLKPKDPPKQLPPEKPFLFFLSSKVPDGKPSSGKKNKEEPNLATNNPRSPQPPLEAREEGKGDGKRMAARQEPSPSQKTNKNLEKKKKGPNQL

SEQ ID NO: 941820 - protein, 35 aa, Homo sapiens
MAELAPWVGFVGRDVEASSLVAVVVVGAGVGVRAP

SEQ ID NO: 941821 - protein, 128 aa, Homo sapiens
MNALLPAYSAFATASSMGPSRELACPGRGSYAPPPINWNPLMVSFRGTSFPIMTCEDLSNLEWLREETLFFPCPGQGQLFFLRKFIHTQDGNDILEGFVVLQDLLPPTGNIVMPPANNVGIHDTRGGV

SEQ ID NO: 941822 - protein, 103 aa, Homo sapiens
MRGGGRRPRTTSNGRGRGSGSGNGMARASGRLGPMTAGPAGAPPAPTATARYIPPAQPPPPPLPLPSISGPTPGLGPALGGAAGSSKGGLSSAMEPSGGPGAR

SEQ ID NO: 941823 - protein, 245 aa, Homo sapiens
SGSAFVCGGLQGRVVGGSGEEEPRNCVTGASGGGHWGPLLQMPIGIPGAAIGGSGYRVLSSSTWVGGSHGSNSLEAGPWAHHFVFQEHVVLWREPHAGPEDVLDAAALAENLIDHRAAGRHLWLLEEEAEQGQPGVEGLRLGVHLSSEAHTLAHSVSSPRSSMMGAASSQSSHVLCSPSFLVPPSISSEVYSSSARFLLPTFGTNLMTTLEGLFAGRLEHWVALHHVVHHVALGHLLRAELQWRR

SEQ ID NO: 941824 - protein, 271 aa, Homo sapiens
MDAGVTKSGRNVTITIRHLMHGKEVGSINGKKGEEVKKIREESSARIKNTEGNSTEKIITLTGPTNAIINAFAINKEKLEEDINSTMNNSTAASRLTKDPEAGGAGHPVRLPEWKKRVYQNKEIRESTGAQVQVAGDMLPNSTERAITIAGVPQSVTECVKQICLVMLETLSQSPQGRVMTIPYQPMPASSPVICAGGQDRCSDAGGYPHATHDLEGPPLDAYSIQGQHTISPLDLAKLNQVARQQFHFAMMHGGTGFAGIDFSPPEVKGY

SEQ ID NO: 941825 - protein, 146 aa, Homo sapiens
MRNPTAPFVWGLTAPEVSWARAKPSQSPQGQPSRGPRLGPPESHPQVCATLGLRAGGVCSHRSREYRTLPGRGPLERQPPRVPVSTPPGSENKVESRPPASPAARSCPLSAAPTLGHSWLLLGAMQPHRAPAHPGPGRRPSLPDPL

SEQ ID NO: 941826 - protein, 167 aa, Homo sapiens
MIEAPVPKPYPFPFQQIPGPPGGRRLSEGGTAEPAPRPPQPGGGPPPGLGAVPDPPLGQSPGPGEGREAGAVAGPERLWVSKLVYENNPFLQGPPNCSDKVKEIIFSVIHRGQPEGKNIDHSRKFAKRLKLPPQINVGDTELLQAAPVPTPEETDIRDVAEDHGQPF

SEQ ID NO: 941827 - protein, 133 aa, Homo sapiens
TAKKGNRAPRPGPPNPEKPPKQNSRAPPPPKETPKPPPPKRKNPAQNTGGGPQKPTKPQTRPPEARPNPSHEGHQATGTKGGTQRNGQGKKEKAKGKKKPQKKGKNSKKAKKPGPKTKTSPKDKTLSKANPVS

SEQ ID NO: 941828 - protein, 130 aa, Homo sapiens
MGVQKPKKKHLLSKATELNNQLETMLPKSLHCHFSKLQRASIKPPLSKCKVLEKDCTPVEKGFQKAVKQKKRRGPIQEAAVREEKTNTHQENHAVKKQNQGLPPVKKENMEIVLKTWGKLHPPPEALNPT

SEQ ID NO: 941829 - protein, 196 aa, Homo sapiens
QNKKKPEKKKPKKAHPYRKPNPKNVKTKPAVPPRKPNPLKRKNEKTQNFIPTLCGENAVCSQKKKPTVTQTKKNAINPKQPKEKKQKEEKKKEPNKKKNHITFHKNEQPKGAPKKKPLKNIPARTKPSRTPRQSQKQRPLPNRGTECPAKSRKQPSDHHPQGQVAGMRHPFLSCLGSSHLHFTFLKVPATQRSFRD

SEQ ID NO: 941830 - protein, 206 aa, Homo sapiens
GSFKFELRAGPSFNISEEGSKGEREGPRSRATGVLGSPQPLGANPPPKDPFFPRGQKGMKKGMKGTHAGANKQKKKRGFWHHHIWAQQEERKEGGLGEQAASVKGWETTGLDARGTFPGPTATEDRGGFLQGPPKGFFCGPWMGLEEIGLINPHLAVFPGMRAPGLLPGLCSGEGLQRTQHQGLQRQGLHQVRVPDHSPVERLQVL

SEQ ID NO: 941831 - protein, 142 aa, Homo sapiens
MSWYSHLPYIRLYPELMSRRSVSLRNTMKPMKVRSFLPAPLMAFLSLSPKKAGVFLKDFTTANMPSSRSPDISRQKLFSISRPFILWYSLKTATRWARLRELRTALNLDSSVPRRFSPAAYSSWASLWASEKSTFVLSSRFP

SEQ ID NO: 941832 - protein, 103 aa, Homo sapiens
ENLNSQSCLFAAESCGQTGIPPNVKRRMSQNKKKSKRALLSFLSLRRRLLAFLEKEICDFLNKWATGLNEQSIPFPKGKNKKKKQTEKKPKPPTVIPKNLIKD

SEQ ID NO: 941833 - protein, 193 aa, Homo sapiens
WGKLPTLLGKRGPKGLPRAHPQSKKTKKEKKRNLQPSPLSLGFWARERGEKGRGGLALKRPEKEKVTGQGCKGAQSGDWGRMTCPKEAHLTQPPVWEGASARHPGGKGDFKKPTAGSPCGPPPPDIVEAKIKKRWARQGEAPGKNRKVLGKPQGQQLLWTEKPRVSDLHPLLQALVVAEHLHAGLFFWVVGWL

SEQ ID NO: 941834 - protein, 194 aa, Homo sapiens
RPDMFIRPAPTPPRGEGPPKPNPGGQGGQGETGARQLPPPPPPPKNPKQTGPQGPRARAAQGIRGLLSPQQQIPKSSPGQKTPEEKPQKMAALFHPPHPKAPKGAPPPHPNNLTKRNLKKPGQPPDPFKPQRAKKKKTSKKKLLENPQNVGVQRGTGGKTGGVRPCCRKPLYTEKILLLESLLWALRKPSSYRS

SEQ ID NO: 941835 - protein, 132 aa, Homo sapiens
MKGWGLWGFPGFLQTPKPEFCWSRMSTAKSQSSPPFLPPSSPCFNAQIAWLEMEGGAGARINLKLKPRDFHIIEAKSQSRAGRCCQRPGSREAKEEGARGKGDTGPNPGFPPTAGAAQGKARRGRPRPPGGR

SEQ ID NO: 941836 - protein, 314 aa, Homo sapiens
QKGFNYTVFDCKWVPCSAKFVTMGNFARGTGVIQLYEIQHGDLKLLREIEKAKPIKCGTFGAISLLERCCTKCSTFNRFGLFSRDDLATGDFGGNLHIWNLEAPEMPVYSVKGHKEIINAIDGIGGLGIGEGAPEIVTGSRDGTVKVWDPRQKDDPFANMEPVQGENKRDCWTVAFGNAYNQEERVVCAGYDNGDIKLFDLRNMALRWETNIKNGVCSLEFDREDISMNKLVATSLEGKFHVFDVRTQHPTKGFASVSEKAHKSTVWQVRHLPQNRELFLTAGGAGGLHLWKYEYPIQRSKKDSEGIEMGVAVL

SEQ ID NO: 941837 - protein, 133 aa, Homo sapiens
TNALPSPRANSDSLLIYCNGQGWLVPERRARATARTHTVINFFKNERLEELSGGAAAAGGSRCCPAVEGNPSARAARARAGGRVAGWSGRRRFRELLDWSPPPRVAGPPPCPPAEAPGPPWALLCAGPAGAEV

SEQ ID NO: 941838 - protein, 122 aa, Homo sapiens
MKKQFGPPPAESPPKTNHPIQTSIPLHGARTTKNRTKGAKTLKNTLFWKKKGGPERKIQTKTQGPNPQKKPKAGRAGTTNSQNPQFKQKAQKKQQNPEVSTKIRKRAKNKEKINEKPKVGQN

SEQ ID NO: 941839 - protein, 165 aa, Homo sapiens
QQEPWLHLENRDLREKIPPARAPPAKTTFLSKGPAPRPPRPPPPAPKPEKRRGGQARPPRSKKQEARGAQKKGKYTKNPGWPPGPRKILEPKLGGLPEKKKSGPPGKKNGPFLEKGEEPKESGAGGLKERTPSNPQEPQKIPQPTVSEKFTHVPPQSPQKTNPNN

SEQ ID NO: 941840 - protein, 122 aa, Homo sapiens
TTKKKLFLLGLQNLFQLKRISFVTQQGPGTSWLEFKKPEFWLPKKSILYVVAYKPQRPPPPDAWPALCPPKKSSCPPACLNEPLLEVKNLPHPFVHFQKHRLRLCLLLLLWHAQQRQKPAKI

SEQ ID NO: 941841 - protein, 256 aa, Homo sapiens
MREQKSQKDTTQFQKTIAGEKVTEKDQQFAKVLEDAFLGEGDLYMPGGGGLIPGGGMPFGVPRAGGSPIGGPMGGLTPGGGAKMPGGGVALPTGGGGVPRPGGYCVGAPAILAVAATAAAATVPLPSGVITCWDGPPTPRTGPANPAGAWGIGTTNWYSSASCPTNPRASSSSSKWYPSNASFFGGGPTTVMDTKFFPTQQQQNQKPLFFTLWLLRILWLDLFELITMTEVQIHMLLKSLKGAMKIRPFCRINLIL

SEQ ID NO: 941842 - protein, 290 aa, Homo sapiens
ELRCLLACARVRFMASNDYSQQATQSYGAYPTQPGEGYSQQSSQPYGQQSYSGYGQSTDTSGYGQSCYSSYGQAKNSYGTQSTPQGYGSTGGYGSCQSSQISLTGCSPPNPGYGQLPAPSSSGSFGCRSQSSSYGQPQSGSYSQLPSFGGQQQSYGQLLSYFPPQGFGLNLFNSCCGGGGGGGGGGYFGQDLSSMSCGEYEVVAVYGNKDQSGGGGSGGYEQQDRGGRGRGGSSGGGGGGGGGYNRSSGGYKPRGRGGGRGGRGGIGGSNRGGFNKFGGPRDQGSRHDSE

SEQ ID NO: 941843 - protein, 135 aa, Homo sapiens
WVYSKFIVIKKPGRKKFTGLQQKGVLSSGGSLNPASSAQSPEKPLSWYHPAPLDSECEKRGCTPELKKGGGPTGQKEQPNWRNLHKHSKGCREKEQFPTPHYSLLKRERVRQQQKTMFFILKKTSKGWSGRSKKQ

SEQ ID NO: 941844 - protein, 60 aa, Homo sapiens
MGGEGSSYSSLLIHNCWEEGSEARVEPPIHTVSLRSGGEIILIFIVLGAGELSPSASCRQ

SEQ ID NO: 941845 - protein, 132 aa, Homo sapiens
GKAKTLLKGKRKEICGNLKRGNLDTPPQAQDQEQSGLFLDVEVRKGVSIYQQFPSKKQPLRSRGAAFLILDLCLEIVEGVTGLHHVGEGLTSKGLHEDLHPTPERERQGQGGLFLDVVVRKGASIYQLFPSK

SEQ ID NO: 941846 - protein, 148 aa, Homo sapiens
MTASADPKKNKLLSFHCQGIGPGSPPPPRFPPPLSLTRPEGESTPRPRPPPPRKPLVRRPGGPGTVGTRKPGRSSGPRPRGTPTLAKPPPEYQGRKALRRKKDGKSPEKRLKSSWMAGLEPRKGAEIFRPRGGMSHTAVFTFLGIHST

SEQ ID NO: 941847 - protein, 126 aa, Homo sapiens
MPFSQLSSFCQTFFNGSHQKEGLFWEKVKFTCQKLLESFDGLLQGYQLPQKNCEDLSNLEWLKKETLYFPCTGQGQLVFLKKFIQTQDGNDILEGLVVLQDLLHPTGKNVMLNAKNVGIHETRGGV

SEQ ID NO: 941848 - protein, 111 aa, Homo sapiens
KKKLYFLGKQPKVSEKRKTTTKKLKKSFRNKGTSYCHPSSGKHHFKAGPEPTAVPSNPKGTRARPPPPGTALHPLLTGASKKQRAAAFPPGSDPGLEGGTEPPPPPGGRVT

SEQ ID NO: 941849 - protein, 237 aa, Homo sapiens
RGPSLFKPAKDTPGAQGSWGALPSLAAEEGQSPEPPWAWEKELPAPLFGAQRQKKKGGGGAPGEPTFNVNLEGKENQRAVFSLGGSKGPAQDPEGAGAFQREGTGLTAAVTQLSGGRVFGIRVFRAAEHHNAFRCLPGATGHVVAVGQEDLTSYDGGPGARRSSQVGGDTALEVLGLGFSWELRANLTSFPSSDSILMTFLGDWVWLLFLFWAVVVFEKSRSTSIGALGVLAASGLA

SEQ ID NO: 941850 - protein, 133 aa, Homo sapiens
MPEVPSLRKDGVGCGDYSGRRRVKKDRGMKAESARRPGPRTGAGGNKGSWAAHRTGGLGGHSPPSWPSRVSGRVAPRRGLAEQAEHPGTPGQKDPRPPVPKTQARLLSNTPPTCDVSPEKVTGKFKTKRKPQK

SEQ ID NO: 941851 - protein, 215 aa, Homo sapiens
PELPFRDAPPFLPSVAPTFQWKDTTIRLEGQPPNAGEPPSPPGPPITPAEAPGKPPPPPPPGLPRLPGPLCPRRQTPYQPPMDSQAAPTPPLAPPEEENPSRPRAAKLSPGPPCPTLAPPAALPPIPPPGPPRAGRPESPRGPSLPPPPSPSQGPCIGRRQAEGGWAEDPIFISQAGGESVSVVPKLNKGGQRLFPTLPDGFWPKQGSFKEGVGW

SEQ ID NO: 941852 - protein, 103 aa, Homo sapiens
MSQRVSALFLSGATPSPFSFWLKTRVKPRALRKEGRPRKTSFSMPKIPFTIVEKGGIPDTFFNMDSRRTATLNPTAQWVDPFSLRTSEALSTTTLCTSFQFSL

SEQ ID NO: 941853 - protein, 145 aa, Homo sapiens
IIQDGFIFPSAGCIPHQPEPQTASQCIHPDDLSRKEGRKPPPKCWPRGTQTGACRLSMQAPPKFSHGDKGAAAWAPESQPKCPEASGDGPLGKSLEEGGNPQEDGRRGPPANLEEKGGVVPPPPQAAEFWRAEVLAEELVAKVRA

SEQ ID NO: 941854 - protein, 186 aa, Homo sapiens
THKNSIYFSGPQHKSKPTAALLGPERGPGNRGERNPKAGRGQGQFRPPAQSLGAAVTKGVFAEDTEGHVGGAGWAGELEYRGAVDETKRGLSPPGSPPVAGFLVPPAEGSRLWEQGTPIRRRELAKGVETATSPQNSGPNTPLSWAPGLLAAWSLLPEARLNGLGPRVFVQAPRGRLPCPVIRLRP

SEQ ID NO: 941855 - protein, 221 aa, Homo sapiens
KAKTGLFNEKAGSGYKKQKEEKEDGGLHKGGGGGRRGGGWARRGDSRGKSSKTALKTTEVTKGQTRGAPLASLTQKKRQGRLPARRRGGGGKPSALGAEGEIQACGPADLLPSSPDPLGLPWWPRQGEPAVEVSGLRPLPQCGHPTQKFALPLPILGEPGSKFLLRELGEPTPFCLEVEFRNVGSWSEKGLGFAAKPGCPSPAPPGPGPLRCCGISSLPEH

SEQ ID NO: 941856 - protein, 167 aa, Homo sapiens
SESNTFIKYPRKDKHKPVKNKTEKRQAWGSNKKETGAAHTGPRGGGRGHKYCRGEEREPKGEGKAGGGQREGSGGLDTAGFGPGRHPPLTPAASCFTVGPWASDSPPSSSYISPPSSAEASWYCWDSDTRAFMLLSASENSISSMPPPVYQCRKALRRNKAVNRSEK

SEQ ID NO: 941857 - protein, 64 aa, Homo sapiens
MQKENGKIAETQDFNGAPGDFSGETYSLKKGGLLGPETSFLGWHSDFTWGNGTSAGSSGHLIGQ

SEQ ID NO: 941858 - protein, 180 aa, Homo sapiens
GDWKDLIFSISFFPQTLRSFSIKEANNPPRQKIEKKKLKPGSNFKKEGKKKNPEHQKIEKKKEKPRPPPPGKGKKNGGGAQGSGGRGAGGAGGGGGPPPPPQEALTKKKKIRGLSKKKNRGPQNKKGRGGTTPPPQALPRHPSLTIEPGKDTPSPRAPPPPAARGSPPPFHPSPSPPPPR

SEQ ID NO: 941859 - protein, 109 aa, Homo sapiens
ISEKQPFKPVEPKEGGKKKNIFFPSEFDYKKKGAEGALPKENDNPQVPRVFFFFFKKKKKTNSTQGHAKKFQPLPTPPPPPQAQKNTQQRAPFLERGERKEKKKTKGAP

SEQ ID NO: 941860 - protein, 287 aa, Homo sapiens
WTGIVPDIAVGTKRGSDELFSTCVTNGTFIMSSNSAFAANGNDSKKFKGDSRSAGVPSRVINIRKLPIDVTEGEVISLGLPFGKVTNFLMLKGKKKVFIEMNTEEAANTMVKYYTSVTPVLRGQPIYIQFFNYKELKIDSSANQARAQVALLAVNSVQLGNLVLAASAAAVDAGMAMVGESFVLRIIVENLFYPVTLDVLHQIFSKFGTVLKIITFTKNNQFQALLQYADPVSAQHAKLFFDGQNIYNACRTLRIDFSKLTSLNVKYNNDKSRDYTRPDLPSGDSQP

SEQ ID NO: 941861 - protein, 156 aa, Homo sapiens
SGGGLRFNGHYEGIEHRSKPGPRPSPPSAGNTARGPQTPGSAQGGAAPPPQLEKRKPILLAGDKSGEPLGPVRGPYSPPEGRGGPGGHCGAREFLKTQGPAPPGPLPSPRPVCGDGATTLRVEKAELKSSNERAGGAWGDGEQAPTQSLLSRRGRC

SEQ ID NO: 941862 - protein, 222 aa, Homo sapiens
SQKKSHFYFLAKQVPPGGEFTTEKGKKGAIHSDLERLEGPEGGPTGETETLHTINWNRFFRFPTGTSPEGLDGAGAPRGKGTPPNHPPTWAGPRSPAGDFLGVRALDPGGGVWQAPTQPGDRGWAKGQGRGACQLRGGAGHTEGGAGAPARAGARGGGTGKGSHGRRSRPCAMYFSSPTCPYNRPAAPSPAPCPPRGASLAGIVARRRQGVVVVAAAQGPGR

SEQ ID NO: 941863 - protein, 151 aa, Homo sapiens
MTKKTVENKGKGKSTEKFSLKAKMKNNQPNNLPPHPRKEREKRNKNPQGLSKKQPKKRKAKTGEGGQPPPMECQKAQGPGFKKTQKGPQKTGKTLIEKKMERKKKEKGLKTDPAKKNKNEECHLPRHNSLKIDLQFAPRLALLNHSSNGQC

SEQ ID NO: 941864 - protein, 249 aa, Homo sapiens
ELTIRYIGEGRKGGTFMSSSQGQQPLQLAGGSGEAGSSWGSSSKDEPQGCLDVPTGGLQGPQAQLIVLDAHVTELLQLGLPLALKAGLPTGLKGILEGLAEDIIGDGLSLTGHQRTFVRSLRNDPGCQEWVCENCSPEFLLGQGGGQLTLGYGPGPTAPLYPREAGRELGVLLQGVDLVFGGKSSSSSESPSNRKPPGISRYELEGMLREEELFPGIGALPATELQNQDNGIYEGWVSWHQRIKHIGIS

SEQ ID NO: 941865 - protein, 149 aa, Homo sapiens
MRIWILHCPATHPISPQMKKSQPWEAAELRRLPTAPVKNTPTGEHVQKEQNPGTAFHEEKLGPKDGGGGGGGEKASAKRTFLRFYTSDPDAESPELGGVLASSSSSESPRRPRFFLLLFSPEELSSLDTNSLLLKLSLSCLEADLDDEP

SEQ ID NO: 941866 - protein, 129 aa, Homo sapiens
MPQQHLDGLNNPINGGPRGSTTKGRGPTTRKAPRHSPRHACEFKLAKQAVIHCHGTPTFKNLKKLTRMVVRIGSEGLCVLGRNGGITLEEDSNDSSSSFKTKGKRSDNQEQQSLNILRLVSRQEGCLDS

SEQ ID NO: 941867 - protein, 165 aa, Homo sapiens
MECRVGGPGDTLGAPDVAGEKEFQEAQRLEGKAPGKFPPVGAPPLPPPCPPPPPRPPPGVKPSGQKAQGQTNGPPPPSFSWAGVSGGGDSAPGPWQGLEGPGWSPVLGIRGMEPGPGSSRRKGRARVAKARGQEFAAEVNGPGVHPPRGRAAGKKVAVAGVEVGA

SEQ ID NO: 941868 - protein, 84 aa, Homo sapiens
MKHYVLPGEFVPPETFQGTCHPQGLPPKKPRLPTTGHLWAFKTSEAVWTAPPQLKLSQIPFSQTLTPPSLREWASRLGQSITNK

SEQ ID NO: 941869 - protein, 128 aa, Homo sapiens
MWENFISKCMKGEGEGGPRLFAPPFVGLRGGGPPEGWGDRAFLPAEAPSPPKLLLLAPSTLGPLSPPPPGGEREENRFNPGGRGCRPPPPPPPWEPRPPSPPPPPPPPPPPPVASFSFFPSLGLFPFF

SEQ ID NO: 941870 - protein, 139 aa, Homo sapiens
MCINLFMDPFPRRAAPPGKGFGGSYTAVPEYRTEPGTHQGPVNIGGRKPQKGISHHYFTTKNNRKDTVPTQPPPKGFEAEVNINSLSQGTAPTRGPGRGGAGKGERVGPHGPGPLKPPTPPSQENHEAAKDKKTLAALL

SEQ ID NO: 941871 - protein, 102 aa, Homo sapiens
EEFQLYLKAESPATMPPLLSIALGGGGEELGAFCQAQGPGGAPLAWEEQEGLLTSSGVVPWPDESCEWGPHLGVPGRGKKRGSAQPHSGVRGTNLQPEPDRQ

SEQ ID NO: 941872 - protein, 100 aa, Homo sapiens
MVQKGGISGFLIRRLANLKKFFLPKKKKPEVEKLKRQNFLFLENLAAICFWEKVRQVPVAENELAPRPLFVRAAQPHPGRKNPHALELILLRERTPAGFG

SEQ ID NO: 941873 - protein, 191 aa, Homo sapiens
GEIKQFPGGFLGLLTTLRQGGKLFSPCPGTKVFGGKGKPQFGGGGALVPAPPRVSCSYRPAGSVAVGPGGGGGCPGPAGAGGGAGRRGLGGAALPPGGGRPGGGGPLLPEPPGGPVGSGGPALPSGLSSGVGLGEGLGGWGWGGGGDKNLCRKGPMLVAGPCFPPRHWVPEDPAFSSQGYNIPQTQSWKAA

SEQ ID NO: 941874 - protein, 190 aa, Homo sapiens
SAQKKVLLNELHAGAILFFPGAAELSVTVQDPERGEAGGVGGLEEGAWLLGDVQSFSGGLQPILGGAGLKSPRRCKTNNQISLLPGLFAVFLQRFLRHGLQKFRVLPGDFYRDRQSNGIKVKKLHDHLSKTERNVRVKSVGSHRGDPQKVLVFALREVCQPGHPLKLLVQLPQQGGGVEHLPLEDFSSPF

SEQ ID NO: 941875 - protein, 104 aa, Homo sapiens
PPRPSCMILQELGRAPASLWCDPPTPWVPRTPRVGVWLQEGRFFKAQGSKVVVGAPTCRRHARERLHQGMAPRVWLRVWRVGNSRCHSYQEPELYLLPQVSKVN

SEQ ID NO: 941876 - protein, 103 aa, Homo sapiens
MTPHVWGLVKILCPQKPNLRLCNLGPTKKFEKKEKKKSKGKPPAAVPNRGKFNLESPEPQEDTGPTTSMDPAPEQQLRKATQIKKLKKQSQVVCVGIPMFVNF

SEQ ID NO: 941877 - protein, 114 aa, Homo sapiens
MLIWDRGPALKREGEIHCAASPGAKERKATGPLAKRKGEGREEEGKDPPAPSMGATGTGKVSVNSSGEEGRHPSCGDYRSTSPMPPKAKFPWTSLALASVLGLPIPRKLTALSF

SEQ ID NO: 941878 - protein, 104 aa, Homo sapiens
KEVSLYFLVLQKKVAKLVAFWGLVKKTKSQILVRLPRLFLGFNLSWGSSSRGGSSGGSRHRGSSQKGRRISQEGLDLFSKWEGVIRLHKKGQDSFVPVDERMGY

SEQ ID NO: 941879 - protein, 270 aa, Homo sapiens
MAELEKNSLNNDLCPGPGANASPLPYTTPGSRDRAKGTRQKSWGLGSRVAVWRSLLLTIPRAFRPLPVCPPTPSPPVPQRRKGVGTAGSRTGARVAWAAPHTAGRGDNPNFYCPPWHSPPPPSSRPQNEKLSKIQRAAVLCARLKEGRCVVVWLVLEDRDVFLSDSMKEAKATILPLCIRGLDISGSCSDWASSQASSEASEEAFPPPADLLAPSEEEAAPTGHTSPSGLSRLLATGGDLFVSTPGEFCKMTLEKNLLYYMFFHKMAAKS

SEQ ID NO: 941880 - protein, 221 aa, Homo sapiens
PPPEMLYYMVSSVINEGSLMPMRGDRNICVEHGTVPPPATQSEGGWGLNGGLASLLWGRLRELSRKKGKPGKKGGRNVQASVTPMFCSLFSRETSLAAAFFLLPPCCFFCFFDGSSPMGAGFTKGISSCSPGGMNPFNFSGTVMPFSVVVVLQDGADGTGSGAHGSIEHMDKHHLVHQLLGLPISDLKPESLVIRAIRTGEQLTEGSGARKPGLQVKLLTG

SEQ ID NO: 941881 - protein, 121 aa, Homo sapiens
KTAQFIIIIFDGYRQCGPPHLDKLFWWKGLGTDRQQGFWFSFFFFPFSFFFFFKKKAERLNGGGGLQENIHLKKIAPKTPPRKEKKKPPTKVKPQTKNNKKGACTEKGLWGKGKGGDFSGH

SEQ ID NO: 941882 - protein, 101 aa, Homo sapiens
MALLLCLQRFRNVESDIYQGPISIILNFIVLEEDIGLEVIEGFIHSCVCGVPGGRPFELTSDRQQFHVSDEFGIRIHDTRVVSRHLGGARISTRRAGSRYS

SEQ ID NO: 941883 - protein, 67 aa, Homo sapiens
PPQPPGFICLDISERHHRVNWLDVNTLKKNVGIRLEREEESRVINESSLHIFHCPLSNMPPSPFCLF

SEQ ID NO: 941884 - protein, 177 aa, Homo sapiens
SHSFGAGLPQQLNERRLHQQDNEISQSPPELGRKLQAEIVPHSLSVSLLFFRPATAVLILKVIKMRTFVCSPQLEYKPSKSISPVCLMSDPYLPAWCLGLSKCWDYRHEPPRLAFSKKHYFIACKHCKNLLEARQLSAGMLGKQPMLNGHTLRADSQLVPNVEVQRKISRATYPTHS

SEQ ID NO: 941885 - protein, 114 aa, Homo sapiens
AALSALSPPGEKEPQFPPARSQPCPGQRKTTRIPGSGRRPGWAAPVRAGESPPPLAAVSGAWVPALRGFQRTGGPLPGLPCQPCRGGRKITVIEEEAFPGVKKAVAERRRPQKM

SEQ ID NO: 941886 - protein, 94 aa, Homo sapiens
SFPALPCLAFQCSSFCEMTLKASEGESGGSMHTALSDLYLEHLLQKRSRPEAVIAITIEITVNRGQCNNQTGLLPQGKPLPKVKGTRKVEKCTQ

SEQ ID NO: 941887 - protein, 259 aa, Homo sapiens
WLSPPSPISESSGGVRCVPRCPGRQTPELHLPWVRGSSLGCDPWGQKRPRDARPNWVGSCPEAWGPLSQRALPSSSQGPAWPPSLVIGDGKSVLPGKPGQTTPKSLTFPGGSALLTLRNRKRMSFLARKPEEILTGTQHPNQQHFCSRGPAGRGVLPAACKSCQSQGFAFLTGLPLARKVTKLSWVGYKLQGRELQWPVYREELELEPPVAAAAGDVIAAHGDCAGERDFSHRGELRKQAVVHILLEADLWGVARQGAA

SEQ ID NO: 941888 - protein, 172 aa, Homo sapiens
MRHHDAPTIGLGQLARLKRLGHGALLVDFEQEAVAGLLVHGLGDPLWVGPCKNIPHYLDSCTGCELLPSSPVILVKGIFDRHHWVVLDEGLVQVSQLVRREVPPGVIGRLEVQVILPRPEELGGRYVHADDHLISLASLPNSSFQQLQAFFILRMLGATVFIPTLVASFHIS

SEQ ID NO: 941889 - protein, 242 aa, Homo sapiens
MVSPFRLFTKISIPPLIRSPMSRVDSFWISFLSRFLPFPTLLPSNINLFIFMRYSFLFFPGALYIFNGVTRLHHESDGLTSQGLHEDLHPTSKTEHQVQGGLFLDVVVRQGACIFQLCPSKDQPLLVRRDALVLALALDINGVTGLYLESDGLTSEGLHEDLHPTSETEHQVQGGLFLDVVVRQGTTIFQLFSGKDQPLPVRRDAFLVLDLFLDINGVTGLHHESEGLTFRVSEIFIHSERS

SEQ ID NO: 941890 - protein, 248 aa, Homo sapiens
MAKPRSSQGGGKARALEMENSQLCKQFIGGLNVQTSKKGLRGHFEAFGTLKDCVVVVNPQTKRSRCFGFVTYSNVEEADAAMAASPHAVDGNTVELKRAVSREDSARPGAHAKVKKLFVGGLKGDVAEGDLIEHFSQFGTVEKAEIIADKQSGKKRGFGFVYFQIPDAADKAAVVKFHPIQGHRVEVKKAVPKEDIYSGGGGGGSRSSRGGRGGGGRGGGRDQNGLSKGGGGGYNSYGGYGGGGGGGY

SEQ ID NO: 941891 - protein, 271 aa, Homo sapiens
MTQPLHPADGCHIPGEHFIRLYICISPPITARNTGIIFTIDPSSRSVEKLKKMIKCWNECGLLSELSLMELMSTIQRPSRMSTQPRKAFLLTPSVYRPVAVALDTKGPVDPNWARSDRQRHCSMWSCREESSTPQKSRCDNAYMEKCEENILWLDYKNICKVLEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENYEG

SEQ ID NO: 941892 - protein, 107 aa, Homo sapiens
YKHLPQLTYLDGNRPGTDKEAPDSDAEGYVEGLDDEEEDEDEEEYDEDAQVVEDEEDEDEEEEGEEEDVSGEEEEDEEGYNDGEVDDEEDEEELGEEERGQKRKREP

SEQ ID NO: 941893 - protein, 239 aa, Homo sapiens
MGKEKTQNNKVVIGHVDSGKSTTTGQQNKKSGGIDKRTIEKIEKEAAEMGKGSFKYAWVLEKLKAERERGNTNEISLWKEETSKYKVTINEAPGHRDFNKNKNTGTSQADCAVLNVAAGVGEFEAGNSKKGQTREHALLAYTLGVKQLNVGVNKMDSTEPPYSQKRYEEIVKEVSTYIKKIGYNPDTVAFVPISGWNGDNMLEPSANMPWFKGWKVTRKMAMQWNTLLEFWTHLHNSST

SEQ ID NO: 941894 - protein, 240 aa, Homo sapiens
VIRIMAALLFVLLGFALLGTHVSLSGLPAQSSYRSKTLAPDKLITCSLNESATEVTGDRWFKGVLVLKEDALPGQKTKFKVDSDDQWGYYSCVFLTEPMGTANIQLHGPAKLKAVKSSEHINEGETAMLVCKLESLPLCDYWAWYKITDSEDKALMNGSERRFFVSSLQGRSELHIENLNMEAVLCQYRCNGSSSKGSDQVIITLLAASLWPPCWPFLGIVAEVLVLVTIIFIYEKRRKP

SEQ ID NO: 941895 - protein, 184 aa, Homo sapiens
MADDISALVVDNCSGMCQAGFAGDAGPRARLSLHRGAPQAQGVMVGMGYEGFLFSSDREPMSKMRHPHPEVAPSSTASLPPGTTWRKSGHHTFYNELRVAPEEHPVLLIEASPEPQGRDCDEDRLRYIVWRPLKHPERVERGLSMAVASPCYRSLGRYPLVIGVWELRLTVGHPTPGAPLYRGG

SEQ ID NO: 941896 - protein, 277 aa, Homo sapiens
SGRPVAPGARRTGGLQKPHAQSLREEVVIIPLPSGDVAATFQFRTRWDSELQREGVCHYRLFPEKRAWGSRSPSILYGSSTCYSHEGFWRTRYWGPPFLQAPSGADAVGLVSKTLLMMWINLGRSSVMCSQWIFCAFFNFIDCHHTVTPTASFKPLGLANDTEHYFLGDAVVAREVVCTENLTPWKKLLPCSSKAGLFVLLKAERLFHTSHHSQAVHIRPVCRNARCTSIFWEQRQTLLVVFDAFITGQGKKDWSLFRMFSRTLTEPCPLASEIRVY

SEQ ID NO: 941897 - protein, 121 aa, Homo sapiens
MGLAGVKQLTSYISVEAICALRKYPLGLVAPLRGKGWAGLKVAGSEGVGDGRRCDLAAAARELVLRAGGSEMEEEEGSLEGGPGLQEPVELGELDMTFDEFILDEVDVHIQANLEDESVKE

SEQ ID NO: 941898 - protein, 160 aa, Homo sapiens
MYCNGVVELLYLCSNGARCATWFEDPTRFIGTMDAFVKIVRDEGTRTLWRGFPATLVMTVLATAIYFIAYDQLKAFLCVSALTSDLYAPMVAGALARLGTVTVISPLELMRTKLQAQHVWYRELGACVRTAVAQGGWLLTVAGLGPTALRDVPFSALYWF

SEQ ID NO: 941899 - protein, 269 aa, Homo sapiens
QPNLVGLQHLVLVLVLAQLDLLGVDLLCQCQPPPGGVTPHEQDLALGAQGLTLRLSRQRLCPQFQQLSSRPCNFAQGPGQKTVPVALPETLSIEAMKLTCVLYVACTLRRKRSIFLGVLIAMPDLKVLPRLPERAGRPGVTELGAEAVEGPGAVNLPELALHVCQPQAHLTRVLVRELLNGLLVDAAGVGYPYDLGRPPEVEVEHVILLGGLHGPCGTLVHGHGMPGQAPLLHQLCVQQEQGLGIVWGAAVQSLFKQVPCPLQLAAPIA

SEQ ID NO: 941900 - protein, 173 aa, Homo sapiens
MWAMRSTTLLVAKSVVKGGKEHKKVVVEGNASPSVKGGGVGVAVEVRGDHLVLSVAQDALDGAPRRLHHHLLDVIIFGRFFYKEGEDHHYNVGSGDTEGHASKHPVQPRDDLAHSFGSASGGRNKVLENTATITPQYPGGAIHSLLGGSYGMDCGHECFHDTKVVMDDLGQGC

SEQ ID NO: 941901 - protein, 117 aa, Homo sapiens
MSSRVKGLVARKLDRARAAGPGAKDINTTTAAGATGLGGGREARPARRPRAGPRAARAGAGQERSGGKPSRTNPARGRGRAAARATAPATGQRGGGGGGGSGAPAGRRQGDGATTPN

SEQ ID NO: 941902 - protein, 275 aa, Homo sapiens
APRTLLLLLSGALALTQTWAGSHSMRYFSTSVSRPGSGEPRFIAVGYVDDTQFVRFDSDAASQRMEPRAPWIEQERPEYWDQETRNVKAHSQTDRENLGTLGGYYNQSEAGSHTIQIMYGCDVGSDGRFLRGYEQHAYEGKDYIALKEDLRSWTAADMAAQITQRKWEAARRAEQLRAYLEGTCVSDSADTWRTEKETLQRTDPPKTQMTQHPISDHEANLRSRGLGFYPEEITLTWQRDGEDQTQDTELVETRPAGDGTFQKWAAVVVLLERRE

SEQ ID NO: 941903 - protein, 128 aa, Homo sapiens
MSSSAGSGQEPSQSRAIPTRTVAINDAAQYLNDYCTNSLEGKLFSTTTGGTRIIYDRQFTSWYRGNYHMAQTRTCHLPNIPEVTNTGTLIEDSKVEVNIGTTMNNHDRKHAVGDDAQFEMDKPLSCKI

SEQ ID NO: 941904 - protein, 132 aa, Homo sapiens
QQRPQSRTQHRGQPGSQSGQSSGSHTGNTTPGVEWQIQDFAATVAPDITQGSSPLPQRHRKLTPKEHVGRGQDGEGCRAVTWRKCGPAPLPPASTTLRPGSPGLGLSRPSSTQCRAAGVPQTLSSPLPTEEV

SEQ ID NO: 941905 - protein, 291 aa, Homo sapiens
WGLTCCVTPPQSGRGSPTLNAQGVLREIWTSFGSLSLGSTWPTILSIAGLGGPHTGVALKPVRLPRSAGVHLRPPGNFERLPYFPHLSPRAGALGVTWLGSVARSPSRPSGPGLSTVQTSRGLPPLVARASWPQRLGVVWGPLRSSSPPSLPGPAPCLTHTFPLDLRRFYGLANSKTMAEELFTRSLAESELRIAPYEYPEAGPFAQLEERRQSQRRRSTQLSRWRTSSSSGPRPLSGRLTVPRSSRSPRPRVRGQVTDACGPVLMLSGSFRESPLWGGTVWGAIPTLLAA

SEQ ID NO: 941906 - protein, 280 aa, Homo sapiens
GAPPIPSHNKQDRSPSGPAGEGPASILLAPVPLTVKLVVHNPQGGEEIAEEKEKEGKAAHKHMLLSCTEVVLGQVEQRQRVKKLPEVSKEKKRQQEGEAPPHPGLEALHSEVHGVPLAQRLCRRLLGSRGMEYLETLAEALVHGKGEELVPEFLVHKNIIPSQHDSRQGGEHLDCNTHQPFIHQPSVDEDALPDGQGAVVPDQQAVEDSICDPGVEQEAASKGEEDEDDGEVELELLILVLVGKLSPPAQDRDVDDPRNRLRYNPFFLRKYGLHVKEEAL

SEQ ID NO: 941907 - protein, 176 aa, Homo sapiens
WGQATTTAPACCRGSIHSRAGVLGFIYKHDQAPSRRGSHPIHPHHTRPPHETLKVTNLLLLKVYTKPNTPLGIPTPHPLNNISRTKPTILTHPPENLQSLPKTPNQHPPSSSNNPQLTPQPQHSHSQWPRHQLTTESFLMALLTIMMASCRDRSVSSINCSAPPRRMKVHVLAFGQ

SEQ ID NO: 941908 - protein, 99 aa, Homo sapiens
GRTGPLYSYYLAQQQKTDSISHWGALLARHEKEQGGTSRWRRQGQSSSISTNKTDSNGKALPWLPNHGLHCRSHHKAAGTEVALQGACTAALAGGCIRG

SEQ ID NO: 941909 - protein, 195 aa, Homo sapiens
MEEGGKGGGRGGGKKGEGEPEGPGGLDTPGFGGGGNQPVNGAAGRGTGAPWASYSPPSSSYILPSSSAVASWYCWYSDTRFMLLSASVNFISSMRSPVYQCRKALRREHGREPPGEGDEEGLDGRAVPDEGGGHLEEAGRDRQKRRELHVVGDPLHEVDCQFWLWMDIISSSTSFMDMRARNTVATVSNGRRAGR

SEQ ID NO: 941910 - protein, 178 aa, Homo sapiens
MAGVEEEAASGSHLNGDLDPDDREEGAASTAEEAAKKKRRKKKKSKGPSAAGEQEPDKESGASVDEVARQLERSALEDKERDEDDEDGDGDEDGTNEKKKKKKKKKKEKKFEKENSLFIFEIYFNVLFLKEKELEYKKKKDDKKGFKKNEEKKELDYGNEEILNYFLEDGEENKKFKK

SEQ ID NO: 941911 - protein, 126 aa, Homo sapiens
FLCNVKVWLLGPSPLQGVYMATVRRGDLVWWGIEFGRDSPSSEGVFLPLLLLLGLVVQGSYSLEATVGHEVHHPVAVAKFVVIPGNELEKVVVEGNASPSVKGGGVGVAFEVTGDHLVLSLAQDAL

SEQ ID NO: 941912 - protein, 106 aa, Homo sapiens
MGKTQDYHAKIKDHMTAIEEVHTNNENKYILRIHDYREDFPSPKGFIIFPKKYRSSSISQVSSSALMKESKQHNRFIRLGELQNNQKSVLCFFLFWIIQNFAVCLS

SEQ ID NO: 941913 - protein, 221 aa, Homo sapiens
YSKEAVQNDLTLKEKSNLRVYTAAFSSPRRRVAPRQASFQERDSWEQRAGVWPTRGFLSISTPTAAFFPSLPTTGLLPATAAFSSDLACSAAAAAAALSTRSLGFLAWRRRGCRRRALAKGFSLNMILKFFSGFFFRTRRGIFLRGARRALGISGLFKILPRSVLIILGMGRLEERWREAALRQGPKSPNSRKALPVQMQKRPTCPPGASFKMFSLLTLSR

SEQ ID NO: 941914 - protein, 108 aa, Homo sapiens
MQRSPGFSTRKHKNIPTGMEPTGSTKPIRTGPTSRKKETGPYKYTGGNKQHRTLLKPKRIPEEHPGEERQLARVVDYVLHDALDVAVPLSEIHGAQPPLFTVLYVRSV

SEQ ID NO: 941915 - protein, 225 aa, Homo sapiens
RKWAAQRDSPALEHVAGREGKQAPPLSAEEKALGWVSSCPLPIRGRGVLASLPLSAAQKPVLVQPLEEAFAELKVPMAQEGAALKNRGRKPAKSPVPDSARILRSSQGETRGFTLKASIAPRATRRWVFTTSKGRVSTAATVPEPPATKLPTEVWFGLSPLSQFTSPELNQFRAEKGTTLKGSWAPAQPQLAPPPWSHFSSNTGTQHPVRQKLNLQLCSHKLQGG

SEQ ID NO: 941916 - protein, 71 aa, Homo sapiens
MPWFKGWTVTRETGNANGTTLLEALDFILPPTRPTDKLLRLPLQDVYKIGGIGTVPVGRVETRCTQTRYGG

SEQ ID NO: 941917 - protein, 130 aa, Homo sapiens
MSWGERLVPLNFGQTACWCQNDAKDIEKSQQEVELGSSLGQFVEGLASKLSLKGEGHGNGKQGECQAEGGVCGQDAEDQAGQGEQCVVENVGERGADEDGQRDDTSLPVGLHVPGVVGMENGLGAEGEGD

SEQ ID NO: 941918 - protein, 202 aa, Homo sapiens
MRGKRMGPPLSQPEPKKVGINRGVKKRGGKREDGQGREEGQGLGSPKSHSIVGRSRGTIGVPSLEQEGRAQHPERGESQGPPVNPIVNRCKSPPPPENPEWAVRRQESLGTDPQPHAQAAPPHPQRPRQENYRNTEFQVSAPPPQTQEREERQGTKTLDVKVNISVDTYKNIEREEDSACPNMDASLHLAGSRNFDSCRYHN

SEQ ID NO: 941919 - protein, 115 aa, Homo sapiens
TSWYKVGREEEEHGARAPGLSREVLTHEAPPRGTTAPGHAPPHAQPPSEGEGRLTVVRGQEGLEGAGAGRGHRKWWATGFWEGMPRVFGGAASKKRKSFWRGPSSPKRAATVPQR

SEQ ID NO: 941920 - protein, 110 aa, Homo sapiens
MGFTDISPRRIKWQTPHVAPPGTQAPLCKEGMTFCRLATGHTQGDSNSARGSQPSPTFSAVMEVRRRRLQGHPASWDAGSPRSQQNPTVVALLPTQSRTRQGSDLKVTNI

SEQ ID NO: 941921 - protein, 125 aa, Homo sapiens
MEFTDTFPVHTQGFFCYDSAYAKPYPGPEAASRVPPALVYALVTAGPTLTILLGELARAFFPAPPSAVPVIGESTIVSGACCRFSPPVRRLVRFLGGYSFGLFTTTIFANAGQVVTGNPTPHFLS

SEQ ID NO: 941922 - protein, 122 aa, Homo sapiens
MAEAGAAFLLITFSPFGKLVQIYYALAAVAGGAPFVGIKAANGVVLATYKKQKFIFYDERSVHKVEPITKHIGLVSSGMGPDYRVLFHRARKLAQQYYFVFQEPISTAQLVQRVASVMQEYT

SEQ ID NO: 941923 - protein, 147 aa, Homo sapiens
AAVMGRRRHTASAVLSQTLGGAPVAGGGEWGTHPRPSLSLPQTASFRAQTHSFRQETKEQREEEAGEEDEGGAEVAAQMKEEERGVGKATPPPHPPQKGARKRQQHAAGGGDKGGLKDEGPGAGGAWGLSESRASGCALSGMPARRP

SEQ ID NO: 941924 - protein, 231 aa, Homo sapiens
WTGKTASAQSGTGPKDRLGVNKEYTLLLCFPQLLKALGHLLLILLLELALLLGCCILVLLVLGHQIDVALGLVNSISSMPSPVYKYRKEKRRNMAVNCSEMRFISSWMAVLLQIKVADIFSPRGGMSQKAVFIIVGDPLNKIAAVFVLDIKHLLIHLLHGHAAPEHGGNLLVAAMAGVAGSHHVLGIKHLLGELGHGQRPVLLAAPAGQLGKAGMKKFSRGNGTMFTASLR

SEQ ID NO: 941925 - protein, 111 aa, Homo sapiens
MALERGGRLKECVVILSEEVDLRSRAMGEKKKKVLTSKNRKVMSSSSNQNVNRAKKPPVFVNNENLAPPGWSKGACNWEFAVNKHHDTVISEPSIQPWLKDEAKEARKCIN

SEQ ID NO: 941926 - protein, 64 aa, Homo sapiens
MKDPKHPDALTPGKDLCTSPGEESRAFCGFDIPLVFTRRDEQLHNFVQQRMNYLKPRIFVVIKR

SEQ ID NO: 941927 - protein, 154 aa, Homo sapiens
MKNHKNNGSITRIQEFRAIFQLFTRTAINLFLQLSKLACNVSRVAIQYRGIAGAYLAWMVQDNHLSSEASRFHWWVIFAVTSYVATTNILDRHILDIEAHIVPRKSFTQSFMVHFDRIYFRCNVDWSKGDHHTGFENTSFHSANRNSTNTTNFV

SEQ ID NO: 941928 - protein, 206 aa, Homo sapiens
MRVKTKVKLTSARVWGPGFVAPRLTSPLLSRARKAMGGPPSQAQPPDLWHRVGFLGGPDVPSRHHCRGFPEAEADRSWYILDQDSDSIMANALLGEAVSKNEDRRGSPEGDKEGGCPPALRAPEFMRRGPWGRLGQEVPQSVPVGEEGRGAVTGRAHPGGYFLSWVGTRCVLACRVLAGLERGRWTQRGGRRRLRQTQNTVLADPG

SEQ ID NO: 941929 - protein, 150 aa, Homo sapiens
QPWPRPCRHGWRLPLLPAQGPVQVALDGVEEVRGVQEVLVQLHIAEAVNPARQALGHGSPLHRLPAHLLQHLGQPDEVLVPIQLPPVLQATCPGKDAGDGVGAGGPALLVLPTVAGDGSMSGLSLNRLPIRAEQDGRYQAKGAKALGQDV

SEQ ID NO: 941930 - protein, 152 aa, Homo sapiens
GRPRVPPPPPPSVAPAYLLSFPFCWGRRQAILCHREGLRAPKMELYSVPDPDPPMAPDARAWGPAVHPRSLGWGGVGRWPGAVLSLASGLGPPGAAAVAWPPPMLGAWLGAPPPSWLGAMGGSGDMGCERGAWGAGRPPYSCSGVKEEGEGG

SEQ ID NO: 941931 - protein, 276 aa, Homo sapiens
FPGSLLLPGRAPWSYHGGWGQAALRFGWAHGPQSNAGGLGPSQSGTFASELGVAPASSQAMGLSDVTLIGGVGPGVMVVAGVVVLILALVLAWLSTYVPTAVATSSWALLCQPATHPSSPWGLWATWWQAKATPSQLSPLPQRVMMSWLEWRVKVGETALGRLELGVVLSPALSISLKSKACPKDKQVQAAAVQRPSLRAEDSTCLPPSTGLITVRLKFLNDTEELAVARPEDIVGALKSKYFPGQESQKKLKYQGRLQQDPARTLRALNITDNCV

SEQ ID NO: 941932 - protein, 164 aa, Homo sapiens
MWAKRATTLLLLAKTVVKPGNEPKVVVEGNASPSVKGGGVGFAVEVRRDHLVLSLAQDALQGALRRLLYHLLDVIKIGRFFQKAGQAHHLNVGSWDTEGHASKPPVQLRDDLAHSLGSVEAGMKFWRPRPSATLSRRATHSLLGGSYGMDCCHEFFHETKVVMD

SEQ ID NO: 941933 - protein, 179 aa, Homo sapiens
GPTRTASLQCPESRARAAAARLRSRPLCVQACPGGGGEPSSAEEAGKRKPRRQKGLNAVPFATAFSLPAPLCISLLFLYFFGPARVWALLVSKNAASRRLKATRIFGLTSCLGQPSRAMSSWSLPAPLSADRSRYDGRQKFVWGGYKSNQVRGLYDFYLPREELWIYNMETGRWKKINT

SEQ ID NO: 941934 - protein, 249 aa, Homo sapiens
RVGTRGTQGWDSTENKPSCCSVEGPHPQDVAMGQPLRVQVEGRQWEAGTGRGRPRAVAGLELVPYNPEPQQGPRVRSEKAGGGAVDKGQNDPAPNQFRQALAQWPQALAAGVSRCLPSALRGDIQCAGEASVMAPSTRRYQGWMCVFRIRATNASSPSITRSTPKTAKTARIGFWPPMKGRSLPTAATHSSAASKRSSRTLSWRRCLPLSCLLKRKKAAAPMFLATAPSTAPNLPSLDNVVKGRQNLGG

SEQ ID NO: 941935 - protein, 72 aa, Homo sapiens
YYTKTFSIILSSLHMAVLFHVHIIGKENEKCKPCVRGTWHSYCSNLLNLLGSKGKRFLLSPHFDRHSSHIFI

SEQ ID NO: 941936 - protein, 157 aa, Homo sapiens
PALCAARGPGPPAPRLGSGAAADPPGLRAPRPPGRPRLLLSSASASSCRLVGGLQPPSALSCQLPRRACVLRPPGPASQPASRAGGGHQAVPMPDPGPRMNGFWLGELCWLFCCAPCPTSIAAKLAFLLPDPTYTVLVLDQRAAGAFAPAPAQDTAA

SEQ ID NO: 941937 - protein, 169 aa, Homo sapiens
GYRAPASLWDLSIEGSGRVRRVHKWKRYFLAGLRLCVAWICPASGFRIIFELLPFGAHYLVVDVSDQLLGGLLGSHGPVNLLNLAHHHVLLQDEGLERSLLGDCEGCGQGLVGALPGCGACAFACERVCEESEKCQGEWGRADWAWATEQVGNTFRSPCTPGRGSCSAP

SEQ ID NO: 941938 - protein, 84 aa, Homo sapiens
PLKRCCSQTARVKYDRQYRLLLSALHIHIGVCACPWSAENLALLVHRGDITSPDQQFQNVPFSYIGIHAHLLKMRYSRANTFPK

SEQ ID NO: 941939 - protein, 341 aa, Homo sapiens
MEDLDALLSDLETTTSHMPRSGAPKERPADLLTPPPSYGHQPQTGSGESSGASGDKDHLSTTVCQPPSPKPAAPVGPSHSPLPAVSWVPVLCELVRLLQEINATEFNITYDILFVFTISLGGFLSAEGGPVSSLELTQPPFQPVSWPPNGFCHLSHSGSGYLMVSLYYFRVQNHSSSLWVSSQPPVVSSTNEGSPSPPEPTGKGSLDTMLGLLQYDLSRRGVPTQAKGSVGSCNKPIAGQVVTALGRAWHPEHFVCGGCSTALGGSCFFEKDGGPFCPEYYFERFSPRCGFCNQPIRHKMVPPWALTGTRAFLLRQLRGALGEEEFHQREAALLRRDFLQR

SEQ ID NO: 941940 - protein, 236 aa, Homo sapiens
VVVMQRWKPWWWGLLGVGAVVFPSPPLLVSSPEGQVTFQNGRVSYRVFSLLEELSVLSGSPLILTSKRSCTSLRILASFSSDTDVAIALGCQTGLSLATRCRVSESTGHVIKSNVHPLEVHALAKLGLPPEVVENLSTATEKASPPGASHGGWQLCWEVLAPLELGQGNAPLPKLYKDHHLVELKDIQKVKELSVLLVVLQFDEYCCHPCSVNFVSSSTKISIGSSMNLRQNRRIF

SEQ ID NO: 941941 - protein, 203 aa, Homo sapiens
MPCGSALPLLRTPASASLCPPDSAAQQGLGEMLPHQEGGGLVPADWTGFSAISRKQQLAENCFLNPKGDAHFSPGLSAPRCPIYTAVRRPLLQPACVAEPAVGAPKLSRVRSKGSGLEFCGNVPFTLCQQLLGSFFGPFLRLTTYLQPAQNNERSDHLLEKALGRPLHPHCRTSFLLAFITAWPPKRSPSWPLLLFLKKATPL

SEQ ID NO: 941942 - protein, 225 aa, Homo sapiens
FYTPPLYQKTKNNIHPPNTNSPTPTPIFTYIPNPTYNPHLYPPSPLPLLFPLLTKILFLFFPPIILFLIFTLLTPSSSSHLFLNSISSIVFPFFQFTKPFPTNIPLNFSHIPFTSSSIRSSIPINRHSYFHRHHRPHLTHPSFHIFPHPFHKLPPLLLLHLYTIFSSTSFIHIPPPNTPPTLTYPPSPPLHPPIIFFPSNTSSLISPTLTPYFSLPPLLTPPNHP

SEQ ID NO: 941943 - protein, 239 aa, Homo sapiens
MWSAVKELIHVQHLAQSLVQSRLSPGAIFSTTAWFSYCCSCRLCPKGVGSGAVQQEGVTKEAGDNEPYLFRISALDLENGEILLLLRAKLGKLRTKPVTEELKWNSLHLQVALYLKISLLVKTKSQTHSSTPSASTCAIEESPANYSRVYLCAGLAKQAGYEFGTVLGSGFPLAEMTESFSRCSLMFWSNRVVSRRGWCRSRELVLAVKEVRAPTSTPCPRGRVGSLELFKKPCLPEDG

SEQ ID NO: 941944 - protein, 161 aa, Homo sapiens
MTKVHALNDGTAVVEHTADVLSVHSAGEKREAVVTPISTGSADPQKLISNEVPGPGHAWVLSGRGSCILRSGVASKFWKVVLNLRFPSQGFLSEQILLVEEQDTEMERINLVVPEALEEVQSLLQAVGLVVLPDDHVVAAAGHHEDDGSYIVEALDPLAAF

SEQ ID NO: 941945 - protein, 116 aa, Homo sapiens
STVFFKRVSFKHNFARNWSKDRKRVGMLKRGGDQGHVFLGAAIDDVVHTQNTPLRFSCPQKNLSLHLKTFCDTQDSHISNGAFPSYPIQSVVYAFTVSGPELCHQVCTVIACNCQL

SEQ ID NO: 941946 - protein, 125 aa, Homo sapiens
EKNFVKCKLEGREDRRKVGKRKKGWRMGDEKEKRKEKGEGGGERKGKEKKRREEGGGGLEVNIEVKRRGEGNVVKRKWKGVGEGVGGNKRDEVIRTGRVEERGEVVNGNVVIVKRKDIEGRNELV

SEQ ID NO: 941947 - protein, 270 aa, Homo sapiens
QSRVDYILSVMNVPDFDFPPEFYEHAKALWEDEGVRPSHKRSNEYQLIDCAQYFLDKSDVIKQADYVPSEQDLLRCRVLTAGIFETKSQVDKVNSHMFDVGGQRDERRKWIQSINDVTPIIIVVASSSHNMVIREDNQTNRLLEALNRFKSIWNNRRLRTTTVILSLNKQDLPAEKVLAGKSKIEDNFPEFARHTTPEDATPEPARGPTLTRAKYFIRDESLRLSTASGDGRHYCYPHFTCAVDTENIRRVYNDCCDNIKRMHLRQFELL

SEQ ID NO: 941948 - protein, 63 aa, Homo sapiens
MVKLNSNPSEKGTKLPSVEDGFQVPVMSGLEVNDLQLPGPEKVIVKKRREYEREEKNKGKFWV

SEQ ID NO: 941949 - protein, 322 aa, Homo sapiens
RGLEGLGQALGVDIPETGMTVQKSMGCATPSADRAVGHTGSQGPAPRVPHQPHPSSARAPRARLTHTHTHITHHTHTGSQPQTLSKGQASPGERAPAGDWSGENSAPPLHPNRTQAGGRGVVEKGLEGVPGAFGSSRGSSGLKGTPWAFPPSGEPWWGAASGALVVLGWFLLNTFFHLDPPLFLILIFMFSHSSSSSPSFSSPSSSGGRWAGAGISGGCMGVSLGEVSGEVGCGVSGAGDAAPSFVSQRSSWSVSALGAALAWGPPPLSPSAAAGLSFCAGTGTPQKVGGLRGAGPKAWVIIAVGWFMGRDWAILEHPISLL

SEQ ID NO: 941950 - protein, 249 aa, Homo sapiens
TVRDTMSDLPEVRNGASALEISYNGEPQSWFQRQLRGAQYQLIFRDQICKDMSTLVAARMRQIPLAPGSDWRDVPNIEVRLSDGTMARKLRYTHHEKKNGRSSSGALRGVCSCVEAGKACDPAAKKYKTLIPCCLHHTGNRYNHWDGFYGRFEWEGFFSTTVTNPEPMGKQGRVLHPEQHRVVTVREYHSKGLPETYRLFGNILDKHRQGNAVPTPLAKAISLEIKLCMWAKARESALAKIKEEEAAKD

SEQ ID NO: 941951 - protein, 111 aa, Homo sapiens
MPQYRSQGRTQWAQSPELQQQRRHEFPELQEPEVAQFRTMLHSVRYSQNRQDRMQWTEQFSCAWEGELGGGGFAAALTLLAALAGEKRVCLQLPVGLGAPRAQFPPVLGRQ

SEQ ID NO: 941952 - protein, 262 aa, Homo sapiens
ALGEWDTILPAMPQPLSHMRNHQGGKDRVPEQSGKGVLPDEKQVVGHIGVDTWVVAVTTARSPADDALQGELALCSLVLTHQRASGITLARIGAALEEPCAEHFEEEEDPCTSGAEQRSKERNGTCASCRKARHISSAPSNWWPQPATWQSVVSEGARRRLAGTPAERKATGARTAVRILLKAQESQVVLELTGEKAIEQAVGAHGQRLARLTAVVTAFLAEHHRQNLRVRACGGGRGEAALSDLATSVLGKPLLPNPNDVF

SEQ ID NO: 941953 - protein, 95 aa, Homo sapiens
LCRRLHFLEYCSLNTATFRFVKYILFRFWSQLDVISDSGQGFLTRRKLFRIFFKSKVFPELIEFDLLPRLLLGIFFFFFLVLCWLFAQPTGSGRS

SEQ ID NO: 941954 - protein, 67 aa, Homo sapiens
MPRGNQFAQRAQTPRSLGVLAAGKGLALTSGTPAAPPPPRRGPKGTEGHDGCSPGVHVFKPRLIAAE

SEQ ID NO: 941955 - protein, 294 aa, Homo sapiens
KSSGGERLVEQRARHQSRGPAESKGSEGGPRGRTCVRLPSPPNDQTCHPGADGPVQGKQKEYKLEAHRIGSIPLGKIHNPRGQRGGIKQQKNPLGPPGLRKPAKTTRATRAPAPTRPVPPGPRRRHRSSSPGSRRPGHPPAGESRPRPPPKPQGLETEPQPERPTDTDAPRGGDEVPAATETGEGDVFQGGEADATEAAWSRVEGPRRGGQRSRGYAGVVASSRGICAARFPCAVSLGGEAPPGTPAAVPGAAGRGAPHQRGTISLGRPRCAQESAARRGVGGGQPAARRPARP

SEQ ID NO: 941956 - protein, 120 aa, Homo sapiens
SGGASNLGLAKPKGHPTGSLVHTCNILRRSGAPPPQSAHRLSRGSRLRIATQSPPGRMAEVLHRRPRGLVSRAPTTKAPPPVHPEEKPLPQRGGGAERAQGLPGGHPAGPPRPRSLAPPE

SEQ ID NO: 941957 - protein, 92 aa, Homo sapiens
TTDDDAGSEKKKGRNRSKEERKQHLSRAREQRKRREYKKQSRQEAQLELQKGERSTTTTTKPKIHRKTKKKRNKKNQDNRNTNQEKQAHGAH

SEQ ID NO: 941958 - protein, 214 aa, Homo sapiens
MKETPLSNCERRFLLRAIEEKKRLVADKPMIIGSSGSHLVQITDAALWTWKTRVLGQVFCELVFTKLNRETEGILFFDLELSEKAAPAFEPGKHLNLLVKLNGLKERNLTNSKCIDTESLCVVAGEKVWQKRVDLHLLNPDGNIIDAASLAAIVALCNFRRTDVSVQGDEVTLYTPEERDPVPLSIHHMPICVNFAFFQQGNIYVVDPMNEKNV

SEQ ID NO: 941959 - protein, 102 aa, Homo sapiens
YLFSVFFLFWELINLVIYSDDVPMVLVGNKFYLPTRTVETKQAHELAKSYGIAFIDTSAKTRQGVEEAFYTLVREIRQFRMKKLNNSNDGTQGCMGFPCVVM

SEQ ID NO: 941960 - protein, 145 aa, Homo sapiens
VLTGVRQVMLLRKSMLLPVSELSVRTGPATRLLAGPGLAAGPREAGAPFSRSPMAAGSRRVEGNPQFSPRLAVSPSACTWTEGGMKMRLLWDKSRRIWSARSGGSAQMTFLSLEVSSRWLPSLIQAPSQCRAQSQRHGFSVGEQR

SEQ ID NO: 941961 - protein, 220 aa, Homo sapiens
EAKSHKGKAKRGRNSKKKKKTKISLFGFSSKKKDPKKKGRERDKREQTPKGREKGKEKEKPQKERGEGKEIKAAKKSLRKEGGGPPKASEKKAKMAPTVSRRERAAFPPSMAATPLPTPDNLHPDVENSAAEPERQKIAGVGKKSALPAAAVPPTPPSQGPPTALGGALGGERLHGAGIQLEASNPLEAAQSGQRFCPTGRLQSFHRRKAFDETTLQKYS

SEQ ID NO: 941962 - protein, 115 aa, Homo sapiens
SLPRGALPPRGPRPVQSGGPEREEPGAQRRREKRTQNPHKRIPARAQHSNQQKEEGNPEGAKERRPGKEEKRPLPFWTLRGTIFAFISEAMEGPPPSFYRDYFAALMTFPSHLSF

SEQ ID NO: 941963 - protein, 305 aa, Homo sapiens
LRALLLWGRRLLPLLRAPALAAVPGGPPILCPRRPTAQLGPRRPPAWRLPAGRLYRPPPAAAKAAPLPSLLSRPESVPGSPSPPAFPAAPQELLDIVARSLSSEEEVFLRELISHASPALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCQEFSSEARVRDVVTKYSNFVSFPLYFNGRRMNTLQAIWMMDPKDVREL

SEQ ID NO: 941964 - protein, 86 aa, Homo sapiens
LVSRRGYASEAIKGAVVGIDLGATNSCVAVMGGKPAKELGNAEEPEPPLQLWPFQQRVSDLLEVPAKRQAVTNPNNTFFATKRAHW

SEQ ID NO: 941965 - protein, 113 aa, Homo sapiens
MASEAAGDSLSSGGGACRAAAALTVRSPAVPCRRNMHFSIPETESRSGDSGGSAYVAYKIHVNGVLHCGVRYSQLLGLQEQLGKEYGANVLTAFPPKKLFFLNPAEEKKKKEQ

SEQ ID NO: 941966 - protein, 217 aa, Homo sapiens
MTPKRPMALPKIFTMRIYYKEAGVLSIGQGSTTAQMPTQTTTEEVRKDYGEASPKDGVACMAVPMAEGLGVCGTERLSHVANDNSYDEAVDGHSLTEEEAEQVLGLDPGGLHYSTNEGGAGNIDAPGCPNHRKGDSRPIPRLDHIKGEVSVRTMQQQSGTQNKNGVAESHGQRAGPEGHEDPGVEQFQPRNGGDGGGGRNGGAGATNAFDLTPSVPQ

SEQ ID NO: 941967 - protein, 323 aa, Homo sapiens
VSPGPSALPPPPQRQGEEGGCRGAGRGWAGPEWARLGQERGHEALGAPVPGQRPGLPGEGSGAALRGEDGCHAAAALPKRGRGLKGVAPRTVLWRKNQGAGSGHWPPGALCKEGDSGTCGNAQGRVQRVRGRAAILRAGLRRTRDRTKGGQRGPPRRMALGGEEEGVQEVGAASRSLSLSLLLGWCGRHHQVGPQEAAPGLAGGSLGQTQNIANEEREGESGFRRLQKELSVVVDVDEAAARQADWGKAGTRILLVPIRPPPGFDARPHHLRNGPYVVDSALGLTGQFLQQSGHHRAGVLACMVLNVGMQLQFLPHHKAAEIS

SEQ ID NO: 941968 - protein, 125 aa, Homo sapiens
MLRYASVNSIWSMPSPVFQWRKAFRRNRAVNCSEKRFKELLDGCSIANGDNLEATRWDVTKGCFDIFGDPFHKVAAVLVLHVKHLLIDLLHGHPTTEDSGHGEVSAVAGVTGSHKVLGIEDLLGE

SEQ ID NO: 941969 - protein, 205 aa, Homo sapiens
KGNPDPCPSSGRGGLGQEAPSIGPSREESGPLFAQRARFQAPTTERTCREEREQRPVAMGEEKWEERALPEESGSLGIPGMHAGASGHKGPAPGWLALGQPVGKQVQTIVQTCSLGGKGGLDKPSAVAYVLLPQLVSEPAHGHGVGHVLLVGKNQRPSIPQLVLLQHLLEFISRFLDPLPVITVHHKDEALSVLEVVPPQRPNLV

SEQ ID NO: 941970 - protein, 108 aa, Homo sapiens
RADLERKALNYRFPRALGSASSPVGSNVVLMRVMCKTNHILLVHCESSLQFASHCTETVEHKARSSYTVDASVTYGERGHSTTKSPPSLFYQQLKLADELCAPGMSDE

SEQ ID NO: 941971 - protein, 172 aa, Homo sapiens
MNREQQHKGSNKLLFLFLPLMTRKGREKDLLKVAPKPMGVNFPVDWGLCCGRPGHKGTTLAPGPVTSVPLVSSLVGGRKKEDKQQEATKEEAQNHEKAQHEENPWKSKEQVLNKKERFHKREVFKAIDVSFLVKSENTTKVDQKSGAHNGEGGSGGREGQEVDEEVPKVPGP

SEQ ID NO: 941972 - protein, 281 aa, Homo sapiens
ATMRYIAALSSASLSEFHKSQKWTALGSHPSWLLLLGLSMVEERREGAVGPMLTPEHCRGEDAPVVPGCGSGKDWKYPAKGSLRNRKLKALAVGPKRTQPHPENFTPKGKEEALGWGFRGEVGDAAVVQKKAFLKAIIQEKVVQGQHWASKGKKELSPEGVGRRGLEFRPPPTAPSGCQVEKGVGAGLGTLPAALPTPGSVGSGPTKSPWGLPEEDLWLPLPPGQRAQEGAALQRALGWVFQGQLQSPGGGGAAGLCHGGAWARGSLESCTSEWGTVHAAH

SEQ ID NO: 941973 - protein, 190 aa, Homo sapiens
CCRAIDKQPKQAAHQGPRVVNKCSSNKGVLVYMNQQQQSQARLACAQCISFSKSAYLGLNSSVGGRSGARPSWVLASGGMRRKWRAAPISSTVTMAGWVSSGRVTFTLVKRDPSTILTQAMSPSVSFSERHAAGDLPPNFSSLSVIHDYRFHREQLLLVKLTKVQQGEPIKLLKAEENLCVSLLHGLKVG

SEQ ID NO: 941974 - protein, 260 aa, Homo sapiens
RRGEKPEPRQGPPRSRLGGPPPHKVPLCKAPGPTRTRAGPRQRDGQGRGGEEQTTQGTSGGEQELGKKAGAAGGESGRQTQPRPPRGKGTEAREPGEHKGSGLPHTDGELGGHNSEEGERGHSGKEREHSLAPKDNRGAQAAIVGEESTTETGARAKNREKERQRQASPNIVIALAGYKAELASKRAVEAQEAQAYADDNSVLSMETSAKTAMNVNEIFMAIAKKLPKNEPQNATGAPGRNRGVDLQENNPASRSQCCSN

SEQ ID NO: 941975 - protein, 273 aa, Homo sapiens
MLLLLLFLLLLFLLLTLWFCSPNDTSTSSKGPSTTDGSSSWLSSPALCSAVGGRNVEIIKKLRLRLLQKKDLYGIRVEVRGAHHFPPSQPYVVVSKKEKPLDLLGIMDVQPGRCVPIAKSEQMWAGSAGLACWLAGIIFIERKSKGDAINVMSEAAQTLLTQDVRVWVFPEGTRNHNGSMLPFKRGAFHLAVQAQVPIVPIVMSSYQDFYCNKERRFTSGQCQVRVLPPVPTEGLTPEDVPALADRVRHSMLTVFREISTVAGGGGDYLKNPG

SEQ ID NO: 941976 - protein, 322 aa, Homo sapiens
EIKRCRIWICFGWKKKGNQPSSEKSREKRFKDPGLVDQLVKAESEWRRSKFRGKEIEESEEPKKQENRRKNKEKKTSGKRRICAKKCAEFRKPYCKGFSKPENLTKKKKPSPQYETILKYEAEEIKLEAKRFENLREIGNLLHPSVPIINYEDVDNKVEMIWGDCTVRKKYSHVDLVVMVKGFEGRKERAVVAGSRGYFLKGVLVFLEQALIQYALRTLGSRGYIPIYTPFFMRKEVMQEVAQLSQFDEELYKVIGKGSEKSDDNSYEEKYLIATSEQPIAALHRDEWLLAEDLPIKYAACLLLRQTVGSMAVTPWHLPVIS

SEQ ID NO: 941977 - protein, 76 aa, Homo sapiens
MSTCENSLHVLPWTRAKNLFQLTLSTSCNTAHCTNRKPRDWILDDKTHKKLFGGQKFSVFCSTPFIPEFSTTNSLP

SEQ ID NO: 941978 - protein, 340 aa, Homo sapiens
LYTHFSHTSNSHNIQTIQHSHPHTLTQPLTPLLSNPHPSQPLPYPIITKNIQNSQPNPKTSIPLTPPPSNFTTHHPPSTTTTTLSLSLSLIFQNTPNPPQTNHPHLLTTTHPLLPPPPHSPLTFPPPFLTPPSHSLHSPHPPSPPPPHHSRRPTSFLLSFHSHNTPPSPTHPHSPNSNLLLLPSTHSHTPSHTPTYPPSLLLSSLPPSPHPPILSSSPRSRNRDSEESVPSKKKLLRTFLIVQILLKPMPPRPHSPIPLPRASHARLPQPVLPLGLPVQLWAQALAGPASRQWDTENTLQHRLSLRHTQVSRDGPPTERAQLWYREVGRVGEEWRDMSPL

SEQ ID NO: 941979 - protein, 78 aa, Homo sapiens
SHQAVRVATQQSLAITRPGQGGALGWFCLAAGTENFLLQSNYNDLSLYIPDLEAGACGSTKPVAVRAEAQGVDEVPTT

SEQ ID NO: 941980 - protein, 174 aa, Homo sapiens
MWAMRPTTLSLLAKTVVIPGNEPEKVVVEGNASPSVKGGGVGVAVEVRGDHLGPSVAQDALEGALRRLLTTFLMLSYLAGFSRRQARSTTNTLAVGTRKDMPVSFPFSSGMTLPTALAAPVGGRDEVLESPAAIYATFSRRAIHSFLGGSYGMDYCHEFFHETKVVMDDLGQGC

SEQ ID NO: 941981 - protein, 346 aa, Homo sapiens
QLGGLPPLPDPPLHSSAYSHGPSPGHVGVAGRGKAKEGVEWSNAEVKVQPDFLTEFRCGGPPLTPPSLHSPGFSLELGGCLSHNCCGLEGEPIPRQWGGQEGPEPEEGPAGPQGCLQVVAGTQDKGVLAPSPLPCGLAPQQPPPMEEQPSPAQQPTRHARFRNEGQGKLCQKNFACKQQEPGKQEEGSHVEGRVGSQQGRQFRAQQRDVEQDAGGMKQPAQEGPVVAEAHAAAQLEAVVVPTQEAEAAGRTVFAAWRHLALALVAVSPAPAQNAAGQLHAKDAGIRAQEEPQVAQQVEQLEGGQPHAKARAKGSSGGGPGASPTREPAPGPRRGPKRGEHEKNCPA

SEQ ID NO: 941982 - protein, 312 aa, Homo sapiens
RLRQGVQAMGQPWAAGSTDGAPAHCLSLLTALWAAAVGLELAYVLVLGPGPPPLGPLARALQLALAAFQLLNLLGNVGLFLRSDPSIRGVKLAGRGLGRGWAYCYQCQNQEPPRSGHCPACSVCILRRDHHCRLQGRCVGFGNNRPFLCLQLQAAGVLLHVSIQLGPALSALLRAHTPLHKAALLLHPWLKEHTGRVSLAQFALAFVTDTCVAGALLFGAGLLFHGMLLLRGQNTRELARGQHFYYLGSCNNLQAALGPRWALRLALALPGLPIAGDGITFQTTAEVGKKPPDSGRAELSGRKGEKGPHTRL

SEQ ID NO: 941983 - protein, 266 aa, Homo sapiens
MAPRTLLRQLSGALALTQTWAGPHPMRKNTTSVSRPGSGEPRFNAGGNGDDTQFGRFDSDAASQRMEPRAPWKEQERPEEWDQETRNVKAHSQTDRENQGTLRGNNNQSEAGSHTIQKMYGCDVGSDGRFPRGNEQHAYDGKDYIALNEDLRPWTAADMAAQNTQRKWEAARRAEQLRAYLEGTCVEWLRRYLENGKETLQRTRYQGPRGAFLIACRSPGLASHKEGRQLGPTLEYHPPSGPEGEEILLGFQILYQRVTLRFRPAL

SEQ ID NO: 941984 - protein, 110 aa, Homo sapiens
GTEFCQLCALQTPSNSNLGSISLSITLMDVVFMSCATPLVFFGVFFHGGVITFFETGKKTSGASSSGLCILGRGKTPLAPVIVGMVGLDCLFYALWVWWKKDLANGRSIS

SEQ ID NO: 941985 - protein, 217 aa, Homo sapiens
FLKKRRPRHMRSQLQVQELQPVGSRGSQEFTHSHGVLLHNILFGKFQQHRFLVAFVVVHIFIVALSMGGFDFGFPGQEWGWERVQGGGENALVQGITRDNLPVVEDRQRKGLSLGVSPEISLKAKRVDGRDKNFDGVQKGAWDGCILSHVPPAPGQDGINCRDAICRGLDLYKVVRLHQTRSSHEEGRVDDSPGCGDDLAPAPVQGLLGNTASRILN

SEQ ID NO: 941986 - protein, 106 aa, Homo sapiens
MAFLFHGFEAAAFSAGFEHSVLDAALLPRHGVDEHYRFKGVALMGVLVEEEVVAGSISGHRGGQLGHIRGLCVHQLNGFPLKVQLHLDVVDHFLLELLECPLGLRL

SEQ ID NO: 941987 - protein, 105 aa, Homo sapiens
GEEPIPLCLYPAPLIPGSFLQPLPASGNTEDQQLVTRDPPGPQRGAESRLFSPRSGSFGEFSEPPHPPASMMLGSAFSVPQNRTNSSSLLLGKECGGLGPRKKLS

SEQ ID NO: 941988 - protein, 262 aa, Homo sapiens
ENLKSCNVCCKSSWNQLQDLCRLAKLSCPALGISKKNLYNFKIEYLFDYKKIRKQEYDLVKRRGYPNSKNTWEPRQNLKCVRILKQFHKDLKKELLRRHHRSKTPRHLDPNLANYLVQKAKQRRALRRWEQELNAKRTIWERITLKNKVDLDGPPRAFFYINKYHCCLRQSPSTNVAVGLRVPGLSVGTHWRLLPGGVLHKFAYNDQGQVRLRAGLPIYECNSRCRCGYDCPNRVVQKGIRYDLCIFRTDNGRGWGVRTLEK

SEQ ID NO: 941989 - protein, 127 aa, Homo sapiens
MGENATQYCPGDLNYRAFEGEEGDENFVGFFSEESLIDEVRMKKPGFISNGKGKEEGEKLKLTSSALGEGGHPRLLCLLGGLLALQLPGLCPQILLGLLHHLVLQSSLCFHHPRSHLHTLGFGPRPR

SEQ ID NO: 941990 - protein, 171 aa, Homo sapiens
EEEDHGDLGQGGGGLRQAREPRSHRRLGKSTRQCKGEDRAFRHGKEVKRGGGPATPHILQAQRHRVEEVPLLRRLFHFPSPPGAASQRGGGGKTHTGGGAQGEGARNKDRPGGRLAGQGGLLIGTLDSYDVGLGGICCTCGVFGQRNLVDGDPGTKVRLHVPQQNMASSTG

SEQ ID NO: 941991 - protein, 122 aa, Homo sapiens
MGGDSVRKRGHRDGSDRARRKRREYGVERDRAGDNQRLNIFPKEGFRPRNNIQRIGGHDPRQQECGIAVLEQMENHGVMPNKETEFLLIQIFGRKSYPMLKLVRLKLWFPRLMNVNPFPVPR

SEQ ID NO: 941992 - protein, 155 aa, Homo sapiens
MGLQKTILKMAAYTKIQELKTIFQLFTRTAINLFLQLSKLACNVSRVAIQYRGIAGAYFAWMVQDNHLSSEASCFHWWVIFAVTSNVATTNILDRHILDIEAHIVPRKSFTQSFMVHFDRFYFRCNVDWSKGDHHTGFENTSLHSANRNSTNTTN

SEQ ID NO: 941993 - protein, 263 aa, Homo sapiens
MGKEKTHINIVVIGHVNSGKSTTTGHLSKKDGGIKKKTIKKFKKEAAEKGKGSFKYAWVLEKEKKKRKRGITINISLWKFKTNKYQVTIIKAPEQKNFIKNMITRTSQADCAVLIVAAGVGEFKTGISKNGQTQKHALLAYTLGVKQLIVGVNKMDSTEPPYSQKRYEEIVKEVSTYIKKIGYNPDTVAFVPISGWNGDNMLEPSANMPWFKGWKVTRKDGNASGTTLLEALDCILPPTRPTDKPLRLPLQDVYKIGGIGTVP

SEQ ID NO: 941994 - protein, 117 aa, Homo sapiens
PARSQQEPGPRRRRRGRGEEATSLPAAGAARAPEPPRPLKTAAAAPRARQYLYIFFFFKSLLAKLIRNSVWPRSKYWRRNHEIDEFALGVGKKVKPGANMGQKVTGGIKTVDIKDPT

SEQ ID NO: 941995 - protein, 236 aa, Homo sapiens
MAAAAGGGAGAARSLSRFRGCLAGALLGDCVGSFYEAHDTVDLTSVLRHVQSLEPDPGTPGSERTEAFYYTDDTAMARALVQSLLAKEAFDEVDMAHRFAQEYKKEGERGYGGGVVSVFKKLLKKKCGDVFEDGWEEFNGKGFYGNEDAILLDAIFLAYKNVEDVEKFEELFLELTEEFFLDYNATILEELAVELAFQEEFFKEEFVKKLLLEMEDVEGDGKWVLDGRELGMEEGG

SEQ ID NO: 941996 - protein, 217 aa, Homo sapiens
PFSHSILSFFSHMYKKNERVSVYVCVCECVWFVLFFSCFKKLCWSGGWGGGRGGRRRGQVGVPWGVSGASGGAPPGPGWKGMGMGVFTGLCAGQPPVGGLCLHCMGGMVAGLLSGSGGLLLGAWWECPAGAVAALLWRGAARELGVLVLPCRLQGLGGSQAPHLQGRELNRRWGNLLVSNVFIHEAVHAPVGLLQVLFFVLLGGLLVAPVAVPPELQ

SEQ ID NO: 941997 - protein, 283 aa, Homo sapiens
MPASALTPPPSRPRRPPGRAAPPHPGPPPPPPPRCSSSRPGKVAVEIAKSKNKKWLQILQFPHINQCEENAAQTYEHDYHKPVRAAAPLGDLIFREFYAPGPELNHFVDFLDGVAEYEMTPDDKRKKCGRQLQKHFLHTGPKLIPEVTRPMLFTTRLAQGPCHGLFPEIPRLNPAYLSVAPFADYLDSIYFNRFLQWKWLERQQVTKNTFRQYRVLGKGGFGEVCACQVRATGKMYACKKLEKKRIKKRKGEAMALNEKQILERVNSRFVVSLAYAYETKAAL

SEQ ID NO: 941998 - protein, 49 aa, Homo sapiens
LQGLGAGETFTSASRGRSTTNKNHGGGAFAPFMPVWCPLLLFPFLKTAN

SEQ ID NO: 941999 - protein, 277 aa, Homo sapiens
NTDSLFHPSFPPLSLHSAGHPFLYAKELFLGAPFFGGTPNLLILVFLLLGSFPSTDARSLPLKATFLEDLAGIGETEGSSASSPNLPPPWTPALNPTSMGPQPTSLGGPSPPTNFIDGILDFFRHYVMLIAVVGSLAFLLIFIVCAAVITRQKQKASAYYPSSFPKKKYVDQSDRAGGPEAFSEVPDRAPDSRPEEALDSSRQLQADILAATQNLKSPTRAALGGGDGARMVEGRGAEEEEKGSQEGDRKSRDMGSSGDTEAQEEPCSGVLRGLWWR

SEQ ID NO: 942000 - protein, 133 aa, Homo sapiens
MPGASGRLRPGDVAGPGEWLRGNGCLRGGANGGPASPGYVATGGALAPGFRLALLGWGSLGLRWGGSGFKFWVPISVAPGPDGEATRGEWGSACMWDAWREAAVCGGEREAVVGWFLRHSRGLKGSAPAMDTI

SEQ ID NO: 942001 - protein, 331 aa, Homo sapiens
YFSGTVLNCCAFLGEGGGALATAKVPASFLGGVRQCPPPPFWSSFLSGFPSLNDKHQPFPTQGAGGGGGGRWVGCSGRGSAAALAPVRPLPWLWGAWPWAAPPCWGWGAIQFSALPPGIFPGEGGRVWEGLCHPVGSRTGGGHGCCGPPVGAAGCPLPPPPPTGYPGVPAFWPWGSGGPPWGSGPGPTGLAGPAGGSPPPPMALHSHTPAQRLLSMQLNVTCVCMSCVEGKAAGGHCCATHPGVQGMQGALSLVYEPRPKRVKGSVSPPSPSPNMPRPPWALESFAMNSPGAFLFILLFGHPHLLQSVLRGQDGAPIHVGSAVPAGLRFDF

SEQ ID NO: 942002 - protein, 197 aa, Homo sapiens
CLTTKENMLFSSFTLLTSPLFAPRKSLLSVIGQKNLKNSTAKLFVLTVDSHFCHLAWVNTPKKQGGLPPMNIPFVLNPKPTITHDYGVFKADKGISVQGVLFIINYKGILRQITVNNLPVVPLYGLNFETSSGLPVHLQTWGSVPIWLETLAVIPSSLMSKKAKNISPSRSERWAVLVPSCIGHPSKQNLFCIFFFH

SEQ ID NO: 942003 - protein, 228 aa, Homo sapiens
MSREMQDVNLAEVKPLVEKGETITGLLQKFNVQEQDIETLHGSVHVTLCGTPKGNRPVILTYHDIGMNHKTCYNPLFNYEDMQEITHHFPLSHLDPPRQQDRPLLPPRNIYPSDQLAKILPGFLQQFLKNIISGTRSTYILTPFPLNNPKVEGLLINLNPAGGGLAWAASNISRRTQTLPAIVVSHLFGEEEIHSNLEVGHTYPQHILNNMNPPQPPPFHQYLQQPAR

SEQ ID NO: 942004 - protein, 157 aa, Homo sapiens
EVNSCGGFGAKVRLALRKGRFSAPFTPFSKYQQGVLPQVPTQPLLELCVVFETLWRILVSPFLLIALAYAIFVVTPFCHLFFFSHCLGIFATGSENKKQRFISTFSSHVLPCAPSRSSLTMFNFQIPNKPRGVVCIMYAFLFLLSSPFLHHPLGSTE

SEQ ID NO: 942005 - protein, 55 aa, Homo sapiens
MENLGLLFGQMLLLFQTFFSSALCPSAESFPGVARCFGTNVFSKTLPAYCIIGLG

SEQ ID NO: 942006 - protein, 63 aa, Homo sapiens
MSWMGALVLPYRTRGLWKTGSLSGGKASYTSNHRGFSFSTPARTRSRVREKMLPTVSSRLPAM

SEQ ID NO: 942007 - protein, 254 aa, Homo sapiens
MASAVAAIRTLLEFFKRDKGVTIQGLRANLTSSIETLCGVDSSLAVSSGGELFLLLHQSCLPGNYSDYSKFKKIMIELGELFLLVIVTVEEQNCRSVLYFDLRLSDNIDIIAYSLYMCSESLEAAVGGPGKRFYLYTSLSQSLNLSGKKIGKALCHLNVPVTVVLDAAVGYIMEKADFVIVGDDGVVETEEIINKIGTNQMAVCAKAQNKPFYVVAESFKFVRLFPINQQDVPDKFKYKADTLKVAQTGQDLKE

SEQ ID NO: 942008 - protein, 323 aa, Homo sapiens
NLGTEQAANQGQGAVERPKSDRVPTVPNPRLGPAAGAAMGKKHKKHKDKSRSSYEDYTDKPLEKPLKLILKVGRSEVTELSRSGHHSNYYNKKSNHEPKRHKKKKKKKKKKSEKEKHLDDEEKKKPKEKKKRKQKKEHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHSSFKMMSKQAALLGNEDTAVEERVPEIVPGTSRNCQEIQKAEIEKLSAACLSLK

SEQ ID NO: 942009 - protein, 153 aa, Homo sapiens
LHSVTLNVSAANLQAGAAAASCISPKYYMIFTPCKLCHLCCRESEINMHSKVTIICIRFLFWFLLLCMLIGKSHTEDDIKIATKNGKVRGRNLTVFGGTGTAFPGIPKAQPPPGRQRTKKPQALTKRPENRNAKKNAKTCGQNIDQRCPGLNG

SEQ ID NO: 942010 - protein, 158 aa, Homo sapiens
GTGARTREVWKWNKWRRRRVRRAVDVESVWKRGKSVCGEKRVKVRTEVQAGPKAAARGRHRQAAEKGKSGKEAGRPGKKKGTNRGRRQGEGAGRNNKKERKRRGAEGTGQQGQEKQKPGEGKQGKQAQEECGGRGTRRAGGKGTEGRKPRSKGGGGLS

SEQ ID NO: 942011 - protein, 114 aa, Homo sapiens
GTGSRRRTNKQKREAREEARRKKDEGKNKKAKGRGKKPGEKGTNRKGNQNRRGRQERKGRKGGGQQREPQDEKQQGAGERRTVNAQGRRKDQRGARKDSYSMMTRGGMNSDNRL

SEQ ID NO: 942012 - protein, 85 aa, Homo sapiens
MGQLYENNEEDYFLYVAYSDESVYGKYSGCESRWEWWGVGAQARVLCHKIQKTALASQRQAAQQTEAHLENITPNTPLITFSHAQ

SEQ ID NO: 942013 - protein, 180 aa, Homo sapiens
RKSQFFKKIAVIVLLCHGLLCAAKQKCSVVLLLLAFMFGFQNEQLVIIMYLKYDQLISLTNIFQPVIFEKERIFLIQIHNIQKIPEREISGIRGLQIRNKTLIQLVINGYKEKKRRINMPAKKEIITKHRQLPPPITKEQKPREKSRGPPTNENNIDQGNDQSSREESKAKMSHSYFRDK

SEQ ID NO: 942014 - protein, 116 aa, Homo sapiens
MVSGLLLRGRGGGVWGWPGGCGARRGARAGGGAGISLSDTPCLCVALIMYSTLPTCSKARQPTGRQKYTKKNYSVASGGKIVNVLVPFTKPQPKKVTHKIPERKRCSRLRLRLSRC

SEQ ID NO: 942015 - protein, 154 aa, Homo sapiens
MTVPLVITPKVVYSGDEGFFFTPSIGRHKVAFSSGCVTWAFLKRKPIGLMNLSYLGGFPVKPSPTKHTLVTILFHAFIFPFPVRITFNTSVSPGARTLGRGTSHFPAGAVRGGVIILERTLARECPARSSREAGTGPGGAVQHSVGWWGAFHAS

SEQ ID NO: 942016 - protein, 287 aa, Homo sapiens
EKGFSHMGTNHQGSPGPHLELPSAALALEPVLRICALTLTGSNRKLQPTASMRVIGGQTVERRFLSSRGQAPSGMAQSSYRGDFAHESPWGSEQIIAGAEPGQALYISIRSMQVGARWAQANEPTRRALTGQQGQEGKGTGKQSPLGGRESVDIGTPRKGTRGLRNRSTQTALGQKLPGELGTSRSVWEPHPVPVAPGTPGSVTPIPKLGACVATKQKGNRGRGAGWQWSILAARGDQVTTGKDWSLVFKKEGWGWHTGKATPIKCLDCVTFTGRRAGSWARHSGTV

SEQ ID NO: 942017 - protein, 244 aa, Homo sapiens
MLWGSGLCLWGVRGIHVLGVWGRGGSRLSWGVRAVWRGPSYGFGDEACRRLWVMSWRGSRLCLRGWAMFWGGVNAGGWGPGLAGGCVPRIQAGPLGNFWICVLASVGLDTQRLRPSQQRKLLENMKDRWYQADSPPADLLLTEEEFLSFLHPEHSRGMLRFMVKEIVRDLGEAGSSLAGSQDPGPDWQGPGIVGRSGQVLREPQPGCGLTHSRLADQDGDKQLSVPEFISLPVGPWRTAGQDID

SEQ ID NO: 942018 - protein, 114 aa, Homo sapiens
MASYSLVVVFGSQLAGQGVVPQSPLRAETRRHCPAALSASLLPALLRGLLGAALVGAPQQPLQRLLQLLLQGGHLPVKAEGPGATAEAGRRGPEYSGYSSKAVALMWTTFWKVF

SEQ ID NO: 942019 - protein, 102 aa, Homo sapiens
MPGSVCTKGYRHCAPNPLLLWTLLLFAPFGLLGEKTRQESLEAIPNWQGPLQNLDDIKAVGTKSTLHYVWSSLEASEDGNGEPHNTPHSTQEPTTGDLLAIP

SEQ ID NO: 942020 - protein, 71 aa, Homo sapiens
WGGVATSHRGSLQGLHEIFPLFDGGIQLGDGIRDHLLIKRGDFADAQVIHGCTFSLAAAVWRSRDIKFTVT

SEQ ID NO: 942021 - protein, 244 aa, Homo sapiens
QFRGWVLILLINGQYGPPPARLPPMPIFGGVYGWLGERVFGVLGGEGGQGCLGVVPGRRGLGCGVPGEGVDVAPWGPGPLGVAVLFAFLWGGALSVGFVGWVVACGSGCWPGLPGWLEWRVGGEVREGLGGLGPFLGGFIAFGFGAVAFGGPVRELGLGVPGFVLANWADPFGWLGGLLGFGAVVVLYFGSLPLPFVCSFLGGLSKTVLSSSLGRLFGNVSSDPLTSWDGITDADSVTFEEFLW

SEQ ID NO: 942022 - protein, 188 aa, Homo sapiens
ARPPTLMAGWGLGQGRVPKVVLFLEQLSSPGARKILFAGVGMVAQACAPGALGGWGGWVPGSGGRGRRWLTWWDPLSTKDAENFGWGWWWGPVVPATWGDGEGGWWGPRRRGLPWAGVGPLHSRLGGRARLRLLEKEKKGKLLCEVRGGGGVWRGGGGTGAGPHLSSSLGSGPPGQPNACRRAQFWPR

SEQ ID NO: 942023 - protein, 206 aa, Homo sapiens
ALLVPVAPPETRSRPAPQCQRPVYPAGAASPPEDSTSNEPSSTLQVASPGHPALMTLKAAAISTVQRYKFFSLRGPMCCKRDLRRLHKTVYPIERLVADKLIFHNSFFCCKIRHTKFTPRAATLRCTGSYNENPTSRSCLRAKANKKRGLAASSTSDALGPQGGGPRDQDGLRRLKPSSPSAEGLERGKRGKVGSEVQAGACRGGP

SEQ ID NO: 942024 - protein, 145 aa, Homo sapiens
MKPENTVFDIPKPWAYTPKPKYTPKNTESNSENPEFEYQNPRYKHQNTAYKPRSPGYEPRSPGYESESSRYESQNTELKTQSPEFEAQSSKFQEGAEMLLNPDEKSPLNISVGVTTLDSFTQGFGEQPTGDLPKGHLFEMPTGAL

SEQ ID NO: 942025 - protein, 102 aa, Homo sapiens
MIQTVPNKNTVHLYWKTGSHLFVRESWVSAFTRAKFNGNLPISLNFSSCQKQNRVYIKVDMTRVTVYISVWPVLFTCEMLPCVIPGGYHHAFRLAFGVAAVR

SEQ ID NO: 942026 - protein, 261 aa, Homo sapiens
SPPPQDGKEVSFQQLQLLSPPIQGSRLNQRGGDQTGGNLLRLHFFLLPSPHSLPFPEPCWPLALRPRTSLEEVDWDRAPGGPRPKGGGTYPPPPYSSPLISQHREHLSPNNSIMEVYQFQGSKEQVGYKLAGAFKMTAGSRGFATSSYPLEETIGPLLFLFVVIAFSHLISLGKQDLSTLFLITAILHFLGLNSKMCKSEVIYKVKFISQAFLQEMDWYPKEDNLVTNNTAALAPAGTWPLPLRFNLFPGKGHRIKLPKVK

SEQ ID NO: 942027 - protein, 285 aa, Homo sapiens
MGSPDSMSVGFIGAGQLAFALAKGFTAAGVLAAHKIMASSPEMDLATLSALRKMGVKLTPQKKEKVQHSDVLFLAVKPHIIPFILDEIGAEIEEKKIVVSCPAGVTIITIEKKLSTFGPAPRVIRCMIKTPVVVRDGATVYAKGTDAKVEEGRLMEQLLSSVGFSTEVEKDLNKAVTGLSGSSTAYTFTALDALADGGVKKGLPKSLAVRLGAQALLGAAAMADQEQVSPAAIKKTILDKVKLDSPAGTALSPSGHTKLLPRSLAPAARIDTSCLTTILPPPSLL

SEQ ID NO: 942028 - protein, 287 aa, Homo sapiens
CQLCAVASYFLSPGLSVSSSAASPDFCQNIARDSFRHRTDWQQGLLHEWEFAPALHGLQARHLLTLGLPEHRKPTWAAMEWDNGTGQALGLPPTTCVYRENFKQLLLPPVYSAVLAAGLPLNICVITQICTSRRALTRTAVYTLNLALADLLYACSLPLLIYNYAQGDHWPFGFACCLVRFLFYANLNGSILFLTCISFQRYLGICDPLAPWHKPEGRLAAFLVFVALFLPLTNHSLPTPFPPTAIHPKPTLSYQLTPPPLPTHYIPYPIPLTLIPFLLPFPPLLPS

SEQ ID NO: 942029 - protein, 127 aa, Homo sapiens
SGAGSGLRSPSRSALPPLPVPPGCPAPAESPPPLAHRSDPCPAAPWLRALPLLPFSGAVGRAALASALPPSLPVCWPLRPWRPSSLACLRPNCRDCSLPLDELGCSLPSPKPGRLDGVGSQSPWSYC

SEQ ID NO: 942030 - protein, 199 aa, Homo sapiens
GDAGPRAAPRHVRVNMDELRQKVMINQFVLAEGCAADQAKRMLQEEHWQFVERAEQRFFQKTNIPKKYQQHLDDVNSQQHPCHAAQLPRFDGYVLQASCLRGNAEQQQPHDSRRLPTYKLQHLMGLLPDKTGVLAPALLPQHLPPPPQHTANVAQQKHSREEPTEKPWSHGRPEMRMDAAGRWAGAKGQPRVVGKQEGQ

SEQ ID NO: 942031 - protein, 105 aa, Homo sapiens
MVLLTRDGVGFFVFPSAPFPSLSAIWGFSLLFSFALPPPFRFVPLRAFPLPPAPAAPHPTGPGGVRKPAVGGHEGVGTNGCNWAALGGWRGARDALRARPAQPDL

SEQ ID NO: 942032 - protein, 85 aa, Homo sapiens
MSRGPGGCAGGGARGPPAIRPRLFRASAPGGGARGSLGGARGGGCVLVQCGWGGAAGAWTGPPSPARDRRVRPPGTKAQRLERRR

SEQ ID NO: 942033 - protein, 179 aa, Homo sapiens
GGEAHACNPSTVGGPGQAGQLSPGVRAQPGRLGEILLLQKIRKTRYLPGMELRARRGHKLLGGLGWGGHLGPGWGSSGLCCRHWTPPGETGRDLVSKGGKGEEALLQTTYCNFRLAEYSRKFMLVSAQGDITPPLLNLSGYGFFVSWPYILDAGTLSFSSLLHFYFCVSSFFSWQQYQD

SEQ ID NO: 942034 - protein, 120 aa, Homo sapiens
MGLPGQVSPERPFPAPLEGLGAVAHQAQEQPHPGGKAYPKNWPCLFLRGPVRKTDAPGVTLENRKLFQEEGGASVSPGALARKALGNPHQSHGRGAVVTCDHGCLAPPAGPPQPFLAGLA

SEQ ID NO: 942035 - protein, 66 aa, Homo sapiens
MVLVSGSESTWSFEALGTFPLVEPNLGSAGSEKEVDAVDQVGERKGGGPTPPRRRPLFRRTGTEGG

SEQ ID NO: 942036 - protein, 237 aa, Homo sapiens
AENPGGPPSRGLLDDGFQVLPGERGSGEAPPGGDRSTGGGGGDGGGGGGGAEAGDGGRRRLWQLLPWRAAAELLLHGARSKPYSCAECGKSFGVRKILIIHHRSHTKERPYEYAEYEKSFNFHSGLIRHQMTHRGERPYKFSEFEKTYNLKNTFRTTQRLHTGERPFQFSLFGKNFIRKTEPAQTHNASTRGERPYTCGECGNIFRYKESLKDHLRVHSGGPGPGAPRQLPPPPERD

SEQ ID NO: 942037 - protein, 104 aa, Homo sapiens
GVESLGSWASGETWPGPASSKTEGARSAGTQPRPLADPAMDPFLGAVALVCRLALCSSELTDLKFLCLGRVGNAKLVSCADRPRTFFHFVGVERIVVRVKLVLV

SEQ ID NO: 942038 - protein, 94 aa, Homo sapiens
QRNCFAACHLLWQAAILVSESGVCSRLGRRLYTFQKLTGSGIVLGCLAFIVLTVNVSSMLLQLCDYVPYVLAPRPSEVEPYPLHLSHSHPHFSI

SEQ ID NO: 942039 - protein, 229 aa, Homo sapiens
MGRTYILEETVGQYFSNINLQGKAFVFGLLIGQCSSQKDYVIVATRTPPKEEQTENLKHPKAKLDNLDEEWATEHAFQVSRMLPGGLLIVGIFIITILELANNFQNALRRLMFAVEKSINKKKFWNFTEEEISERLTLHISASTKKIFSRTYDIHDPKNSARPADWKYQNGLSSSWLSLECTVHINIHIPLSATSVSYTLEKNTKNGLTRWAKEIENGVYFINGQVKDE

SEQ ID NO: 942040 - protein, 113 aa, Homo sapiens
QTSNDNKIEEIKLLAYLTALNRILDPVKTKSYVPMWVYANLYTHIIPLGGPSPILAIISSTQFFLAISVDSVWCVFFSIFHNSLPLANSTKAFYRRGCGGGGGGGRHLSQFFT

SEQ ID NO: 942041 - protein, 206 aa, Homo sapiens
MVPHFPQTINSNMNTENHKSTILSSCLLSPHSSIMPPSSALAAPGHLEVLGCGWGAVGGLRVVQMLPQRESQLGGCIWAGVLIQGRGEVGAVSWVAGAEDRETPVLFHLPSINGGFLQLLRRTPTTSPLVDPPLSPGDTDAAGAMRRRSLPRLDMMSSGTVVVMISSLVLGIRSGPWYLHSCSALFRLRCCLTVLVTRPLQLSGMT

SEQ ID NO: 942042 - protein, 148 aa, Homo sapiens
MTSKALSISPLYSLKKVSKRRQNVRVHFFCAFSLSPTPFGNRCQVLQPLLVGFRGTNLGDDKTQQFVQQLQYLVSILGKVIQLSASSNSTLFSATQATLLKTGFVLLVNLSITPGFLLPSFSSFPRIISNSRLSITSSLTQRRNMFSP

SEQ ID NO: 942043 - protein, 106 aa, Homo sapiens
MGTCPHTHPKKGFTGLHNSKVNFIFPKGLCQVEPDPSSLGVWVTPPRGCHSCRCAPIRSIPKCNEEQVWLLTRAVAPKKLSWLLFKWPLSCRTMLYQRDKKSTLFC

SEQ ID NO: 942044 - protein, 137 aa, Homo sapiens
SLWACWCLALRWYLSSIPGEVETENVGTISTEVVQPTLVDLLLPTGQLCLQQLGQVADDEGVPGGRGISKGELLGAQGLGEQGQRLPSLWVQLLLQLFLVLRPVLPSEQLSRSMYCRCMRPGRKKWRGKGIASAYHF

SEQ ID NO: 942045 - protein, 70 aa, Homo sapiens
IETSHYVAFVNYGKDDSAWLFFEILAAFVLVVIVVSTFFKLPPVPDFGVYFMIFVCMTFFFCFPVIFLFV

SEQ ID NO: 942046 - protein, 97 aa, Homo sapiens
IRHWITGPPGIDRCALFAYCYISRKWPSFLRQKVLWFRVYHRPSSSAGGINVDICVCDFGGGGWVRRGACCSIYEWLRFEAWDPLPKELGPGPQVAA

SEQ ID NO: 942047 - protein, 93 aa, Homo sapiens
ENSTFSSFTHRPRPSGIHPELRRVRKWSRARLLVGLMGSGAEKVADSSACGPAAGSGSLLIFPLWSLTSEGGKGEREKEGPGASGLYFRRQRL

SEQ ID NO: 942048 - protein, 192 aa, Homo sapiens
MWHFEEATFLERDAWFQAIESYILASLQCCESSKVKVRFFCGVEDWPQELTLVLTAIGNLTAEVVFFESRGVFFVGGAWRQSQFQPKFSLQLRKDSQSEVVAIQVIGNAKGNSICVDCGAPSEFQEAAEGLGSVVNAGVPVLPGWEPPLRSFRRPHVGQLEPGLLICIECSGIHRNLGTHLFRVPSLDLDDW

SEQ ID NO: 942049 - protein, 122 aa, Homo sapiens
MGGGMAGPGAVASWEGEPAHARGSRAGQAGPATGPTLGSGPPAAMHHSTPQARGCLNTGSASRASAVARSLGSGSSIMDKGRTQFGRQGSELRGQVALAQWLQALPTVGQLHVACHLQDGEA

SEQ ID NO: 942050 - protein, 226 aa, Homo sapiens
GGVNIPHTPVRFRQVMAHRFGSPTEELSVSDVSPSRRDLRDGSEVSALKLQGQGSSERGDGARKALEEAPAAAAGSGRSGPQGVEKKAAENAGGASRELEPVRWYKEWIRFSMTIPSTAMPVKSRATSSMSTETAVLPFGATRAEIQKLNPQPGGPMAWGTKSTSWTKKMKKKKKKLNELSLRKALDMGRYQQKKEQGVKKKTQKIESPKPPPFFGFHTEAGQAGE

SEQ ID NO: 942051 - protein, 61 aa, Homo sapiens
YEEPVAGGDVWVELWPPLLLLLVLVVSGSPVGSSGRLMASRCSLELEGLGLGVCFLGVFVC

SEQ ID NO: 942052 - protein, 112 aa, Homo sapiens
MKKTIQLIKPVVRGGAVGGPGLPSPGSRPAAAAPLPPGCPVSFGGGGGGGGEGGGKFCCPQCGGGGGGGEGVCSLGPGGGVGKQGLCQFCGFRAHAERNSPFVPSCLPPLLC

SEQ ID NO: 942053 - protein, 293 aa, Homo sapiens
PFLDHHTGRSGPDRQVDRQTVQRDKKTTNWISGPRPGSAAVSRLQLQLCSGELVSKKNWPGPLFLQGSFSSCPTFPHPACWDPWQVDFPGLWLAGLSEQRIEALGDSLGSWRPGFFGVSSSSGGTLVNFQAVATAQQGPYFQGRPSTCPPHQHGAINKISSSKSVSSRRAAGWQKGRAEKDKPPATHHICSVGSSGRKSVLCTGVGVWPCCPHEHSPLTSSPSHQRQILLGGAEAGQHGAHSVHDGCQVLVLRLRPTELHEVCQTLQVFKVVAGEAPAGQDLRGNGLFRRGAR

SEQ ID NO: 942054 - protein, 258 aa, Homo sapiens
SALSYSQTCREGCGAQIHGGSVGWGWVSELCACAPEVGSRACVLRHPEISREMAGMREDDAEAKPGAQTGRSPVCQGWRWALLQAPGAHQWPPGVVVEGVHVGCASQEPLMQNGQEDEVDALCRKPDHPSAGRDPRLGHCSGGRAQVERVGQRRGDGREAKPRSLVAAIWWERYLLKRDSGKCSRKIGVQKIPGYEILGKVNYDQGKNVPQQTLEHCPPFPKRMAGAGAWLRLRGLGSYEGLPGCALCFFFPSKVLGL

SEQ ID NO: 942055 - protein, 71 aa, Homo sapiens
GVSTFMFTGVVMVAAAPSDMEGSLGGGCATPDAIEQAKGSGLAGSERFLALCGGSLNNLNPTLAEEFVFWH

SEQ ID NO: 942056 - protein, 69 aa, Homo sapiens
IGFTSSFAYLRATEAIRGPGPEELEWRVIQNKELSVASQGLRSPPGTERDLRDDFLFSSSGNQNKGRFG

SEQ ID NO: 942057 - protein, 112 aa, Homo sapiens
GSSVREGWLRERRVRGPRWTSRRCSPPALPAEGNIGGGAPGARLRAEPHAARLRATAARRSAARPAHLFWALNIGGPGARPGTASRPNPPARRGAIRLAGDLLFFRCSLGSC

SEQ ID NO: 942058 - protein, 190 aa, Homo sapiens
AKKNTSRNPPPGNPPRPRSTLLTRGHLKTTPPPPPAETTTTPTRTTNNPTADPQTTPREAPNTPPTTHTQPTPPNHNPQPHPNPQPKPPTQDPTKTTPQQTTPPTPPTTTPPTPPPTHTHHHPHPPPHTPPKIHHTKAKPPHPTTPTPHPPPTNPPPHPPKPTTTTRTHTTTTPPPHPPQPEPPPKTTPP

SEQ ID NO: 942059 - protein, 133 aa, Homo sapiens
MQPNSPALRGRPNPSAARGPRTLGGQTATFQILQRVPGCRLCFRLPKKRQLSLQVFHCLKRPFFPIKRCQVKKKYRGVFSFVRFLLSQADVGVPRRAGVGSPRALLGLLGPIAGVCDFGIFYFLLVQLVLSPK

SEQ ID NO: 942060 - protein, 190 aa, Homo sapiens
PGVILDNRALGKAKEGGTEVHAHRGIPAVTVIPDIFKHLHGREGLEEKRQNRLGYGSQPQHSGPLGGMTEPTISGACVCRNSSIGQGCASPWGSWAPHSRSVAVWVGLGGLCSVTPLRRDEGGFPGGCVDRAEGEVGVNSPQGSGELPGLSAHMYCSNLYPMYISSRRSGGRASLWARAFGVSTSLKYSV

SEQ ID NO: 942061 - protein, 69 aa, Homo sapiens
VSWLNALQSAGRYVAFTHTCCCGPELEGAFSHRTAKGKYCVKFGIKVGLGVTGEGAGEDRLAPALHHLG

SEQ ID NO: 942062 - protein, 104 aa, Homo sapiens
MPLTQGWLRGLPAQTGLAVVCFGRRVNITGNGSVSPRRVGWPLVPGLLLALQAIESLNLLPLLLGPGEGREEPVEVHSQQRVVITGYRVGEEAGVAVGVHEAHC

SEQ ID NO: 942063 - protein, 131 aa, Homo sapiens
MIPNVPFLEKVAKYIPGVCCACPLIHKASMFLPPVLMPVSFQNPNWGRPLALGTDIRGEYNLLLGRDAAASSKTALCSQNLMAGSWLQYSAAKHDADSSRICNPVLSGLHTPTVGRGTGPGLRRLQALAEV

SEQ ID NO: 942064 - protein, 103 aa, Homo sapiens
QQTASKTSYRTHWPSPGCSQPCIHRCARQLQPPPPWGLQRAGLLNHFPCVCTTALSLYFLLQDWSALPPRRKCCGRKWGERAGISRALKLPPSLAAWARMQEA

SEQ ID NO: 942065 - protein, 122 aa, Homo sapiens
SSLYRNQNILLKKKAEITWVLGKEGGNRNCSAGWGSLSWGAVEGAESIKPHILCRVGLVAKAGWGCWNKSLRFWKEASTFYGALWDPRRPQDRSSDRPKLDLPQLEWVVTQLASQLDLCHQG

SEQ ID NO: 942066 - protein, 140 aa, Homo sapiens
MGRVNGSCGGFQPNGTYQEWGCGLLSFLGEEERAVPQFSLWALRQGPQCAGRIPKGGKVGVMGSDSGGAGHGVAENGALGGGKLGGWGVGRHQGGGGAFPLRVGAGNQHFRDTRSASFNPFTRRMSSWRLICHEVEGLAE

SEQ ID NO: 942067 - protein, 278 aa, Homo sapiens
ENILLAKPGFLLLFLPILILTPLRGVLQSPEKDFIAIRVNQDGAEISPVPQLLWPFQTNFLLGLWATPAPAAHTVTIWPGRRMYLGVNLEAISSPSKICLLILQFPRDCSLYDFFFICTNFLSRSMSSMVMLHEDEDCWASYNLPLPPVPVPRNLVPLPKGSSTSSRFHLLRPRGPVAEKLPLLLEVAREKVTREDGLGDSFSLSSSPSRSFREALISMSRASFTSSSSWYSASCCCITSRISVISCSLASSIFRNLSRSPAMASSSSRMRSSAAVAC

SEQ ID NO: 942068 - protein, 149 aa, Homo sapiens
MFSLRKLASSSAGTFIFSKMKVMFELDFISAPQEERVQWVRTPPGFSRGKAWFLMKCELVSFPGLLREWVRIVQDPIKVTVEEGVGATPSHRPFKGMTFFFFSGAQFRSRWKTPSFHLMIQCSEMGAFSTFDAAMAMPKPTSRTRPPLE

SEQ ID NO: 942069 - protein, 214 aa, Homo sapiens
MARLLQASFLLSLLLAGFLSTGIVIDFNAGINGTIYYYGALTISGEDYMPFKHYGGKYLVFFNVAYLFTGHYIEMNAVQEEFAPFGVVIVGFPCNQFGKQEPGENSEIFPTLKYVRPGGGFFPNFQLFEKGDFNGKKFYTFLKNSSPPTSELLGTSDRLFWEMKVDIRWNFEKFLVGPDGIPIMRWHHRTTVSNVKMDILSYMRRQAALGVKRK

SEQ ID NO: 942070 - protein, 108 aa, Homo sapiens
MGSHVLFVSLNDLEGSSSGIGFVCYKVPVSGWTMGHWTELTNRDFLGPPLGEPFLESGFITKSDEGTAASGVDGSSSSMRSQCRRGSIKFYVNVLFLGAWVPNKWHCD

SEQ ID NO: 942071 - protein, 135 aa, Homo sapiens
MPPGSQGHCPQKQALERDRQLFIIPSRTSVKLAIEGFDLGGDGLLLEEFTFTGVLIHSLELQFVGQLFTVLAPGLGQDPEPLGGVARNVVGLLVKGCHWPWMLGLSVWKGLRMRITSKPDWSASFCTSVEISSTD

SEQ ID NO: 942072 - protein, 255 aa, Homo sapiens
KLIVDGLLLYFPYRYFSPDLFTFLLDPSPRWAPRVLDSWGSPLAPGSQSPLLALIMAFQTTYPLEVALLFSCSITVPDIEKVIEELRELLLFYQELEGELLPFLGLALTSRLDLCVPPAVPPLLFGKDVDGTCLLLSSSSVRAPSPLVTSLPRCRFSEEFDAHGRVVPLPAGFFHLADLQALGRRQGWCPSFLARYSILHANVVVYSYHYLLDPKIADLVSKELGRKAVVVFDEAHNIDNVCIDSMSVNLTRRTL

SEQ ID NO: 942073 - protein, 109 aa, Homo sapiens
ERRPRPARTRRCRWSPGQCRRARGGGGGGRAPGGRRGGRPGAATSCGIAVGAVLSFVFFSYCFTDLFLAVSYYLSNQHTYHLFLSFLFFFSFSLLFLVFYLFFFFYYYF

SEQ ID NO: 942074 - protein, 265 aa, Homo sapiens
MNSSSRSTRERVHSAAARIWKAFPGRPLKVEDDSPGVGAVPGTGSRRRVGPCRKSGVLPWARSHCSPPVAHPGLSQGPFGQDADLTNPAPGPSPQDLMGASAQQTHLAVGSRARGCPGRRYRFVGWVDFGEVAQSPGIPRGPDDPLSEPQARALCWGSPVPAATQVQNKGLEQEDEAQGPTGTAGVETGERGQGHCMGLGKGGQAPPGRALASPGCSREGEAQSAGGEQHSPQEGREERGPREGGARRWEGGRGPREGERGLREG

SEQ ID NO: 942075 - protein, 270 aa, Homo sapiens
PVSRPSRTSPPLVAMYRYLGEKLLLCRAGPAALGSASADSAALLGWARGQPAAAPPPGLALAARCHYSEEVADRKDDPNFFKMVEGFFDGIAIIVEDKLVVDLRTRESEEQKRNRVRGILRIMKPCHHVLSFLFPIRRDDGSLEVIEGYRAQHSQHRTPCKYGIRYSTYVSLDEVKALASLMIYKFSVVDVPFGGAKAGVKINPKNYTDNELEKITRRFTMELAKKGFIGPGIYVPSPDMSTGEREKSWIADTYASTIGHYDINAHACVT

SEQ ID NO: 942076 - protein, 206 aa, Homo sapiens
GPVCRGILWLERGGSTRPLQLPQPGSGHPGTAITPPTLFWVWLLVPGTQGVNDGDILLADGGTTNQGPLEIFYRGQWATVCDNLWDLTDPTIVSRPLAFHNPTHPLPTPPFPQPSPPIILHHLHSTPTHPSLPLSNSLPSLNTNSTHHTHPGVFSTNETTTTHTLHLSTDLSHPLPTSLTPTAPPTSPSPSISTPTTPSPSGATRP

SEQ ID NO: 942077 - protein, 97 aa, Homo sapiens
MPGLGAEAVPASAVLVSVRLILLVTAQEGQRVLVAEGVGAGQQELVLYQNLRTAAGRQRAPIGLVEFELSSCSGSLPEDTGTSGDPQDPLAGGARAW

SEQ ID NO: 942078 - protein, 223 aa, Homo sapiens
MHAPPPVKPFLITVHQPTQWGSRLPRQFHNGFSGFGHLYVATHAPFFTPAVLHQPIFIVISFCSFKSVANHQHTMTHVFTATVWLKINAFFIEQEGLTINSNRNGPHSNCLHQGLLLLRDVHKAGVISNRILGIVLTGFFCLWIGFLVQASIILNILESIIHEATIAAFIAFRPRAVYQILLTQSDKPPSFPEHLSFKSTSCTKSPIRTTLTLILHRSDVAFL

SEQ ID NO: 942079 - protein, 208 aa, Homo sapiens
GGASLGGGRAGCARDGTFSLGPPGWGEPLGTRLLITAAALWVPHFVFFFFFFIFRPEPLDLGSQLLHLVAGFLAGPRLLLLQPPIFLLRPVDSRLLQAPGLGFGTRLLAWLAGPGRALGWWEGGSVRSSGGRSLGWEPQPVAARAPGRNRRGPPGRQPPPTWETVGVGEESPMGGNNPKGGGHPSGGSPWSISIWGTWGWVVGRGGPR

SEQ ID NO: 942080 - protein, 44 aa, Homo sapiens
LPSLTKGGDTEGTGDSGLRAPPGGLNNLGTPGGFLSPPPHTTRP

SEQ ID NO: 942081 - protein, 170 aa, Homo sapiens
MISTSRKVRAMVAQEAFSVRGVGPRAARGGAAAKVPGKPDLNRQSPLGCFARWDLSFFSGGIVSRPRKQGSRWGITLPTRDSRHGLLAFKLPGEAEGNLRAERVGWGPRAARSLRLLAPLEEGCLGPGDVTSVPGGRQLRREKARARACTHPLRHTFRLPGVGWEEQALK

SEQ ID NO: 942082 - protein, 84 aa, Homo sapiens
MVRGQTLAGRQQAQQQPGTQQGDACPQPAIGRTEIAQKALAAADAHGSHTNIDAFWDGAGRGTGLAQAVAKCDEIPNAGTSRHS

SEQ ID NO: 942083 - protein, 124 aa, Homo sapiens
MAQNRPDLSRFLDRLLSRSRRQPPTLAAPGPGSLDRERRSRDRDLDLCFLRGGPYSSRSSLEMGFKCMKLQKPPRGHSPISYCREQASLKSVTGESSAVDRLSIKQRVIQVNHSLFGIFLTGKI

SEQ ID NO: 942084 - protein, 301 aa, Homo sapiens
MRIYRALSRGRQSIKYFTPSMTSGTSPTSELPRRSKLEISKKPPVAAVSTPPVPRFWSLRFSRLYGKRLSLPSRGSLPCTPARRPVPRLDGQVKTYPKHSCHMISQPRPWISLSTSVKPRQNLSNTLFMSPPFSMEITLCMTLLIHPDQEALLIVVPNSTSIWPVSSHSCCSQQRGHRLIKQKVVINKLLLFSLCHLTEPIVTSSQVTLQATQCIHHNTFHLSSLCSSSSRRQTESSDASASADSRGQYIPLSKVARTDFTGIQIRGVLQCPGVISIVSLLDHRVKQVSKYLIGLSAQPPC

SEQ ID NO: 942085 - protein, 127 aa, Homo sapiens
MGDPGPSLGGTGLWEGGSPGGRTRPAGALGLEEDSPSGRGGEGLHQAVELVAVVISYGCLSRKRENMGKAARGLSVGTMWPAPLNVRKARGENSSTKPAISPPPSPYFTNQGRRRTPISWLRESTNH

SEQ ID NO: 942086 - protein, 184 aa, Homo sapiens
MGGNVEGLCGGSTIFSTAFILARGGKFTSARVRNSAGAAPALARGPRQALSARGLQGTPIGEGKRPGSGKGAAVDGIEVEVMPLLRSDPQTGRSLLGQLGAQCDAGSDSCHGNLLWGILDGTGMARGHHVGLEQGPPRYDMMVTQGLVHSSQDLLCNILTTFEAVVSIRQYFRVHNRHKAILLA

SEQ ID NO: 942087 - protein, 247 aa, Homo sapiens
RWHRKEVGGGKDTEDQVSSRVQFAFSNSESTSFSVSIWHSQTRSPQSSYSSQQGHWPSRGRSCPGSSSQETPLPGRHGPLAGQPGWGQHKRPLFILDGLGAQAQQQAPGSPWPGSGSALTKRAHLRGACAAGAWGGGGPKPARSAAAGTEDVLAEVWAHPAHLQRGEHRAVRAHVPTPRLKRRLFLSQRGPRALGAEECGYRKATETEGGHGGREAVHEEHQLPGPSPAGPPGPAFFAAPLCCWTRR

SEQ ID NO: 942088 - protein, 158 aa, Homo sapiens
WPPAKRIARQVKNVPSSALVILFACEVAAGIWGFVNKDQLAKDVEQFYEQALQQAVVDAAANNAKAVVLTFHVTLVCCGSSTLTALTTSVLKNNLCPSGSNIISNLFKEACHQKIDDLFSGKLYLIGIAAIVVAVIMIFGMISEHGAVLWHPEQRRVY

SEQ ID NO: 942089 - protein, 185 aa, Homo sapiens
GAATTGQSDVRKEESVKSGGQCAVNKGGQSMMLGAEWPGGSTLTLSRDLDAQASVHAGIWEGEQHVPRPRGRISWACRAQNKAPARGRISWTCRAQNKVPAPGSHFQDMPHPEQGAGPGVAFPGHAAHRTSRWPRGRIFLDMPRTEQGTAPPWLHCPWPLSSGDLELAETMKPGFNLGCPGQPGV

SEQ ID NO: 942090 - protein, 66 aa, Homo sapiens
PAPSPQPDKRLQAPNLWSWIIEKDPKAHLTDYMKLQQLVCTSESALNPPEKNSTTQKTGGQLGLKL

SEQ ID NO: 942091 - protein, 227 aa, Homo sapiens
MSLFPPPASADRSPPALPRRPPHPLPCLLLRFPFSPVLGSDIRGRRGRQPKQPAASAAEAARRNLHRNSAPAPPPPPPKSGPIGGLSSRHRATEGEFFFGGGLGGGFLLAVAALAQGGPPVPGGGRRWSPNLLRPGGGGAAAGAAAAAAAPWPGPPRPGGENKLVYDDHGSSEEEDGDVEETQESEEKEEHEMEEDEADSDYLEELEDDDDASYCTESSFRSHSTYS

SEQ ID NO: 942092 - protein, 95 aa, Homo sapiens
MLVQLREAEEILQVSFHAEGVGQENLVVVVAEPMRMERLARDSTAVDAIQVDEDVGHPLQYQLLLHDGLAKAERQCLHGPAEAVGVLLKLVGTVR

SEQ ID NO: 942093 - protein, 246 aa, Homo sapiens
MYPPPRHAVADDDRYYRQLYESDISGGLIKGVGNFDSTFLTSEHLYADFDRHEIQIYEGVANVPPFQRDTLVLIGAQGVGRRSLKRFIVLNPTRFGTTVPFTSRKPREDEKDGQAYEFVSRSEMEADIAAGQSLEHGEYDGNLYGPQIDSLLEVVQTGRTCILDVNPQALKVLRTSEFMPYVVFIAAPELETLRAMHKAVVDAGITTKLLTDSHLKKTVDESARIQRAYNHYFDLIIINDNLEKAF

SEQ ID NO: 942094 - protein, 188 aa, Homo sapiens
DTKEQGKYKKAQGPDRKTRERRSGAWVPMAQRPAPRTPPILAQAVGCVFLLEPEQPGSALRSPWSALCLGPAPAPPGPVSPEGRWRQLGRAYRAASPALAPRGSTVSANAWVSDPPKTALEVGRTRRNRASQRSPGGAAVRAGPLARVGRLSGTRFVTAALSTRLASAPFSHPGSSLRSSRSKATKAS

SEQ ID NO: 942095 - protein, 227 aa, Homo sapiens
DLDEPQHQQPEQVCEPACRHGPPEVGQCVEIPDVELVEEGAAEADANEVGGEEGRNALVGCGELGWGFLLEGSLSSDKFISPVLCQLLEGKQQGRGGVGSQQGPAAGSMRGERLWEEEPVHCPVEQKLAAKVKGAGQVAAGVLQLEGQPQHHLKASDSQFEEGPRKPNCVRRRNSNPGAKSSTFIFTETARLKKQQPQPQRWASRRLILRKSSTMATGSLKSRSTKM

SEQ ID NO: 942096 - protein, 82 aa, Homo sapiens
MAHVSPRRVGWPLVPGLLLALQAIESLNLLPLLLGPGDGRLEEPAVEVHSQRRVVIAGYRVGDEAGVAVGVHDAHCGDVHLG

SEQ ID NO: 942097 - protein, 184 aa, Homo sapiens
IRIQVQTGQPASTASTANTGLDKEGVSENVLIGSFRVTSRVRQRNVRRGPLSRRGHNTHPGITVSKTDICLTIKDRAAAPRVSQHASDTINISTLVTLIPRKGTPGDPPGHAAGPVDRPQRQAPPPPGSHPHTQAKHTDQTLVQNLKEEKTLKSDTQSSRRLPAKASRKATGAMPEAATRPPLP

SEQ ID NO: 942098 - protein, 310 aa, Homo sapiens
PPPQSPTATGLGPAASCLAKPPFRGPQQPPSLPQGPGAMSELEQMKKEAEQLRKKKRDARKKCRESTLNQKKAGLEPVGKIQKKKRKTLRGHLAKKYAKHWGNKSRLLVNASQDGKLIIWEKKKKKKVQAIPLRSSWVINCAYSPSGNFVACGGLDNICSIYSLNIRKATSGSAGSCLATVGTCSVDRFLDDNQIINSSGDTTCALWDIETGQQTVGFAGHSGDVMSLSLAPDGRTFVSGACDASIKLWDVRDSMCRQTFIGHESDINAVAFFPTATPSPPALTTPRAGLFDLRADQELLMYSHDNIICG

SEQ ID NO: 942099 - protein, 158 aa, Homo sapiens
MAGASLRINSGVGCFTLMGAGFGVIQFTRGIFHVFFSGKLAHPHSILLHISITAFPSFSACDPSGPASCLTEEVLKQELGNQIFLWGPIPPTTEPPTPTSISPGELHTKPTLAIIITISSINSILCISGVLEAHEGEGHEAVRVLELDLADVAVLVEQ

SEQ ID NO: 942100 - protein, 326 aa, Homo sapiens
NISTPAFRGCMKKLKKTSGVVRMNEKEGVRKKCSEDWKLVRAASLSRGGQLSFTDLGLPPTDHLQASFGFQSFELSGKLKEDEKWTRNLQVTLEDGYIELSTSEKAQFLNLHRRKWMVYGIKYLYKSENSGLRLLIDDQLLKKSKKPKDISSSRQSLLSGRENFEGCISNVFVQRLSLSPEVLDLTSNSLKRDVSLGGCSLNKHTFSNVAKGSTRFNKTKTFRINQLLQDTPVASPRSVKVWQDACSPLPKTQANHGALQFGDIPTSHLLFKLPQELLKPRSQFAVDMQTTSSRGLVVHTGTKELLYGSLSVKRTSGLALGTDGKN

SEQ ID NO: 942101 - protein, 112 aa, Homo sapiens
MAGGVLTQLTSLETYFVCQFIFQDFPTHNKLPLFNPTTGARTERPQARHPRQELEERAHCFVLKRDFRQQRYSSMATEGKIERRGGGKGGSNGCASWDSATASNPFCPISTK

SEQ ID NO: 942102 - protein, 173 aa, Homo sapiens
MSVGFIGAGLLAYALALGLYGRRILSAHKIIASSPGMELATVVRAQEDGCEPDTLLLGEVKNSDVMFLAVKLHIITFILDEIGAVVKASHIVVSCEAGVNFSSVEKKLMAFQPAPKVISCMTNTPDGSAGRRCCVRHGHPCPGGGWAAPGAAPEPRGLLHCGGRGPPRCRPGA

SEQ ID NO: 942103 - protein, 188 aa, Homo sapiens
DSHWSYQKHHGALGRAPGVEPRGGTSEPPLPVGLEVNFGALVLLLVLTLLCSLVPISVLRRPGANHEGSASRQKALSLVSCFVGGVFLATFLLDLLPDYLAAIDEALAAFHVTLQFPLQEFILAMGFFLVLVMEQITLAYKEHSGPSPLEETRALLGTVNGGPQHWHDGPGVPQASGAPATPSGLGVP

SEQ ID NO: 942104 - protein, 40 aa, Homo sapiens
MAKAKKVGARRKRLRGEGGSPKRNGEGKIKYVRGESKKEE

SEQ ID NO: 942105 - protein, 221 aa, Homo sapiens
MHAAPWAPRAPQGRRPSALALGKATGSLLQRRAAARVATARPAFWSPLSSGCGLLVEMAQGRVAGVRQGCHSEGQGFRAHQGTTPRSAQPGAPPGRMGSLVERETGSKKWGPPAAAFSAAGLLLGWCGRQPPRGGAPGGSPRPGRGLTGAWFTAILPMKNGRVKVASGAFRETCEVVVGVDEAAARQAGLGQGRHQDLLVHFARRQAVDARTLHLRNGPYV

SEQ ID NO: 942106 - protein, 204 aa, Homo sapiens
PGSPMRPLPTGRRKNRGSSLRLFALCLAATRCLQTQGVSLKIPQANNKATVKKKILLSVEYSCQGVPTNEGKKSANWGKQKNVEWKTRTQANISQNQKEKICSFEKGSSQLFIVGVRDSGYYVINVTERLGSSHFGIIVLHVSEILYEELHFVAVILAFLAAVAAVLISLMWVCKKCAYKFQRKKRHKLKESTTEEIELEDVEC

SEQ ID NO: 942107 - protein, 108 aa, Homo sapiens
MSLRAVSSGLSTGVCRVKRVSNWLTSSSDCRQGLKRGSPRLARRSSQFMCRKKGCLCTSAASPGPPPIRWLGFRFKNFLRRSRASGVKKGGSASLPLMILSMVFFRFS

SEQ ID NO: 942108 - protein, 182 aa, Homo sapiens
MYKGFCFSCSWSRGCTLSSLSVFRWFCCVSCLNFWEVAFKSSSFIVTSSSWLRVFGFVFWSAVSLGFVLSGSFSSYGFSFSFVALWSSRDFSRWSSSAGRSHCLATSLLFSFRRVSNCSFKCVEYRLFFIYKGRTLSPKPPAGGKGRKGSQVPLVEVLQLGSALPLALLSQSLLYTGGDRVR

SEQ ID NO: 942109 - protein, 111 aa, Homo sapiens
MIGPLVRSSSSLSCPWLCCLLLKWSRTTIPCTAVLVRSCPFGVFSGWTRLFGFGFCFSCWSQRACPPWNQRAFPPCQGPRRTPGGLRSSQWKFPCAGALSQHSASPRSQAL

SEQ ID NO: 942110 - protein, 149 aa, Homo sapiens
METRKELGNEIMRAAPPALDALPTPHAAEKYFTGCTEEARGVGGPGGPGLRGTSRANATGLSKRGRRKNKKRKRIDNITILISVSRSPDAFGNWPFRFLLRAKGFLLKPPLRSGKVTARRSIVFYGGAFPGQKGAAPALGLHGRAQNER

SEQ ID NO: 942111 - protein, 149 aa, Homo sapiens
MRKKRYAIHGVTEYSINQMTCATVRETTMTPFTSKLSHACLCELYISFYQYKKKALVSDTEKAVWPLGGPGWLGALNVSGLFSLLHSLPSAPPPDTQGRGQGPGVCPQERGDGIGWCRHRTATLCGGLSPPYTLLFYNEPLEQFLKKIK

SEQ ID NO: 942112 - protein, 277 aa, Homo sapiens
PSAPGCLLFPGEIMKRGRLPSSSQDSDDNGSLSTTWSQNSRSQHRRGSSSRHEDRKPSEVFRTDLITAMKLHDSYQLNPDEFYVLADPWGQEWKGVVPVTPGTIPQPAVVSDKSLMLIRPKKYIVSSGSEPPSGYDIRTLADSLCRYDLNHDALELTNEEFKEMGMPELDEYTMERVLEEFEQRCYDNMNHAIETEEGLGIEYDEDVVCYVCQSPDGEDGNEMGVLCQMHICVPKAVMESQGTEGSGCADMCLGVSKMYPCQKREEDEATVANQWVT

SEQ ID NO: 942113 - protein, 288 aa, Homo sapiens
YKTAPWNQVAKEAAAPGGRLGLGGKLRLPDKGRGSGCWEGGGGGGGEAGSYGSSAIPATEVLTAAKGLYCTRRSPSVLCSPQSKRTWQRWSAQPLVLRWNGGCLRCDISWVRGNDWGLPLTRGWGRGLPAQTGLAVVCFGGGVNITGDGSCQPLEGGLAPGPRALLALRALEGLNLLPLLLGPGDGRLGEPAVEVHSQRRVVIAGYRVGDEAGVAVGVHDAHCGDVHLGCVSHGHVWLKDVVERVQEDDEVRQADRGAKEEARVGQHAAPEVASLGVLAKITGHVLNQ

SEQ ID NO: 942114 - protein, 244 aa, Homo sapiens
GCCGRPEGPQALALPSVALRQRLTLLSGKGGCELPRRTPGQPWPQPLPVPSVEPEPLLPSEAGLLRIILLPLKELSPGHEEDEELKKKLKHVSSSPAAKPEERGFHKFYSQKITTIFPPPSAHFASDAGGSNFFLPWELLLASLTVLKPLSSPPQENSFDLNNYKLAFQSQDKFTYTFIVPQQRVTGAICLNSKEPDVLLENRVHKLEPELLNNELLKQKLQIETLQQLVEVDGGIVSEVKLLR

SEQ ID NO: 942115 - protein, 149 aa, Homo sapiens
MIMLYKALANPTAYSALGPSPRVWEVLPMGWLGIGGEGGGSLGAGGAVLRLQASEHSQVPHPPARCFSAEDARIARGVTGKRDIKSDGGCGLPSCQPQRAPRQVLALEAAGVSGSSERSLGSGTSPHTCFNHWSASLSSLQVAPDDQRH

SEQ ID NO: 942116 - protein, 153 aa, Homo sapiens
MHDKGPKGGEEGEGTQGGGHQGSRRAGIKNREPRGGKEEAHPRQRRGTPPRILDPADGRRVHEFGRVPAGEQRGGPRLAAKMSPAMRSSGSQGPGTATKLGNDATFFVSGDVVIVNRSIENRALRPPWLRQTIANLLVGPLQPLFWGPGLGLE

SEQ ID NO: 942117 - protein, 316 aa, Homo sapiens
PGERYFVAAVRGELPVPPPPLSVRGGVEEEWEMLEKMWEMEKEMGWTQKKKGSEYDVGLVKVRWGSMGGRCWKGGNGGDGKEREFDVMKWGDGGGGEIGFGGVGKWRLGSQRTFKGSEEEGYECSSVKCMDGVIEYKGANMELLDLPGIIEGAPKKKPFPPDDLCATHFSGHHHNPEYHQDKIAYSLLEKYLYSVVILLNNHKPKIYFNLNKGGGISFKSTFTLTHFSEKLLQLILHKYNIFNAEVLFPEDCCPDEFINVIVGKRVYMLLLYVYNKIKQISMAEVDAWGEKKTVWSSAGDEAELELSAGKLWEYLP

SEQ ID NO: 942118 - protein, 123 aa, Homo sapiens
ALLPGLPSTPAFQQGLTSRQSVQSYKCFRASIEFPQAHPLRRYSGATWANPLLFLILGILLSIAMFVDLGTESRVSTCQGEWDGKELWLGGGAKKGGDEVPSIGAGHCGMTPPQQDLAAGHRG

SEQ ID NO: 942119 - protein, 201 aa, Homo sapiens
IKHHSLRISKALWCLDLCTSALAGREKSKELGPALAHGSFSLGRQLHWKKATDQVQTLKTTNASLQKPEKIKTHWKKEEVQEEDPAQPPGWAVGKAMTQFAESCNDEHWLCAQTPKAAMDWAALSWALGKEEDLLPSSPVYALEKQGLTSPFRACIKRRLRRERLASEHSRQPISHSVFLSWGPHPGPAGPWVLRGAETLE

SEQ ID NO: 942120 - protein, 210 aa, Homo sapiens
MLQFPHISQCEELRLSLEREYNSLCELQPIGRLLFREFCATKPELSRCVAFLDGVAEYEVTPDEKRKACGRQLKQNFVSKTGTELITKVPRKLVTNCTQRLEQGPCKKIFKEIKRNHEYLSVAPFADYLDSIYFNRFLQWNWLEKQPVTKNTFRQYRVLGKGGFGEVCACQVRATGNMYACKKLEKKADQEAARGGHGAEREADPGESEQ

SEQ ID NO: 942121 - protein, 212 aa, Homo sapiens
ASLPLSPQAHPPRRHGARRRPAGQYFQARLAGAGNSTARILSTNHTGPEDAFNFNNWVTLLSQLPLAVLFTLLNSFPCYQLRPGDGCAFLGQPCLAITCLLLLPLTAALGSRLDIEPRTLSFFHSPLASVLAFINFLSVAVPYRAAFFGQLGTMPSTYSTLFLSGQGLVGIFAALAMLLSMASGVDAETSAQGYFITPCVGILMSIVCDLSL

SEQ ID NO: 942122 - protein, 195 aa, Homo sapiens
RPCRETPSPYSSPPSFTSRSTSSRLIFFFLCKAWPAIISYRRQPSAHQSGLNVYRSFFTTSGGHVTHGAHTPFLALGHHSSQVDDVAVVIHQNLGLQVPVHLPVQVRRRAQQIWGAKTATFGETSLAHVVDVELEGAPVHQCQHQAQRVLGLIGVGKAHYKPTVHFLQDLLLVQRHGLPFRFLIRFFSSLLEAYI

SEQ ID NO: 942123 - protein, 133 aa, Homo sapiens
MSPICEGEIKRRDFNSKTTKAWERGKPCIKKIESGVNLWDTKERAASVTPQTVEKRLRNCTVCTTNGFRKATVLFRRIAGTLVRSMPEPMRGSPSSSIFSAGGGPRVHPQTPPRWGPPKPVITFQLSPQVPAS

SEQ ID NO: 942124 - protein, 88 aa, Homo sapiens
MAIRNKMISEGLDPDLLERPDAPVPDGESEKTVEESDSESAFVIKLNFDKNDICMHRGTFTFCKRLSLNSLSHKNIKWPHVHYQASAM

SEQ ID NO: 942125 - protein, 215 aa, Homo sapiens
PVDTGVAARTPAVEGMTEAEEEELRAELIKVEEEIVTLQQVLADKERHCGELKRRLGLSTLGELKQNLSRRWHDVQACSAKRRLRKLFDRKERRLQLAYPQMGSTISRKIGDMRNSETFKWFDDRFGTIKSKVVGDRENGNANLSSSAGSGEKPLSDPAPFYSPGLLHPLQSTRNPASASQPQLCSADSQPGRMNRAGPEDSPAHPRGDVAAAFA

SEQ ID NO: 942126 - protein, 114 aa, Homo sapiens
MLQKRGGAAEALAAHGAPVGPLARVGALVLDESGGAIEGLAAVGAAVGAAWQVGAGVDGQHRALAKALAALRALEGLLPGVAAGMGDKGRPLGEALAADATAEGPLTGVHPLMA

SEQ ID NO: 942127 - protein, 165 aa, Homo sapiens
KCRRDARGGPDERDSPCPDFDAGAAGRARAVGVATGAWGAALEGSPDGLAFGAGAGGDSGTEEEGAEAEEASGEADGDTEAEAGGRADGRERHPGLRGAPRRRARDRPARAAARAHGAEGNGADAEEEGKTPRGQAGQGGTVSGGEDRRQNGADANQRDSRGRAP

SEQ ID NO: 942128 - protein, 235 aa, Homo sapiens
LPHRPPSSRTLHQAASQPTQHVHQPLRSFWLSSTPSSTSISPRAFIFFCATELGSFIRWLRSVTSADLNSGNLTPAVSGTAGFSASFFWGSFFFGALRSVRRCSAVVSAAVVTFCRSSLRFSRSFFRASILLIPCGRYSSSATCSGVLVVETLKLFLPPSFVPSIKYWYLKVCSLHSPHVGKLSTDFGSSEYFRSSKERFLNCWGAYRVWITTKRRSKRRLKSRGCQFLLSQTSP

SEQ ID NO: 942129 - protein, 211 aa, Homo sapiens
MFQTCKARKESKWVNCMGGLKKYFMEEAQQVRITAMVISEAHFGGGMEAEQVSQKVKSIKDKSMAKQRVKQTGIIHKKIKKNKHGAVGGRSAWKARKHTYGEGMKARKKSDLKQGKAGRVCRVEEEESEQNLQHPSTWADIKQQYIQLIYIILELEKEKKSCFQGGGRQTKKGGHFQAEEHGGLTKGKENSKEWAGVFKEAPEHPFGQKLR

SEQ ID NO: 942130 - protein, 265 aa, Homo sapiens
GKNQVGAAGAQAAGKKEGGLGPGPTEPSDPSPRAAWQRDQPTGLSRTCAEGGKPGLPAGHRGGRGEGRHGEARQEEQKDPWAQGGGGAGAGLGLRRPQETEKRRKKKSDEAYSKPTRSATKNMRGGRLSGKGALGAGPGPRTRRRGRRRRRMRLGLSGTGTFVASHVALGRPRPARAEDPGQSPSRPAPATPAWMLGSLSEVLVGSLDGPPFLPWEEALGCAGGSQLTGQCSGQKWGTNNTGPEDTGTQVTRALKVACDMSYPGP

SEQ ID NO: 942131 - protein, 280 aa, Homo sapiens
GLRETVRAGAFGHRADKLTQWVIQCLVFYCRTLSPIAQCINLVKLSISFEYVIKKNIGSKYKPLYILLENLGRFNCAKLGRTKQVQNYSNPKFSKNLELKYRFKKIKKLHFEIYKIKKKKPKLKNNNFLWGTKFSLKEILSNKVLNLPLMLKLEKSSGRGNITVSTQELKDNRLINMEVEARNLHKKDFLGKSDPFLEFFRQGDGKWHLVYKSKVIKNNLKPNWKRAAALGHEVSGGNPAHLSWGQGPRRTWAEYIYAVVWSYQRHSSSCSPVLVVSSYP

SEQ ID NO: 942132 - protein, 276 aa, Homo sapiens
LGDGERRRGPLRCAKCFSYPTKRRIRRRPRDLTILSLPEDVLFHILTWLSVEDILAVRSVHSQLKDLVDNHASCGHVASFQELWPSPGNLKLFDRAAEKGNFEAAVKLGIAYLYNEGLCVSDEARPEVNGLMASRFFSLAERLNVGAAPFIWLFIRPPSSVSGSCCQAVVHEILKAECQLQRTHKASILPCLGRVLSLFEDEEKQQQAHDLFEEAAHQGCVSSSYLLWEINRRTDVSDLGDASTASDNSGTTLPKAAGKRQLLPKPVPILTSLGWW

SEQ ID NO: 942133 - protein, 136 aa, Homo sapiens
MTKSSLHSNESQGNCCFCFIDVLSVGKAICPWQKPVEPLQHAVAQALEVCCGGRARNPLCRVHAYELIGPPRGAPAAFHVGDVFATWAIAEGEQYACQSHLTLVFWIHKDIFSCDISMNILILMVELQGIKQREAT

SEQ ID NO: 942134 - protein, 122 aa, Homo sapiens
KSIHNGSGSIRITLAGALRQSCFHATESFPIRFLSDYCFPMVMSPFNNINGKVLIFKFCIRKLISWFAIRDLPSKPVHSASERGVSACDSIKIIIIGCIRIIHINGNYFPVGFPFVNYSQYA

SEQ ID NO: 942135 - protein, 240 aa, Homo sapiens
YRCGGGFGGWGTQVLHWNLGSCIMYQVGRSVANLSANLRGSPSFQEKSWGGRAVGFHNAVLIIPSPSCHMAEAGWRWWRRGGPPPSLAPPGKGGLRRRTGPGILEFLGHFGWGSVPFFRGVLLFVGFPGIELLPEVSIHHILPVVGAAVVPPPVWGLFRPPCSPCWRPWASWGVGGTRMPIPPDKVVQTSDSEPPGISVVFCKDSTVSPDMVVHDHLCLLGGPIEQATVPQGFVSCRTLI

SEQ ID NO: 942136 - protein, 106 aa, Homo sapiens
SAAAMAAVDLEKQRVSGAGKAIGVLTSGGDAQGMSAAARAVTRKGIDEAGKRLPIYEGEEGRGEGGGRRKLANRRSGAQQHPAGRRYRYQRPPPGLFHQGGAPGSG

SEQ ID NO: 942137 - protein, 105 aa, Homo sapiens
GRAWANGRSGLGWARDGGGPGAGPGGAPREYLSWCQGGDTSCSPQHAGRHRPHRDIGPDAGGVMGHGAQAHSTTHLQWLALCGSVGGAQTGLSPTPQGATGPECI

SEQ ID NO: 942138 - protein, 238 aa, Homo sapiens
MSRRAALSSVGLSRAVGTGLPELVLEGVGVGVVEGVEAAAFHAEVRGPITVVSCLEGGRGLQVAAQGPVPTVTVVEAAVGYTGSWELEEAGSEWVEWVRAAESREFRLSRAMGSSCEDWETSRRIRLAAFLVSLSQAAARMFSAKAEVRRGGVGVVISMPFFFMRRQGLRDVRMRFRARPWNSGNCRLQDWMMAWIFSLGCLEKGTWRSRLSSTKRRTNMLKAFRRSGSMPSESSILS

SEQ ID NO: 942139 - protein, 260 aa, Homo sapiens
MLGGWGGLGGLYLRLAVLSLPLTVRVLFSFLTRFSFPSGAASGAAASALKARIPCLRPRRQTSNPPPTPPRRRAQKPPAIQPRLFHASAPDEGTQGTLKGTQKRRLHPTPVSKSGAALHEPGQDHLPQPGDRQGETTWNKGTEAGEKAACSQTAWARGRGMRGQNWHSGQDLGLYSMGRGEAPGAAWGHGGGGRRRHRLLCQRPQSSCSSASRRQRTRGWPLGPPPPPPPPPPWAPKFGAPDIMRNRTTGMMYIQYLAKK

SEQ ID NO: 942140 - protein, 248 aa, Homo sapiens
MLPRVGCPALPLPPPPLLLLLPLMLLLLGASGGGGGARAEVLFRCPRCTPERLAACGPPPVAPPAAVADNGRRDPHAMRGARPGAGLRLLLRVCARMEERRKMRRLHPAMTGELLPPGLHELPLAGARSWSEGTDEKAPGTPEYARQPESWFADKWAIDHSRKEGLGVGTLVGQQPWNMFGAGGEQFWAGKPLKVEVMKGAGQCSGEKVTDAAPADGARVASIILAWRSPRSCDHPLPGLPANRNWTR

SEQ ID NO: 942141 - protein, 328 aa, Homo sapiens
VGSKPRWRQQRWGNPAAPALADRAVAAPSRARGSGCRAGTALREGLGRKVEEGEACGTVGLLLEHSFDIDDSANSPEAGLTALEPAGWYLVPRHSGSSARLTLADSGDVAALNGLYRVRIPRRPGALALPGTSLAQLSSFPPSPPPPPPPPPSLTTLTPRTWMSPATLVGVSVVTHPGGCRGHEVEDVDLKLFNTSVQLQPPTTAPGPETAAFIERLEMEQAQKAKNPQEQKSFFAKYWMYIIPVVLFLMMSGAPDTGGQGGGGGGGGGGGSGQPLVLCLLLAEEQLDWGFCTAAGGSCARGPHGPIHPKGFPLPMEESRDLATMQSD

SEQ ID NO: 942142 - protein, 96 aa, Homo sapiens
MVPKENSRWQLNAGWLTLDGARQQPGRDPDPDPELRCGQCCGPVPDLRLPDGLLRPLRGRPSVHSPGQFDSWAPDSASSAPSKGRWPSRGFPPMSL

SEQ ID NO: 942143 - protein, 111 aa, Homo sapiens
MEKGFREHGQTFNRGAKKICKRKIKKKAAKKVVKGLDRVQDEYSRRSYSRFEEEDDDDDFPAPSDGYDRGEGTQDEEEGGASSDATEGHDEDDEIYEGEYQGIPRAQSGGK

SEQ ID NO: 942144 - protein, 120 aa, Homo sapiens
MPAMLRTLQDLNPRRDISSWLAQWFPKKPARSVVALKNPIKVELVAGKKYKWCVCGRSKKKDFCEGSHFFQRTGLSPLKFKAQETRMVALCTCKATQRPPYCDGTHRSERVQKAEVGSPL

SEQ ID NO: 942145 - protein, 244 aa, Homo sapiens
SWREPRSLGGVFEGGGGHVSGHPEPKFPTLSAVMSAEVKVTGQNQELFLLLAKWAKGAALATLIHQVLEAPGVYIFGELLDMPNVRYLAESYFASAFRLLTVFAYCTYADYLTEARDLPPLTEAQKNDLRHLSVVTLAAKVKCIPYAVLLEALALPYVRDWEILLFMLFILKCFVAPWTSATSGSDVQYSIGREIQRQDLSSISRALQEWCVGCEVVLSGIEEQVSSANQHKEQQLGLKQQIES

SEQ ID NO: 942146 - protein, 103 aa, Homo sapiens
QGLPVPPGIQSPLSPGVGQTAQTVAPALPPGRLPNISLAFHVTLPNPPGPSLPPAPYRPTGPPPPSLGTPPGADHPTVSRGPKLASPIPPPIPTTPPPPARGA

SEQ ID NO: 942147 - protein, 91 aa, Homo sapiens
MVEGDTGSIVMKQGPKEKVLRENQAAQGEELQTHPLGPQLLVDRLLSEETTDKHVAKDLQSSADEMSRWWVDECDWVRSVHDWHFGLRNRT

SEQ ID NO: 942148 - protein, 191 aa, Homo sapiens
MGFFFVGPDFFPPSYSLEWWFFPHSRATKAQVGACPSPVEPKPSHRTSCGWAQTWVPPPVGLPCRGGQGVFSALGLRVGGGGLEVWGSLSPKASRPSRKPRAPSPSQPAREGWHPPCRRRPRGAPLPQPPAWGPHPGPQALPAGLRPGSRSLRCRAVKATCLNQGSFFSYLLQDFLDGCFLNLVVITVWEA

SEQ ID NO: 942149 - protein, 313 aa, Homo sapiens
KEDPKPRTPPRKKNQKKARAKKKDKKTPTPQKPETKDAPPTPKKKRRQKKQKPKKNATKKKKNSPTTKKTKPHTTPAHKTQKTAPARARNHPKNPPPTRTPSKAEPRTKPPKPHQKHANPKNHHPPRQQRNEEHEPPSTNNPQPPNHNPHRPTTNNPTKKPEKKEENPRRRTGRSPQQKPRPQPPRKPKTENQRNTKTKPQGARAAPKEKKQNPTTPAHPPKAPSERENERKPPKTQKKRDRQRHRPNRRKATTKATRNKATTTTTAAKSPNAQPTTKTTTKAASNPNAPAKTNNAAPKTTQQQKNPQQHPPP

SEQ ID NO: 942150 - protein, 172 aa, Homo sapiens
CPGPSFSRPRAGASFFVGCVPCPPFSFWFSPRVCALLPGGAASRGLWRGPPPGSGFPGVGPGLGLLGPGLGGGWGGLLFGGFFLLVLDAGEGAGSRASWGFLGGGGGGAVVLGLGGGWGWGGGPGPWFLFWFRGLWPLLPCVVLGVGGFFLCPFLLVLLVVFLWPLAAGLLA

SEQ ID NO: 942151 - protein, 173 aa, Homo sapiens
PSFSVQLTAVSAFGFLKTCAMYSGATSNAHRSLGGGENVSVAASRVNILPPPCVSLFPLPQGDHTRRRGPYLGGVGGLEGRAIGSFSKLGAGSTCYGAFVWDEGSGSFGPFSIFSASGDFVAPSASAIGLFSPRELNIPILIAPPFPRFFTRVITRTLSLPYFWQYLKATFEV

SEQ ID NO: 942152 - protein, 242 aa, Homo sapiens
MRGCLVCKEELEGQKTPYRFSSIIRCSDFGKQNPASRSSQPQDELVRSCSLCCGQRDQGGLLAMATRGQEGELAYWKVLGFGRIIINTFLSELETHRFSAQIDSVLVAALVMAPTVTEPVEVGVGTAVIPTAFLLVVGTVFYVDILISVQGGELLAVVPCKGVTRIDMVNAAKKLIILALWFQAQTGVFCKDFAGGPVLHGHQEFVVALVRQPVNVLQAQPVFAVNVPKPLLLRLPVPEEVN

SEQ ID NO: 942153 - protein, 197 aa, Homo sapiens
PDQEGTSRSGATINCFLFRLEGCFALMRDLQRDKRLDDTAAGGPPSPGGSPRSPATPQGSIQFGEVNFGQEEVGGFQPQVQVGFSGPDLALPGAGVSRSPSPWIRGRCPERIFFCQTEPMNGRSSIRFGFSSKLYLSLKALPGDGHEPPQDIAVLHPPVEVAVESYVVGGTSLAFCIQFCMRLSQNQGDAKTSLALL

SEQ ID NO: 942154 - protein, 80 aa, Homo sapiens
APGYCLGGNPAVRVAHIRLFEYKDSFKGPHLCAERRDLALLGPLEEFYAKFKANPNITNFKKPKMISVDKNKKGLFELGS

SEQ ID NO: 942155 - protein, 142 aa, Homo sapiens
MTKGGKPENKKKKRTKGGLSERLPWGEKAGGASATLGEAQRPPSKNTEGPCPSPQPHPHCEGSERGLPQRPSAEAQTLRAAPGRGGLLQPAGGGKRRGGRAQRPGKAAAGSRAGAGDPGPAQPQEHGFQAGGHGGGARGRKR

SEQ ID NO: 942156 - protein, 160 aa, Homo sapiens
RVKHCKRPVPRRTARGSVQAVPLVLLVLRVALFLPGLGVVLHGFGKRFHALVGGLHSLSRQTELAQEGAQLPRGQGCPEQAQGLLELGRGQGILDLIRGLRQRLPRRQVGKQAPLDRVGEDGSYYLRRHSLARTCWPPAGPAGTSIVARMLWRAPSWMGW

SEQ ID NO: 942157 - protein, 201 aa, Homo sapiens
MRVCPPCDKSMGALIEGSALPKAQKLQTWRRPRECPGVPTIFPGGQFPRGAADKLEPIPAQPCPCPDLPGCSPTRWVLSPSILLKECPQSVRPPRVVPTALAHTALLTIIALFATPIIVALSLSYLFNHPTFCHEMWAFTGPEVGLTLTLSHRLCPALSLLCGGHTKAPGKVWWRLRKICYHIVEHSWFETIINFMILLSS

SEQ ID NO: 942158 - protein, 39 aa, Homo sapiens
MAEGWMVEEMTERKSYDDGGGEQGNMVEQGRVTKAVAHP

SEQ ID NO: 942159 - protein, 173 aa, Homo sapiens
MGPWCNYTTGTVAVMWSVQGVAWLRPAWNPAYARVASPWRCAPLGSSSPSSPQRHEEDTSGPVPCALLASLALETFGLLPGARDPGPQFAPPPPPHHPSGPLLPPVPPPPPAEPEPPPDKEPPPSDFAAFSLPPPVPPPTPPPPTPPPPPPSPTPHTTPPTQTCPAHPPPSPR

SEQ ID NO: 942160 - protein, 257 aa, Homo sapiens
PEKPQSSRAVNEVFLVVSGHPFCPPGVAWAAPRAGTVRWAQEGAKMPMNKSEKPKSCHNVKVVVGARPLNEKKKSMCYKKAVSVDEMRGTITVHKNDSSNEPPKTFTFDTVGTLLLALRGLITYCKTVIIDSVLEGYNGTIFAYGQTGTGKTFTMEGVRAIPELRGIIPNSFAHIFGHIAKTEGDTRFLVRVSYLEIYNEEVRDLLGKDQTQRLEVKERPDVGVYIKDLSAYVVNNADDMDRIMTLGHKNRSVGALI

SEQ ID NO: 942161 - protein, 167 aa, Homo sapiens
MSKGLKSIKHKDSRKHQQEGINEEKVKPEVERVAQPSVLESVAVLCKEVEHIPIDLAHRNHKLENEAEGMLGEKGDNHQEAEWSPQASRNGFHAHCKVVTQDVSAVSLGIFPREGLASKQVFVVEKNKLSITRGINPQTAKQHRDSCRQVPNGTTAARPENSNVVTT

SEQ ID NO: 942162 - protein, 105 aa, Homo sapiens
GGCFSGFYRFSPRHKPSGKATDCAWGPLWLRGHNTEPGIAVSKIYICVTIKDRAAAPRVSQQVNILNFYPLVTRFFGKGFLGGPPGQGAGAVERAPRQGRPPSGS

SEQ ID NO: 942163 - protein, 105 aa, Homo sapiens
MGPLQGDVQIQELGRQGWGPFSCFNSNSRWWWAQRSLIPQNMTANSSSKIRFVLFFPIQQGNELDTHGEIYNQQHHPSHCLFYQILHLKLSIFGISALGGVRILR

SEQ ID NO: 942164 - protein, 147 aa, Homo sapiens
MMGQCKGNGWEYGLTGIGVGMVVLGVMMGMWNVVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARG

SEQ ID NO: 942165 - protein, 144 aa, Homo sapiens
MVTVVDHVHGEGRVGQVAEKEGSYDENHHAAKLAYSFLGGSCLRLNCKSFEGPKQLSVGEADEGERDNAAEDEEGPRIGLAAGFGAHGVPVRATGTLQGLRGEPAPAKEGWDGEANSNGPGSQEHRQFMLGAEAEVAEGLQMKM

SEQ ID NO: 942166 - protein, 240 aa, Homo sapiens
GIGYFVFGRYVCALEGFLGTVEGLVKGWSLAFLAFERYIVICKPFGKFRFSSKHALKVVLANWTIGIGVSIPGFFGWSWFSPEGLECSCGPDWYIVGTKDSSEYYKWLLFTFCFIVPLSLICFSYNELLRALKAVAAQQQEEATIQKAEREVSRMVVVMVGSFCVCYVPYAAFAMYMVNNRNHGLDLRLVTIPSFFSKSACIYNPIIYCFMNKQFQACIMKMVCGKAMTDESDTCSPQKK

SEQ ID NO: 942167 - protein, 223 aa, Homo sapiens
HSCGSPSSSQPGINYSFATSADGKRSLPELWPGLHQVPTLKQQKEPEGILEPRYQGAFIRGDGQGSPQRGFNKASPPGCGGTKSIGASWVVQLPGMHLHCQNQKQEHEGNGKETKEETVGLAMAVELLCKAKHLHAAINEWSDGKEFHADHGEHQVTNVVSGKGEKAQERGQNAQQIRVFPLIGHGHLIMLQEPQVFHAHVINQQQPYYQMYVDQLLDFILEG

SEQ ID NO: 942168 - protein, 253 aa, Homo sapiens
VLFGLDCINKSLFKRFWGSCTVAWSFRIFSSSRDTASELGVPLASGAALLRPVSRPRLTLSSRLFGGTEPSLREMRRGPASRPPSQSSAVRAGSGPAVGGYRSSWNRSDFGGTVLALGSHLRSCSFLNLAFSQFFTFRPRLGFLPLRRWDFLEINLESYFWKGASEVISKYRFELFTLATEVDDVGVRVKKGSRTPLLVSSSCRDSGSSRCFVSHSATCRSLMRLKPVVRIFPSDTNTARTGRVPSWGRVLLS

SEQ ID NO: 942169 - protein, 109 aa, Homo sapiens
MGCDAWDSYTSFLASKKLFWCRICQTPMAKRMRVCRMDHHSTRWLVLSLGLPEALLSPPLVVLLFLDLLHLFHQLSHSELQLTQLVFSSHFCIVIGMFTYLDVQVNSQH

SEQ ID NO: 942170 - protein, 239 aa, Homo sapiens
MRSSGSGGGSGGSSWYLPPPLFGGSRGTEVLSGRPLVGQPKPRALMMGEEGGGNISGAPALNALQLLPPGPLHCLRTLRSRGAGESKDAAKLRTRGLGFTPKNSTGKESETFPQRRNSLRVRYTAASALGSRPDRAEDLGGAKKEDKKRPGQRAAAGTRRFSDLKVADIGGCPERQYPSSDCGGQEKTVPKCHLPSSIVVPLYRAQGLTKGGAALGAENGRLKVPPSEPSVLECLWTRP

SEQ ID NO: 942171 - protein, 96 aa, Homo sapiens
VPPQSLPGQQEQQAPIPGSLWPRVRESGTPGPPGPSSPRDPDAACELDPGAQLPPGWVPGRLKPAGSEAVCVMASGSSHLLLGYGGGWWVSGGGGR

SEQ ID NO: 942172 - protein, 268 aa, Homo sapiens
MGTRVGPASVLGPLTGPEAAVGAHQDPYTTLLARSPALYRKELLFWGIAYPQKDEADFGDKTGLSSASRERTEPSESAPWGQPGFLGVSPAATHSHGPPKGTPFLILAKGAQAFRICAFNAQRLTLAKVAREQVMDTLVRILARCDIMVLQEVVVSFGSVVFFSVFFFSWIDGSGPYSTLSSPQLGRKPTMETYVYFYRSHKKEVLSSYVYNDEDDVFAREPFVAQFSLPSNVLPSLVLVPLHTTPKDVEKELNALYDVFLEVSSTGR

SEQ ID NO: 942173 - protein, 148 aa, Homo sapiens
MLNIHCLNLFINKGTAEITRTGRKMEISFLDETALCITRLMCLKICMSSGLLRENRLSLAQSKEQAITIQKKEKKEERGPTTKPAKAKAPPDVPAVFTYTLLVRLGLFFPPPPSPQQNPQNYFDTARMSEIKNAKDSTKKKNHSIFFT

SEQ ID NO: 942174 - protein, 284 aa, Homo sapiens
PSEEDFQGITPGAQGPSSRGPEPEARPNPDASETGRSHPSTTTTTRPPRYSPAEEAQGGRDPAEGITPPKGPPPDPNIAQETQKEMTLLLDIYNSPPNDHRDNVHLMAAEPRLRPTVDDLLDLIPELEERDPRESKKIPDDDPLPPIRQAEEQIEHLHAQPPLPPTTEEEALLSEMDVTGQAFEDMQEQNGRLLQQLREKDDANFELMSERIKANQIHKLLREEKDELGEQVLGLKSQVDAQLLTVQKLEEKERALQGSLGGVEKELTLRTKPWELNKRKDVEA

SEQ ID NO: 942175 - protein, 282 aa, Homo sapiens
ARREHLQFCRLLRAGAASPSAGAAAPQGTPGGGRRGACSAGPGGQPAPEARVHFRVARFIMEAGVKLSKRSTPSAIACSIYEKYFCENNLDAYDPYLIAKSSIYLAGKMEKEELRTREKKNVSKKYFNPSGEPLEVDSRFWELREIIVHCELLMLKVLRFQVSFQQPKKYLLHYLVSLQNWLNRHSWQRTPVAVTAWALLRDSYQGALCLRFQAQHIAVAVLYLALQVYGVEVPAEVDAEKRGGRCLMTTLPSQELIILCLISFIFIPWTQRSPKVLARLPK

SEQ ID NO: 942176 - protein, 108 aa, Homo sapiens
MVVSEVADMFVPLLDGFLVNVKKSRAVITSYGDQIPEKIADTRETEKEKEPENQGGKEEQKAAESPGKLFLFHTYLPIAEAPGKLKNRDDRKLTNSDKEKTLFQPQTG

SEQ ID NO: 942177 - protein, 172 aa, Homo sapiens
MREEFLECSIMSVWFLVVIDGLQMVLDDSKLDGNEEVGGWKMGWLQVFEKMVHGNFMGQILVSVDLLDEGIKVVHGFSELLCLLGLVSDVLLQKVSRLLRELGAYVLKVFLVELAVKMAGHLVLIEGPVFAQRTHKLDPFHHAVSLPLFLLVLTLLACLPLALGLAIFILGG

SEQ ID NO: 942178 - protein, 145 aa, Homo sapiens
GSCAGGGPHPQGLPGLGGGGGQAVGRGLSQAPNLPGAQSLGTVAQQLSVERLCRENEPLQEEEGEKKEPGPRGEEGMGPGKKKKKRENGGGGGGGGGGRELGGEGRGLAPSLAQHHPAPSPEAATRGPAALARAPRLSVTMTVPF

SEQ ID NO: 942179 - protein, 210 aa, Homo sapiens
MAAGPKLHYPNGRGRMASVRGVLAAAGVEFDEEFLETKEQLYKQDGNHLLFQEVPMVEIDGMKLVQTRRIVDYIAEKHNLFGKNLKERTLIEMYVEGTLDLLEMLIMHPLLKPDDQKKEVVKMAQKAIIRYFAVFEKILRGQGQSFLVGNLLSLADVILLQTILALEEKIPILSAFPFLQEYFVKSVISVQLRDYLKMEERRRIEVMKFM

SEQ ID NO: 942180 - protein, 73 aa, Homo sapiens
LWIPGTGPAAKVKPGNEWHRSIRAASHREGPSPMKPQSSCPALPPGHAGRGRSPQASPSQPPAPRPLSRPCTW

SEQ ID NO: 942181 - protein, 112 aa, Homo sapiens
PPTLENGLLQTYPRLSRHPPCNAVVGRQDPWEGATGCGHLFQAPWTPCLTPALPIDPAVLRATKGRQLWSCHQPAVTLAKPLRPGWPSVPISNDTQETMGAGSKDKVGEGGT

SEQ ID NO: 942182 - protein, 301 aa, Homo sapiens
MPSEIITLHLGQFGNQIGFEFCKQLWAELCIIPEGIVEEFATEGTDRKDVFFYQAADEHYIPRAVLLDLEPRVIHFILNSPYAKLYNPENIFLSEHVVGAVNNWASGFSQGEKIHEVIFDIMEREAYVYDSLEGFVLFHSIAGGTGSGLGSYLLVLAEFLVILRSWCSYTQCFPTRSMISDVVVLALQFTPHLKRLTQNADCVVVLDNTALNRFATDLLHIQNPSFSQINQLVSTIMSANITTLRYPGYMDYDLIGLIASLIATPRLHFLMSGYTPLTTEQSVASVRNTTVLDVMRRCCSQ

SEQ ID NO: 942183 - protein, 277 aa, Homo sapiens
GGWSIKQGLDQPVMADEVSLVLWGLTAPGCPRRCYVWPCGLLVSHSMSCCTISLDVSISIKVFLEHVLLTELLQEGLPLNQSFHTGDKFSRGSDEILVLLAIMSPLTRWAVVAGRETSLDMVLYLDACWAPPYEVVQLGFPDPLPALVDLSGVHLSLDDFDGGDVAVVGLAVSACGPPSRSLAAAAASLTSRTVVFLTLATDWSVSERGVAGHEEVEPWGGNERGDEADEVIVHVARERRVVVLAGHDGKHQLVDLGEGWVLDVQAVCGNPVQGCVV

SEQ ID NO: 942184 - protein, 244 aa, Homo sapiens
RESGARPPPPSPCPHATSPSGIVERGFSHANPGARGEGEAPFCAPYPRGTDTATARGAVRPRGHEKGGRERGPRPLMIRGTGDRSGGEELSGTGGEDCGSECPLPSFRTKKEDLGSASGQEKGEGAAAARKRPGREAPPPARGGRTPGSQQRLIKKEQSREKESGRVGRDCFLPASSPSEGSAGGGVQAPALGEGGARAPAGLGRWSSSRRDAPARAARRGHKAGRRGNSPAAGKRRPGDGGHR

SEQ ID NO: 942185 - protein, 97 aa, Homo sapiens
RGPPNTTHEGFNVTLHTTLVVTTKLVLPTPGKPILPVQTGEQAQKEEQSSSKTTFSSLLVLTICIKLVHLLIRYRLHFLTRESCSIYRYSQWSSYKK

SEQ ID NO: 942186 - protein, 137 aa, Homo sapiens
EKKKRPNRGLLQPTWGRKMSKSGLHNASKNKKPANDIITKEKKKRNGRITSILRTKQASTLKGRNKNCRTKHGETVKAFGVSKAKPTMQVEAGKPPQPNLKLRTLRNGSRVKTTEAQQKNTITGPLLTSTSRSLRSQ

SEQ ID NO: 942187 - protein, 353 aa, Homo sapiens
RGARRTRAPPPRRPAPRAPRRATHATPPPLARARPLTLPSLTHPHAPTPTPTPSRARPHTRSHAPARSHTRTRACCRAPARARARARARAPSLHTHSHPHTRSLSPRTHPPHTRAPTPPLPLTLSHSPTHTTHPLAHTPSPSPAHTLTLTLPPTHTLPPPPSAHATHPPAPHTHPHSHTHPLSPTHTLTHATHAHTHPTPAPSLAHTTAPSRPLSLTLTLSHPLPSLHPLPLTRPPSTAPPLPRNPPRPPTPRPPPPPLHIHCETLHFNKATHFSISIHEPHKHSMHHCLCSQLQAKGRTIHWHYHKLCPMQMNSMAGKLHSSNTPRPCAQHALLRIYAKTPFKSKHAWQAIC

SEQ ID NO: 942188 - protein, 182 aa, Homo sapiens
LKPHNAGLQCFRSQELKLMDSRLPVKVKDIIAEGNPNKRETAPGSDPCEGQIKSLKTVDVAACSLVDTLKKKSFDSELAWRPEIMAAAAGDPGLSELQFAPFSSAIRDVGFWHELTPKKLNEYRLDEAPQDIEGYYYHGVLPPQPVAAQLLGPCIPPPPSSLSRLQMRGSFWDKLPMRYGNP

SEQ ID NO: 942189 - protein, 223 aa, Homo sapiens
RGMKQETRDRADEETPEIHHQPGLSEAAGGFTHEELQKEGKGQSYCMWMQDKPLLQEELGRDYFPTRIMLFQTTEAHTMFLQAFRQTMKREWKDIDKLSQEKFYMHKRMALNESLKELKMQGCEKIQIEELLKQQMTEILHPSSQDPNGVKSHFIEIFLEELTKVGAEELTADQNLKFIDPFCRIAARTKDSLVLNNITRGIFETIVEQAPLAIEDLLNELDT

SEQ ID NO: 942190 - protein, 217 aa, Homo sapiens
DPLMMGPSLQCRTIPSRPGTRDSRSHGPRVYRTARANLVPRRRKRRARPPSLPALGTGHITVCVSSSSPAPGHWPPLPGHWSGGQRCPPSLASPSLATAPELSSEEGPLQLMTGWTPASARASGPAPTPLIQLICCSMPGPGGSFSPFPLYCSNQRKKPLLAAASSAASLQAGACRPALGSHLQGKCLLPSPAASGSLCRDAFCTEKGCTGGWPFQT

SEQ ID NO: 942191 - protein, 175 aa, Homo sapiens
MDRRGGRKGGSEEGDEGRGGGGVGEGGPGEGLRGQGLRGGGRLMGGGWGERGGPGAKSLARGRGQGRGARPGSRPGVGGGGKGGARGPGRGSWGVGGGGGVSKRGVGRGGGGGAVSEVVWGGHYAIGKGVTCAACRSLHSITNAAHCMPAACGCGNLESGPLSINNLNVCPDVCA

SEQ ID NO: 942192 - protein, 168 aa, Homo sapiens
YVYSIQQVILQIKKKRSKKERKRRIKSQKKKPKGNSSKRKRKKNAKNKNGNNKGARGKERRKTKREEHNRRKKTTAPSNAGKRGANQKRGAKKAKKRGAHGQQNHRRENKRKKPAGKKSERNSARNTEGNQNRCVVSKAGNQAEAKQGKKQEKAPEQQEKAKGRKASS

SEQ ID NO: 942193 - protein, 136 aa, Homo sapiens
MEDSVGLRAVVHIAFSPPHLMTVRIGAIPSEISNLIHGGFIFNGICYFRHRRMEQLDLHFKWVRVTQQLIRFSGGQAFHGVFIGLLSILDVKDLGHFLNDLSTEMGGKSVSGWWWYKKLIFPLTQLARKALAAVPD

SEQ ID NO: 942194 - protein, 258 aa, Homo sapiens
MMMKIRKKNKKEGEGFKGQKKISWGYPQAAKENGKKGTSKVASAPHFVDANDDGNGEGELKKKWVEEMREKQQEREEEREKRRTIESQCEDVLRGQEEFEHKEEVLQELNMFAQLDDEATRKGYYKEFRNLVEYSDVILEVLDARDPLGCRCFQMEEAVLRAQGNKKLVLVLNKIDLVPKEVVEKWLDYLRNELPTVAFKASTQHQVKNLNRCSVPVDQASESLLKAKPAFGAENLMRVLGNFAAFGEVRTTFVWVLW

SEQ ID NO: 942195 - protein, 264 aa, Homo sapiens
TPPPVPEVTSVAERKNLGREGDLPQEGGETLEEQPGLQARAGRDQQRCKVPLRRTQPFPSQQSSLPCWGLGLGEGSVAEEAKICCGSTSFSLGFPVPWPRATSSASSFSQYDKETGLDPSAAEEGLDGCVARGGARGEQTSIEVLQQHLGGEEAVSDGCGYDTCWSSLQPAAAVEGWNIHKAGLHIGDDPSLELKGTLGSTGRLLYPMLLSTSPQGRSSMSPVGSARVASSTPSSLVTARRTPAGRRPSGEGSPCWGASEKAEA

SEQ ID NO: 942196 - protein, 135 aa, Homo sapiens
MTVGLVSRYVDFEECKDNPLFLPPTPGSQRPFKSISKVYPEPPGTIRPLASLSGPNLSSYPEDPQGTRKCVGAGSAPPVAQDLAQEEAEERVFKILHAAIDEPLDKPPAFFTHLTISTRARYCQKWVGWGALMPK

SEQ ID NO: 942197 - protein, 310 aa, Homo sapiens
PRSRAPFRPGRAQLECRDRRPATAHTPRPPAATVHGPRDTGPPLTRAASPPAPPPTPPPPRPPPPPPPNAVPRPPPPGAPSPPPGRPPGTPPSTPLAHPPAHQRLPGLRQGPPPPPAHLTPDLHNAVLSHLLRQRFQRTSAAGGRSGPFRRQARTASAVQHFARTTPNYTVPGRSAEKAERAKAQASWEPGPPSSLGLGAPAGHRPKPLPPGRLGSARAFTASKPPLGAEFDGLEEATPQRSPLDGLEPGEAAFFPPPAAPEDCALRPFRAPYHHRVVAGPGGCHGAPWRKRSGPPPRRALAGLSTAPGH

SEQ ID NO: 942198 - protein, 220 aa, Homo sapiens
IGLFVAVGSVSPSGQAALGFPPPPSSPLAEVTTFASYLAEYVNFSGLGAFGGFGVLLSLCAPALTLMLALSRRRRLSPLLSVTSFKRFSRGDSPTDSPEALIGIPLPPWLEKTDDSIETTTARLLYESRGRGMLENCLLLSLFAKQLLLHMTDLLLNLYDRLINEPSKDWDIYYWATEAKPAPEIFENEVMALLRDFAKNKNKEQTLRAPDLEYLFEKPR

SEQ ID NO: 942199 - protein, 167 aa, Homo sapiens
MALPSGRPRSHYAILASIFPSSVGRSPDQPAASGSKWVSQGQRSPPVIKLLPRRQSLLGFSPPVVFSQPLRIPGFKICPHLPRDSFLQFQSLPLLHGPSCLFQPFWRRLMWVPVLVALLAPAPPPSNPSNLPAASPPWPAAFSSALLPLAAAPSVPPPPEFAAVTVP

SEQ ID NO: 942200 - protein, 129 aa, Homo sapiens
PLVAAAARDRDPAPAPLSATPRDPNPPAPRGTCGSGSRRPALEFFPAPASACPHAGEAAKRLAQAMKRLRRLRKKIRDRLLQAIDPQSNIRKMVAVEVISLEKYPITKEALEEKKIGKTHKKKYEKKKK

SEQ ID NO: 942201 - protein, 308 aa, Homo sapiens
MRALLMALYELFSHPVERSYGAGLCSKEELFLLLEEELTYILLLLEAFRSYGFWLKRRAKEEEETVGFQEEVVVVALLGGEREGFLGWSKFPGFKWVQGDGLRVALVSTREEDRNQDGKTDMLNFKVEEFTEDVLGVELLSYGLHRMGTLVMERMGFVEWWFGVPGSQLLVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERINIFVFQNQVVTTFLLTVTPGEI

SEQ ID NO: 942202 - protein, 110 aa, Homo sapiens
MGTIEEIAHQIIEQQMGEIVTEQQTGEKIQIVKALDHNTQGKKFILTNHEGSTPSKVILGREDSTPGKVFLTTPDGGGVNQLFFTTPDLSAQHLQLKDNFSEEPNKDFDL

SEQ ID NO: 942203 - protein, 36 aa, Homo sapiens
MTLMNNFRDSYDFGVITEQEYENQNCKAKADGQKAW

SEQ ID NO: 942204 - protein, 243 aa, Homo sapiens
AEMQRRLSDTTCNYYFPDRSANGGAFQGISGCHILLLAFGVHGREQKFFLDVGGVREKHGDSINAHAPASGGGQLICQGSTDVFIYEQGLTITSSLGLGLSFKKPPPPHGIIQLSIRIAYLFLHDKQPKALSQTLFERRHSAKGLMCQWVATDECGIDASDFQGLPNKPVKDLAVVRGGGHSTAFATRDIIKNFASLFSFKEVRFWQLHPQGFLKLFYHVDSPEGWGEVNIVGLALWALWGGR

SEQ ID NO: 942205 - protein, 200 aa, Homo sapiens
MGELSEMGPTVAAAEAQEEAQHVVVMGLCGGKLLYRLKKKEFDQRDPHQRQQHREEPGAPGGTAGQHAAQEGDGGGQEKLRRTVALLYRAGQTVLVFVVDACGGVSGWRKRKVELHRISRASDNQGVPVLVLANKQDQPGALSAAEVEKRLAVRELAAATLTHVQGCSAVDGLGLQQGLERLYEMILKRKKAARGGKKRR

SEQ ID NO: 942206 - protein, 114 aa, Homo sapiens
RHLPILWSPPRGDRFPQLAAEDVASAAPTPPAPREPRELGQRPGLDGWDPSPPPKACPSAGRSLEASPGPWPSFAAQGPGRLFAVGSPRAGRSSRPPPGAAGQSSRPSDICLSR

SEQ ID NO: 942207 - protein, 134 aa, Homo sapiens
MFGPGLERIEYLFGVELMSSEELCPTAGLPQRQIDGIGSGVNFQLNNQHKFNILILYSTTRKERDRAREEHTSPVNKMFSRHNEGDDQQGSRYSVISQIQKVCEVVDGFIYVANAAAHKSSDTEAETLTGFLNG

SEQ ID NO: 942208 - protein, 260 aa, Homo sapiens
MSSNCTSTTAVAVAPLSASKTKTKKKHFVCQKVKPFRATEPILSVLMWGVNHTTKELKKVPVPVKPKPKDFKAKSKKKVEKQLYKKENLPSRFKFKEYCPMVFRNLRERFGNEEEEYQKEVKRSPQENENKGRCGTRFLTTYERRFVTKTVSSEDVAEMHNNLKKYHQFIVECHGNTLLPQFLGMYRLTVDGVETYMVVTRNVFSHRLTVHRKYDLKGSTVAKEASDKEKAKDLPTFKDNDFLNEGQKLHVGEESKKTSW

SEQ ID NO: 942209 - protein, 110 aa, Homo sapiens
MKLMQTKKEEKAEELHEESFPTPPSPKLIHHPETTKVRTLTKEENPNEEGPGGTTKEATPPNQYPTISSTGRQGLTCSQGYIIIKIYKMEDTRAQSPTIPGPQRHTPIFV

SEQ ID NO: 942210 - protein, 225 aa, Homo sapiens
RQTKGDSRPQAPRLGPPRLLLEPARACPARELTGELLDEDDLLEGGGGQLAVEVGLPELGKPDVVAGAAQGEGGEVEEEAWQGTRTSGAHWPSGPPAPALPASPRIIYGPGGGRQTRRRTSSDPGENKMWSIFVSFKMKRAVLGPRGIVCNLQLLLFMEEKHTDEDVSTAFNRWNANSGFEKEPPGSPEITAQRLEGEPNPGEHLKRRPGQTRREGTTQITQQDQ

SEQ ID NO: 942211 - protein, 109 aa, Homo sapiens
SKENHMQGKPNEKEKMISGQKLEIERLEKKNKTLEYEKEILEKTTTIYEEDKRNWQQELETQNQKHQRQFSDKRRLEARVQGKGTETTKKWETEVSVEWQPNSGGGGIN

SEQ ID NO: 942212 - protein, 292 aa, Homo sapiens
VGAGWEVFQPFKMLRVVSWNINGIRRPLQGVANQEPSNCAAVAVGRILDELDADIVCFQETKVTRDALTEPLATGEGKKAQGSLSRNRSGYAGGATFSKDNATPVAAEEGLSGLSATQNGDVGCDGNKEELTQEELRALDSEGRALLTQQKSSKGEGKEKTGIRSNGERPPGGPWEALSGEPGRGAPSGGGKSEQKPSGGSMIILGDLNTAHRPIDHWDAVNLECFEEDPGRKWMDSLLSNLGCQSASHVGPFIDSYRCFQPKQEGAFTCWSAVTGAAISTMAPGLTMCWGT

SEQ ID NO: 942213 - protein, 165 aa, Homo sapiens
PREPTQHALRPLVPSSRRRPAESPLRSRRCSGDMVLCVQGPRPLLAVERTGQRPLWAPSLELPKPVMQPLPAGAFLEEVAEGPPAQKEEMKPKDAGPKGEIQLCITKELLLASGNLAGIGVPLRANEARENLQKMPKRQRSYYSENTHPNYLFTLSVKKNRGPTQ

SEQ ID NO: 942214 - protein, 155 aa, Homo sapiens
MVCGSSAFFFSALGLLWGPSKKSLQLVVCVVLVYGVLALGLDVPVEISSSELEWKPVAVVGPEVLEGDLIQREPAWAHFVALQESSLGAVCFDEMKVNKRLENLKHDLAHLVQGVNCKNALLLPPPPSPILDGLFFLHFAPKAIPPAGPQASLFH

SEQ ID NO: 942215 - protein, 241 aa, Homo sapiens
GGPDTETHRLGTLIADADEQGGRGRQGSGRRGGPPASGPVLGGVEGADSPRRSQLEVGSHGWTASSLAALAGQKPGEARQSVFEARQSGSRWASWGVRGTRGCRVSSEAAECGPEEEAEVAEPCRQRLHSGSSARKFFLLGKGLSPKSFSCWRSFGNWPSQTLQLLSKVWVGVGDGPGGLDGFKQSRQPSPVTVITYAVTIVVLLRDACKAVHKAVLPIKAAELDEVDTFFEVLFDGYSGV

SEQ ID NO: 942216 - protein, 114 aa, Homo sapiens
TVIRFFPAASATKRVLPPVLPRLQSSHPGTAQRPPRVPRIPRSPGLPKEDEAGAPDRPGAAPDALPPATRPCLLSRSRADPVQSKSARRFASWDEMNVPGRHGLLQLGQGLREH

SEQ ID NO: 942217 - protein, 209 aa, Homo sapiens
RLDSHFRGLGVEVPGVGQAPGRVAFVSEPGAFSYADFVRGFLLPNLPCVFSSAFKQGWGSLAALGEARGEARIRTNAKELRKSGCNNCKKWGPRRKIENQKTKKSQKTNKIMEKTKKSGLIFSQGLSLNEKMEIVQGIFGGGGFQAACVFLVRMAESILGCNGCGEIMLCLSGACGQLVPFHAEIFRSFNWSINVCGKKKWLLFPPGQE

SEQ ID NO: 942218 - protein, 263 aa, Homo sapiens
SADPERKSQAAGAAMWAPPPPPAAGAWLPGVPSCGAAELSVNSIEKFHFKSWMSKPPKTYRYGGVPPLAADVCQPLEEDKAPINGNHTFKMALNQFSDMSFAEIKHKYLWSEPQNCSATPQELPSQYWSLPPSRGLAEKRKFCLTCCKIRVPAAACWTFSSPGALESAIAIAAGKMLSLAEQQLVDCAPDFNNHGCQGGLPSQAFEYILYNKGIMGEDTYPYQGKDGYCKFQPGKAIGFVKDVANITIYDEEAMVEAVALYNP

SEQ ID NO: 942219 - protein, 176 aa, Homo sapiens
RPGNLRCRAPRRKGKSRGQSGGPPGRGGTAGGGPAETGGQGAGRGGHTRRGAKGLQERAGPGGAHRPSQGGEQGEEGTGGPGRGGRGREEGGDRQRGPGQGAGGGQRERDRGRGAQEKGERGKQGGRETGKRAGGQGGGGGQRWGGRGGGGKGWPSGEGEKEEGGGGEGGAEQGKE

SEQ ID NO: 942220 - protein, 295 aa, Homo sapiens
KTPALNEYGDQDPKGQTSLEHLKQLPNHRGLTKKGEGHPGDRDKPEEGQTGGRDGGEGGQGGPARRLGGGGRPERRARGEEREERPGAGAGTGNRGGGREGGGRGGGGRGGGETAGEGRERRRGEKQEKKRAGSKEQKPGEGKPGQERRRGGHGPAGLGTPAPARPSRCRPPTPPAAKARKASPYPNTHFPTSLGPRYIHAHMHAYMFRAILVSKYDPSLEGNCIGTSNSGLACTLSCAALHIHTCIHEPPHKHLHTWGLLTMLTSLAGKEGTHGPALAGGPFARLRGVASPESY

SEQ ID NO: 942221 - protein, 205 aa, Homo sapiens
RGPVPRGGGPSAFGGGCGARLPFSGGGAASVCPGARWACVAARRWREGSLPVASFRSALSPRPPGVRPVSPGGLGRRLCLVFVVVVLFCVFAIRTGEGPCCLAVGPGALSPFSHQTQVMHLPKKKKEKDFAAKKLSSEEAEVLKIKNLQLRFNRHLPSPHSGLSKPQEHEVQKHSLWKALPTRTKLLALAKGTVPSSSLTSHLVS

SEQ ID NO: 942222 - protein, 186 aa, Homo sapiens
MSPLLWFQIKRKKMCLVNLKLHRVQMQLYCLLKEQRIFQHITFCCSWYGFTNKGTEDFVVESLDASFRSPQVLPAFISMKFHSLLPLKHCSATPGERQLVENPITPAEPMGGRPFGLVINLNYKDLNGNEFQDAVFNQTVTVIEREDGLDGETIFMYMFLAGLGLLVIVGLHQLLESRKRKIPIQK

SEQ ID NO: 942223 - protein, 219 aa, Homo sapiens
GRADSGTGGGRRARSARGWGSGAYMRFDVPGQGSSAATFRALLLLRYVVARVIWADILFIAVTFFFTLCLFPGLEYEIRHFFLGEWLLILIMAVFNLSDFVGKILAALLVDWRGTHLLACSSFRVVFFSIFFLCVFSSGLLALSYYAWFCFFFFAYGHLLRLFGCVFLFLAAGKVSSKLRELAGTMTVSYMSGLTLGSAVAYCTYSLTRDAQGSCLHAS

SEQ ID NO: 942224 - protein, 227 aa, Homo sapiens
AARARAAAASCWPKGPEGEGKLAAVYWNITNQHLRREGNKKEVNVNDYVDKESTEENSPGVGPGAGAGPGGGAEQYVLYMESSNGYSTCNASKGFKRWECNRPHAPQSPIKFSEKFQRKIAFSLGYEYHAGHEYYNISTPTQNLHWKCLKMKVFVCSASTSHSGEKPVPTLPQFTMGPNVKINVLEDFEGENPQVPKLEKSISGTSPKREHLPLAVGIAFFLPTYLG

SEQ ID NO: 942225 - protein, 230 aa, Homo sapiens
REGLKHSLVLQGAWIYLPKVKSKLRSVGVSLKDSQTGWAVSRKEGPGQEEALVAAQGIVGWGLGPLRGGARAEGRPCLRGPAPKDGEGRSDTDQPGPLGTGVTSGGSSGQRWRAWARPGLGRGGGAGAGAWGHAPRAPGLTWTPAYVGQVVVGGRGKVELLTRRVVVARAAEPQRPLKVQQLPHEVEVGRDVGLFPLDKLLASLSDRFIFCIREATVTVTERLSLPGSAP

SEQ ID NO: 942226 - protein, 195 aa, Homo sapiens
RRARIRREAGARRRGWGPRGRGAVPGQGCPAPCPVAARAPHEKPAPRPPQRGRTLSTSGVAAAGGTRAGNPGAGPGSGAGTGAGAATGAGAMPCKSAEWLQEELEARGGASLLLIDCRPHELFESHIRVSAIQPGHPGPHVAPPARCNLPIRSIIPNHALTKERFATRCKAATVLLYDEATAEWQPEPGAPASCA

SEQ ID NO: 942227 - protein, 230 aa, Homo sapiens
RRLVGLASLRAVSTSSMGTLPKRVKIVEVGPRDGLQNEKNIISTPVKIKQIDMLSEAELSVIETTIIVSPKSLPQMDDHTELFKDIHNSPGINNPFLTPNFTPFHSAITKKFYSMDFYQTTLEDTIAVGTPAIIKDMLSAVMQELPLAALAVHCHDTYGQALANTFMALQMGVILVDSSVAGLGGCPYAQGASGNLATEDLVYMLEGLGIHTGVNLQKLLEAGNFICQAL

SEQ ID NO: 942228 - protein, 299 aa, Homo sapiens
KFKYSESPLSQTRTRTDRASPYRGKGAGSGEGYTKQGRGEGTDNGGVPGGGGRLGPPSILGLSSDGGNRPPGIDRRLLRQEEKSDVSALPPRPPRAPAELAGIGGSSPRGQGEGVFGRRASPPRPTSPEGGRKAIFVLEGLGGRQARGPPGSPQIVSEENAKGPPARVPNRNRGLQAQLRPPAPLQVLCMSSWGAGLRSRDCWQWRHGSRARVMGTLTKKGAEGPPPLPSSPGSQIFVVGGGARELVVLVVVSAAWASVVRCRGSSVQGVRWAATLQLLHVPISLSFGCHLDDVLLPGV

SEQ ID NO: 942229 - protein, 330 aa, Homo sapiens
GGEQAAGRGDAAARGAPGLIAASRGARRAPGAHSPPAAACPGPRSAVEKPPEERGLRAPRPPEMVGHLHLQGMEDSLKEQGREGLLESPDSGLHPKASPSPRFYSLAPGIIEARAGGAGASSLPPGPNKAKPPSSQLPNPPASEMRPRMLPVFFGESIKDEEEHKMKEDENVKIKYDSEKHFQDKVFYAPVPTVTAYSETIVAAPNCTWRNYRSQLTLEPRPRALRFRSTTIIFPKHARSPFRTTLHCSLGRPSRWFTASVQLQLCQDPALSLLGPCHALTGLGPPGVLDEPGPGETLDDDTIIRLALGRSGKEAADKDRVEEALPLLPD

SEQ ID NO: 942230 - protein, 91 aa, Homo sapiens
MFGPVSCVACFCSSAELSPCGGAVGLLGKRMNLERYSFSRCTWACRDFVDLYRLSRIHRNADGPGHLLVNAGHPELLQAEAAAGAHLRVVP

SEQ ID NO: 942231 - protein, 204 aa, Homo sapiens
ELAGLERFDPSELLEQALLSGLLLSGQEPSGLEPFYCGGDLFCWNFSSSSSSSSSSSSSLQYQVLFWELLGLPFEASQLHSGNILSLIFFAFLTLKRSKSVTWAFPSLASISSAQRVAAQSRIDVTLPPGFSDILRVGTVRKRDDDISHPHALHKHGLSPHLTPRPIDQSPVLINNTYNREPFSGMRSKGEIGHPANLQKRLNT

SEQ ID NO: 942232 - protein, 204 aa, Homo sapiens
PTLRRGGKSGGQGGANAGQGQGRGEQRGERGGEGPQPAGGGGAHSGPKKEKKQDRDKAQGAGAGRGEAGKGPQSKGRDRGGGRQPRAGKGPGGRGEATGPAGGKKAQHITQRDQTRSAGPKAPQPGRGNRRANPQRERGESRPHHRPAHPPTPEDGREGGAEDRGEEGDGGAAQAPPGGRRGGGGRARGPHRARAPDKAGEKDL

SEQ ID NO: 942233 - protein, 225 aa, Homo sapiens
SQHLVPRRVVRRGARRELVVTMAMRELVEEECGGANPLMKKDGELTQDKELGVVREGGLGLGALEPWWEEGAAKWGGGGREEEGGGEGGQEQKGPWGGGGRENGKREEGWEEKEEREQRYSGYACLESTVVLQTLPGESECAPRQEGGSEYSRGECTACRRSETYVRPIRQRVKEQTPVGVARAAWRRKRVTKERRTVGEENRRKQPPSARCSKSSRRRSVSTRP

SEQ ID NO: 942234 - protein, 143 aa, Homo sapiens
PKRDQARREEQSKQQANEHRRRQGASQAKGGGPGSHTKREESGRSAREKNGTREDQQSHQKQEERINGDNKPNRDRREQQHQRSQEARSGDNKHTNETREHSRGGGEQRRTTSARTSNEGENQSRTRDAKGSSQEQKQEYRAS

SEQ ID NO: 942235 - protein, 176 aa, Homo sapiens
TGELWVLAQNKGLRTSSDARPPQAEGTGTGDMAGFRLQAQPRHPPLPLESPPEEHGCPHGENEVSRGFLPCPTYPLRIYTPPVFSSPPPGSSYTPFLQSQPRPRLSSPYHTPKTYLLNSGENKFYQFLQLLLQALFNSMVFDDPVKVPEVVQATFCLSIVHPWREHPAPLLALLQR

SEQ ID NO: 942236 - protein, 99 aa, Homo sapiens
MEQRRVTDFFARRLPGGPRIAPPCRLPSPAKARTPRPGLRYLWPGARPPRGPRTRQARPPARRRLRLSVDEVSSPSTPEAPDIPACPSPGQEDKEIHSG

SEQ ID NO: 942237 - protein, 314 aa, Homo sapiens
MRLKRATRAGPFLTSGGGGGGGGLCGDHEAPPLGLLAMYRYLGGGCCGPGGGELAWAGGVPGWAGLLGWARGQEEEGTELGEELGERRYYREGVEEGEEEAKKMGGGAGGASIVEDKLEEELRKRESEEEKGNREGGILGIIKACNHVLSLSFPIRGDDGSWEVIEGYRAQHSQHRSALEGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFMGLK

SEQ ID NO: 942238 - protein, 252 aa, Homo sapiens
SEQEEIQKQQKKYHSQCNGKNFSEAGIITLPSFSLVFHGPPPGPSNIIRKSQFLQGSGRQKDKQAFNPRAGGALPPPTPPAPPGGPPNDRERRAARCQRGEGPPGSPPPPPASETTLGFWSSSLPLGTGLLWPPLGTLLPPTPPRPPPPHPGLSELAAPRLLRCVGWGGGGPNPRAPLPAHQQRESSGQTPLPHLLCGRWDTFLRTSHVVVVESGVALERLLPAQVLVLVFDAEKRGTGNLSGIFEGISSSS

SEQ ID NO: 942239 - protein, 273 aa, Homo sapiens
TGRAMGAGGRGGGGRGGGGRGCPGGGEGPAARDEGRVAPGRARTMGRAGTGTGGEAVAAVVAGPLLLLLLARPPPASAGYSGKSEVGLVSEHFSQAPQRLSFYSWYGSAKLFRFRVPPDAVLLRWLLQVSRESGAACTDAEITVALPFRRPSGHQPGCGTSFPGTTAEATDPPFQVRGLPAAAPTAEEANAFLLKVFGGRAPGGLASLAAQLAPLQSKKNRIENGLVSHPVPALFQPGICWVTRGGGDFPSVGLDVAPSLKTLLSQSQTTSRV

SEQ ID NO: 942240 - protein, 62 aa, Homo sapiens
MPGMKGSLISAGTNTATLRPFSISGCCLEAARRHSSFLAGNVLYRANDFKFSLPGDAFMKEG

SEQ ID NO: 942241 - protein, 100 aa, Homo sapiens
RSLARSLALSAWAPRRAPGPRAAGTPGSHRPGRGRGGQPEEALHPLQPPGLAAAAAPREAALGGGDGDRKDSTRPGAPGVVSPFFVFSFKRWWYEDYVII

SEQ ID NO: 942242 - protein, 86 aa, Homo sapiens
MFTVAVTTRLLAQKLLCVPVRRHCFGQVGASGRCRRFLCFLRWLGLGGLFWLSPFGAGPLPFFGAPRQGLVGGCVASAVALSGGGL

SEQ ID NO: 942243 - protein, 156 aa, Homo sapiens
MVNTSNYNDETWMSDSLTIRRNWSGSGTTQERGTPNAWMATVRPSGDCGLVYERWSGAAGVHQWGPAAKRLGAWEEMKKAVLAWGRERKPQTSWGAGEDLSRSQCRRKVGMGPVDCVGNLCQGGSRGGCGCGPGDQRGTEQGKSRERGGRRFERRS

SEQ ID NO: 942244 - protein, 159 aa, Homo sapiens
PAGCPRLYPSSPYPLGFTHRQGWVFEPPAPCPSVKPLLQLGAPVPPTGGGEDCPRGDGGVSHVGAPGPAVLSSGMMQKQCLLGLRTLRSLCRQVMELLHLPSAEEIRTVIQYQTVRYDILPLSPVSRNGLAQVKRKILVLDLDETLIHSHHDGVLRPTV

SEQ ID NO: 942245 - protein, 99 aa, Homo sapiens
MNNRELQRRLLRALGSVEAEGVQRGAATVLLELLRRRVDLVLHVFRVRDTLAELTDERGPRGGLLVVVLDVHIDHVHGLAGLLCSGMQIFHQLVIHSLF

SEQ ID NO: 942246 - protein, 52 aa, Homo sapiens
MKALDFSRQFNLKITVPVVSVRIQKRLKRPPLKDPGIPTEERSPIPENANEN

SEQ ID NO: 942247 - protein, 92 aa, Homo sapiens
METESQQNSNSTNGNSSSGGSSRPQIAQMSLYERQAVQALQTLQRHPMQLSISTSFSTSIPSCIPGCRPGHNFCQSAGQLPKHQHYTAADYQ

SEQ ID NO: 942248 - protein, 320 aa, Homo sapiens
EPLSSGGRGGGSGGGMADANKAEVRGATGGDSSHLQRAEPPGEPRREPSPAEAEKQQQQHSSSCNGVKMENYELAKEEKFYFEEKFVGSEKANGFYFYFKDKNFGTGEKKGSNCKKVFISDISYYIKWKAIKDLMREKVVEVTYVELFKDAEGKSRGCGVVEFKDEEFVKKALETMNKYDLSGRPLNIKEDPDGENARRALQRTGGSFPGGHVPDMGSGLMNLPPSILNNPNIPPEVISNLQAGRLGSTIFVANLDFKVGWKKLKEVFSIAGTVKRADIKEDKDGKSRGMGTVTFEQAIEAVQAISMFNGQFLFDDYACE

SEQ ID NO: 942249 - protein, 180 aa, Homo sapiens
MLVEGGGSLLPGLGKIDPRVMHHPRPRKNVRPPPPKEEKAAETKQGEGEPHRPASKLVCWPPGLESFFKGAAARVQTCICGGCKWTLIARRKNEWDGNVKGKGFPASKRWKGKKPKPKNKTTPPTTTEEACPDPKQQLVTMEQLHLALPKGSLPVVAQAALPPGPWALLPITKYFLDHIQ

SEQ ID NO: 942250 - protein, 291 aa, Homo sapiens
AGAGSGGRSWELGRRNITEADSLVIVAPGRLSQRPFTPWFLDLPWEDVLLPRVLNLVPQPRRSCCCRYRAFLSLVLLLLAWLLLFNATLVGPPIPQAPLALLLLDAEGLLELALAPCHKWLSDKDLVPVLARNPQLRECGVGRLRATERRALGALAEGCPRLQRLSLAHCDWVDGLALRGLADRCPALEELDLTACRQLKDEAIVYLAQRRGAGLRSLSLAVNANVGDAAVQELARNCPELHHLGPHRLPPRRKRRCQDIGRVLPRAAFAAGCGTATMCGSPACSRLRKRG

SEQ ID NO: 942251 - protein, 292 aa, Homo sapiens
MARAAASPTEVIRAAKKDEYYRGGLLEAAGGALHSLAGARKWLEWRKEVELLSDVAYFGLTTLAGYQTLGEEYVSIIQVDPSRIHVHSSLRRGVLVTLHAVLPYLLEKDLIELEKEMKDEIESRRSLQGSLGPGGRGCSGARSWISKHKAHPDIEQQRRELLEVFVLKKGLAWIQRLHVAWFYIHGVFYHLAKRLTGITYLRVRSLPGEDLRARVNYRLLGVISLLHLVLSMGLQLYGFKQRQHAKKEWRLHRGLSHLQDLLGGETRFQKPLCTLCLEERRHPTATPWVHLF

SEQ ID NO: 942252 - protein, 297 aa, Homo sapiens
GGRRQAGQSPSGRETGPGPSETGGPPHAGDHGQGTLPPDPQTPQRGGPERGKASRDPAPAEAGLLAFSASPPQGKAGEQRREAGGHEARQQEAETPSGGAKGGGGRSRLERKKRGAHRGQNGAQGGPREGGTGGQGQHGRGQGAEREGRARAKGRGQRREEGKERRRGERAGGRRKNRGGGHRGTHIQHQVQVSSCQRLLEGLIEEALLQQLQDMGLLGLAVKEGRGDRCASSCAHGLHDAGGDGGLLLPERHTHLTLNDALYLGQKGLLQAAHSHMQLVRTSARTLPATVAAICPV

SEQ ID NO: 942253 - protein, 318 aa, Homo sapiens
EGPGARGAGGERRGDGGGTGGPRARPGAGERGCGGRGGGGTNAGRAGRPRRAQGRRRDIDIEDATQHRRENRKLDRPAGGPRAESPRPARAEKGERKGRLGPEPPGAGESTAAKKNGRRTRPPKKRQEKQVICCSGEESTTGRGSLAKEGERGASRDASRASKAWGSNKGKKQPGAKNDGEQKDDEGNRRAGANAGGAEARRAANKGAAGGRGSSGKPAERTGRKGGTGRGAERAGAHRNAPQRAGREEAGNRGGGRGARGKGKRQEESGGQRRQPEGTPRNHGRRSSGGPAARRRPKRRGGESQEGPAAGDGRRGGR

SEQ ID NO: 942254 - protein, 236 aa, Homo sapiens
RFLVRWLEKSCCQLLVGFLLFRMLGNSSPIPPGGARSPRLGGQGLQGTQRLEPSISSGPLGPGTRHHRVPVSHSRPPQLQVQPQTPTLTHTHTHTHTHYTHTHTHTHTHTHTHGCNNTGPTPWTPGMDQNRTAGSTVRGAAQGAGSLRYLLAASQAFLPSLYTSTGSEKDVMGVWYPSGHTVQDMTAVWRARSIFTSQDFSWFQKGQVNWVLRVPVIFFLGGGFCFDFLRPMFAGG

SEQ ID NO: 942255 - protein, 108 aa, Homo sapiens
MDAVTHQWELLAARLAAHSAKLGYPGIAGILALELREAALRVGAGNHRRYAGALRRVYSAEARAYTCAQLGTAARASSPVPWQLNVYLCVACAVLEGKAAGGALLCQR

SEQ ID NO: 942256 - protein, 220 aa, Homo sapiens
MGMLSSDNASERRHKRPRDSGPENRLAQQVFTIGCFEPFFGNEGHSRSGAWDPGQGVLLGVGNHTRWGPRGSRLSGTHTAGTMAAHCEGVEPLCQGRLGPSGAQCDGNVLGERVRAWDPRAGECEREEPLLRRCQSLEHYMPSTAALQPTQSQRQRVANVAAISDPHLKGYEEVAGALGKALGALQNQLSGSPPSCLLFCLLILLPTKPPEARTGAKRAR

SEQ ID NO: 942257 - protein, 41 aa, Homo sapiens
SPGEIHFAAKCDQQWAEYIIAQSQCQTANVAQGMACRVSLE

SEQ ID NO: 942258 - protein, 312 aa, Homo sapiens
GRSVRESGGQPLRGARAETGSVQSPTRGGGTRLAWISRRKGPGEDRAGQPKQKGGAGVREGAAAGPGPSRLGARLREPPTQAARRREQGHGGEKGQVIHRGPREEEGPGGGAESMVRSPLEAVVKGSSNMLYFNTFSSSSRAKKQRQEISNRRSLERSNWPTSASLWGAKIKQHGEKGQHHGVPIHAVVHKGPRQALELLEGAQDLLVAAEDTFGVLHSLTLPGLGLTKTPPTSTYLLLLPPPVTGAAFFGRSAGGRRLQTQGPRNGPQHHHGCYPPSALAQASPGSCLCLHPSREMNESAGTQKYSVLKIS

SEQ ID NO: 942259 - protein, 136 aa, Homo sapiens
CWFGGTAWSREAPGAQVVAQGHSARSWGTRGRGTRPVSGPGLPAGSGGRDPGVAAPHLRKTIPGLSTDDRPSPRKRTLSSRSLYSSSSYEPGSTRKVMLRKVPPDLALLQQGRHAARHALRRSPMPRPRPMPRGIM

SEQ ID NO: 942260 - protein, 121 aa, Homo sapiens
MALAECVTIRSSAESRRAGSPTAVTEEGTFSSTHFKSSACPSLNFTISIGFLLVLLIVIPPKPAFSIGSFCASSSSSSDNGDKANLWLFLDGRQRTMKTKRIMENSKRQMASSTHSSRQYD

SEQ ID NO: 942261 - protein, 297 aa, Homo sapiens
GSGVCARHNDPGRGAAGLERVAGAAEPSMVGQAAVRMPKTLLTNAGYLEQVKRQRGGPSDTVGSHGTVPGTVGLLEEDLDRLTIIHVTGTQGKGSTCAFTECILRSYGLKTGFFSSPHLEQVRVRLRINGQPISPELFTKCFWRLFHRLEETKDGSGVSMPPYFRFLTLMAFHVFLLEKVDLAVVEVGIGGAYDCTNIIREPVVCGVSSLGIDHTSLLGDMVEKIAWQKGGIFLLGVPAFTVLQPGGPLAVLRDRAQQITCALYLCAMLEASRKGGAADLGWRGAQRSKRLACSGHC

SEQ ID NO: 942262 - protein, 190 aa, Homo sapiens
MAASFFLLHTGQKMPLIGLDTWKNKPGQVKTAFNYSLIVGYRHINCPAIYSNKPEIWEALKEDVGTGKAVPREELFVYIQAVDTKHHPEDVEPALRKTLADLQLEYLDLYLMHWPYAFERGDNPFPKNADGTICYDSTHYKETWKALEALVAKGLVQALGLCNFNSGQIDDILSVASVRSAVLHVGIHPY

SEQ ID NO: 942263 - protein, 63 aa, Homo sapiens
MSRLRPRGLGTGLGALAFLHQANPPMSPIRRYPGTVLVSPLTGTSNTAVSVAPRGNTLTHMRL

SEQ ID NO: 942264 - protein, 167 aa, Homo sapiens
MWRASAWSPLFPKGLSGSIFTKTLGREKNWKASSTCTSVRSSAARWLWALSEFAPAGSGSPRSSGLWLCELLGQCFQLRVLRLRVWAGGMAGSGCALLAGLVPPAATVPLRSNKLCVHMCPAVCIVCAPVCLLLALAVHFVPGPCQLSREMPFGGALLVQPVALVTN

SEQ ID NO: 942265 - protein, 103 aa, Homo sapiens
VGDCFLSEAESGPRLTAGSTAAPYAPSLPPPRPPRRHQPSNANRRSRGGAAARREPQPGLRLAHRLRRSSRGLSAPALSPPRPSNGPPASRQWTQNKGYIYKL

SEQ ID NO: 942266 - protein, 107 aa, Homo sapiens
MAAQPRPVPAEGMNQQQMSVFSKKRKGLVQSRGLGSVLMFNHCALPACFDAQGSNSKVEWPTCGLSVVAVWGGSRPPPSDLGGRSFYALRDKLQPAAEYPGNPDRYS

SEQ ID NO: 942267 - protein, 157 aa, Homo sapiens
MGGGGPIPRPVKFESFGGSSRCDPFRLGVLGPFTTSGYSQLDRGGDEMRVQSVQKTKRWKGGIVTAAVNGVCSLSYAPLTPLRANRKHQESDAQGGLDHAERTQNQQRPWAGGPQTNAHWLKNEKVFSPLLPENQEFTNPGPPSSATKAWGPQFHFF

SEQ ID NO: 942268 - protein, 155 aa, Homo sapiens
SDLLRIAAPAPIGSGLCPGTRPLELALALPTFLPPSSLPDVDPSSTLNPSPPPPHPPHPPPLLPHPHHPPPLNTPLPPLQTSPPSSPSSSPPSLPPPPSPLSHPHPPPPHPPPNTHPLLSSPLQPPPSPTTSFSFTNILLNTLFSFPTSTPIFTP

SEQ ID NO: 942269 - protein, 207 aa, Homo sapiens
QGEAESWAELQGGGHTGGWSSCPGRQAGSLSHPKATGPTTEAEAMSNGWNHPPTPPPQQPLHHPPHHSLQLSLHFPIHNHKKTKTHSHPPTHNQPTPPHHTHTHHLYPQPTPTHTISHPHNSTHKTPPTNHTNHTHTSHVQAQAKKPTPKQRSVSQIETKIPGERHTHRLRRKGGESKGAPGERGGAQGQGGGLGALGCCRPPGPRG

SEQ ID NO: 942270 - protein, 110 aa, Homo sapiens
MAGMHRTVAFAASNHPSAMFGYEIVNNSAPPSSPPLIFSGKKGPLLYFLFNLQIMCKKLSVERKLKKLNVYVCVGALSLWLSEPVRIDHWTPRTTNCIGKNLELVFSAWL

SEQ ID NO: 942271 - protein, 233 aa, Homo sapiens
MGPVGILQQGQSVCHPRGLAQVLGQDEKVKQRLRAATILVERLQQQAHNGPPTALGHVAGRLPKQQQGGRALSKHLEEVVGIQQHLTTRSQADPGSEQGGILVQVLHTLHHHPGKQAVQHQEQHYHGCSLQAVPLVQRTQGGIRVLVVEKEGGGHELEGGVGHVHAPPHLLVQPGHDAVPPTLVGEAVSKHAHGLELRGRGGLELIQDHTELPLRQVRSIQEDVPLHVSFFGF

SEQ ID NO: 942272 - protein, 288 aa, Homo sapiens
LTWTRGLFNEGRYGRVGEFPRPCTFRGSVPRYAPLLRRLFAGGWALPSAPRDILLTLPGAGDGRRRRWFPSWIQRAVPLRPSAAGVSRSSAMNDRSSWRRTMKDDETFEISILFDEAPHLDPQIFYSLSSFWRNFEEPPEAACSALALMNSVKTQLHMALERNSLAAEGIEDLEEERDFLRCQLDKFISSARMEAEDHCRMKPGPRRMEGDSRGGAGGEASDPESAASSLSGVPEEGSPVRGGGRSRREVLVGGALGKPKAREGSEFKDADGVLCRYKKILGTSRSSR

SEQ ID NO: 942273 - protein, 165 aa, Homo sapiens
MGELLLLSAVPVLLALGGPYSSSVEDVSILFVDQMKPQRVEEVERLNWSKVRKLLNQFSLGEEPLKKLERYTLTKVAIRNWQEKRSMRPPWHRNGIGKVFDFKGSFEFTCEESSKGANEPGKGGESDAVNLEGDIRTVFQQMTEWITPGMLYSCRRKRSEGSEST

SEQ ID NO: 942274 - protein, 306 aa, Homo sapiens
MTHTESRITVASRATHLFGLSYGHSFTTKQQKPQTGTRMLASPLEAVQTPAGGLGLTTRLSGAGHQGVRVPMLPQGVGMTGRSLVTRQWTSLGEGWRERAGQAPAAHRLAHANTLKALLGGFSENQGERSSPSLGRCQFFLPPHSLQSPETLRVFWLGVLSSVFDPQNLSLLMSPRHAREGVGLLGRLAQLPPHPAWLGPRKLGFSKLAWGAGGLPGFLHQNRSPPPPLPFQLKEDAEEEKALGRGALVPSISPLGSTFLGAALNLFFLPFASLGKGLAGGPKGRCGLLEEGRGSRVGGDRDVLWA

SEQ ID NO: 942275 - protein, 88 aa, Homo sapiens
RPVCGGEPRDCRHSRFCWLLHAAGCGRKPSLGLVALRCRGSKKMSSGLRAADFPQLEGKISEELKRRERLQKKAFEEIILKYKKLLEN

SEQ ID NO: 942276 - protein, 169 aa, Homo sapiens
QHAPHAPAAKPTTNEREYEEEETQRRRQQQYKEKRKEYQDKTQREAKYPENRKRNKNREESTKEHSSVKQQKAEKEKIKASKVEKEEAQRSNNKTQGPQPNTSSQYRLKVWQQKTKAVVKQNRIVEKETEKSAQNRPTEDQEKQYKETGLSVKHKSEEVKTKKTEQQQQ

SEQ ID NO: 942277 - protein, 106 aa, Homo sapiens
MKKKHYRCSTRSICTWSDEIRYILDGSGYFDVRDKEDRVDPDLHGEGRHGDAAPRGSITSFTVEREELHEEAMRLFVGEPVWTAYNRPADHFEARGQYVKFLAQTA

SEQ ID NO: 942278 - protein, 367 aa, Homo sapiens
EPAGRRGGSAADGASSAGSKITAIIELFKRTKITKVDGPYPFPAEASLISQGTITEVKVKTDLPDNYIHKVILQGEAKEEKKAVSKDGTSYVPSEICFVIGGVRNQQTLGSYNSESFARITIITTSSRPTFGLTETPKPPHGMQPPKSTISCTHVISAGRSTNTTSVSNITDTCTHDVFSVEGAPYNRADPFYQSVVATDDVKDPPPFKIGPMNNITSDIFKKKEVRQCQKRETGNYTCEFCGKQYKYYTPYQEHVALHAPISTAPGWEPPDDPDTGSECSHPEVSPSPRFVAAKTQTNQSGKKAPASVVRCGTLLHRTPPATQTQTFRTPNSGSLRARQPSQRYLWQGKLFKCAYQLSSLKFAAQL

SEQ ID NO: 942279 - protein, 222 aa, Homo sapiens
MSTIQGMNSLHLGLSGQNHFFELGAQPQASQVIVLCPEAREADGLAGQAAQVHKAGGLRGTEVRDSYQQHCVVLRTSDDFGAKAGGVATKVDMRALWEDERVSFLEGVTTRVLGAVGLMLRTRSNFQDLQVILHAAVSENLTHVLSLCSQKSDFINGGLEGVGEQQEPGVGSCQREHAGVEGLLGERFIGGKNSPGITSTGTEALSCRRMSSSILTASTLAA

SEQ ID NO: 942280 - protein, 247 aa, Homo sapiens
EGFGILIAGPEDSKGGRGSLSGGLRDHGVQQSQTPGTLHRQWASAVVEDEPGPAGEGPAVLAQPRLVLTGPRLPLALEALAAPGPPGAVLGAGLTEPPQVAASLAEGLEALCFLPVPGALTPRLSLQGQGWVHTLRSWGLLGGGLRTSWLSLESSPLWTVKLHCQRPGDVVFLPLPGLIILICWPSIFLGHPALRGLLPKRGSICCLWVLFLTRGVTELHPSAGEFTHDPLGIVGLHVPIIRGCRMR

SEQ ID NO: 942281 - protein, 233 aa, Homo sapiens
GVLLRAPLPSVPPPGGGGESLSESVKGDWRRFLFPFVRVAGAGSRRRGPRDWGLPAGPGGALLRMRPAGVTVSAALLCALRPPPGEPARCPENPGVRAGRGAGSVRSGAGPGLPAPGRDPGASWRRRAAVSLLGTALPAETPRASADAPPPPPPPPGFGALPGPPIPRGASPPGLRRGSLPPSSVGSFSSPSFAFSFPLSIQSPAAGGTFSFSSFPALPFLSTSSSSLGPGAR

SEQ ID NO: 942282 - protein, 116 aa, Homo sapiens
MRTALRRVYRLCKPKERWADLLTWIQGVSGVIPKAKYGWKGEGLRDDGPGISREAQDDPCQNLGEDAGSASQQLVISGGHKGQASYASLSHRARPWKKFLKRFWASSFTLLPGEVF

SEQ ID NO: 942283 - protein, 283 aa, Homo sapiens
SKVMASGIATHVRGSNLWGRIIIIHVALGPILTIPITTQQSVPKGSRPKDNLGPTQQGDHGPLLRGTRALPWNTALKGMGSVALARLEEIKGSSPLCLQGTEDRLDEVGCGAVAAHVSSPHLANFDHLLHRICDHAGVKPKIKRPQHVGSRQQHGRGNGKIPAHCLGKWVPGTVLKDCVSRTIALTRDHTSPPNQASSQNVNNVPIEIGHHKHIKLVKILHQLHAAVVYDHCIKFDFGVQFSNFLTALQEQPIPKFHDVGLVDSSYLPRPFFVAYSNANFAIS

SEQ ID NO: 942284 - protein, 111 aa, Homo sapiens
HLLAVILDITTSRYMMSIFKRANFSLGLFFEILFYPLLLPPSAPWPVAGVLRGATFGCLLAWVFFLGFFLCLPPFGLVFVVVCGSVFGFVFLRVWRWLVIWPRLLGSSRFW

SEQ ID NO: 942285 - protein, 128 aa, Homo sapiens
EDGRPSPGQGCLLPRWWELGDPCAWPGQGRGPRRMTPRDPWLILACQCTVFTPRSPPSGMYAQQLVATLSMSGPENKKLGTFLLTQDLARLVMVPYHLKQISWVTQTALDGIDITTGPHIVMEANMGP

SEQ ID NO: 942286 - protein, 172 aa, Homo sapiens
LSRPWGGTGPGWDPEGVLGGGPWWAALPAFCRFSVSSTFSLKRRFFCLILASSALRLGSRSGSFPSRFSCFRLLFFFFSLKWAASSLYLTLSSHHVDLCEVLLHLGLFHGELLQLLLCTGRPADSVDEILGEPGGVVVDDQLYRRNVQAPGGHVCCDQDPVDAGLEVGYGGK

SEQ ID NO: 942287 - protein, 149 aa, Homo sapiens
MVTYEHQPQKATWLQLDSMKLCNNQKKPALGFEGGESHAGRIFTIPTLSTVQAVSPRLPVPEKPGPTAFWMLSWARKGKVWEECLPAANEKICTHLKGLGEEKAAFFKELQVEHHQAPALDFPVLDSLRACTLKLGSNPGSFLPEKMTP

SEQ ID NO: 942288 - protein, 40 aa, Homo sapiens
APRARLGLRDVRTVHPPGAPGPPGPPPATHRPPPLSPQDL

SEQ ID NO: 942289 - protein, 96 aa, Homo sapiens
LLRPAHPLLQPALSDERTGERGAHHSGGHGGNSLLEVLPLGTQKSRTFSPRTRIEAGDLIPSAHHRQPFASEKRGLLGWVLGLVLLSWFIYFQLKI

SEQ ID NO: 942290 - protein, 108 aa, Homo sapiens
MRWLQNRKFFCKGLCFFSKQRHRLAACALGSSSCCSSLDKDSPSTLFLAALERMKLSSTVAFKSPLNLACALGSSYNQSPVPAAPLVPGCRARQLHRGQLGQRADFCK

SEQ ID NO: 942291 - protein, 133 aa, Homo sapiens
MSNVPAKLFAEVSKGGPRVGVCGVGVPGLDLARFDHLLPLPDHGNYRPWVHVFHQAGKEWTVLQVNVVVLERDLAGSLLEFQNNKAESFLLKTLVNLSHKNPLVPIWFDRNEGTLTVGHGSFQLLRFELRLQR

SEQ ID NO: 942292 - protein, 92 aa, Homo sapiens
MEKGKARGLEPPGFPASHVIKLQTHEEVGSQELTSLTRETHLDDQALWEAQGLQPLYSFFLLLRHLDVVQLQGLLSYGAHLPLHICKVRQHP

SEQ ID NO: 942293 - protein, 177 aa, Homo sapiens
LTIGLNKKTLLIQVPLLIIGMKEHHFSNFNPLNSFTAIHLRSFGAVLKGARFSQDLIHIFTFFGIFTLQPPIWWSTDHSTTFYTVNSFPASQGIFPRAEFVEGKTGVFFFFFGFFYFQWHFFLSFFLGFDYYAFFLLENRENKKPEFLDFLFLGHIIWLLIFICVFGTFFQIKVNPS

SEQ ID NO: 942294 - protein, 165 aa, Homo sapiens
HTKEQERTKKQANRTGKPGNAEQAAGSRRYLALDLSMIATYRDIHHPENENVLKRGYSGYNTRWAKKILTQDETGKETDYEDIPVAVTNNNSTNKNPLKDEKPKQHIPQEEKAANPKNIEQYLNSVDMPKNEYNHNTPTPLSKTTWEEQSIKQGCKLNRLNSEVG

SEQ ID NO: 942295 - protein, 129 aa, Homo sapiens
MPWALEMAAVNNSKRKRPPPGPWQPRSPWLFCFSPQILVHLLFEHLKTSPMTARTPPPLLPPGALSLLFPSFPSPPSGFLIFSFLSSCLSPLHIEHTLYSRTAFSSSSHVATALLSRLHGGCLTAHFHF

SEQ ID NO: 942296 - protein, 262 aa, Homo sapiens
GAPHPPPAVWGGGGACLGGGRVAKGRGGRETGRRARARPGGGGGAGRGGGGGGSGGGGGGEGGGGGGGVAAARAEGRRREGGAGGGGGGGDTGSPKHQAHQHFTGVEPGATALPADSQTQERRAGVLHNPSQEGCYGLADLGGPTGAPSLPAGAIKPSVSPDGRAKGIYIRPLGNGGDLGASLGDPRAGTTGGAARMPPPAAKLGEGGALWWGGSEAGRSPDLGEGRQLPWGVGLPPGSPWVETGEREDACQRGRDPPQKNT

SEQ ID NO: 942297 - protein, 249 aa, Homo sapiens
LAAMPPRAPPAPGPRPPPRAAAATDTAAGAGGAGGAAGAGGAGGAGGPGFRPLAPRPWRWLLLLALPAAFPAPPPRPVPTPPWAVPVLGGPAEADRVAAAHGYLNLGQIGNLEYYHFSHSKTFNRSTLGGPHTFLRVGPQVKWLQQPEVRRVKRQVRPRPFTSAAPFGPHVDLHCGDKNRRCRSDMNVATWLEGLPRIARGGPPPDDGIERHHPDLGPKFIDSYASYDVDGNDYDPSPRYNASNENNTE

SEQ ID NO: 942298 - protein, 169 aa, Homo sapiens
FVTWWDTATPNMYRAEADILWVNEMLQIKMLPNGTQQKKQLHATQAFSSTHSFSCGKWLEIVTVLELSIFIQEFWILLFWFWKFLVVIQNVQSWHYVCALGDEVSSENGVSGCFMGQVGGLQCDEPLNLMHHSIHVGPLLIAGWQGFGLAQSPVNFFMGASLRSQGYFM

SEQ ID NO: 942299 - protein, 142 aa, Homo sapiens
QREPTMVVSPAEKTNVKADWGKAARTLGEYGEEALERMFLCFPSTKTYFPHFDLAKGLPQVKGQGKKVAEALTNAVVSRGRAEPNALSALSDLHAHKLGEDPVNFKLLSHWLLVTLAAHLAAEFTPAVHASLEKLLACCEHR

SEQ ID NO: 942300 - protein, 226 aa, Homo sapiens
HQGTKHKTTSTMRALSNQKPGPQSVNVTESAIEASMAGPKGTLKIPNSLASKELKLHAPGTKPLESEHILQPRSQEETQQPPCNQKGGFSSRGLFVCPQVSRWPLLGAPAQAGNGHILGESQESPYFVGLGPGPARTVGGCLCCHGLDQDGGGLQRVVAAPPGFPEDFVFKLLLLLWDGAEVLAVEVGMAAGAKPSAFREALGAVLVPAEVVILVPSGEGYGEAAG

SEQ ID NO: 942301 - protein, 143 aa, Homo sapiens
MSHDPGPGEALLCTQSLEGEQGKDALSQELHNDLLRAHLQLCRKLQRHHHHLLVLDDQVAGFALPRVVVLYPVVDLHVPPQVALSGKLVATLGALKLAHPLVPSEVHTQLLQGFEGLAAYVEEVGPVLLMFVCYVPFVVSLLS

SEQ ID NO: 942302 - protein, 240 aa, Homo sapiens
AHTPGGPQRCLHSRASSFPGRPMKGDRFGCRTCCYGAPWTNRYGWVSGRALDSEADPAPTAAWRCSQPADGFFTKRPLQGTSANKPRVVQGVRDRARWERGSALIPQMQGAVRLRELEGAWDKGVHNGKEKKKNSQGRALGSPRETSPPPGAAVVEDPLDLGIQGGHGAVLWTLGVAVLATMVNAAGGKRVPRQAVQVMECGQPGWHPHICSLPMISKPRCDSRAAVFRRHRASTQHGHA

SEQ ID NO: 942303 - protein, 287 aa, Homo sapiens
QEPAPPLEKMFSMRIVCLDLSVVGTAWTADSGEGDFVAEGGGVRGPKVVEKYQCACKKSKWPFCSDEDWNKKDTSGCRMKGLNEEVNQEFKKTKKNLKKSQFEYQKNKKDSHSLTTKIKEKMKGDFSSANNRDNTYNRVSDDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPGEKALTDMPQMRMELERPGGNEITRGGSTSYG

SEQ ID NO: 942304 - protein, 106 aa, Homo sapiens
GPPSMGFFRQRGQLTRPTSMSYPPARFSPPREETVMGAAGREGPRQCFRVRSGAEAGGTGRSCPGAVTIAHLQTLAWPGLKVPHGCWGRLSAGCPQRAGGAAAAQG

SEQ ID NO: 942305 - protein, 73 aa, Homo sapiens
MGSQHTGTAVFHLGGEEASAQRLNGTGQAHPRKGTQDPQPLWSGLWATWREGSRTVLVDEPLPTSPFSSRPIP

SEQ ID NO: 942306 - protein, 225 aa, Homo sapiens
PAALVARPPYLAHGQTQVLPPTWSSVRGPPIFSGPCASWRGKSLRGSEDPAFPPGLPPPSLEYSFQITVSFPGSQTVLPDLPLVIGSRSGLSRRPSRLARRTRSEMSWVDLNLPETPDAPPCNMDVIPEDPRLASPPSPLPDDMDGSQDSPIFVSAPEFQFLPPPPYAEVDPSLLNNNVQEPVADKKPPYLTCFFLSLFLDTHFFRDSTVSAMECGSTLASDFLM

SEQ ID NO: 942307 - protein, 129 aa, Homo sapiens
NKYTKQLITNRVLKAVRSSTTPNKPVLKIPQEKFKNSSLNIYENKKKKNRGCVSPWQGPLLAAAATSHTTVECSPGAVGLGGPPARIARAPAGEGPEILPKYLSELEFWGRRTHSGHTVTVGDMGPCVP

SEQ ID NO: 942308 - protein, 171 aa, Homo sapiens
MRPAAGWSLSLFLSSFHYTRSLRSLYGGYRPGALFECGFRAPEYFLGGSLGFDSIPGQFVSKFVTEGFSFDIVFFGENGIGKFTLMNTLFNITFEIEEATYNDVCLLIFVQIYDFHESNVQLKLTIVDAVGFLDHINNDESYMSIVDYIYVQFENYLQEELNIRRSSLRLL

SEQ ID NO: 942309 - protein, 139 aa, Homo sapiens
RGKKHGHRGSSLTVFGGQHGGSEKRGSCVPGRGEPQGVNSAWEEGGQGHQQAVAEELEVDRVHPKLVRVQVAQGGQRVGHVVHVPHGVGQRVGHLLAVALNLGKVAQVEVREVGLGGREGQEHPLQGLRTTLRHPAHPT

SEQ ID NO: 942310 - protein, 179 aa, Homo sapiens
MKRPELGVTLTLLLCWSLTQYSKCVFMDAAALVLAPIDDVFDRGELSAAPDPGWPDCFYSGVFVYQPSVETYNQLLHLASEPGGFDGGAQAFWTPFLAFGPQQISENTCHLFVTSAASLYTPTSRHLKCLVQVPKLCISWDESNHGIILMIPKQKVSKDEAHDPNMTHPEFLILWVDIF

SEQ ID NO: 942311 - protein, 249 aa, Homo sapiens
FQKDRRRKAGQWWAKRRACRLAAGQTAASAPRAPAVKWRIRPCTGQEAPSARAQIVWPSICLLISQRESISAGRASPLKKGANTLFIQIQILTAWGKLAKALVLIKLNEAGDGFDDVRRAVHEDDRSCAQACVCLHKRIEVHEERLKKRIGDQWGREAARDERKEVVPAARNNPIMLLNQFFKGTDISSSTVQGWLTWPEMLNSLVPKKRSLPKPANKVPPRRQIVGDTATVSTLATVVGQPNTPTSAG

SEQ ID NO: 942312 - protein, 81 aa, Homo sapiens
GVRLRRQDLPYTGGRTRPPLSDPPQCLFDFVCMCVLMQAFQLTVSYVEKYSVVILYLYYRKELKMIIIFSGVFAGATWDIN

SEQ ID NO: 942313 - protein, 269 aa, Homo sapiens
GPGAARRVWVCRPGWRPLVCSWLFATSASWAPAFLPPAPPPSRACRVPALPPPGPVPRLATLWLPCEWGSCSFVCSSLAPFFAPVPPPLPPPLPGSGEAAAAAAAAAPTCGRLLLLVAGTCGFCSLAQMLLPSAAQSPSPAPPPPLPPWGLSGLCQARLPLAPAYLAFPRRPVLPCPPCPLPVSVGALCGFLRPSCVVFSACGRPPSVLCLRRRWPGPPGGAVWLARLFLPLPGPPFPSRAPPPPYPGGRGRLPPLLGACLPPLPRSSF

SEQ ID NO: 942314 - protein, 281 aa, Homo sapiens
RLREPEAERGGGPKPGRGEEGDAGPVAAKQGAGAPGCERHPRTPDRDRRPGPRPDQARAEQEAQAPGGRGRPPDRPAEQGERGGAQQPRRAARGGGGAGGLGAGGGAGGVARRATTSSRAGEGRQATGTVRGELALLVLGKQRRSAAGQDRNGIRQAHQGARRRRGGGADARGGRRRGLVLLGTGLTLAGLAAAPAPARPLAAMLSVGIALAAFGSLLLLGLLLYQVGVSGHCPSICMATPSTHIVHFFHFIIFIISLHYSSFLLHYTTSIISILILLIQI

SEQ ID NO: 942315 - protein, 139 aa, Homo sapiens
MQLALLCTCTAGMLDGVVSAGDERDEEAEHHVDEDADEGIKVDLGDEPHQAAALLRLHMKDASTIQPTEAVAQVDDIYAVKASSEAPQCGDEDILVVEEGQVDHPTHTSSVEVLRKKLQTSELAKFLASMQIFMMVPDM

SEQ ID NO: 942316 - protein, 289 aa, Homo sapiens
LPPPLCSSPRSLPPLLSLRLILAVLGVVEAPFGGYWLLGSPCLGWCPRPAPCRAQSPAFLGPLEPDSGEWLCAAAFLPVLPPLRVIVQPAPRLFPPPPPPPALPSPPPASSGSPPPVVWPPRAVFRVCRLLPPPARLAPPALGPPPPGLPGPGGPPGALPLAWLPTSGPGADLVWLCGLPPLWLSGSSALPCRFSLPPPAGWLRAWGAAPLGASENTIVPQSIAGLGHWSDSPRGSQNWGCAERLRGLCLRYPCPSSSSSLRSGSPGTVFRINALQAALVQRRSQARSL

SEQ ID NO: 942317 - protein, 183 aa, Homo sapiens
MRKTTLRSIKINTHTMEPPSPTPPLGHHKEESSDVLKAIRKYESQKASEKAAETEINENGMENKGLKENRRRGTGAHACDPSTEGGREGRSTRAGNRDHPDEHGETPPLRKIQKKLAGRGGGRLEAQLLGRLRQENGVDPGGESAEIPPLHSSLGDRARLRLKKKKKKSTKLLLIFQVYIMLN

SEQ ID NO: 942318 - protein, 69 aa, Homo sapiens
QFYTQPPVCINIPIGPHLDQLGESFIDEDDGNVEGDLLGIVGGGREGLGGGEDRGGGGGGGGEGGQDVL

SEQ ID NO: 942319 - protein, 285 aa, Homo sapiens
GVVKTTPKNKNGKGKKSDEDCGDWRGKFGKVHHYWPAEPEILCQRQNNHLKKLRRRLLTWERAPSSIPPALAPLPPPRPRGIPLAPPLWPPPPRPAPAPPLPPPRPTPFPPPPPPRPLPPPPVPSRFSPPAPRRRPPPAPPPLARPAPLPPPPPPSAPPPPPFPASPPPFPLEPPNTQKRSAALVPAVRPSLPPLGSPPAPVAFVPLSGWPGAPLLAPRAPLPWFPGWPVPRPAGPARGPPLLAALACLLPPPRPPAPPLRLPLPAVSPLGGLGPVPVGRVALGV

SEQ ID NO: 942320 - protein, 74 aa, Homo sapiens
ECPELRGFCWTSREAVFSRLLCSVTSLLPPPRSLGGAIHTAEPGGGLEFFGEVERAENGFPVPKPSLISEMPHL

SEQ ID NO: 942321 - protein, 221 aa, Homo sapiens
MECLYYFLGILLLAARLPLDAAKRFHDVLGNERPSAYMREHNQLNGWSSDENDWNEKINPSVEAGRHEVEKLLEGRPCAGGPEPVTHQPSWAQNITFAVNLIFPRCQKEDAYEQHNLMKKLTKNEGWFYLAESGMYYKWKNMCQKTDDGGKMAPAKNQSIMSSLDGKIFFLTTPGWRRRNFIYVFHTVGQYFQKIGTMFIESFCEHSQCDTWASTHGSDCV

SEQ ID NO: 942322 - protein, 147 aa, Homo sapiens
ATAEAKAMPGGGAGARGTKTALNKKTLEAECNSPAPPTPEPGEGPRKEEGGTSAKGTWQPPSSIGCRKKDMDGEKQAEPGGGGEPAATQEPQTKDQGAEKEPTQHKEDEGENQPENKEDSIENGREKDSPNGGAKNQKPDMFGSPFQ

SEQ ID NO: 942323 - protein, 247 aa, Homo sapiens
MLSPQRALLCKLNNINLQHVSLGLHLSRSHELQEGPLSTHPPPGETGGKESRGPCSGTLVDANSNSPAVHCRCCQEHGPGLENSRTRNRRKRGLHLPKKQAAPPHSAPAQILAPMSQLSKSTCGNSMVMRMTLSPVSYTWSRAHKWIKKELEPAHRTASAALMINAQELILQKIMDLDSNCNALNTCQDVPSPGLEEEDERAERDLPTSELLEADDGKIDAGKTEPSWKINPIWKIDTEKLKLNGNH

SEQ ID NO: 942324 - protein, 132 aa, Homo sapiens
GWCGTGRPQQRRRAKPRAGQTKKAARVGRHGRRRRSARAGRWGSALLALCGALAACGWLLGAETQEPGAPAAGKKRRRRLRKKDGSPSKHRYTRSCARRSCRVAAVHRYEQEFKTVWAHRRAGSSCVIEAVR

SEQ ID NO: 942325 - protein, 76 aa, Homo sapiens
MGQKAFIASLRYCLEQFAELFDLGFPIPWQILSLILIRTLQLLLVQRFSVPPDDVLLAMIIAPICLIFLITLVVWW

SEQ ID NO: 942326 - protein, 176 aa, Homo sapiens
MDRHVVTSSSSQCQPVYRCMQILLVGYMHANQSSACMDFVMKQALGGATKDMGKMLAGDDEKDPDAQKEGVSERQEALRQQVWNFISSTVCRFGCGGGGRSGQQDPEIKYGAERRREEKESRGRKQPWEQPCEGELTRPKKAIPAGFGDEEEEEEESILDTVLKYLPGPLQDMFKK

SEQ ID NO: 942327 - protein, 318 aa, Homo sapiens
LGAPPTRFSPPARSVPPPPSPPPPPPPPPPPPCPPLAPVPPFPLAAFPSVGYGPAAFTPQPPPPPPSPAPFLPPVPAPLTLSTPPPPGAPMSPPPLAPCPPSPVPAWLPPPPVWRPPGPPAPRRLPFLGPPPPPPPLPPPPPPPGWRPPLRLAPTPRLCLATPLPPNPGPPSPPPLPVSRLPPPPGPPSPPRLPPPPPRPAGLPRRAFFRVSPSFWLLRAAAPLFHLLGLPPISRLVALLVRGLGTEKEDSCFELLHRAVGHFDLRKNGTMPREVARDPQLCEKLTVLCSAPGTLKTLARYAVRRSLGTPVSPRCSEG

SEQ ID NO: 942328 - protein, 189 aa, Homo sapiens
GLVCVQRRDQPVVRSAPAARSVPPWSPRRRRRRVAKEVQKKAQRIKTLSVWKMYHSLMQPGGLRLHRKQQLSLVMRTPGSPTSRPRWRPPSPRCRCRPPSPLTPACPRPEKPSPRPKERPPTVNPRFRSQWTRRRRRQPRRPPPAVPRAPPKSTANDAAQPERRRGSWTGPEQKTPSGTKRKRGESISA

SEQ ID NO: 942329 - protein, 79 aa, Homo sapiens
RLEFSGSAGRRRSAEVSTPPVMALNATGFPAFLRCLRPILRLLAEEADYGGAESLPLSAEVPVGKGFDSASPKVKAARE

SEQ ID NO: 942330 - protein, 295 aa, Homo sapiens
TLFSRPRGEDTSHLPAVSFLPENPFRASERLVKSCCLLLLLQTKCWAVEVKKPRGVSLKKKKIKEESNPFSCLDGSATKANEDVKKEKCDCKKFSEDSGKAACAKGSIKCNNNGYKHLYIPSNRVNDGVCDCCDGTEEYNSGVICETTCKEKGREERQSLQQMAEVTREGFRLKKILIEDWKKAREEKQKKLIELQAGKKSLEDQVEMLRTVKEEAEKPEREAKEQHQKLWEEQLAAAKAQQELELAADAFKELDDDMDGTVSVTELQTHPELDTDGDGAVVRSGTQALLSGGHT

SEQ ID NO: 942331 - protein, 69 aa, Homo sapiens
HSTSPSLDSEYNEELNEEDSQSDEKEQNAIETDAMIKKKKKSSKPSKAEKKKEPRKEKEKVRRNENIFH

SEQ ID NO: 942332 - protein, 198 aa, Homo sapiens
NLLRILVLQMFYMCGAVLRLRLDGFVPLFLVGPGAAPPGGGAPPPGGPPGVPPGVPPALWYSLVVVGLRAFSGSFCWCSGSSFSAVWFLSGQLVVSLRLCGVFCLSSSLVLPWGFSSSTVAFVLKALGSSDFLGGTLSLCFSSSALCFSASWAVRSVSSLLKRPLSLVIVILFSFPVLLSTAETLSIPLASMSKVTSI

SEQ ID NO: 942333 - protein, 130 aa, Homo sapiens
ETGVNGERSPYMSLHNKPKNEMNPEELQKRDEEEFGTGYHSLFITQSVKNNTQILINCRNNKKLLGWVKTFDRHCNIVLENVKEMWTEVPKSGKGKKKFKAVNKDRYISKMFLRGDSVIVVLRNPLIAGK

SEQ ID NO: 942334 - protein, 125 aa, Homo sapiens
RVPQDHDDLFPAQEHLGDVAVFVDCAWTSSCPFHFWVPYFTSSLLLQHHVAVPIEGLYAAQEFLIVAAVDEHLGIVLDLFFKLRYLTGFKFLLLLLLQLLLGYLTFWLFEEAYYGYYALRSLPFP

SEQ ID NO: 942335 - protein, 218 aa, Homo sapiens
DPRRRPGGPGSLFPKPPPLQPLHSWEGICCGQRSSLPQNPGKGIIQPTRVFFPVSLRVRRGPGNPPSSSLQPYVAAPGAASLALSLGPRSPRWPSHWNVAADVGKEGSSSPGRIVLSFCPSAARYTTALLVLPLDHLVVLPVLQVGGQLGVLSLLSPLPGSVALLVCLHERGPGLHDVVADGALAQGRCLVQTGLPVFLHRIKDLWGGRGPPGSGPHP

SEQ ID NO: 942336 - protein, 115 aa, Homo sapiens
TTPSFLPSCGPPSGGRRRSPGPRAPDVASPPPDLPPLVSPLFRPVGPPTLFLPPGREPLVPTLRTRDLVGSGKEGTSPAPPEVVGRLLPLWPYLGPFPLPPPPPGAGGPLFFCPT

SEQ ID NO: 942337 - protein, 267 aa, Homo sapiens
PPKSPNGEDKPHIDIVVIGIDVDSGIVHHYWPSDLYMRWHRQRRTIEKFVEEAAEMGKGSFTYAWVLDKHEAERERGITIDISLWGFEASQYYVPIIVAPGHRDFVKNMIAGTSQRCPVLLLIVAAGVGEFDAGVSKNGRPREHALLAYTLGVEQLIVGVNKKVSTEPPYSQGEYEEIVKEISTYIKKIGYNPDTVAFVPISGWNGENMLEPSANMPWFKGWKVTRKNGNASGTTLLVALDCILPPTRPTDKPLRLPLQDVYKIGGI

SEQ ID NO: 942338 - protein, 284 aa, Homo sapiens
DADRRWGRRRVCWSSRQPGRKTEAALAAAAAAAGAETHLAQKPEQRHCLVNTAPTPPVFKDSQRQALISSLPPRNRCENLLKHPRSWDRKNRTEVNTGFYTQMGVGVFLEAPHREGDGRGGEGAGPATLDRNKKGTDGKINLMKGKNRTQNYSNKLALFGMAARDGVLPATGGRASSRVDSSSPERAQRSTGSTRTTDHTRRHTSSVAQVPGGDHTTPRSRTGRLISSSEATGLAHTHNGCWSFHETHTHGHLSPRVLGGSLAYTPRHSYALKTAIVDHSMDIN

SEQ ID NO: 942339 - protein, 265 aa, Homo sapiens
MAPSLWAFLLEGLSAFCWLGCTTPNPCSPNPFLGARSSRAVDREPGGVGERRAGSMVFRGGGSYLGGQFLAAMTTESSKPPKETAVAPNSHFHGMDQAPLPGHLAGSRLGLPSIFRYKAVSVLRCAACFFTSFESSAWLVLLEGSSFSDALIFFAGENVLPLLGQPLALAEDSFDVVWLVLQPKAAGAQGCAVVVELQQRGRQVVQTLHLQLQELCLLLERYVHFGAGGDSFDGEVVGVGGQDEMPPLVVGVAHSRFRLAGHALF

SEQ ID NO: 942340 - protein, 57 aa, Homo sapiens
MWLWLSVACSSSCFFSRPGWLLAWLSRGSSGEKGIKLRTDAGIGPAEVQAPVGPAAG

SEQ ID NO: 942341 - protein, 265 aa, Homo sapiens
NGRVPRLLQLLPSSSSSSSTSGFWGITVLSRQQNEPGGGPPQQVPRRVWTAGQGGPSAMKKWAYRQIHLETSGFCAVNPKYVALSCEGSGGGACLVLPLGKMERVDKNAPTVCGHTAPVQENPWGPQNDKINASGSEDCTVIEWENPDRGTEAAPDGSTWSPWRATPSVWDIVAWHTTAQNVLLSAGCDNVIMVWDVGTGAAMLTLGPEVHPDTIYSVDWGREGGLNFTSCRYKRVRLIEPRKGTVVAEKDRPHEGTRPVRTVFV

SEQ ID NO: 942342 - protein, 205 aa, Homo sapiens
MRKIMHIQAGQYGNQISAKFWKVINNEHGIKPTGSYHGKNNLELEKINIEENKTTGKKYIPRAILVDVEPSTMDFVKSGPFGQILKAKNFIFSQNGAGNKEAKGHYTKGTELVDSVLDVVKKELKNCNCIQGFQLNHSLEGGSGVRDGHLLINKIREEYTNRIMNTFSVMPSPKESDTEEEPYNATLSVHQLVENTDETYCIDNE

SEQ ID NO: 942343 - protein, 166 aa, Homo sapiens
MKLRSTQMHPPRKNSDLTALRTGSLDKNAGPKTGAEKASARPLTVLALKMFGWIKQTDSRLLVDTAKENFSTMTSLYGSIHPADSVYLSTRTHGAVFNLEYSPDGSVLTVACEQTEVLLFDPISSKHIKTLSEAHEDCVNNMRVLDNRLFATCSDDTTIALWALRK

SEQ ID NO: 942344 - protein, 126 aa, Homo sapiens
MLCRVRGESSYVVPRKIVVVRVIIIMFVYAAMKNRAKGPAAYSMLKPETSSDSPSARSKGVRLVSASVEINHMAKGHDGRSNQRCCVVIRVERLKEPLISNVESRMMARVTYETVWATARSPPIRA

SEQ ID NO: 942345 - protein, 295 aa, Homo sapiens
LLGGLYLSSTWDFCLLLDQSLPPQACCAQAPRTFPPPGLWPHCLVKAGPPPPPVYTSSLRLNRWIEIPGLIGERKGQAVPGKGIGFGEKKTEGGAMEKVAPGGRRREFDKKAWGLKRNVGWYRLGWGPLGSQSGSWLRCWLAPEFADVAAQMASRLTLLYPPGAAVGCGYEAAEIKMLPAPAPMIQRVSKTEAKVNVATTVISKMLFVEPILEVSSLPKTNSTTNSATKITANTTDEPTTQPTTEPTTQATIQPTQQTTQLPTDSPTQPTTGSFCPGPVTLCSDLESHSTEAVLG

SEQ ID NO: 942346 - protein, 67 aa, Homo sapiens
GPGRGSRVKLITSLSSSTVPGDQKLWEPLPCGTTDSHQGTYHEHCTCNTFITLGCMGNLKSTSEIHT

SEQ ID NO: 942347 - protein, 94 aa, Homo sapiens
MREIVQIQGGQWGNQMGAKFWEVISDEHGIDPIGSYHGESDLKLERINVYYNEVTGNKYVAGAILVDLEPGTMDLVRSGLFGQIFRPDNFVFGS

SEQ ID NO: 942348 - protein, 282 aa, Homo sapiens
ALSVPLSFATNMRFTFPLKAKFLENAKIVLFGLIVEYEKEQKVLEQLKKNKPKKKGKNFELKPLFQKVEVIYSFGFGFLMTFLKKKGFSSVGTKIIVAALGLQWGTSVQGNLQTKGEKIKIGKKKKKKAKISAAKILKAFGAVLGKTSPTPNADHKKIKKVFFAHNEYLVSEIFEASDIGASMTIHAFGAYFGLAVAGILYRSGLRKGHENEESAYYSDLFAMIGTLFLWMFWPSFNSAIAEAGDKQCRAIVNTYFSLAACVLTAFAFSSLVEHRGKLNMIH

SEQ ID NO: 942349 - protein, 88 aa, Homo sapiens
MPQAFPWSKFYLRRVVGPHPREEPVARLVVLPHPGLARDQGAQAEEREGADQLPEAAVAAHVGPGPDRQLASRERPREGLVVHRVELG

SEQ ID NO: 942350 - protein, 66 aa, Homo sapiens
GRALLLLPPPEDDHAAGVTGGQWALVAVDADIKHRCTVALLLVDSSLGGPLHIKDVHAHVLTARYH

SEQ ID NO: 942351 - protein, 134 aa, Homo sapiens
GQAQKDGWGQGCCVLFNGGHNVAVTVFLILQEHCWQIQLLIERLHPGHFLSLLLPVFFLQGLVLFWGGPLRTLNHQPAAFVVLGVGASFAGRAGVPQGVGVVFLLLPLRGLLGRWECSFSPSVPAVCMAAALGG

SEQ ID NO: 942352 - protein, 299 aa, Homo sapiens
PPSGFSRRPWGLPPPPSPASPGRCSRPPPAGVGFPSPLPSCRGFFLWSGGGGKQFCALSPLPFSAFAGVEEGVGGFVVLPKFPLSGFSRLALWRRGAGGLGPFPPPSPPGVQAALGVRSRRGGGVPSLPPCPLGGPGGLPRAPVPLPWARGAGSAPPPPASWGRLCRSGLGAWLSWPPAHPHQAQLLHKNKGPPAPGVGVVSGKGPRYGYGAAISPPLLGVQEKSPPFRCPPCHASSVLELGAPALRKKKCLCALSAEKRGDEMCQVLGVGSHFLRPLALRSPPSLLGLPSSVDEVVGC

SEQ ID NO: 942353 - protein, 104 aa, Homo sapiens
KQKRKKREKQKKKTKLYVLRAYNLFSPTPYFFQRALGVSIKSRSMFSQSLICLTPVLRRFKVSVSFFIVLSRGRKGGGGFLLLWKGTSPWGTHLPVPVLRIPVT

SEQ ID NO: 942354 - protein, 144 aa, Homo sapiens
MSSRSSGNEVFLAKLIAQPFISIFPDSGHFNVDNIRVCKILGSGISSSSVLHGMVFKKETEVNVTSVKKCKNSSDSCPFDGMITETKGTVLIKTAEELMNFSKGEENLMDAQVKAIAETGCKCRSNRWQSGRHGSSLCNKYNII

SEQ ID NO: 942355 - protein, 175 aa, Homo sapiens
APGGALPRGQAREGPRSGRRPQPRARREEEPPHDPGSGEGPAARASGPETGPAGPGPEGPHRPPQPRPPGGDSDGRKREKEESEGHPRGPRGARGGEKGERATGAPRDGAGAGRGTPPGGDGGAAEAGNEDSAAGAKQGRAERPRGPANPELDKLRSQASQGRRRHRREREKVHD

SEQ ID NO: 942356 - protein, 199 aa, Homo sapiens
VSGSARVHYSFSAFIHAFHAFSCVSLSLTRHGPCITLVSPPLPLPPALPIARCGTFNPFPLCHSRNMQSHTYLTMTSCWPPHPRDTLTGQDALYQLLLLFSSLLCFVFGSHLLLFRTYDSACFTDITFVHLGHVLSWVSRVTRLQKPEISGLDTPHLPALLYGFAVHVLFFSAPHVNYPEDCTFIMDPTIMLDITLITK

SEQ ID NO: 942357 - protein, 219 aa, Homo sapiens
GPARGGGGGPSGQRRGTKAQEAQRGAQAEGKEEGGRRAGGEGLGDGRARGGAPRAPGGQRGPGEGGRERRGRGRGGEEAGGPGGNQREGRGGGAQREGGLARRQQRLRRPGSCQVQTQPHGARRPDGTGVVRVGRAPEGLARWAEGCARPGAGGWSEQRWHEASAGVNEPVVDLQDGEPRVQRHSFLLPPRGVRVLKELEQPGSHEVGGHLGGRTPSSC

SEQ ID NO: 942358 - protein, 221 aa, Homo sapiens
APWVGLIPNFNLPPGIRAQARTLTRMLLGLLVPYAHGEEAAPTLGMVPQDDMRKLSFRQVVFVSTLTCSGLLPPELYREVSRAGHHQVALSTDPIEPVMPPGANGPWWVCGFLHPDGLVSGCGVQGSHGVLDPSKGTFVAHIKGPDKLEAAVAVGEDVQQALVVTSPELGFLVGHAEQVGVQQQTLQDAVGSAVHHHQGVVLAACEDVPVIRQLGQHGSGV

SEQ ID NO: 942359 - protein, 79 aa, Homo sapiens
PVRPPSANSICTPAVTGPVICMAVTVRTLSVYITNALYVAPGSTGRLDVPLYRINNSGGLYKLYAMPPCHLVFSQAHLR

SEQ ID NO: 942360 - protein, 147 aa, Homo sapiens
PSLSLCPCARTAPEVEDGTMIFPPSEGNFLIMAQNWYQPGELEESHESVIICVTRAHVLADGIVVKLHHLIFSWQWLQSPAPCSVPAQQIFQTYPVCGPSTTITRSPSALGTRVSSMFFLRPPRTRPSSVRQTQVSGLRTPSIIILV

SEQ ID NO: 942361 - protein, 76 aa, Homo sapiens
MTKWRVDTGDATAGIERLVVGTIDVKIGKLRANDANMKTPGNNGLNGYYNGARKSLCYAAYRNSYGRGTCNTKTVT

SEQ ID NO: 942362 - protein, 108 aa, Homo sapiens
RAAWAPAGRLQGPPPPPPKGFNLQQLGNCQPNPNWFGVRPPGSSWPLAYLAGWLVPAPGYGPPPCPPTQELRAGGCRPWARRKATAGHLGQTQTPQGSVTEGVLFPCS

SEQ ID NO: 942363 - protein, 63 aa, Homo sapiens
QATQAGGGGGSGGPPRGGQGAPTLPQETNNGQQGAAEPAGARDMRAESRFLCQCKAGVGQAEG

SEQ ID NO: 942364 - protein, 202 aa, Homo sapiens
HPAPGSGGGRAPPGAGGERRGPGTTGGARPGGGRRLRRGQEEKEENGGPPAGTLSGGGRREAVRQQQREGEATGELAPGSDLAFRCASSQNPRSLEPGAASPERRRRQPSRALAGTPPGGGRREAGTQQQREATLERPQRATAPPAAVFPEPKKPGTCGIISERRRRQPSRGTTGLGSPRPSWSHQVASNKGLPPGLRGCWS

SEQ ID NO: 942365 - protein, 307 aa, Homo sapiens
MQARPEKGRAVGPVPVACQWCQGANDQAWSQQPSAGPEEGPQDKERLAEERLLPLLSQPTLGSLGEPLRHCPQLSNPLPWEPALEAPPSPEALGRSGGRPRPSLAGPASPFPFLTALLSLLKTLAQSHKGLRGQRAATVAAPGLQNDSPQGVAPGAAPHLTPFSAWAFSHQYHLFFFGIRSGPESGILQPLPATHAALNHGMALALLSRLLPGSEYLTHELLLSCVFRLEFLPERTSGGPEAADFSDQLSLGSSRVPRCGQGTLLAQACQDLPSIRNCHLTHCSPARASLLASQALHRGERQRAQPC

SEQ ID NO: 942366 - protein, 216 aa, Homo sapiens
VSCPPLGHNVLRLARHLWKGWIQDNAPIIPSIATTPGPRDPTLELSGSQFLEEVLTQRGQLRIEPKAPWERGIGKLIEQEELPETLICQQPEFCSILSAGSFDLICFQWVVFEEEASDKSHSHSIEQRGTNVGGRTSYQGPEEELKEGQVVFRRHCVTLQGHRQLGQRQAQSPQGTHVFPKEGKAQGDTLPTLQGQEDQGPKRWSQKRQPQNDPGS

SEQ ID NO: 942367 - protein, 292 aa, Homo sapiens
GEREDLHESSKGSASATAGGGEAGSAWGSSSKDERQGCVDVPTGGLQGRSQLNVLDAHVTELRQRGLPLALKAGLPRGLKGMREGLAEEIIGEGRFLNGHQRTMVRALRNDPGCQELVCENSTPELLARAKAVASLWVRGRGPAAPLFPREAGRERGVLLEGVDLVFGGKLSSSETNRKPPGISRYELEGMLREEELVPGIGALPATAVQNQDNGIYEGRVSRHQRIKHIGISEDRKEVLVLENPKSKRVTAEAWGGHNELIQKLLIAEHLKDRLPVRGAAVQGSVPSRELS

SEQ ID NO: 942368 - protein, 116 aa, Homo sapiens
HRAKEEFPHHAPDREKAKTQPPPPAQPPNPNPPTPPAQKTTKSTKPKNKATKSTQKKSTSKQNNPQQKETRGNPHQNQNPSPHPPKRNPPKQPHPPDTKNKKQNKAHPPARQPNQT

SEQ ID NO: 942369 - protein, 235 aa, Homo sapiens
MSCLQGHCSLEAGTGKKQAALHYPKQNRCELAHGGVPFAWAWNPKGEEPPEPGVTVQSLGLQLGGQLFTVLAPGLGQDPEPLGGVLRNVVGLLVKGCHSPRMPGLLVWKGLRMRITFKPESSASFCTSVEITSTDLQLMLFSRTAPLRYLATALGTQHGREFAYITTPGFRWAKWNTFRSTNSLAPREEEPSRLKLKLKGCSSSTKRPSSFLRTLAKKRLGVPRAAIATAWRARN

SEQ ID NO: 942370 - protein, 58 aa, Homo sapiens
MGWPSIFRYKAVSVLRCAACFFTSFESSAWIVLLEGSSFRAALRMGIASLYSPCWAST

SEQ ID NO: 942371 - protein, 127 aa, Homo sapiens
MRVKPPICSAQPKGRVYKKTRFSVSCQGGYCRRVDWCGHFSIFTMYGPGKQSAELSIKIPGADPWYHSKYPRTKYYSSHFCFHHQQHAKTLRKFSRIPAAQRDHTPKHMQPSYYGDTTTQFETESIY

SEQ ID NO: 942372 - protein, 296 aa, Homo sapiens
PAHHPSSACSDGTLKLKKAASKEEDVKIVIKTEFQEEEVVATPVHPTDLEAHGTLFGPGQATRFFPSPAQEGAWEIKGSSFPIQDPVLGLRKPARPERDMGELSPAVAQEENPPGDWLFGGVRWGWNFRCKQQVGLNPRTGPEGLPYSSPDKGEAILDPSQAPRPFKEPCKYNGRTKGFGHKTGLKKHPAAPPGGRPFTCATCGKSFQLQVSLSAHQPDEARPTGRARAQAGGGTGSGGGWWRHCWGAAPGHGSALSVWGSAAVASRAPAASSAIAMLHTGERPFPCTECEKRFTG

SEQ ID NO: 942373 - protein, 144 aa, Homo sapiens
MAQCPVSDSGGVRSESSPPRRPRRSRPPRPREDNPRARRRALQSRVDRGRGGCGEGILGPWALWTAAGLPGGPAPAEAVPQKPWPGEEGGHRAGCGAGLPRRSPAPPQCPPQAGAAGWRTAGGHRPRPGGLVAPHAQHAVPVGH

SEQ ID NO: 942374 - protein, 300 aa, Homo sapiens
MADHNPESDSTPRTLLRRLLDYSGPAHPAATPDSSGWSPESPSLNGFPQEFEWPKKDDSQRAFPWSQFFLQIGPYEAIGHFEEQTPRTLLKNILLTAPEFSIFIHYWIFKPLPAPQRSNPPNKKAVSAPGAATSLARAPHNPGSRSPGPWQEETEAETVIFQQGLDQGLSLSQEPQGNSDASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKDRAVGLELQKNSECVDWVAGANLAW

SEQ ID NO: 942375 - protein, 100 aa, Homo sapiens
MKRGEERSKAPSLQGTPNCTTQPYRKHTDLRECTVGISSNAGELLQMRERDGLTGQLLVGLAGKRQQWQLLPMGEAAAQHTQAGAVLPGTVHVLMLLHAL

SEQ ID NO: 942376 - protein, 284 aa, Homo sapiens
MSFGSEHYLSSSSSYRKVFGDGSRLYARLSGAGGAGRFRSQSLSRSNVASFVACPWASSLGLGLDYSRQLASEGLELNKAAARTNKYNIIRTNEKEQLQGLKERFAVFMEKVHQLEKQNRALEEELAALRKAKLSSGPYGQLFQREALNCCPVEEASSARSQALLERDGLAEEVQRLLARCEEESRGRKAAERALKATARRGRRTLARLDLEKKVESLLDELAFVRQVHDEEVAELLATLQGASQAEAEVDVTVAKPDLTSALREIRAQYESLAAKNLQSVEEW

SEQ ID NO: 942377 - protein, 361 aa, Homo sapiens
GTHEWLHSTQKPTHLAGMPHKTERKQITQQARFILAVTAELPTPKSTEENIALNLQTSEGGASGSQGCRDGSGHRHRPPGVCLETQVEKPPKNSSQTGAAGGCPSTVACLQDSPGSLSPGRLWHDTKASRPGSRPCHCVCLIPGPHSPPPGQEPRPSPLHHPLGPQPTHSETHTGLAQLLNVLPSKAWRLKAVSRNFFSYSRRVFLFPVAGAAAGVPANKPKGPCAPEDGHEAWADVVIVAHVLVLLLKAGQPRTWVLLYILLEQVEGEWRKLPQALKATFSSRSWLRRSFTRAKYTFAVQKMSRCTFPGARSAAPSSGITRWKLVPDTIWSKLDLACWFFNRELGVKKNSGLREGSRSSR

SEQ ID NO: 942378 - protein, 165 aa, Homo sapiens
MGGGGEEQFCGGGGSSVRGENYWVPNWWVRRAPTADTGGVGAGVISWGLGTLGGVGLSGGARAGWLGSARRVCGGGSRVPRRVPGGRVGVSWRAWGVAGGVFGWGRGGCRGPGFGRGVWRGCGGPACRSRLLSLLWLSSAVVFGRCGGAPVIVWSDNTNTFISNS

SEQ ID NO: 942379 - protein, 256 aa, Homo sapiens
ESDPGPSREAHSVKIGNYKNTANECLEDKGEQKTEVVCENLESKTNRGEREEDVLDSQRRAGEHPERLWQPTQPHPLGLWSALQGGPWQGGVDHLTTRLRRTEERGLSDAGAKAPSSHQGWEWEGVLRGPALSEKMGVEAEGVTRIDQGVTAELASAHRGRSLAPTGLCGDCGADVGGAAGVGPVFRLASSGGLALTGRGLAVASWTRRAELGKGATPIRGSCLGRRGASFLLLFRSLGITGLNLFGSLARAGLLA

SEQ ID NO: 942380 - protein, 284 aa, Homo sapiens
RSDGLSLAVWGAVVVVDWLNKLLLLLLLLGGRLAGEALGLLCCKSRFLCLLLGFLGCFNKYFGRGLALQLSQEKFKTLESFGHVAFEPGKNKSLDSSGETKKARGDPGFPADFSPATFVRFHTVNTSFLHHHQQGVVKVPGEGSNGLILWVHKRVLQDVHRVSNIGRKKWLGPAWHPVGLGQEWPGQFLVRGNLPVYYVFRKDKFAIGIRVPLQEGGEHLVPGTPEHALAQEILYHRPGRSGLSTRAETEGAELCRYARSGPGRGSAHTRRQVCGLVTTAPRPS

SEQ ID NO: 942381 - protein, 176 aa, Homo sapiens
MGLGVLLVVFVHFGLFLGRGVVVVVVVGDKVVDVGVGLGEVDVVDGLARVPVQEGVGREHGGELLGDGLEQLLDGRAVPDEGGGDFEGGGGDVREGEVEVVGDGLEEVGGVVGLDGQHLLSTSFMDMRPRNTVATVSSGRGAGLQAAIMFLASNICWVSSGTVRARYCWLPRAVRG

SEQ ID NO: 942382 - protein, 296 aa, Homo sapiens
PLSFFFVCFYFSWGGFLPACFPSWGPPGGSGCLPPRGVLGGAGVPPFPVPECFPSPGGGGGGLGGAPVRAVGGAGLLGGPGGRGRLGGAGPWAVGGGVPAPPPGGGGGPLGVVWWVPAPRVCGAPAAGPGVGWAAGGGGAAGVRCWGWGGSGLSRWPPLPPRARLPGSPPGWGRDGKEKTADGGGTEFCSPSPPGWLGGGWGGGEVPPWSCGGPTMSAPRSGGETDSLSGTLSGHPYFFSPKPQPLCPNGVAKQRPKAPGMWGVCPSWGRAACAQEGVQLGFGEYSGGRGGGEGLR

SEQ ID NO: 942383 - protein, 111 aa, Homo sapiens
MCPMAGPSERIVTLKVGTLYMDDTITLDPQTKSILLSPLAARRNGRGKLEAGSLFDLHVKSPSLFNGIQDKLPFPKPTNPCSVPLLPALPNRTFSFCSHPPFAQILQGDVP

SEQ ID NO: 942384 - protein, 282 aa, Homo sapiens
RSGGDGYWDGGGAAGAEGPAPAGTLSPALLFSTGTYERLVLLQGSIGLLGEGNNLLVLVLKKKFKRLRTPSEIFLAKKSLIYLLVCGGGAIFIFVSSLKNGWVWETSREACGKGSKEASSNDCEEKIKKKKVKKISKEEKKKEKKRIKKKKKFLVCRMPEKERSIMLVKSKGQLETPTISIVSYLFAKSNTVYNPVIYVFMIRKFRRSLLQLLCLRLLRCQKAAKDLPAAGSEMQIRPIVMSQKDGDRPKKKLTFNSSSIIFIITSDESLSVDDSDKAMGPS

SEQ ID NO: 942385 - protein, 236 aa, Homo sapiens
MVFLKAENAEQSQTPLPSQGVLEVSGEELCTTGFLGARGPLGEEQKTTSQGCYRPASARMLSDQGPTHGLASVWGPVSQGGPLGGGGGPRGGAPSSSLRRRSGVFFFFLGQLWAWVFWGQVGTCSFLAFGSTGNLKFMLPCFMNSICIILMNVLSMEAMLILVQLRLSAFHVLFVFGADCYDYHQGLIPKVALHPFNDINASDSILKYVNCSLAAIYQQKVHEFHHLQSCVHRISD

SEQ ID NO: 942386 - protein, 161 aa, Homo sapiens
MVTLMSRYQAASSSQLSPQPQALGLGAEAQCGPEVPPSVIPVSRVIGSPGWAAETIASSGRAAGNTAGGGGAGLRSRLGDTGSDLMLWGWVVIFRAAPTWGRGLLGLRFLKFFRDQVGFLLRWLLRLLRLLLLLLLLLRWLLLLRLLLLRLLGLLLLLLEK

SEQ ID NO: 942387 - protein, 288 aa, Homo sapiens
KKKQADPPNPQPPEKKGKNKTQQERRKARGREGAKAPKKQRTQRDQQDARQNGKEDRPGRTAGRRRKTENPKAGKSERGGHKENPEKGERGQKAEPKGGGAKAAPKQRGKKPETKGRRRPPPAASNGETRKKRKPPGAGQKGERREGGPAPQPGPQTTTRRAKGTRRRRSETQEGTPRQGGSPPPDRNQLCKKMQESEEKKERESRKTQETQNERTKEKKKTPITQPAIIKERAKRQSKPAASSSSTAQQNRHTNKPKANTQERASGPLTKETPPRPERAPKGETKAI

SEQ ID NO: 942388 - protein, 81 aa, Homo sapiens
EPSLIPEPEGDWDRENGDGGRPRRRRTRARNPGGPARSRPRPAGCGTLPKKVLIWPSLPAAPPPSQHRPLKHRNNSFKNKK

SEQ ID NO: 942389 - protein, 186 aa, Homo sapiens
MSSCMCEYSTVKRKVQPPGQQLHKGSSKQVQQTAFYLKFEGAGAKVHVAVDQHNCKHAVPEQREVVPLLGSFGPEVKYLVEELDEHRVEEGEEVDELIEPSQKLNPAEVSIQDGRIKNSLKYFEKVNEELNWTTPRFSAIRLRLNSKASCLSSSASANSWLATVEGMMKKAFLPSMVFPFPSVSRP

SEQ ID NO: 942390 - protein, 128 aa, Homo sapiens
LVRLGPGAAISTLGLGSKGGELPAPLGAKENLPLKHVRTPGARRPQFAPPPPCRGAPAQGPHARSCTGAPGKHKEAGPRSSRSKAAHRSGGSSNGHREKKKEDQRNEEKGQVEANKKIEKQLQKDKQV

SEQ ID NO: 942391 - protein, 227 aa, Homo sapiens
MNFDNVSIRGNTDFVFPFRNKNHPPINPNHGIAFTTIIAKTEQTKLPPQGNNRRAGHKGATGDAGANKGGTATPPHTPRPPRQEGPDTGPGARGGPSTGNRSDSNTGKKRRGQGRRGTPAHAPGAAQGPQRARTPQAAERTTTKGKGQAILTVGFPRGELANSHCLTTLVCCLTREGQGGEENRGAVGSSSSRKNGSVPRRPWPAGPKGRNTEGMPAPDVRTRTAED

SEQ ID NO: 942392 - protein, 139 aa, Homo sapiens
MDARKLSLDAVRSRRPPLLGWLAASRKRPCMYRLKPRGLGTGLGALAFLHQKAKPPMFPIRRYPGTVLVFPLSRTSNTAVCVAARGNNFTHMRFFLDTEALESMGSQKGEKPAAGGSCSPRSGYRPPRSPAGSLGCPEN

SEQ ID NO: 942393 - protein, 315 aa, Homo sapiens
MAPTAAQRAYEPRRARPPPPKPGARGSQKEARREEGAGPPSPALPSPARRQTRRNRDAKKKQSGGIAQRARAPPAPGAETRRGDTSQAPPPEPAEPGPEPERVRDQQPPAGQHPGPCKPGRGRGQRDKHPARKHPSRRGPNRRGTEHTQERPTNPEESRQEDSTAQDSEGRRSTGDAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEER

SEQ ID NO: 942394 - protein, 314 aa, Homo sapiens
FQFFDFDLLAQGYYSYILFGSGERFIFLDAGPLMMGPSFQCRPFPPAWYRSSGATVLTLKNSPVSLVPAVQARAGLPPCLFLARPHHSLRFFFFSGSWYIGLPLFGQLVMGPRCPPSVASPFVAKAPGLISEQGPLSSSWLLNSFSPRLGVGPYTPPPAPLPLHARAVGLLLTFASVLLYNLAYFFPLRLLLPPPFKQAPAGLLWDLIFRENAYCQVLQLPDHFVETLSVLKRGALAAGHSKQSVSNCLVVKLENGAATVPVVTCLLLTSLRFSPADGACERLLRALLGQRVFTLTTLRGLITVRRHHLILCVQ

SEQ ID NO: 942395 - protein, 283 aa, Homo sapiens
MLVATYADLQQQSASLRSNPGLGDSESNLFSLPFLFSALKMKPYTSNTMCSSNVIQQNRSSIPRHSLITSLANLFTLVVIECLTVDGNSFLKYGKTCGLLCSLRALPSFMYVNERNARALLSSERMADMICWRRLLDINLGCRANKCTAGHKQVLKRVCERGMYALLLLTLDLMTFQLGLFIYRDVHVTQHSVPPPPPNCTLYCPRNVSVYQETLLEGAESGFNSKNGKRGSSKSGKLKGDDLQAIKKELDPDKLEVDSLLVNLEKIEKVKSIQAVEMKNDKS

SEQ ID NO: 942396 - protein, 248 aa, Homo sapiens
MWGRRSPFQCEGFLCSVVFLTPKGGGVPGETEAAAEADPAPVPVYAVTPPKEAGARGEWPGPLKAPLPAPTGPGHPCLWSVPCSSGGPPGRGVEGWGVPEGGLRYGNKGPGVLGGGAGLGDGKVRKPVAQRDTKPPGGQCGVLKGERVRGAAERGPGGGERGGAWGGRRQSVEGPREGGEKDASAGAPPSRSGGAYAYQRGHTEDPRVSQQGVREVAGEGGALFSEKQKKRGRGAARVGQGAGCRRGG

SEQ ID NO: 942397 - protein, 227 aa, Homo sapiens
MEQDRIGGEGAGKGGARSSSRRRGGADGPEKQRGSTRDTNTQDQGGTQEPSQEGEGGEHRGEEAHARQATEERTQPGGRHARRGTQRAQARTPGRGAGDAEAAGRRRTARAPAEEAWQGVEGGWSRRPADNFSEMLKILPLPPLPLSVEGVAIQMEGQFALTPTSYSSRPSSKSERKAARAMPTDSMAASGEAGGRGGGQPGQGQAGDQQHEATEQHHEGGGPSTTA

SEQ ID NO: 942398 - protein, 242 aa, Homo sapiens
QSIWLRNRCRKRSGCQRTCWTLKYLLTAPSSSGGPLATRAAAMASGSPPPGQGQGTKAKRQTLPLPAPLGCSSLGPALVGLGSRSPKASCAPLARLNAALPPWPGLAPRAPPPAVASTGWSPQHVGVDRIPLLLAAAAGTSGHVPGPGDLTRLRRTEVPGFHEEVSPSNLPMNSCHWCSSSPWSFSVHFRSLGGIIFFLLFSRFPGGVPSPKFGQGSPQPLFFIPMAEGQRLQQLEVDIGVG

SEQ ID NO: 942399 - protein, 275 aa, Homo sapiens
FAATVCAPGPPPPPPAARGSLRWARAARPEPGERARGGCLGPSRAAPGEARPRAQGPWEGAGAAAVPRRRAHEWRTATGSPRPRVPESGWRHLKMWRGPGATQRSPVSSKASKDPPPVAAAMVMFQGTYTFLTCAGFWLNQGLNVLLCCFCTTCAAASNGARRSDYTTNLRARKLEHLLEGSMAGSTPGLAPPQPPPHRSRLAAPAHAHPHPHVHVTPLLHHGAAHRTRTPPTPAPTRAPAPAAYAPFGAATALEPPAPRGIGHVQTTVLRKGGA

SEQ ID NO: 942400 - protein, 228 aa, Homo sapiens
QGQSQTRHGPPSPGAQPRPTATRAEDADRRKEREERQRRADQGAEEARESTRRKRQLGEERKEAGNRTVGRWEEQGEQRERGEEGRNQNNQDKKEAEKNGKEEGKGGGLGKRPGNKRKTSEADKKAGGKKQDGGGASQPARGGDEREQRANSGGVNLQGTKEARENEREENLEQVSGNIGNLRHMALDMGNEIDTQNRQIDRIMEKADSNKTRIDEANQRATKMLGSG

SEQ ID NO: 942401 - protein, 101 aa, Homo sapiens
MAARPAQRDSTSTGDVGATQTSDAGARGRAEVAGLTSRRSQLARERRSQCTTYSLHKRISRRQNTPLTTVHSLEQLEALETSQLAEVSEVQISTFSRFSDN

SEQ ID NO: 942402 - protein, 237 aa, Homo sapiens
HERPPFLKSKPFKISYGNSLKELEGRVKRSQVFTRTHPPLHIGWHCHTAASDLLEYRPQHHVCYGEYIPSQPRSLPKNRVHGAENSGFFFTASLFELKNRNIYPAIYKVCFDSMLLAKQKEQGTCNVPFAFLGAQRLAAEYHLPFRHILPNSSKFQPIVLEGLFFILFSKALNKVLRHALERGVRVHSGQDPEVLKEQPVQHKQGEGRGGRVCVDHDVFEPPVIFPKHLIEVQRIGG

SEQ ID NO: 942403 - protein, 288 aa, Homo sapiens
TADTFLSFPMAAASSLSSSTFAGKAVKNVPSLALFGEARVTMRKTAAKVKQVSFGSPWYGADRVLYLGPLSGEPPSYLTGEFPGDYGWDTAGLSADPETFAKNRELEVIHCRWAMLGALGCVFPEELAHNGVNFGEAVWFKAGSQIFSEGGLDYLGNPSLVHAQSILAIWACQVVLMGAVEGERVAGGPLSENVDPLYPGGSIDPLGADDPAFAELNVEIKNCANVLNVFVKLRHGGPENTLTHRRRQQQCMSCNNVAASLRCLARGVSVLSVQRKCKASKKIKKGYG

SEQ ID NO: 942404 - protein, 84 aa, Homo sapiens
QAMLYLKGAQGRRFISDQSRRKDLSDRPLPERRSPNPQLLTIPEAATILLASLQKSPEDEEKNFDQTRFWKTVCLTGENILDYV

SEQ ID NO: 942405 - protein, 274 aa, Homo sapiens
MYLWRCRCSSCNLVCVACVSIAVYGIVVFSCLVACYIGRASMPILSDVVLIVSSEVQTALIECRLPAGANHFQREREEETPAYQGPGNPEESPKREAPRKLKTKDWGTKENREGRHNQQNHKEETENKGEDPQHGYYQTAFDRDEETAKASKQHRPKRHHSQTHGKGSKCDLNGRPREAEVRFLCYEGAGISGDYIDRVESPFSCSYVLTIRTPRLSPHPLLRPPPSAAPQAILCYPSPEPEEYMAYVQRQAVDSKQYGDKTIEELQDLGPQVW

SEQ ID NO: 942406 - protein, 208 aa, Homo sapiens
MICLKAAPNSAPAPRGPPRTMNKKDAAPMAPPPRGEEEEEEEEDEAVPEGPSPIQERRQNPVVHPSAPAPLPKEYAFTFFDTNEPACQEILFEPQNNIPELFAIVRQWVPQVQKKKEVIGNEILRRGCHVNDRDGLTEMKLLHYACKDGAHGVGDPAAAVRLSQQLLALGADVTLRAAGTNINALHYAAYFDVPDLVRVLLKGARPRV

SEQ ID NO: 942407 - protein, 193 aa, Homo sapiens
MDYLLMIFPLLFSGLPKELQKQQYEAQSSARKVRTEGEKPTPSPPWRLRRSKRCSCSSLMDKKYDKFCNLDIIRSQHITSTMYRKDLEALGPRELWRIYFPQREQTVRIDANVLAKKTRSAGIFAKQEKNSGLKTFMEKDWNNHKKGKDCSKLGKKCIYQQLVRGRKIRRSSEEHLRQTRSEPLRNSVKSSFH

SEQ ID NO: 942408 - protein, 166 aa, Homo sapiens
VSGTSTSVALGREEPETSIQRPNSVFLTICVSVTAPQIHSIGNPAFCPAEPVPGIKAEPDESYARDFHVIAGPQDSPFEGGTLKPEPFLPEEDPMAAPKVRMTKINHPNVDKLGRICLDILKEKWSPALQIRTVPPSTQALSSAPNPDEPLANDVADSGRPTKPKP

SEQ ID NO: 942409 - protein, 226 aa, Homo sapiens
MSLLDSGLALLLDEVDEPIGRSVVRGHLSTAIKLRLYFLSQLLSQLHSPLVKAVDVPDDTLNEILGLIHGDQGSKHEWCELGEHNRVGWAISFKDLMWQQPLKVLWTLARSLELLSGLLRRFSPHQGLCLGQEVGQEDLVMQTLPYGVLGLDRDEEVTGYHLGALVDELVKSMLAIGPWLPPHNGGCLVVHTGFQIGDVFPIGLHVALLEVRSKAVQVLVIGPMAC

SEQ ID NO: 942410 - protein, 107 aa, Homo sapiens
MGVAEELDQQWRASPDFKNLGPSSRVVAERRMRLFSQLGELACNVSGVAIQDRGIAGAYLAWMVQDNHLSSEASCFHWWVISAVTSNVATTNILDRHILDIEAHIVT

SEQ ID NO: 942411 - protein, 149 aa, Homo sapiens
MALHAGSAACVPQKRGSATPVRLHAPPLIQCHGDLIGTREPLAGGLAGLLSVSTPKHRCPLPCAFCWPLRAFRDCLRLGHSLDLRGATLFPRGSARSLFPCPSSGISGQPPFRRLSRPSPAPELQSFHDFGPLRTWCALRCQRPGPTVL

SEQ ID NO: 942412 - protein, 242 aa, Homo sapiens
MTRRVYAHHRPMVGRTIVISYERTPSNVNPPGLKTPLNGNALISLNINSVMFVQNRRRNWGMGMTNGDRHNGRALRLSSLDRVFPETDKKPPEMVVGVPLPENLSPVMLHFPRFRTIPTLNASTSDVPPAGEAMIHNGTQTLKHAPKTVRVYPPPYRHMKRGGPESHTAEMGCTADPPAPHTVFLQPHARTTTGPMRMHVMKQQNNGTEMPKAVNKKIGPVIKSDRSPHYTRGVSPDYAARY

SEQ ID NO: 942413 - protein, 144 aa, Homo sapiens
SSPSYEWLLRGAIGINIVKVVATIIIVVTTIILGISGAIPVGEIAAGLTGHGIMDAKDVADIGTVAVLEGGKEDELPYWIRIAGAGMGGDAGIDALTRPDQIIKGWVKEKDLIKQAERDTREIIARVVAGGRLKATVDTGTETE

SEQ ID NO: 942414 - protein, 276 aa, Homo sapiens
PRSARGPTFHLARVRSPLPAWPGLPGGRRPLAAPAFSRGGGQVGGHYCCRSRRQIPQPRSGWDRLGLGGWGGGSGDLSSEQLVFAARSLLRTLSLPAAARSRARWHLLGAARSPSSYIQAAPAPSTARSPKPDSPMYEDSYVPGFEDSEEEFNRIVNKKLISGLKGSLEEDRENTRSEVENKAQQKLEKAKHKPVAFAVRTNVSYCGVLDEECPVQGSGVNFEAKDFLHIKEKYSNDWWIGRLVKEGGDIAFIPSPQALESIRLKQEQKAREIWGT

SEQ ID NO: 942415 - protein, 157 aa, Homo sapiens
FWGGGKGQLSKTAKGTGKPEVVGALPSGLLFGLLTGILLLFCGGILVLLLLRDEVVHVALSLGELHLVHALACVPVGEGLPAGHGSELLRDALEELLGGCAFAIGCLEAWGVTDGCLVGGPFHKVAAVLVLPVLLIALLHGHPPPADSHGEVSAVAG

SEQ ID NO: 942416 - protein, 184 aa, Homo sapiens
FFQAPWKHHWAPERVPPVAWLSLRSQRRRFQQKTPKKKEVEAGALNPPLQKPGAERHKNVLQWQNPGAVTVQNKKAQGGGGSNAAPCRTASAPQHKRLPTVLQATPESRGEDFSYEELNGLLSPVVHVAVQPVSFHPSSQLQALVFLLHKSSWAILRYSRKSSIKVRLLSTNAFEALDLIKRSF

SEQ ID NO: 942417 - protein, 275 aa, Homo sapiens
ARLRAAADLGAETGPPPPTPPSTSAARTGGSETDGQNDGRRLQRPRDGERHAAGGDLIRSSGRAMDGNDNVTLLFAPVLRDNYTLAPNAIFLGPGTTSPSPLPPAPAPALGSASGRVRALASAPAPLDPGAHDQRPRGRRGERRPFPVPSALGAPSLPFWDTPLNHGLNVFVGAAVSITMLGLGCTVDVNYFGAHVRWPVGALLAAFCQFGLLPLLAFLLGLAFKLDEVAAVVVPPVWLLSRRQFLQSYVPPGYGDMNLSIIMTNFSTLLALVLM

SEQ ID NO: 942418 - protein, 100 aa, Homo sapiens
AVRKERTMKFMSADEVQASAYVVAIAAEQQPREPTEDHSHVFVATVGQLVICAQVTAHGGQVEAQELGQHLHHHPHQICSCSQAQHLLGEPFLSSQFHPS

SEQ ID NO: 942419 - protein, 69 aa, Homo sapiens
DKSTLPYKTQIITLTDEKQKQTAQANRNDNHTLSLHATAWKKIRIVGYVRLCRLSMVTPRFSVPFSGLH

SEQ ID NO: 942420 - protein, 80 aa, Homo sapiens
RLIPGSHIGEKLPRDLSQDTFSQSSHAQYVVPTPVNIIPEWHKLHNVSLSIFSPRGDSYITTIQFDHCIKFCRANTYHNY

SEQ ID NO: 942421 - protein, 87 aa, Homo sapiens
MPGTQGLPPGSHSVEILSRHRGTQTAPNLEGDASPEPVIDGRLVAIACRLAPGGNPVHVPVMTNVHGNLVHLCHPHKPVASQEPDYK

SEQ ID NO: 942422 - protein, 192 aa, Homo sapiens
MSGGRMAQVGAWRTGALGLAQLQLPGLGPGLEAAASPLSTPTSAQAAASPGSCPPTKYQCRTSGLGVPLTWRCDKDKDCSEGSYEEECRNEPWTQKRQCPPPPGLPCPCTGVINCTGGTEKKLRNCSSLACLAAEHRCTLTEDCIPPTWRCDGHPDCADSSDELGCGTNEILPEKDATTMGPPVTLESVTSL

SEQ ID NO: 942423 - protein, 115 aa, Homo sapiens
MVLFVLQDGGVKGPLLPFLRGQGDLAAKPPGEKGTRWVLGPVPSPQRPQGRAGVPPVGGFLELQPGDYLTTLLKEQKYDKIKRPSIGKERAIGGEPRPPPGEARKSQGPPLGVGI

SEQ ID NO: 942424 - protein, 100 aa, Homo sapiens
KRKKDKRSYGELLDKEQRGQGEHWKWHRGEGKWWDHRGWGSYWYVGAQRLGEQLDVGTQRLGELLDVGSERLGQLLDVGSHRLGGANSCTSSLRELVSSD

SEQ ID NO: 942425 - protein, 97 aa, Homo sapiens
MADFKPGRLPRITLRVFGRSSAQRLRCPDEGERGERGLGERAQAGPGGCGKPLTGRGERVGPLSISSRGGQLRVPNSESSDSKKRKQGSSDQENRVR

SEQ ID NO: 942426 - protein, 224 aa, Homo sapiens
SRLRGGPGCGIYILSGHWWCDPDDPGFVYDSGCPVALLYNPNNPCLVAFTILGDFISAQNRAACPRGKQIRRPPEVSGQVPCKGRTCIRSLAHRSNLGQPREDVNHKRHPVPLPPGQVLRMAQNPEARKVSGVGLERVPQSSPVEPRHVHHRLPAGQPYISLGDHQSNLIPFLRDIQPLVHTPLPPFPQGSCQPQPVPRHCIWHDKFIGLADSGSHFSQDNAGV

SEQ ID NO: 942427 - protein, 195 aa, Homo sapiens
EQDNKIACTLFKTNQALIKNIYHCSSNSTSNLNSKIWAFILHIMCQAWQRRTTSTRASKEKWPLTTKTGYPGGEGQLAAHPALCRAREGKGAACVPPGLPGWALVSHSFSVSGCGAMGREVHAVVQIRGWVLPALFGFVIPPQGICPARSHLQGLASYSSYLLLWLMGNQDSESYFSFLDKKQQQNTFLHTVWQL

SEQ ID NO: 942428 - protein, 290 aa, Homo sapiens
EAGAAAMLPGGRRGQLGWHSWAAGPGSLLAWMILESPGPAPCPDDCCPHCSSGLPCTRDGALDSFNNLLGAENIIDLYMENQQHLQHFELRDIKGLEELRNLTMVKSGLPFVAPDAFDFTARLIGMNVFFNAVEFLFWKNLQGLFLKELVLLGNLCTVLVPCAGYSVGGGGTGRSAWTEAAVSWAKPPGHMLNASCGVPTLKVQVPNASVDVGDDVLLRCQVEGRGLEQAGWILTELEQSATVMKSGGSAILGLTLANVTSDLNRKNVTCWAENDVGRAEVSVQVISPSR

SEQ ID NO: 942429 - protein, 168 aa, Homo sapiens
MMLWGGIQRMGSMVRLLHTVIVGAVDMPAHAKITNFDHQFLAHQIVACGQVTVHKMQIRYVHHPRSDLASHGQQLPQTQGAWSHILPTSQQLGIRSMGSEEAVEVPCRIYSKTMSRGRPRCRRRRSARGNGAADGEQLSLTLEVCRALSDASFSALTAPASCPAQGGG

SEQ ID NO: 942430 - protein, 344 aa, Homo sapiens
EPRPGHGAAAAAPAVPPPLPSAGTWPEAPAAARDPTPTLPPDPRPRTAVSLPGPAARAGEKRPGGQGGGRAREAWPGTGEKGAAHRVFPPFILAQKRLGRTGPLALCLLLLLHGAMPLGGGSRKKLACWLAGRAARTGRGEGGRQLRKKRRGGGGGGGGGGREKNYKVFPGLLEDLIELGPESSGIPATTGAVRYMEEECRESSGGPHSFQRAAETIEIRAQPEGRPTAVTWPPSVRFIGWCWLYGVEFWTLPAIRGTEFQAAGIKRDIGGKPREGQRPSLGAELAEEGARCETGRRSARWAAPEQIADPVGSGSPGRARGSSAKQLGIRVGVSAGLLPGTSER

SEQ ID NO: 942431 - protein, 103 aa, Homo sapiens
MAEDLLRVFVAVGGGGEDKQRVQQAYGDAVRALVAGAPDSRKATVGGHEQDRGKVTFQGPVEEGEALDVQHVDLVDEQHFRDELRLALLAPLSHLGINLLTDF

SEQ ID NO: 942432 - protein, 41 aa, Homo sapiens
MYREESSVYLGQGGLAEKKAVSTFMSPVRPGLEWPIVDISA

SEQ ID NO: 942433 - protein, 223 aa, Homo sapiens
DRVSLCHPGWSHRARLQISKKKKKGGPVTGGKCSQGETEIKGQKKKKQEGGRKKHEWEEFMEAGENHGGDEGKAHGRSPSGGIFVVWAHSAGHCPAIGVLHNENAFADRQPFHPIHLPPQGIINEDLEARRRVAERADADLAVGKRMKMIFEASELRDRLTQKNLARPPAWRKLARVVLGHVLAGGAADGVVMLELSHRLIEGCTVSGAIGSHVGRQPTSTYS

SEQ ID NO: 942434 - protein, 152 aa, Homo sapiens
VYFVDKGPLQEAVHKNNPTRYQRLENKSEDYNTTLFLLEDAFDMPTLIPKNALFHEGCPRPPHPHTTVDVVAYTHICRESPKLLLQRRYSTKSRFAFAVREAAAGLVGDWKAQFSLHNKRLFCAHVCQRHHDPAFLYCIEMRLISSADHNMS

SEQ ID NO: 942435 - protein, 83 aa, Homo sapiens
MVLVKLELGRYLVQHNDIFFFEEASGLANIHGKVHPEVHVLSPGLLDWVLAQHREDATVQVGLTSCLGIPGHSNDGGTWAVSG

SEQ ID NO: 942436 - protein, 72 aa, Homo sapiens
FLQGPQIELKVRKLGAGFLQALAPGPPPEERALRSSGEGVVHTGVPLEKEKSRQPTHGHWIGVSGFQATAMC

SEQ ID NO: 942437 - protein, 107 aa, Homo sapiens
HNFIPTIIQPVKIPKTIQITSNILAVKLPNKLDADQYSQVAIVSNDFAEMHKMDKPRYLRNQQAFIFFVPRLENAWKKLDQKTPQSNCYCPTILKILNIWLKNLLAM

SEQ ID NO: 942438 - protein, 153 aa, Homo sapiens
MLGESCCNAGNARLLLANEELEVTTSFSSTAHKYFSAKKWPSSSSFGGLLCWDVWSCEGRVSGGGEEGALEGTVMSLGLQESALELGGWLGRGGLTPSCVEPSCRAVLCAWAEGADALGPYGKLLHSDAFPAPRVVDDTGNGDTFNASVIFSS

SEQ ID NO: 942439 - protein, 52 aa, Homo sapiens
MAKPPQTHSQTCIRNSVTCINYPRTSTGRKGTTTQRIMEPVEPEVEGTEQDN

SEQ ID NO: 942440 - protein, 123 aa, Homo sapiens
MSAKNKRDSTFGVGSWYRWDSDTRWFMLLSASVNSISSMPSPVYQRKGLRRNMGVNCSEMGLNSWMAVLFPMKVEDILRAGGMHTATFTLLGIDSTKYFLLWMASICSSTSFMDMRPRNTVTS

SEQ ID NO: 942441 - protein, 55 aa, Homo sapiens
MTKAALVSDLSLRQQNANARAAHPHARSGTQLLTKLREGGGLLTPETQKLSKMRR

SEQ ID NO: 942442 - protein, 282 aa, Homo sapiens
MSASPSSSSASPCSSAVVSWYCWYSGTRTFMWISASVNSISSKGSPVYQCRGALRRNMAVNCSEMRFNSSWLAVLLPMKVADIFRPRGGMSHTAVFTLLGIHSTKKLLFFFCTLSISSSTSFMDMRPRKMAATVSSGRGAGLQAAIMFLESNICWVSSGTVSARYCWLPRLVRGATGHEEVREMYCLMFTASLPRSAFSWSGKRTQVVTPLMVADTRRLRSPYVRGGQLQGAEQMSYRASLSMEEVSSVFFHQLVDREGGVVGLHTVSDTVGEGMTLNVFMM

SEQ ID NO: 942443 - protein, 345 aa, Homo sapiens
SLQMTCCRGLMFSHNSRKPKEKIISSKNRKLPTKKILHKLKMNKFTGVKTNRFQLKTSSSPPRSGQTHQPRDATAAAGLAFPTLTDPQDKTPGSCQPLEKSQNTQPWHVIFLHRSEAAGHTDSPSHSFVFHKLVLFLATCAKPHVLEVDLKDMYLVLNKYFGEQLTSIQGQFLQQVLQSSADIRYKLQGQFVFEGLFQSREGSMRGVRWRGANFYSQLTHESNATHLLSPFEKHFLWTLEGPDSSYSCLLIHICWKVDSEARLEPPIHTEYLPSGGAMIFIFMVLGARAVISFCILSAMPGYMVVPPDSTVLAYRSLRMFTSHFMMELKVVSWMPQESIPRKEGW

SEQ ID NO: 942444 - protein, 269 aa, Homo sapiens
GEGGKGALGGGERRVWGARWLRGFRHCWVGGRRAPASDSSCEQLHLGPWASDSSSSSWYMWGSWWGVASWYCWYWDTRSFMLLSASVNSIWSMRSLVYQCRKALRGNMAVNCSEMRLNSSWMAVLFPMKVEDILRRRGGMSHTAFTLLGIHFTKKVLLLVWMGSICWCTCLMDMRPRNTVATVREPAVARVAGGHHVLGIEHLLGELGHGQGPVLLAAPGCEGGDGAMKKCRRGKGTCCRQLAQVSVDWPGKRKEVVTRYGGDTGGEVP

SEQ ID NO: 942445 - protein, 287 aa, Homo sapiens
PPPPVTDAEVTPPPQPPPTARRRRRLPGDAGGRRTAEVPAGSARGSVLGRRTALRPRSDPGPAGTPSTPPPPRSFPPPLLWRARSLPRFFTFFSSLFPLPSPLFVSLFWVLAIPLNLPSQPSLSGYALSAAPAMKEEGAGAVAAAAVRRGGVGLAEIKLKSVQSSSGSLEGQTSWSQLFKSPNPGSAAAARSLLNHTPPSGRPREGAMDELHSLDPKRQELLEARFTGVASGSTGSTGSCSVGAKASTNNESSNHSFGSLGSLSDKESESLALLPRLECTGTISAHC

SEQ ID NO: 942446 - protein, 130 aa, Homo sapiens
MFMPGRVGYKVRELVLVRFTVPFSQKTLFGISWSHYCAQHSHGGLLWGHRKSREKITVFGALSMGGAKQGTTRGTFPDGNQGSHPVGAQHRWDGKTLDRGQRPRPQPPHQPAPAQASDYLETVGNQCGTD

SEQ ID NO: 942447 - protein, 218 aa, Homo sapiens
MAFMSLSASVNSISSTALACVVEVGFSLGEGSGMVRDELEELLGGCAIANEGDCDLEDTRWDVTEGCLDIVGDPFHKVAAVLVLHVKHLLIDLLHGHPTTEDSSHGEVSAVAGVTGSHHVLGIEDLLGEFRHCESSILLASTAGERGKARHKEMETWEGDHVDCQLAEVSIELARETEAGGDTLMVAEKGGSDPRSWVWSASECGKAYHRGPRCQCNR

SEQ ID NO: 942448 - protein, 243 aa, Homo sapiens
MLAPPYTSSSASSPKSSSSSAVASWYCSYSEKESFMLLSASVIFILFIISFVFQWGLEFEEDMGVNCSGMSLMGSWLAVLLPMKVTAILRPRGGMSQTAVLTLLGIHSTKKLLFLFCTLSICSSTSFMDIRPRKTAATVRYRPWRGSQAAIMFLASKTCWVSSGTVRARYCWLPRLERGAKPGIKKWRRKKGTMLTANLRRSALSWPGKRRQVVTHSWWLRQGGSDPRSLVWSASDCGSRYHR

SEQ ID NO: 942449 - protein, 71 aa, Homo sapiens
MESKPTKAKLQTPKGVATFFGGVGANELEWGSSQEVSTPPPQDEDAARDGAQAHTTLDTLPSDKHTCTHTH

SEQ ID NO: 942450 - protein, 89 aa, Homo sapiens
MDEKLEEAEGEGAQEWVALTDDDEDIQQEQDGCQSEAHSLHRVVVIVKWVRFLRSLCGGLGRGRHAGPEQGAAGCFGGEGALQQLEQGR

SEQ ID NO: 942451 - protein, 165 aa, Homo sapiens
PWASGSSSSSSFISPSSSAVASWYCWYSGTRSFMLLSASVVSIWSLHSPVFQCRGALLRVVAVVCSAVRLFSSWLAVLFPVGVVVILLLRGGMSHTATFTLLGIHSTSELLFLLWMESICSSTSFMDMRPRNTVATVSTRPWRGSQAAIMFLASNICWVSSGTVR

SEQ ID NO: 942452 - protein, 203 aa, Homo sapiens
PLPGYRPGKPPTPSLSSSAFPNPSRGDIYASAAPSSSSPSPCSSAVASWYCWYSATRSFMWLSASVASISSMPSPVYQCREALRRDMAVDCSGVRLASSWLAVLLPVTAAGIFGPRGGVSHTAVFTLLGIHSTEELLFLFCALSIYSSTFFMDMRPREMGAAAVCGVARVAGGHHVLGVEHLLGELGHVSPRYCWLPRLVRGA

SEQ ID NO: 942453 - protein, 103 aa, Homo sapiens
MVAVVQLRFKHLQVAHLEGRGEWDLKVHGNGGSSHFFLSLVGRSSISALICDSFMPAMRLIFHTMAFSLALYLAFPFMQITCTPLVFSGVGISPRSFEPAVRV

SEQ ID NO: 942454 - protein, 255 aa, Homo sapiens
MSWYFWYSVTRTFMLLWASVSSISSMRSPVYQWREALGRNKAVNCSEMRLGGSWVAVLLPVWVAGIFGARGGVWRPAVFTLIGGPLLGVAAVLVLRVELLFVHLLPGPAAPVVGCFCFVAAVVWVAGGHHVLGVEHLLGELGHVSTRYCWLPRLVRGAKRGMKKWRRSPGTMFTASLLQVCVQLAREARQVVTRSWWPTQVVEVPEEGVVSFRVRKRCHTGPRYQWSRFICVFHQLVDREGGVVGLHTVSDPWVR

SEQ ID NO: 942455 - protein, 239 aa, Homo sapiens
MTNSSETGLPPRIKRGGAGWGLGGGGGGGGGGGGRASASSRRGHGVVDTHRNWLVHIKDSKATQRGGGGDALNTQGRERAKINNGSIIQKARMEGQRPALDQNGEQAFPSAQQTGMRWERVGKSKKGARGAEVAWMVQDNHLSSEASCFHWWVIFAVTSNVATTNILDRHILDIEAHIVPRKSFTQSFMVHFDRFYFRCNVDWSKGDHHTGFENTSLHSANRNSTNTTNFVDILERQAQ

SEQ ID NO: 942456 - protein, 109 aa, Homo sapiens
DPLLVPPPKEPPPPPVPRPPVPGPLPATPSLPPPPQPQLQLRVSPFGLRTSPYGSSLDLSTGSRLDPKAPGPPGAQSPPSATSTSSSSSSTSSSSAQPTLPRGPQGPCL

SEQ ID NO: 942457 - protein, 68 aa, Homo sapiens
MLCRASHSSLVMGFMAWDSGLLLIRQGWAILFLPQLIGATGPARGPAELHLLCFRLLLAFFFSFFSSS

SEQ ID NO: 942458 - protein, 206 aa, Homo sapiens
PSPTLALLGILPLHAARAATPVERREKSDVLFEMQAEKPGRDVHHLLADPGLEGQHASLVDGLGKKQQEVLGLQAVSLRYLLSSGPGCNLASSCPHPAPPCGPAAAAGRCLRTDAVGPSHQASEFPGGLAGLGQGKFDPPDLTFVPEPILADQLQLLVETRFLEGSPRGHISFATNPAPGHWHVGSASPSALMETRKARATIQPKP

SEQ ID NO: 942459 - protein, 123 aa, Homo sapiens
LDARSIYQAFIVLTSTVYISALQSVLRIEALTEVKYCLPFGLCATTATVEKSKLLLIPGWYVHEHHVGALGVGEWGIIAESEISTDYISSSLPALPHDLYCLSSFHLKTGNCRDGQSRLKLKK

SEQ ID NO: 942460 - protein, 89 aa, Homo sapiens
MAWAGGGPLSSLYKDCTQDLDDQATTSSGHDEGVVLPPVPAKAKIGYCIRGVDDIEQGLVTINVDLSIGQPSHDGLEARECCSRRFMVR

SEQ ID NO: 942461 - protein, 285 aa, Homo sapiens
PNKNAVRRQAPTCKPKPVLASYKRNGQDLDNDNDSINPPIKNRPKQTLLSGRQAPAQAQTSDLVPSLFPLGLWAPGFCTWSSPDEDKRPRKPVPGTGNRDSGTRRRLQDATEQDPRPGNDVASAETAGPPSPSGIRAQDRAPRHRRAPPARMPVAPAPSADGGERRARAGRGTRVGGWGPKTHLSNKIPTDPGRDGDLGAPRRPELLHISTPPPEPLQEQGGGLFHRTRSVYNGLELKYLDESGEAVRGEVPSVVFLGQLTSLGFHSARAWGCWTWEKVVVVAWE

SEQ ID NO: 942462 - protein, 145 aa, Homo sapiens
MAAKLLTQKALYSNGAIAEFRPPNEDVDHNLLAVSALLLGILQHLDHLILVLPGEQQAPGPQTHGCLVIISVGQATGHVAAQKHLFPRDLCPASIIPYQGHHWDLVSDECIKFYEAVAKNSVPKKEDLIWAAQLGPKFKCCTNSQ

SEQ ID NO: 942463 - protein, 127 aa, Homo sapiens
MGGFLLGLHLQDAFHVVLVGELRSTPAQCDQNRFHTSLAGPIEVISAAAQLLVVHVRTEIHLLGVDLHDFRPGLLIGHGELYFGVKGREGGVQDVPVCWNYLNLGVGLEESNWFRSSSIVLTFRSPF

SEQ ID NO: 942464 - protein, 147 aa, Homo sapiens
LLVERVQLLCKTGWKFLSKLFLSYRMTQQVHLWVYALEKQQPASSVHGFTAALLIVAKKCSSAAEETNCGPTLQWNILCPPKGTKPLTPLTAWATLENLMLSERGQLLQATYVQFHSHEMPRTGKSLETEIDELLPGAGGGRMASDC

SEQ ID NO: 942465 - protein, 122 aa, Homo sapiens
GGDKAHCHSCQELMPKYYYFNEEMKNIHKPLASKAVTATTKGASRGDSSRLMLPEEETLLSRRGDATLDLPGDCVMISAPWSTRVFEYFLKFNFSVFFLFFPPPGSCWAFFCISIFVWAFFL

SEQ ID NO: 942466 - protein, 185 aa, Homo sapiens
MLPLKWGRHGNLREVLFTPVAQGQGKDKGEGKPKAKVCVGTTQLSTGCSFSKKGAREKHSFASFCWEIIALECQPVEGTTFQKFKGCWLEKGEFWIAASSQNPLLSPEPASWCVFSSKLSLPNLSSSEGKRESVPGFSRVGERTGKGTDILARVKLLLALACPLFRNSGPRRLALRLSTLVLGEH

SEQ ID NO: 942467 - protein, 104 aa, Homo sapiens
KGKSERGRWGDPAPKDFRKHSGAPDLAHIQRVGRGRDLAILWAWRAGGACYGGKERGRTEEEWSPISSRQFQKKGVYGDLATREGWMQDGIPGSNRSLKLWIYS

SEQ ID NO: 942468 - protein, 93 aa, Homo sapiens
TRTPPPGPPPAIFSRVSYPTTTGPAEAWKRREKHNFVFERGPPPHTKHCRCSRREKRKGGLGGTLAWDPPNLEDSPPPAPPGNWGEGVSGGPL

SEQ ID NO: 942469 - protein, 248 aa, Homo sapiens
RGHRTQAPCLAGPDLVTGPWEGRARGRGQGGGGLAPEAPGGPLGHGTVCVEGGGREHHGPFLPKAKGGGASKAEERASWDRVPIPCWEGVPGYPIKALQMQTVGEEPPSLGPDCLALPLPQLPLWFGGGEKGLGPPLPQQTPARNLTRRAEARKDPLPLLWAPGVLLARPPPVLLAVANKEINSVAAPPLQLGVLLLQGAVESGDDLSSAAELRYLVLRSRGARAARELSPERAGAARLRPARPAHAH

SEQ ID NO: 942470 - protein, 143 aa, Homo sapiens
FYNPSFFYLSFIPFLPPPLFSIFSLFKPFHAPSNPFPFFTSPSIISPHSQSIPPLLTFPLSPIYSYFYYFHLIYIFSHFLSHLSNHYYLISNSFHFIHFLSYLFNSVMNVAFFPAYYLFLLTFLHSFSYIHFQNFNTTFFFKY

SEQ ID NO: 942471 - protein, 90 aa, Homo sapiens
YNGVKASSSSSEPRLWELGSPGGALAASAGNPDKLFKVHSSIPIEVQISDNFLYVSVSHLMTQELPHSLSQNGYFPITIGVKLSESISKI

SEQ ID NO: 942472 - protein, 202 aa, Homo sapiens
MTKLWKEDGEKLYCGVWQNEKTTKIIMSKKFESLQGAFHFFSMLNPHINPAEGTQAQTEEVTYPESHRQKPRTEAKTFNNIKLSFYEEVGADPPSRSLQGSPRSGQHCGDAGEHNMFKDFGDGASALQGQGLVAGKRAGTKGLQRAAGTQARQAAGEGSLKLLPEFATEEVVDDGVGSAVGRYTSQWEKVKQAYTASRSLAW

SEQ ID NO: 942473 - protein, 143 aa, Homo sapiens
MKETHAHECAVVFEPYTWLSSSRGGPGGSVCSSKPLPIGALFIFPAWGANICSTRSRQEGLQHAQPDHTVSSSLGKGDGRGWRPPDVASFQPLPLGGSSKEVVRCIFVPTHTAGWRRMNRSPAHASAPTLAPQGFFSGNKETK

SEQ ID NO: 942474 - protein, 110 aa, Homo sapiens
GELWSCSHFGGPFLGVLPVPWKVQSLGSSGSGEPNLRGQPLVAALGHCCSGWAAGLDFIVHMFPPHKSNQGMKIFGKGRAGLGSLEEVAGGRGHSGLPRGWQFLDLDGVT

SEQ ID NO: 942475 - protein, 147 aa, Homo sapiens
MPSHAKPHHTHAPAGGLALEALCQPKLLSFLGPHPQEDMPLALACFWDPREPKGKVPLPGAARLCPAHSNPGASKTCQGNQGSDHSPFIYNPASPTGINQKKKSPHLTASEKPTWATTCPKKHSSVTIDHLPQAGFIRNEAGHTWDL

SEQ ID NO: 942476 - protein, 204 aa, Homo sapiens
MGVPFLEELVLRKEHGLNDVTAVVEHKEDVLSVHSAGEMRVAVETPISTGSADPQKLISNEVLGPGHAWVLSGLGSSILRSSVASKFWKVVLNLRFPSKDFLSEQILLVEEQDHRDGAQHSVVPDALEEVQSLLQAVGLVVLPDDHVVAAAGHHEDDGSHIVEALDPLAAFIALATHVKHVEVDFVHLELGLKDSRSQDTAARG

SEQ ID NO: 942477 - protein, 266 aa, Homo sapiens
MAGAAETRGAVEGAARTTPSRREITGVQAQPGEATSGPPGIQPGQEPPVTMIFMGYQNVEDEAETKKVLGLQDTITAELVVIEDAAEPKEPAPPNGSAAEPPTEAASREENQAGPEATTSDPQDLDMKKHRCKCCSIMLTLATGLLSSHTTDDDHPSPSLLLPTLHPQPHGSTTWRLFTCAFRAFFRWKEGQGPPPVTTPQHSPRTRAVHLCLEERDRTDALFPRQGPPCHGSFTDAARATGVLAGGTRGLHAAQGSLPPSGPRTC

SEQ ID NO: 942478 - protein, 102 aa, Homo sapiens
MSGGGAGGGGGGGGRGARQWRGTRRMFSVSTVQGKRGELEGSPSPRAGLTLRNPPREKDLARVTRGAASGLGSSILRSSVASKFWKGVLNLASSQQGLSQRA

SEQ ID NO: 942479 - protein, 126 aa, Homo sapiens
LGLKKWGGNPWGISPQEVGASYGFRGDISNIYEPWALSPCSQHGPHTRSLRLTWELVKNAGSPRSIELESVLRRSPVIFIKNKVCKEKLKNSDCRNEEALGGVVKRNGKGGCEEGMMKDMEKGRRP

SEQ ID NO: 942480 - protein, 138 aa, Homo sapiens
VGGNREFPQTDMTVTLCPEGTIDSPQEPKPPPPPPEPPARCLPSVSGSELWRVVSSLKHVTFQFIFSCQVYLVPEPGSKASPCRKHQTGAEIDKATHNSSCHTAVVPTSSAALQGPHSTLTTHEEPALLAPFHWTGRE

SEQ ID NO: 942481 - protein, 200 aa, Homo sapiens
GTRGLRARVPAAASPGPASRAPPRPLRAAPSAGGVFVCGGVGGERESAQPPSARSLPGRVGASPHPPPPPPREDALARAARTAPGARARGRSHMPDPQPREQAPPPPPGGYRRRTSSRPAAAAPERRGEAWAAAPLQEGAEGKEARSTSEEQPDREQEKEGRAGQADIEQLESLRPDSPLHLATTLGDLECARVLLAHGQ

SEQ ID NO: 942482 - protein, 266 aa, Homo sapiens
MSVNMDELKHQVMINQFVLTAGCAADQAEELLQAAHWQFETALSAFFQENKTPYSKDKNQMMCKGANTPAKPPNFAEALTMFFSVKDVRELPKRWKTMAAKERKIRKNFSMQPPEALRSSWNKEAWNPGGKKKKKKLWKKKTYEASEWKKFEQKKDLEIREHTAMEAERYREAPPPSRRPGPRGAGERTSLRAPFTPFLSAPLVPRSPGGESADSSQAGTRLVPEHAAAHTQGHGPSGPGTWSGSERPGCLADRTSETRSFLRNAL

SEQ ID NO: 942483 - protein, 283 aa, Homo sapiens
MRAQVRPAPPLRPPQRLPSGLPPGRARLLRLAGLPRTGAAQQPQNLLEAAAAWAPTPPESYARASSLQPWRPGRRGSGWGRRGGGVGAGRLRSICARRAGAASAAPSLQLCSPPLWGGPGSFIERRACKKAAPFCSGALDELEKPPECGAKKLRSRLQSRYAGYMRPDDAKVAGNVHGGNILKMIEEAGAIISTWHCNSKKGERCVAALARVERTDFLSPLCFGEVAHVSAEITYTSKHSVEVQVNVMSEYILTGAKKLTIKATLWYVPLSLKTVDKVLEVPP

SEQ ID NO: 942484 - protein, 211 aa, Homo sapiens
EPVVGGGSLGLRLRVALSLRLHVQVPPFAFLKALLLVLGVGDQLGQRQRPAFLAQRDVGEEGTGPVALLRAVHKRVGVKEDIDFYGLIVREGNASRDGDDAAFFDFVMKINGVHGSCDDVGLAVWRRFKETSSMSFMVTPPCTKPCRVQSEGPTRWIKLDWLELTVFGSGLRTGWTMSPFLHLVSMRSSFWASYRFRPSSSSPCREYTTGG

SEQ ID NO: 942485 - protein, 128 aa, Homo sapiens
MGLCHYTKGLTKFITHFLASSRPPPPGPQPPLFPSPSSLVAPCGGPEEEEVFLLFGVFFCGEGLLGGVGLGEECGGGGWGGGGGWGGGIGGGGGGVGGCGGGRGGGREGGLVGVLGLHISFRDLFPFF

SEQ ID NO: 942486 - protein, 152 aa, Homo sapiens
VIQTYLKCYIDVINITKKEKKSKKQHSRPPETQRTPKVDHASFLPLPGYGPGEDPTASLSSSFSKQSRGGIQALLSLSSFSNSPCSSAVVSWYCWYSDTRSFMLLWASVNSIWYMLSLVYQCRKALRRNMGVNCSEMRLNSSWMAVLLLMKV

SEQ ID NO: 942487 - protein, 188 aa, Homo sapiens
MLLSFHCKDIVPGGPPPPRFRPPAFPNLSGGGIYALFSLSFSSNSPCSLAVESWYCWYSDTRSFMLLLASVNSIWSMLSPVYQCRKALGGNMAVNCSEMRLNSSWMGVLLLMKVADILRGGGGMLDRGVFTLLGIDSTKKLVFLFCTLSICSFTFFMMRRRKMGATVSSGRGAGVEAGIMFLESNICW

SEQ ID NO: 942488 - protein, 270 aa, Homo sapiens
MEVREGPGQRRRRRGNCSLLPRIQFRGKKAVWSKKQGMLGRAETKPLKGPARYPAPTPARLCFGDARSRGAARVSSGDLGGGDLSERGEAGSRARSAIRGLVDEGQVLAGIIQGRGRGEGRRLSFVVGRRGSGPAQRLRWKGRGGSSGCSFSGGGEAAAVRWVTRAVTVPVELAAVICDVPISSRFQWDTTRSQFPMVVSTEAEVSQAEQDPEPHQRLKAGESCLGVRAGHIVAKAHGGKRHYDKVDGLQLALVLHIAEHERGREAKEQA

SEQ ID NO: 942489 - protein, 209 aa, Homo sapiens
MGVMEDMGVGWSPHLLTLCLHEHRHMQVPLQKQSQGSSSHKGKGRNNSCFSVPHKAAVSHFTSCERHIRALGTVTACSLRVAPSFSISAVPPPHSSDSSSDSSKENQASNDAHDGEVGWEDGSHLRVRGLGRPSCCTWQVYLCSSPECTTTAAHFWKVPSPGLVSTSSVSWVWSSPSRQVSVISAGRSPGPSISEWPHGQRWGGGSYVS

SEQ ID NO: 942490 - protein, 203 aa, Homo sapiens
ESTRFNPHIFLRAHCGLAISGAGLSSGLEHEAFEVKRLKTFLELGLRRDDWILSGRNYAETLKFQEINMVQNSNCSSKYFRRSATTAEPSLLRGIGSAMTDLIISSLAHKRFTLGYARGVCGGAGELSPTRRGVGEFSILDFSTSVKNGPRRGRGAFGPPVFLGLSARSPACSFRFGRWVTLKLSTCWGSSLTNTSLKNLSCC

SEQ ID NO: 942491 - protein, 197 aa, Homo sapiens
SKMNSFEATMSSNSSALNLEKPHFFEMWIFWGPGKLNFALLQGLNQMLLVLQLGADGHDKLNNVNPGHNTLGLSKGTLHGCFLLISPSTGQHLVDADEVGGVVLHPDIEAIFATTFYHVLIGTNFFSLQGFIGQLLIFICYHVATNWKLIHFFFFAPQVKNTNFGIRYTSAEARFWVRLVLTISVTTGGAAAMATPG

SEQ ID NO: 942492 - protein, 179 aa, Homo sapiens
MAHTIVTVWGYGSPGGCPDDRGECAAAGRGPRSGFYLPGQAADIRVEGGQRGPGRLVLPGSLVMQAANGGLRVGGVLLVQDVVAEVLRVFHLPPLLSFWGELGTQLLGAWRGELFMLYDWLLGSSTGVLLRGKPGLWSDRMFFLNGPHGDKGFLGEREGRRERARELCCPEARAAAAAC

SEQ ID NO: 942493 - protein, 329 aa, Homo sapiens
EAKEAGQKEGTGREEAKGRGEAAGGGAAGGGGGAAGGGAGAGGGGAAAGGPTRGGGGGGNTNSSRRAGRTDHRRRAGNRRRRSGGGGEGRGGSSGRSHPERGRPGRAKKGGPAQGRGRGGERQQEAQGGQGGRREDAARERRAGGAKGAGERGAGQEAAKSGRKQRGQEEEGRDAGGKRRDAKGRTRQRTPGKHGQAKGRNGPQAHQEQAAKGAAGGQEAEEGQGGGGRPGGDQEPQERGGTGPGAGDGDGGAGGRGQPAGAERQRPGGEQARREGAEGSKTAAGGGGEPGNGSGNDQRKDRNGRKTRTGRQDQGGEGGGSQGRTEGGA

SEQ ID NO: 942494 - protein, 98 aa, Homo sapiens
PPGAGGGKIKSLFPPNQPQRGPGLRDAAAAAATSVAEQPPPKPTVIAAPNSRRWLWSVLAAALGLLTAGVSALEVYTPKEIFVANGTQGKADLQIQVY

SEQ ID NO: 942495 - protein, 191 aa, Homo sapiens
ARAPFLPQKELWWALGIRLHGFLVGEEAWGEEKDSGTVSSPCAGVAEGLLCPAMGTPGSRGRSVRVGCISILSRCSVRAVCGWCSLCLLSSCSRARVEEALVLTQKWGHSGSGELLIRYEGFIPPHPKSSRSTTGLPVQVQEKWQGFCDQPAVPILVGAAVSRQVEDEKALGELIQLQYFYQVLRKVQKLE

SEQ ID NO: 942496 - protein, 249 aa, Homo sapiens
ERSGAGAARRQGGGAPTESGGAEKGEAAGKKGTGPAGGKAPRRPERGNGGHTNGRKNNRQPEAGREGAGQQDEGGGGGDGQSGGAKAQRARGGDAPRGPGGGGKQGAGRPKGGTNQNRAPGAAEREHNPKTRRQRGGPGGRSPYQHGAGRKGSGVEEGAVNGAVWEGKRKVIGGKKTGSGSAPEETPSLESEQKGEDPAAKEAGKGKRRNRRRSQRRGPGSSEKEEKGSSKAGRNSPGKDAAEGKQAEQ

SEQ ID NO: 942497 - protein, 92 aa, Homo sapiens
METPQWEPQRFMLLSEMAAMRIWSKARVKKAAKVLQKGTYLLRVAQPTAMLTMFLLSNVALDEAVRVLFFEDFEKVEFLVSHPGRGWVTGMA

SEQ ID NO: 942498 - protein, 289 aa, Homo sapiens
EVPPARCRVLPAPCAARAEDTNGRYSPARPGRSVDGAPAPRGRALKRAPEAGAAARRRRRRCGRPSGGRGCGACKTLDRSFLAAAAAAAAVAAAERDPSRSPPSPPERRRAPGPRRLGRGRALRSARKGSASCWADERGQDASRERPLLLSVGRRRGCARFIPPAGRLARAGARAPGPVAQSHPCGTVLSLSPSYRKATLFEDGAATVGHYTAVQNSKNAKDKNLKRHSIISVLPWKRIVAVSAKKKNSKKVQPNSSYQNNITHLNNEKLKKSLSCAKLSTFAQPHRPA

SEQ ID NO: 942499 - protein, 161 aa, Homo sapiens
MGGGKNQMRAFGRLVFPMLVLLPSCCIRWSLLHSKPQKIFLYMACGFVRQYHISSSQFSQLVLALWVLELPCRTGLPETFVRGRRMPDTVPGNWEAWSRLDAASLSGASRTRLGSLDKCPLLTQRSKSPIFQLPLETIWCGGPNLQVSSWSLAPGWNPYGC

SEQ ID NO: 942500 - protein, 187 aa, Homo sapiens
CSPTTQSSPPFCSTFSLCPHLSPENPLFSQRKEVRGTLSPPLPKKKKQKNPFPAWGKHEGDGPPGWPWSCCCTSWILVAQAVRDRNLLRDDRVLQNLLTIQERYLLQLHRRQAVQKDIQSYMSRMEAIWMLEVLCRNRIGINMVLALLCHGMNLVPWAGGCGCPDFRKCPMLANCLGVSVLAWSPGS

SEQ ID NO: 942501 - protein, 116 aa, Homo sapiens
RGHAEGAKRKAKKRRGGEGRQETRRGGGGRGAKKKQQTAKKEYSALLQPLPEQPKQCPKAGEATRAQGNAHKRTATPEQQQAEASWLTGRAEMARGGKRKQRTGRQGACSSKTKHA

SEQ ID NO: 942502 - protein, 227 aa, Homo sapiens
PSTDPTSLSADAWSHPGLDTTSHGPEAGLQFPDSLGPLGLLLLPLLCSSQGQGGPASFPTPPPPHAPGSLLYMKGLPLTSFCGGLICDFLGGPARGNHYTPIRRCCCYCSKFGCRTCCWLVMTRRMLLTKLPWSSGMRPMKIFFYEEYRSISTRIYTMLCRKSARSRRKLFMIWHRLFSVSRSLVKWNWTRREFRNSGTRVVSSCCGDELHVQLPWPLLGPQDLPLV

SEQ ID NO: 942503 - protein, 128 aa, Homo sapiens
FWSSSTVSPEPLDGQRKEEKDPASPPPPPQSLSTLTTLLPPRCPPACPARQTRQGSLAKARGLPRPSPPYQVILSPPDSHTLSPPPQYPSPPPQQKAHPVVPHSVELEPEEEVKPTFQKDRPTMGHKY

SEQ ID NO: 942504 - protein, 141 aa, Homo sapiens
PAAAISPLGLGSRGGELRAPLGQTELGRCLPVRAPRGPRPQSAPRAPCRGAEPALGLLGRGCLGPPGPREAAAPAAAASRPPPAAAAAAMGCLSNSKMPGPAQRGEGAGEANKRTDKQQKDKQYRATHRLLLLGAGSGKTT

SEQ ID NO: 942505 - protein, 275 aa, Homo sapiens
LAGRGLLRFCLFSSFPLPSSPPLASFPLCCPSASGVLPSLSSAGLPSPAPALPALRPPGPFLPCPFPSAPPACFLPACACGRAPGPGRGALAVPALPLPPVVRWWLSGALVSPPPVSPASPLSLSVRSLCFFLPPPAPPPFLSASPVPRACPSLSSLAGPPRLPPRALALPGCPRSGLIRLPAPPLASPPPLLPPLLPASPFWPPAAGAVGRCSFPPPPPPLGVSPFRRRLGVAAGPPAGPPAPPVVLPPSAGLLGALRPAARPPSGSCWCGPFL

SEQ ID NO: 942506 - protein, 82 aa, Homo sapiens
MASDEGKIFVGELSFEINEQLLEQVFSKYGQISEVVVVKERETQRSRGFGFFNFENIDDAKDAMMAMNGKSVDGRQNRVDKG

SEQ ID NO: 942507 - protein, 201 aa, Homo sapiens
DRSGGHCENFPTATASTWRWRGDSLKAERQGARKSCVVSSRANPCRVGGCWGEVGALVLGRLGDGLGAGLGLGKRSTHEGFVVGGFEEREEHGGMGLYEKKMWHSCTEWACDEDKEQFGGEECAVEEEPGDIHQWDGGGLRVGVFGWEEGLMGFGGLDGDKGVVSLEEEGGCGVLENRWRGKEWRKNGKGVCGRGKWLRFW

SEQ ID NO: 942508 - protein, 252 aa, Homo sapiens
SFPFLPPLGRFAPPPVAPSVCWFVAFGACFPGSVSRFSLPVPPLLLLPCSAGCLLPFFFVRPFACPRWAFPPPPARSSPSPFACGSGVCSPELLLPPPPRGGGGGAGSLRGGFGFGGGGAPGASPRPGPSLPQAAPLPWACFLLPGGWVGAGGGVGAPRGGAAGGAVGFGGLGGEGSLARSPPPAPAAPRALVRSRGPARPLPLPLLLLLRPSGVAAGPPASVSVLAAVRVVVARLAVLPRAGLAPPPLPFL

SEQ ID NO: 942509 - protein, 66 aa, Homo sapiens
PPQQSNSKGGKANGFPHKSSRLKWLCYQNLYFCSVMSIGARFRYSRRKRNARCGRLFSNSGPCVQN

SEQ ID NO: 942510 - protein, 70 aa, Homo sapiens
LPKKRDKRKTTANLMSIQTVLNEEQPEAEVGISQKDSKPEDSGEGKKESLESEVVEGLQNAPAGPQVSKE

SEQ ID NO: 942511 - protein, 132 aa, Homo sapiens
MFASQIMVSFSGLSHISTFFDLFLILTAAYPDELKWLDATVLSQDGCKASYPEREPDFDWGMKPSGCTLEFSSSLRFVEDAGVNARQLRAQRPTADLSYWLLCENALVSSTMPTKFANLFFLQRSIHKGWNE

SEQ ID NO: 942512 - protein, 312 aa, Homo sapiens
ALSSAFAAAVLPRRRAPPGAAGGRAPRLPRGAPLSCAPLVPPPACPLRPAPPGVPRAVRPPPPARPPGAPGPPRGPGPPGRRWARPLAPALAAGGPGRAAAAARRPPPGPCPAALGPGRPCPSPPPPPPAARPPGPPPSRCPPGAPGSWGRGGGRCGCPWGAWGPRSWSCAPFPPLLVAGGVAVAALALLLGVAFLVRPPSSLGARRGARRPFLSRPAAARACRVPPSLFVPPPLPSPPPSAPPPPRPVPRPPAPPPAAPGLPPPPGPPAPRLRGPPPRLWGAGPLGPGRPAGPVCGPPPWRWVLWAPGLVA

SEQ ID NO: 942513 - protein, 295 aa, Homo sapiens
PPPPFWEFACCCAPRAPLGLAVLWRGCPRGFPRCRGLRPVCAGGSPPQFSSPCSCLLRWFASGGAGCPLAGPSRGAGRAPLCGALALPASPPVSGLPWRPRWGRRPLGRPPSPRRLPGSVCRPPLGLGGVGLVALGLCCGACPPPVRPPAFAPAAPRWVRPAPPWGAWRPRALSCPPAGRAPAPPSRPPPLPSAPPWGPRLPPPPGVGGPPPGPFLSCRSPAVPSPPLLCCGPRRLGSFCPGGWGPPGSAGVGSGVLFPVRVSWGPLSVCAACACVRLGPGALCLPWFLGSVPPW

SEQ ID NO: 942514 - protein, 294 aa, Homo sapiens
QEKGRRGKTKNGKRPHAKKKTKGGHKTGAGPPEGGTRQGEQEPGGDDETEKAKGNKQGRDRATTTEEEGGGREEGEDAESPRSELGRPGGLASASSRRGHGEEDTHRNWLLQNTNSKATQRGGGGEAPNTQGLARDQNNKGSSTRPQEDRATAQRFTRTAGKLALQRSKQAGQGSGGASQDRGRAGAEEAGRGQEKHLSSEASGGQWWVIFAVTSNVATTNILDRHILDIEAHIVPRKSLTQSIMVHFDRFYFRCNVDWSEGDTITGFENTSVHSANRNSTNTTNFVDILERQA

SEQ ID NO: 942515 - protein, 140 aa, Homo sapiens
MRCIIQDMYENESYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLNGVESKTFRN

SEQ ID NO: 942516 - protein, 202 aa, Homo sapiens
GEQEPGGDDETEGAKGDRQGGDRAAPTEGEGGGREEGEEAGGLRRGRGRRGDRASASSPRGPGEEDTPRNGRAQNTNSKATQRGRGGEAPNTQGRARNQNNKGSSTRQQEEEGQRPAVDQNGEQAGPAAQQTGRPGEPRGANQDRGTAGAYEAWKEQENHQSSEASCFHWRDILAVTSNVATTNILDRHILDIEAHIVPRKS

SEQ ID NO: 942517 - protein, 214 aa, Homo sapiens
PAAPTYPSEEALAQLRPLQRRYAEHLPRRGQAAPTAWPDTAAALSGDPGARAVTRPQARMLLGWGRRLSPSAGSGSAPSPPAPLLLLSLGKARNSALRKYTLLRVDAPGGTKKIKTMDGAEEEETMKKLAPRKKSTAAEKEEEEQQQLQQGAHKQTVRCVSRRARAPPWRLRRRVLLRRPVAPSRKLGSARAPHPHSKLERGRLVGCPGGVAGA

SEQ ID NO: 942518 - protein, 135 aa, Homo sapiens
MALGCKTEDFGTSQSCQFRTELCLQQEQYSSSMTRKQLSSRALGRTSFRFGPGAFKRDNTDSTLGLTSTSVRPCWTFSSSVCTSCRYFQDGWPSSSTSCTDSVALRLTKTHRYRSSRSLTWALSLVTLAILNTPS

SEQ ID NO: 942519 - protein, 38 aa, Homo sapiens
QARGWPVFLRIGERAHTPPALRRVLRVTLRTIEGAAVS

SEQ ID NO: 942520 - protein, 283 aa, Homo sapiens
TSARGKQSKSNPGRGAAHGTTPAPFFPPDAEVAGAHGGPGGTVRIGSAGQHLQAGRARLLLALGRGDTGYIGMGGGDQPGPKEKKTEQRPAGGNNKKDQKGHREEKKEGARKPPVKANTGESSKNPKGQEKGTQQEADLTLNKEEKNEAEHLGDIHRTNKNSEEHRARKGSGNITPNQEQWEKAKESSPHREYPPATAREVDPLRIPPRHPHTSGQPPWCDPLGPFVVGGEDLDPFGPRRGGMIVDPLRSGFPRALIDPSSGLPNRLPPGAVPPGARFDPFGP

SEQ ID NO: 942521 - protein, 257 aa, Homo sapiens
RGDSSTCNPSRGTEGRGRAGGDMKAPSALRGGDSWGYRREARGWGPRVWGHQNGASDVSVCEGGALVSLVGAEGTAGVGWSRDLIKEEEGKGVMEGRFLGLGTQAPSVGDIKQQHEDHVEDEKPPKPDGGQMGGRALPPTRFTASSAVRSPRAVPWKRSEGEHRSASGTPIFRQASRKLSTFFRALRALSFGTAGEGPSIKGSERGRAGWQLEQDDPLATASAKSEAGAAAAGTQGPGAVTSLSPSHLEPGGTAEVS

SEQ ID NO: 942522 - protein, 99 aa, Homo sapiens
MRSLFPWPLAANTQGSGVRARDGRTTSEKAATHIHLIPSEGTTWQVLGVAAVPRVKYRTPLGRFAPKKKWQLQTKKKDKQEAFFFHTLENAINMLFKIL

SEQ ID NO: 942523 - protein, 258 aa, Homo sapiens
SKPGLSWAYLVLVTQAGGSLPALHFHRGGTRALLRVLSRYLLLASSPQDSRLYLVFPHDSSVFSNSFHHLQLFDQDSSNVVSRFLQDPYSTTFSSFSRVTNFFRGALQPEPEGAASDLPPPPDDEPEPEFKVISCVELEPLPTVELGPPVTEEEWARHVGPEGRLQQVPELKNRIFSGGLSPSLRREAFKFLLAYLSFEDTADSHNAHILKKTDEYFLMKLQWKSVSPEQERRNSLLHGYRSLIVDVSRTDKTNKFYD

SEQ ID NO: 942524 - protein, 145 aa, Homo sapiens
MSIKRISGGICSGSSPFLDLTPFSLVAAVYKHGALLRKVHADPDCRKTPRGNRGWKSFHGILKGMILLPSEEEYKAGKALSDTELNNFISIHHAIETCVREESNRRHVFYLRKAEWRVFLFHAPSLEQMQSWYHSHQCSIPYFLC

SEQ ID NO: 942525 - protein, 207 aa, Homo sapiens
MEKGKIEFVDDGSLGKIFRKEKLVFGQYGGGKNCGKGAHYKEGAELVARCPGRSRKEAESCDCLQGFQLTHSLGGWHGGRKGTLLISKIREEFPDRIMNTFSVVPSPKVSDTGGGGANATLSVHQLVENTDETYCIDNEALYDICVRALLLATPTYGDSTTWCRPHERGHTCLRFLEQLNADCATGPSTWFLFSPALLHARLRTLNS

SEQ ID NO: 942526 - protein, 155 aa, Homo sapiens
CCFQARGILANQSSSQLLAVLFRYLGGKRSCRSTWSSCSSCAASSSRVSSFPTKSYVDLARVAEAVLQPVLVEGRQLLRVRVQQVMDQIDQEHLQATPKRLTPPRPPPFFDFLTARIMAHGELAVELLVLQLELAAEGGDQAHEGVAHEEELGVL

SEQ ID NO: 942527 - protein, 106 aa, Homo sapiens
MVQDFQRRNRILQWAQLATSSSQEKADQSVPRAFPWSPPPHARYRNWQRKCDKKKDDEDKKNEDIVSGGIILYSSSQSVKCKNQHSLQYINRDLRHFFRLHISSQI

SEQ ID NO: 942528 - protein, 119 aa, Homo sapiens
MDLRGKKRGDEKKEVAEPRNKHTSSSTFLPTDPALYSGPFPFYRRPSELGCFSLDAQRQYHGDARALRYYSPPPTNGPGPNFDLRDGYPDRYQPRDEEVQERLDHLLCWLLEHRGRLEG

SEQ ID NO: 942529 - protein, 251 aa, Homo sapiens
IFISRVCRTWFRFASPRGPEWLAWSLCGAVSCTCLGIRREEAGTPGSQEMDSVAFEDVNFTQEEWALLDPSQKNLYRDVMWETKRNLAPPEGKEGRTSNIKEHNKHRWEKATEATGPERLYQTKRPATQPRGTFSPVSQIRIVSKKIPASETLVKALYMEKSAWVSHPLIDTSKITVDMNQRNIRNMERSQIHVTSVGNPSVLTSPLRAQEIIHTGEKLYDCEECGKPSFLSKELEDTSSHTVDMHHINVR

SEQ ID NO: 942530 - protein, 207 aa, Homo sapiens
MIEESGNKRKTMAEKRQLFIEMRAQNFDVIRPSTYRTARKSRFVQKRCNPHPVDIRNMIEALRDNGLNTLDHTTETSVSRPETVTPPTYHQLNKRLPPTHQISVEQSTSPPPNPTIAAYDSEGRGKLTVFSDKAMLATMCGGKMLDKLRYVFSQMSDSNGLMIFSKFDQFLKEVLKLPTSVFEGPSFGYTEHSVRTCFPQQRKIMPN

SEQ ID NO: 942531 - protein, 241 aa, Homo sapiens
IREREEQLTRGLGGEDEANTAGGGQGSPRGRGKQGVGREKAPGEKTLALGGGALSLQGRAASLGARGLGVLLVVFVHLALFRGRGVRELRELGDQGVHVALGLGELHLVHALARVPVQEGLAREHGRELGDALEFLDGRAVPDEGGGNLEGGGGDVQGLVVGDPHEVAAVLALDGQHLVLLHGHAAPEHGGHRQVAAVARVAGGHHVLGIEHLLGELGHGQGPVLLAAPGCEGGERGMKKC

SEQ ID NO: 942532 - protein, 147 aa, Homo sapiens
CVHQWRCETVRNYPGLAGPCGAFSDCTERAPGFWDPYRSLAVGPDTHGKPFSWRWKQLRCEIPPASAASTWWYGGHWGLPFQGQPIYLICQLDVTEDVAKLLKLPDVPGWEEPSPTLQFLQQRPCAEAALRAPRSRTGTPTVLPADL

SEQ ID NO: 942533 - protein, 131 aa, Homo sapiens
MAKGTEKPELMWLLSYSSYFSSSGEWWWCMLAVMVFVVMVLWSLFDFCVVVFSVDVLDWVWFLGFEELVGCSGFLSIVVSCVSSVVYFVLSLAFLFVVCFLASFFFAFVVCFAFFLWLGALLDCLVFVAFP

SEQ ID NO: 942534 - protein, 240 aa, Homo sapiens
MLKKFDKKDEEQARVFNETPNNPRKCAHILTKILYLINQGEHLGDQEATEAFFAMTKLFQNDLSTFLLFFYLTKEKSCIAEDIVTSSPTKDMGKKNNNRGPAVRTPRITESTLQAIETLQEKNQCETKEPSVSSSAPVSALHLLKCSFDVVKRWVNEAQEAASSDNIMVQYHALWLLYHVRENDRLAVNNMISNVTRHGLKSPFAYCMMIRVASKQLEEEDGSRDSPLFDFIESCLRNKH

SEQ ID NO: 942535 - protein, 197 aa, Homo sapiens
GTFHQISLHSSFFPPSQPLALTSLFFLTSPLTLYSNPSKKPTKTTNLIIITFNRTPTTNPPSHQNLNNTSSFPFNMNPFSSLMPSTTTPPPSHYPYSSPFNPPSHHIPTYSPSFSLTFLNFTFTFLTSPSPTPSSTFFPTKSTPTPYFSPSLHTSISPITSFLNHLLITNLPSPIPQPTFTTPPSRHHRSSPPHSPT

SEQ ID NO: 942536 - protein, 124 aa, Homo sapiens
TGSPKLATCIVTVSKKQQPGARQGVMATPGHTQEQRVGVLVNRHFVSPLTKVHSQELHNNTHSLFKCLDGREGERFLLLKFIPYLIPGCFEVQFHDLLNVISYSNFQIFQHILILIAFVTSLPS

SEQ ID NO: 942537 - protein, 204 aa, Homo sapiens
PPIPPFLHITLHTPLLIHTLLTLPPHLHSSTSKIFSTHHHPPSPIPNPPIPLYPSNPQTHHHYLSSIHHTLYFNHPPLNIILHHPPHLTNLIHTNYPHLLPPIPPISDQKPLGSINLYNMMPNPILNLPPINLNHSLTNTNFDNLYPSPHSLIHAINPPTHLIIAPNLPLLPPYAHLPNPSAQPLPPFPPPLIITHIDPINPLH

SEQ ID NO: 942538 - protein, 185 aa, Homo sapiens
EKPAAQGAVCRGQGAPATNPQAVAAAARVARRVNMAALTTVVVAAAATAVAGAEGAGAAGTGVGAKPAPQQSDGCFSTSGGIRPFLQNWKQKENQTKKAETAEKFKNQVIKMEKEKKRINNQKSDFRIEMLEELENKLIQSRKKERAKIQQQLAKIHNNVKKLQLKVKPTDFVEKLREMEEIEMQ

SEQ ID NO: 942539 - protein, 152 aa, Homo sapiens
LILNTFDPNPPPCRAGGTGGLGGAGGPCRHSQLFILLMSPPHPSSSLPGCSGTLRTPGCPGQASRANGHAGTAGEVPIISCVRTFNLGNQGVAGLFLPLPTPIYNVLGKTMRGGKGNIQPPSTHITSSEAAKSTNRAWESLSSKNPNGSHAA

SEQ ID NO: 942540 - protein, 109 aa, Homo sapiens
KGFFAQGHTSGVKRGPSWGQWFSYFVIGPPPPPTLPPPPPPPPPRPPPPPPPSPPLPPPAPLPPPPPPPPPAPPPPPPTAPPPPRPPPPPPPPLPPPPPPPPPFPPPAP

SEQ ID NO: 942541 - protein, 77 aa, Homo sapiens
MLMSAFIQVANQTCYAAPFKRLPRVRGKGSQTGPLTASALAWILSVDAGLPLLSPASSTRPAWPFTFQMSVSRGLQT

SEQ ID NO: 942542 - protein, 72 aa, Homo sapiens
MTGSSVFDYIHPGDHSEVLEQLGAADADARPPNPALRLLFLLLFLFLADTPEIEASLTKVPPSSLVKSALVC

SEQ ID NO: 942543 - protein, 200 aa, Homo sapiens
MALGLRILLVVFFYFILFFGRGVLVLLVLGHQVVYIVFGFGELDVVDVLVRVPVQEGLGPEHGRELLGDALEELLDGRAVPDEGGGHFEEAGRDVTHGHLHVVGDPLHEVAAVLALDGQHLLSTSFMDMRPRNTVATVSAAVARVAGGHHVLGIEHLLGELGHGQGPVLLAAPGCYGGERCYEEVQAREGHMLTASLRKS

SEQ ID NO: 942544 - protein, 254 aa, Homo sapiens
SRVSLQGSHYLSAVLLHYLRIKFFPRRMRIPIGLNCFQIPRGSWVSTQLGCDFPGSRHLPTQKSWKMMSRISSVPPPPGSGGRGAGGICELFVRRSFDCLYVAEGIQEKLEVVLVPCSGEQGGICGRLPTHCSQLLPQRLQEGVQPLFRQKGQKQVRGQVQGRDLGLRGQQVRLVQHQVEALAVTGALGSQRGYDGGQEVATCCRGQVRSIQHGQNEVSLLKSLPGARMLSCSTGTTPPATSRVAQQHRKSGEF

SEQ ID NO: 942545 - protein, 152 aa, Homo sapiens
MARLKKGFGGAGAWISAGTEGGGWGLGEGGGVPAAQRGGPWAKSLEGGLGVGGGGDRRGRLGIWGGDPMGAGWGGGLCFLHAEHGVFLFGSINSQAFQAHGGESSFNADRFAISNLSSTAFKGARRGIKTAVCVYSSVCSVAMGEMSLIDED

SEQ ID NO: 942546 - protein, 183 aa, Homo sapiens
SIWLQKAKVAYCSGTNNQFIIQSETKFQVNNHVDLEIFPMDTMLNQLVTKGNFRLSNCVKWGRNEIMLDEIDSTFNENYQGQTIWFQKSENFLPDWRSLQTCQPTMSALGNIVGKVLCYVRVGSSTLGQSCASGNGCLEFSPCSSSVSFIRVCLLDNIPPPQELLEICKQSGPFAKGLDAIPK

SEQ ID NO: 942547 - protein, 114 aa, Homo sapiens
CAVEFRTLTWETRVVDGEGGGGLAGLRQWLFSPWCCSYLQRGAWGSVISAELLIGPGSGKAPAVGPSRASLRPERWLCLQRSEGISEPVSGAGHAGTRGALRLLLLAHSGERDK

SEQ ID NO: 942548 - protein, 181 aa, Homo sapiens
RAAPAAPASLLRDSRTPPPPLRERRVGGGALLLRRPETRRRWTRRRWAHGADRPELEAGGGGERPGRPRSGAPRYQCGVPELRKEILSADFEMMGLENGGGGLKSPPLVLAALLACIIVLGFNYWIASSRSVDYEDTDDEAGRQGPEGGCRERGRGAEEEEFQGELEKQREQLDNIQSIDF

SEQ ID NO: 942549 - protein, 158 aa, Homo sapiens
MRGGGNTSMLGAPPIHSPSCHHGRAWALGATRGDRLSPLGTTHYSAKRNGRAPCDQQTQIEPKQQASPPPRGIMCHHPVCSGRAGMEEIFLVQLHSSSVRTDVPPYLGFREGGWGFPSTLQQILQCYCHLRPNFLPRALYAMLHLGQMFRSVCLLVPI

SEQ ID NO: 942550 - protein, 136 aa, Homo sapiens
HHPPPPPPPTPPPPPPPPRPPAPPVRPSPPDPDLNPPPPVFPEGPSHACLLPRAAPACLRAPRRRPPRAPARAACGPAVGPGPPPRPSPPQAAFPSLPRAPPLVATSPPPPRPSSRPQPPPSPVHPSSRCLQSFLF

SEQ ID NO: 942551 - protein, 33 aa, Homo sapiens
PGTMDSFSGPFGQIFRPNNFLFGSGAGNNWAKG

SEQ ID NO: 942552 - protein, 96 aa, Homo sapiens
RVGRTVRAAPPGVQRPAPPRLAWEKPPGRAGLEWAVIGFLRFRADSDPISFFHIQVWRLLWRLGPRALETFRAWPPPASFPGPALAVLPGGTVAPG

SEQ ID NO: 942553 - protein, 115 aa, Homo sapiens
TGIYTVWYQKLGPTWCCLTCIRNIKSNSYHKDTGLTIHHIGPVIPWEFPNAITTPFPFYKYIKKQKVSKTSIMMWQTEYNSDVSGGSKVLIRPSKFYNVICSSSDHYFRIQTGEK

SEQ ID NO: 942554 - protein, 197 aa, Homo sapiens
KEESRRGWLIVKAGGRTRGQEKPGCLPFPGSLGHLGVSAKLWGVCWKVVVIGIVGGDKTGMVQMVLVEGFGRVTVRGSLRLGLAWIWPVSGVWGQGLESRLGRGLGVGVRAQAAASLGPGGRSEFHWAMGRRRVGQHGPAQVPQAGPRRAAAPTGHPPDGPRFLAQLCRSPARVSSTWHLSGTWVTGAPRKLESFVW

SEQ ID NO: 942555 - protein, 77 aa, Homo sapiens
EEKRIDHRAAGRHWWRLEEEAEQGQHGVEGLRLGVHVSLEVDALAQFGEQRQVQHDGCGQQGVFIRVVQHQCVGFAQ

SEQ ID NO: 942556 - protein, 216 aa, Homo sapiens
YYPLRREPEAAPSAPQETPIMGSQSSKAPRGDVTAEEAAGASPAKAKGQENGHVKSNGNYSPKGEGELPPVNGTDEAAGATESDAIEPKPPSQGAEAKGEVAPKENPKKKKKFSLKKHFKLSGLSFKRNGKEGGGDSSASSPTEEEQEQGEIGACSDEGTAQEGKAAATPESQEPQAKGAEASAASEEEAGPQATEPSTPSGPEIGPKAAIAEQNE

SEQ ID NO: 942557 - protein, 161 aa, Homo sapiens
RWQLVLSESRVSICSSVGEMRHLTLSSSFLLMFPSSRIPQKTLFAKSWWRNTCEPEVIRRHACQRYSVPCTFVNLKSTSQPFARRKEEGIPYVEFPSGLLRTFDPQLCGFKDHSVTVPCHTPRASRAAEPHPLKNSTKAVNDQCNVWSICVEGEGGGGKRN

SEQ ID NO: 942558 - protein, 142 aa, Homo sapiens
MPLECAAVRARVLSGGVFHSHLTAWRGGAAGQACLEGVLFFGGQGSLSSSGTLHPAVGTLDPSKDGCVRLAGLLRVLGPPWEGGWVGGARGGAVLGSVLFSAAISVLCVIENLKSSLCQSQQQGLGSGLQIDSNFLLMSGAD

SEQ ID NO: 942559 - protein, 159 aa, Homo sapiens
RQNQKKKTEKTQHNPAIGQHAGGRQEAGETRLHSKGLRGLGGEKEKKQSGGKPGRAQKQSYIPQHESSPGRGRAAKGGGGTTLPLESANSTAAGGHRAEAVGYARVAHKVTASATGTGAKRAGGPKHLKAMSKTPLSKVSREGFGPSVGVVSTNLTVVV

SEQ ID NO: 942560 - protein, 116 aa, Homo sapiens
YRMDVEKENSKYTQWDRPQDRLGVNKECTLLPCFPQYLKDLSHLLLNILLNSPSSSAVASWYCWYSDTRAFMWLWASVNSISSMPSPVSLSRPAFRRAMAVDCSAAGLNSSWMAGL

SEQ ID NO: 942561 - protein, 235 aa, Homo sapiens
GGPSAPLPHHPGTAWCLVGFSSLFSSYTMGIPVDRFSSMIAWADIPSRGLKMPRGLFPWAAMSTRLLALIWGTISSFQKGRARAMVCLRIWQVGSSPGFRPAYRRSLLMEWWWGCFWSMGGGGMWKERLQSFTCSSPCLGAVSALLRPVRPRNASSLRRQVRTTGSHWSVPSRMAQRVRMARFSTDVEQKSNSILASLKALAPRLASSVPFSLSSASNQPQKRFFWFHVLSPCRT

SEQ ID NO: 942562 - protein, 74 aa, Homo sapiens
MAATAIPVTTATMIPIGEELGAWTVMVTGLDEYSVVAYVSCAVVITTVTVVCLWDGEVGIRTGKFLGFSILEEC

SEQ ID NO: 942563 - protein, 316 aa, Homo sapiens
LHVARRSAWLSWCSVWCSCTFFLAVNGLSSLFDVIELTPSNFNQKLFRVKVCGLKKPMPQGVVTVKEEHQNGRKQQPHKKKLSKSVQLMQKSTIPQEVSMGSRSPPRILDPTKTDQKKTKGAEPVKPLKKPRRVPPRQPVKDRPGGRSGGNSPGKQGRSESASKKDVIELTDDSLDKNVLDSEDVWMVEFYAPWCGHCKNLEPEWAAAASEVKEQTKGRVKLAAVDATVNQVLASRYGIRGFPTIKIFQKGESPVDYDGGRTRSDIVSRALDLFSDNAPPPELLETINEDIAKRTCEEHQLCVVAVLPHILDTAAA

SEQ ID NO: 942564 - protein, 151 aa, Homo sapiens
MALPILPSHRKLYNHLDLEDLILVQVTISILSLLGAKTSTADLPKEKNILLLPSDLGLLVLQLPLQVLALLRLLVQRPLQLTCLVVFLVQLVLSLGQLLFELLHPPPQLVHLTLVLLPPPVGMCQLCHLLLELLLQLAMHMLQVCQLLVLL

SEQ ID NO: 942565 - protein, 105 aa, Homo sapiens
IHPIVTEYCQTIHLLFNSFQILDDKELLFPKDFLYQGDSNAKQSISEAFALTKIQHTIVPKDTRPHIVTSDFKKAINALKKTHFKLKKLLKAIVLQEITNNQKGW

SEQ ID NO: 942566 - protein, 244 aa, Homo sapiens
SSAHYSAARGPHLPPPNLAPRVHPKQKKKRKPRSLLLLFGAWPGSPFHRSQQAGEWTPLCPESKDPGSNNSWNMLAGAGAEACGFGGGKGGGKGTACGVRVSGHPGDARSSFRASGACPWLVSALTARGTASSDHRTDLSLGLAQVAWTYHVRLRKFCCPSLLVSSLTGMALGMSCFLANTSSTASRSSSSCSIFWSSSADSWTRSRSLLFTTKMRPSVFWKWFRHRGRIFFWPATFQNVKQMF

SEQ ID NO: 942567 - protein, 111 aa, Homo sapiens
MEGPDSSYSCLLIHICWKVDSEARMEPPIHTEYLRSGGAMILIFIVLGARAVISFCILSAMPGYMVVPPESTVLAYRSLRLSTSHFMMELKVVSWMPQDSMPRKEDGRVPQ

SEQ ID NO: 942568 - protein, 294 aa, Homo sapiens
GELGGEPGAWEARAEAAFERGERSVEKGDPRKAKMKKMVEEIMKLLYSLYGEKKMKAAVKHSGKGELEKEEIDFVGGFEGGQTGIEVGGAVGGLSGAWMKNGKFNLVDEKIMELHPAEEKRLFKEAAAMMRKLEWTEEVKMKALLMGSEALEKQMLAMVVNYVTKELRAEIKYDDYGRTSGEVGGPLNDSVILKGGLGVGRSQRMPPGESPHHQCITSNVPLERPPLCSVMFQKLLMKQHVLVACALACHDSPLTGPQRRVKACLPQFRRRLLSPLTRMGLEEVITLSRRSDKL

SEQ ID NO: 942569 - protein, 150 aa, Homo sapiens
PFGAKLASFWAAGSSSKRAGSCLLVPRLAGLWVPFSGLLVGWTLVLGSRLGQGPSGLQRVAAFLAGLLGWWGLLRAGARAGVGTGFRERVNVGRAGLAGPAEDNPEQQQQEAHETVADDGDEGPLGDGCPHDRQHPQKKKDSGAASMVRP

SEQ ID NO: 942570 - protein, 106 aa, Homo sapiens
MVGPLGGGAWGGATGGGGSTTRGCPRGSSWDASCALVQLGDGGVANLLQLFLLVFKLLLLGSVIVIKPVENFVKLVQNLLFVLIVNLRHMKVSESSTVRLFMLEEQ

SEQ ID NO: 942571 - protein, 114 aa, Homo sapiens
MHGRGRATGATAPCWALGLQNIMAREDEVPLGWGVEQVHTGWSCSPPQSHGCRAFAKPFTLPTLRLLHQPAKGRGYGLRVAWVTAAGRLVTCDRAMKLDKPSEKQIRGLPALAV

SEQ ID NO: 942572 - protein, 152 aa, Homo sapiens
GPLHIEIRLPYAREFRRKHRKLKSLSLGGRKGETTLRQNSSPPHPRAAECREPPVKFYLAVGGDPGNIFGVSREGRAGGLHGPPLLPPAGRQASLPLLAATGGGTPPSPEKGKAWEGLAALPPVAFGGAPPPGAPRRPRKDVVVGGGGRSSL

SEQ ID NO: 942573 - protein, 146 aa, Homo sapiens
MADTFLEDMCGEENRIYKKKTTKKEDGKKEDKNGPASRRRGLEGRGGGKRGKKGWGGRKKMEEKICRTKSFKSIKKLRKEKESFASDPILYRPVAVALDTKGPEIRSGLIKGSGTAEVELKKGATLKITLDNAYMEKCDENILWLD

SEQ ID NO: 942574 - protein, 109 aa, Homo sapiens
MSGTFLGMYRRYSMGPGGASMGTSSKGGWERAEQGGGGEREGAGVQRLRVVLKGGSFVLERGEGHSAGLKRNILPYHAISYTGIPCLCMCMACPGLAWKLIESQRDHWL

SEQ ID NO: 942575 - protein, 152 aa, Homo sapiens
LILSAFQVLIITVSLAPRRLVFSVGALVRVPASARALGLALPTCEWCFRPRPPWASPPLPLRLSAPLQPVFGGSSASCRLSVLALRSLVSPSGPDVFFGPTDPRFLLPPLWSGPFSVFLCPPTAVSAPQVSPTGSLSRQGRAHSPLHVFSPP

SEQ ID NO: 942576 - protein, 99 aa, Homo sapiens
VAGAPQLLSSTSGIYWSHPEMHWLPTHWLDAGLVHGWQNQGIPFGDVPNPSGPEAAPSSMSQPVLGSAAPFAGTLALLRGPPRAIAGTVGGNGEPRFPH

SEQ ID NO: 942577 - protein, 72 aa, Homo sapiens
CSDSDTFPSGHKAPDESQCRTPSSQYSRVTLLRRTPRLLASGTRQRRNPAPSPVDLAGYGFCQSTEPSCPDS

SEQ ID NO: 942578 - protein, 183 aa, Homo sapiens
LTKGTAHRNFQEEIEFLNAIFPNGAAYCIGARMNSVCGDLYTLDFPESRVISQPDQTLEILMGEPDPAVMDQFYMKDGVAAKDVTRVGGIRDLLPGSVIDATMFHPCGYLVNGMKSDGDYWAIHITPEPDFSEVSFETNLSETSYDDLIREVVEVFKPGKFVATLFVNQSSKCRTVLACAPED

SEQ ID NO: 942579 - protein, 82 aa, Homo sapiens
KILPGYKNERAFYENPLNSFRVEWQPARRHILRRMAVSPSSWTRVAEKAASTPDINKPLLVLVSQVALTEHCRVLDTEEYLL

SEQ ID NO: 942580 - protein, 119 aa, Homo sapiens
MGGGSGGTGRGMGAEEGHAHECISVHGLVNELLQFFGLVVWEFCVEQPGEVLEGLFVFIERVVPQGQVEEVIELCLLAPFGQQLLEQQDAFTDVIIVLAPYQGPGVFKLRALGHRACCV

SEQ ID NO: 942581 - protein, 249 aa, Homo sapiens
EVAESWEQAADSGEIQISSQSAHSDSGRYPSRGAPVHRSASSTAPTSNGVVSSPNSTSRPTLPFKSLAQREAEYAACARKRILWLSASPEEEQEKPILDRPTRISQPEDSRQPNNVIRQPLGPDGSQGFKQTAHKCRRRKDAAVAAVTASWVVRHRELLTAVADQLDLVAEANDLDLLCTVDAPLLRPILAFLAHVPCDLPPSPPSHCDWHIDKGCPKSMERERVGVRGRLEGTTKDSESQTVPLGNLG

SEQ ID NO: 942582 - protein, 138 aa, Homo sapiens
MIAVRGVIHQAVGKHTPEEPHGLQQRLDEQQEEADSSRLDFCCLSSMSEGVGIEFEKQKEVWELCRNEYFWSFGIYGFFKLLVGVNGQLVRARGLEHSLVKKPGKRNGLDGTSLLKPGQAEQGKSQEQGRPGAWSHFH

SEQ ID NO: 942583 - protein, 134 aa, Homo sapiens
VTSKRAGVANLHSPADSAFLLEVSIGIVWVGTTLRRYGKGKSVHFRAISAEYDRGGVGALPRLSVRYRAQPESPGQGPDALGLSSVEGVYGDGVRRAGSGGCESRCRLFWAAVGIQKLSSPKSYWFQSLVNFPV

SEQ ID NO: 942584 - protein, 289 aa, Homo sapiens
EELEARPRTQIGTIELRDTDYQPEPHMRRLLSMEPEVAGGRPRSFPRAPTAHGGVGGARICPVRSATRSCPPPGGSWGFWEEAAPYYGGNGKATMQNLKDRLASYAGEGFAPWRSANMKLESSILEWHQQRDAGSKQSITVRSMRKTSHDAAGADSGWYRVSNAQIILLIDNARMAEDDFNLKYENEHSFKKDLEISSQRASARPDNLTIVTTDLEQEVEGMRKELILMKKHHEQEMEKHHVPSDFNVNVKVDTGPREDLIKVLEDMRQEYELIIKKKHRDLDTWYKNS

SEQ ID NO: 942585 - protein, 72 aa, Homo sapiens
VPKRGHQGTVGDPLSRKKRSVLKMAPDSVSFFLTCQPTRDLVSLDMPLFISIYVFEFLASAANRSMRSGQCS

SEQ ID NO: 942586 - protein, 170 aa, Homo sapiens
SRSQVLEQLASSLPTLLTYLYDNLYQALEPEDISSLLALMHHGVLAIEPAGGVSKVDHAHIYRTGADGFVGIKDQQNHQLTPLTGPPNPQHLTPGPLRAAPCHHKLPAEELDLKLFVFCCSNIALSSVSFLSTGPRSSRRRYRPLWKNWKSAFLKPCTDSFRPWYLYMNM

SEQ ID NO: 942587 - protein, 269 aa, Homo sapiens
MFSLPFFLGAAPIGNSYWYPRIHFSKVNHLVSLTPLPGSPAARLKATYSSLGHLILRSFKDDSKLFLSQILMPPSMPVVQNWELLALLLLSTEIWLTLFLSSEFRPAPAAVPPSGLAFLSRFWELSGAVKPRCELCLGTSSRPPKLSIPAAASEVNSTGKQLWPAATRLLFVMKVSATVGSVSEARVATAIFLSASARQTVLSWLTQATRLPLAEKQTPCTQPQLLLDSNISAPKGILGAPRGGCRPFLHFFDEAGKIRTFEVTGAGSQ

SEQ ID NO: 942588 - protein, 151 aa, Homo sapiens
IWYTLNTANMHNICQPSSCIIGREKKCDVTSILSDYKFIASVSFLSSGIPFTCSLLWGNLSLMWQVLLRLPQWHVCPIIVVCVSRGYDFPSPRVEHRKRCPGPCYLSFLGHVSKLLGRVLTIPVMHQLAVWGLPVSLFHAFPLAAHDISQS

SEQ ID NO: 942589 - protein, 240 aa, Homo sapiens
PADREEPIGWVGGLAGCPFLPSYRTLPGTTHQGAKFSPAASGGPAANPLSSVLSVPGSCLLRFCPGPEGLPQWPAGLGVGLEEGLGKDGGAGPPQGHDTVPTLRLAPAALVLSLEAVSRTSLENFLGFLGAAGMTSVPGLGDGSWLAFTLYPPARWARAGASRDPGPVPQATLSPQQVDFSYSQARNLESSGSVLASQQVLALPWLGGDSDVEMFVDPTVTEDSLASGLKPGSQRDSAQK

SEQ ID NO: 942590 - protein, 208 aa, Homo sapiens
MILPLLLALLFGAVSALHLRSETSTFETPLGAKTLPEDEETPEQEMEETPCRELEEEEEWGSGSEDASKKDGAVESISVPDMVDKNLTFAEEEDTVKKEGIPGGHSPPYRLERSHHTGRQPGATSPQGYTGNRGSSHNIKKGLAKNWQQTHKKNPPPAPPKPYPTSTTFNPQLPTTAQQHISIIETNPKHLLYHSKSLKPPHYPLPKN

SEQ ID NO: 942591 - protein, 287 aa, Homo sapiens
MGSLSGLTVLATDSDWADVQVPPALGVIAPSVREQCKCGGSCGWDSGGPKGSAENEPQWINVLQEDSVTLRGRGTHSPESDSYSVVPTDWEVSCPTHTQLSKRFKAKKKDSGEYKCHNGQSSLSEAVHLNVLPEWLVIQTPHLEFQEGETIVREVPQLEGHKPLVKVTFFQNGKSKKYSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALE

SEQ ID NO: 942592 - protein, 113 aa, Homo sapiens
MAGEPMAEQREGPGTMEKWYYNWMGSPAEEGAVVELKIIMGGVTGFGFGRRGALSKSPSLLAAARILSMEEGPERGSTEGRTGPGECSEHSRKYSFGKGKSMLCLFCFPVKVI

SEQ ID NO: 942593 - protein, 134 aa, Homo sapiens
RSPLEFYRLKHNPKQTVSIITTLPKEPAYSPPTPLLKFVNATVNVSIIKNYKLFGDYLDDLLSSSSPQECSNGMCAQQLHIGKIRGHNHLSPLQINIFLKEASQTRLQLSYIFFNLIVRYSWISTLLSMSINSA

SEQ ID NO: 942594 - protein, 237 aa, Homo sapiens
FFLPREGPGLPSESHRSGVVGNPLAPTPGCSLLLKGGGVVSSLFRVTMGSPFGVRCPEKPPGRPWGPVPFPAPHTGEAACSQLPVPQVGLLATHPVAAPSTRKIATSDAPHAGDAGQVLPHPKAERAGAAISVAWSQRAVGGVKLRSEPRRPGPGSARALSMPSRRHPQQRKLSTALHTSLLRKEWMKGLTAELRTARARIQCMPRSYSWAQRLEPKTWASSSPKSGPQHTREASRI

SEQ ID NO: 942595 - protein, 96 aa, Homo sapiens
PRGGEEKEEHAKNLMTIIQMGKNNRFTKATFSILQLSTSHSWKKGWGEEEPGSPWGPWEGPGLSRGGGGGGPGGREAHFPGPWGGELPEECANSLM

SEQ ID NO: 942596 - protein, 234 aa, Homo sapiens
CQELAAGGHSRLIVLHYNHSGRLAGRGGPEDVGFGALRGLSVAANCLVLLDDIFVWFLRPSLNHILSRHLVYYCLKITLSDLLTGAAYLAKMLLSGARTFRLAPPKWFLQEGLLFTALAASTFSLLFTAGERFATIVRPVARSGATKKNRVYGFIGLCWLLAALLGMLPLLGWNCLCAFDRCSSLLPLYSKGYILFCLVIFAGVLATIMGLYGAIFRLVQASGQKAPRPAARCK

SEQ ID NO: 942597 - protein, 240 aa, Homo sapiens
EPQPGLGAEFLERLEARGGREGAVLAGEFSDIQACSAAWKADGVCSTVAGSRPENVRKNRYKDVLPYDQTRVILSLLQEEGHSDYINGNFIRGMDGSLAYIATQGPLPHTLLDFWRLVWEFGVKVILMACREIENGRKRCERYWAQEQEPLQTGLFCITLINEKWLNEDFLLRTKKENYKKEYPSFYKQMKMSWENRGVPEVLTHARYGGGSRRLRDLALNPLCHCSAGCGRTGVLCTVD

SEQ ID NO: 942598 - protein, 140 aa, Homo sapiens
MPRYRTSPPKICPRSGREQGENGTAGAPGLLWIDLALALALALALALALSDSGVLKAPAKAHPLPPKSQPDKLHHKKPQLRKIFGWGNLTYPIYKSIFTAINLGLKKEPKCGSRGLRGQQPVQSTKKNNNNRMPSHDPKL

SEQ ID NO: 942599 - protein, 261 aa, Homo sapiens
MASGRENRRSCPRGDAQSQLPTEMAPGQAPHQDTPWRDAHPFFLLSPVMGLLSSAWSRLKGLGTLEKWLVEEVKTEALVEDGLEGENRNLLAMNHKFWGKSTEEEAEDSGGPGEDRETVGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKEQK

SEQ ID NO: 942600 - protein, 246 aa, Homo sapiens
GRLRRRRNGSPGWRAPRTGILLGLAAMELKVWVDGIQRVVFGVSKQTTCQEVVIAPAQATGQTGRFVLVQLLLEKERQLLPQKYPMGAQTTWDSVPDNVQFVLRLTRPNPAGKPSSNSCPPPERCLIRAIIPVKPRAALGCNPRKKLTPEPAPNLSLPWAYGPVTPTPSCCTLGLELKVQENAEELGHEAFWEQELRREQARERDGQARLQALSAATAEQAARLQALDAQARALEAELQLGSGGPW

SEQ ID NO: 942601 - protein, 180 aa, Homo sapiens
VSLVCVLVRPPPCCCCSFSLFFLVLCLTMWSLWALPAPASRVGAWVSLLLSVVSSWCSLLPRLPLGGPSDACFTTFLLFSFLAGFSSRLVWSSTVSLAVGTRKALPVSFPFSSGLTLPSALAAPVVAGLLSWCSPRPFRHTFPEGPSTVFWVTVMAWTVVMSTSTIPKLSWMTLARGAKQ

SEQ ID NO: 942602 - protein, 236 aa, Homo sapiens
MVWPWVAMASMWGPLIGLAPCCLLAPGGSLSDGGVCTACQKIVEFKKNEKKEENKKMHPKKINGVKLEMDGHLNGGFHQEVFLGKELGGFDEEAEGGGGRKLMVIFSKVDVNTDRKISAKEMQRWIMEKTAEHFQEAMEESKTHFRAVDPDGDGHVSWDEYKVKFLASEGHSEKEVADAIRLNEELKVDEENTGSPGELKDRWYQAEQPPAELLLTEEEFCRSPPEHSGECSGDGE

SEQ ID NO: 942603 - protein, 205 aa, Homo sapiens
MRPGGLGPLVSPLNLNTGGGLGNWAGGRPGPRKKEAPGGGGRAPGKLRGRLGKTASVGVLEQHSAASLALAWGCARGGAGGGGGMGHHPPGLLGWDGGDGPPLQPGGRPARGGHGLNVCAAYVVALSSLVVLWIPLSSYILVNPVGLIPSTYLLVPTGILGLMWSPDVKQQGCCPSTSHTFFLAGGCVELVPYAWIHPIVTAKDY

SEQ ID NO: 942604 - protein, 304 aa, Homo sapiens
MRAPRDRAGLLLCVLLLAALLEAALGLPVKKPRLRGPGPGSLKRLAEVSASPEARPLKEEEEAPGLPKKQLQAEPEEEGCWTVTEPAAKSPGKTTPPRTPEVTPLRLELQKLPGLAKKNLSTPNPEKQASASPEARPLREEEEARVLPRTHLQAEPDQEGCWTVTEPAALSPGNATPPRTQEVTPLLLELQKLPELVHATLSTPNPDKQVTIKVVEDPQAEVSIDLLAEPSNPPPQDTLSWLPALWSFLWGRLQRRGKIYGPRGEGGGKEEDEDYPSEDIEGEDQEDKKEDEEEQRSGSMEYKQ

SEQ ID NO: 942605 - protein, 75 aa, Homo sapiens
GDSRSVGGGGAGQVLCFPFPQHSAIFTLLGKAALDAYTRLVLLLTIESYEMQSYSAVGCSGVWKEGMSTATRVKT

SEQ ID NO: 942606 - protein, 293 aa, Homo sapiens
EGAAGKEAAKSAALPLAAGSLDAPGGGGGSVGGARPGDSHSPVPPPPQKAWTIDAKKWAVVVLAAFPSLGAGGETPKAPPESWKQIYFFRFVVNAAGYATIMVPGYFLVQYFRRKKEVETGRGLCFPLVKDCMFGNEPKASNEVPLAPPTEAAETTPIWQALKLLFCATGLQVSYLTWGVLQERVMTRSYGATATSPGERFTDSQFLVLMNRVLALIVAGLSCVLCQQPRHGAPCTGTPLPACAMCLAAGANTKLFKFVSFPTQVLAKASKVIPVMLMEKACVSAQNEHWEYL

SEQ ID NO: 942607 - protein, 226 aa, Homo sapiens
MLVFLLEGGIFFVRLLFEGFIGKVCELSIGMEDSGAYEGQPNAIIEKVFICIKKYDDKKRVEGCERRWIGMFEKMNGGFDIGGMRTSPQRLLNFVKACGDSHFIYVYSAMELDFYGRYFGSGKYDSAGINYPFEPLSSGLYHYYIMELAFYWSLMFSQFTDIKRKDFLIMFVHHLVTIGLISFSYINNMVRVGTLIMCLHDVSDFLLEEPNWPIMPSISGSVTPFL

SEQ ID NO: 942608 - protein, 208 aa, Homo sapiens
LGLWCFGVAALVSFTLGGSMFSPIGVLALGFSSLVFLVFWVLGVGGLWFLGLRLVGVWGGVVGLLLFFWVGAGLGGVVWDFACVGLVLLAPGAWLVGVRFFRVLLWLGCFLPSGLHSEDEADPEENQGCDASSPDCSQDTTSPAFWFPMHKETLRDLPGALRMLSTAGEISFFCSPYLRQLLGPGIGDGGGVQGGEAWEQLRCAGGLR

SEQ ID NO: 942609 - protein, 246 aa, Homo sapiens
PVPPPPHEAWTMDARWWAVVVLAAFPIPRGRLGDSRRTYGIMEPDIVFPICSECMLDYATYMVPGYLLVQILQAEELPGDRKGPLLSPGESLLFLAMSPPTNKVPLAPRTKAAETTPMWQAIKLLFCTTGLQVSYLIEGVLTGKSDDTQLMRATATLPGERFTDSQFLVLMNRVLAVIVAGLSSVLCKQPRHGATMYRYSFGNLSNVLSSWCQYEALKFGSFPTQVLDKASKVMPVKLMGKLVSQR

SEQ ID NO: 942610 - protein, 220 aa, Homo sapiens
MEKSIGIQDHTTWWCWAGLCIPFAQDSTIFTLLGKQNWSINRFFFCHQGKKCKYLERGVTLEGGREKLGQELRELVGRVTVEPTYALLTKNSPKALTEECLPPRAQNKLLTGRWVTEGKREELPPGLTNALLQWSSDTEKNTCILPFQPAPSEVTAEGDGGRVLFHFNPTGTFHPQTFCTGDSTGTAFFPRGFRRPRAYTLSRRAAKTTATPSPPNTVTV

SEQ ID NO: 942611 - protein, 74 aa, Homo sapiens
GQGTGHSSYHLLLGSLHLRGDFFAEVFCQKGHQHISQELEVLRIHMQLVTVQFTQLGKGALEIIQVLFGISQGS

SEQ ID NO: 942612 - protein, 254 aa, Homo sapiens
MASYYEKLEVTRSSVRCMTIKKADIGARLSNGTQTKTQKIKSLAEKKFKEVAEEDKKLYDKKKREIDERYGREGLTGTGTGPISGRNKAEEGTGFTYHLLQHPRRSSGEFFGSGDPFPELYEDLGPISELQNRGSRDSGPFFTFSSSFPGHSDFSSSSFSFSPGAGAFRSVSTSTTFVQGRRITTRRIMENGQERVEVEEDGELKSVKTKGVPEDLALGLELSRREQQPSVTSKSGGLRSNRPCLMPLDSDSVR

SEQ ID NO: 942613 - protein, 209 aa, Homo sapiens
MGGPKPHPESYVYRGPEAACKLRSTGTIEPQCPTIKEIRDQGSCGSCWAFGAEEANTDRICITHQIAHVSVEVSAEDLLTCCGSMCGDGSNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFSSTSQECTTR

SEQ ID NO: 942614 - protein, 149 aa, Homo sapiens
MWLHNEDIATELPYNIFPNLFDRSLSNDMGYLIAVCDVLAKKHNCQCTCSFLLSISYKPPQDLAFEGGTSVLDIVAQVYNQAAVCNLYFSFAIVTFRNLLGELNTLAGFFPALFVPVGPKPSPCLTQLAKNEKLAFYSEEMVSVRISFD

SEQ ID NO: 942615 - protein, 253 aa, Homo sapiens
ACGCSGCALLVLLARRAAAWDWAGSEKISGVRFTPVVCGLRCVHGPTRLPLYPDLRAPNATSVDSGAPGGAAPGGPGFRAFLCPLICHNGGVCVKPDRCLCPPDFAGKFCQLHSSGAAAPGPGLPGLTRSVYTMPLANHRDDEHGLASIVTIHVEHPQRRRWWLHQVERVSGPLEDANPEAVAPPEAAARAEAAAPYTVFAQSAPREDGYSDASGFGYCFRELRGGKYASPLPGLRTQEVCCRGACFAWGRSR

SEQ ID NO: 942616 - protein, 116 aa, Homo sapiens
MCEVGSFVPDKVVAEEDEHDEQQEENESYDPTDDGVVGAGGGGKRNGVIKIAGCSEELLAENACCVRMLKQASCKAKILLERKAKASGAPSPWRSFFQGRAQKCPLPFFHISAIAT

SEQ ID NO: 942617 - protein, 301 aa, Homo sapiens
RAPKRLGGALSVNIVVHTLPIPSPRGFRLASAQPGSRPGSAMGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKAPSPTAAMCNSTASPFMHWVKKTSQLRSKKAHSPPLLLSSFWAAKPCQPRASPWQQRADQRSSTRATKPAIQARSQMAKTFHCSAARLTFQDYPGRMMGAGIVCSVNHESLKGADRSTSQRIEVLYTPTAVIRPDPPHP

SEQ ID NO: 942618 - protein, 59 aa, Homo sapiens
MLVALIGGLPLIFAGLVGAGGFSPLVIQLLRFIAVLPAAVPIRRRVQVLGNGDGLVCTI

SEQ ID NO: 942619 - protein, 272 aa, Homo sapiens
MNSRDEEVPNSGAEMFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNKKILGFRLTRTETEKGARYSAFRRRGKFPQKSPSFLFLPHLEEGTRCLLLERYHTGIRDPGGPGSLHCYLEESCSLPIQCEPSSFQKEPVGFHDDPKCHKRHLRFQTVGIGKERSIYFPSQLPFLSSLSPGPGLKIVEWWVWAVPHWGRKGSTAGMWRDNNG

SEQ ID NO: 942620 - protein, 112 aa, Homo sapiens
AEPYEKIIKTLLKKKITQKKRRGKRGRMWGREFWRGPGGGSEMTAGAELLVETCPVHCAYALTAGAGSSPSLARAPKLHAPSRPLPEAWYLLLTKVALRKKQKKDPKLEKGL

SEQ ID NO: 942621 - protein, 243 aa, Homo sapiens
LVDPTYPPLPAKASSPIMPYPTQGQEKQEHPLGRSPSSYTTPPHYTPGLLWSTLLSTNQPTNLDHRETLTSPTSFDAIYHTTLTPSHIFTNTHPSSPSNTHTTHSSSSHHFNHHTTKQPISSSHSSILPIFPTGQLRYQENISKPLPTTSSLLKTYITSKSTYHHTPASPLPCRANGGEAKREAGSGLGRSSPGRQAEPACAQIGLGAREVFDYPCGIYYGADDREQQAVKLPQKEKHSIRQC

SEQ ID NO: 942622 - protein, 244 aa, Homo sapiens
MDSMRDLASRCLLLLPLLRQLLLLLPAPELGPSQAGAEENDWVRLLSKCKCVNNVAVELKSAFEETGKTKEVIGTGYGILEQKASGVKYTKSDAVKRNKLKTLQKLLYNLKEEDGSNRFAKGCEKTFETLHNMVHKGSSGWIPYELWTESPAEVADLKKQCDVLVGKFEAVIAWSQQPPAENLSCILCAIHVLKGKDTSCLAEQWSGKKGDTAALGEEEAKKKSSRAKAAGGRNSSSKQRKESG

SEQ ID NO: 942623 - protein, 185 aa, Homo sapiens
MARGAALALLLLGLLGVLVAAPDGGFDLFDALDDNENKKPTAIPKKLSAGDEFYLGDAVFDGENYDPRPPNPPKPMLNENTNNPSSFGSFLDADFADGVSGGEGKGGSYGGGSYRKDGEEADAPGVIYGIFGAVVVAVAGAISSFIAYKKEKLCFIENAEQGEVDMESHRNANAEPAVQRTLLEK

SEQ ID NO: 942624 - protein, 81 aa, Homo sapiens
LFTFTYSAIPGPPGALNEKAKSREITADLTGLLPKRTSPVRIPAKRVKYLGYLCSDSLEMEELFQSISCLPNIHSRISPTK

SEQ ID NO: 942625 - protein, 49 aa, Homo sapiens
MVILNFIGSSRIRNTESNNFTDIPIFISLKFRPLIRSCPGKIPVMLCLF

SEQ ID NO: 942626 - protein, 154 aa, Homo sapiens
MPYFMEEKHSPRQPGASAHLLPDGELGGEHSRHIDGHGLPRGRPKIGEEAVPTTLVLDPAQQPLPEEVQFPAHDGSYQFRHLGAQGLEHQFAGKVEKGDNPAPVEVAVRKHVSCHLEKDLWGGVFFHGGNYPLQLHVTFHFVPDALKFAQLLGG

SEQ ID NO: 942627 - protein, 257 aa, Homo sapiens
MKHYYPGTPPWTFHPGSESGGPPPPPPPPRTDCAASPGLPPQRAAIRSVPEETSSSTCFNWAAGIPTCTLSRSLISPSPPPGTPAPASRLTPAPPPPALGRVHLREASAVLLSPSSTGRCLSIHPAAHVWQAGEGVELNGRRPRGERGRFGPSIWVPGALGPPAMADSGDAGSSGPWVEIAHQQQKEKQGSRSGGCRLPPSPAPGGAHANLRLPSPGLDQQLPGRTSTPIFSGGAGEPPNQTSDYGGKSGSSRRNLK

SEQ ID NO: 942628 - protein, 153 aa, Homo sapiens
TATSWYWLQILYKGVYLSHEFLFGFFLRNILFEILQQHWFVHQILILELRCFVIFLGFVLVMELLYVGQLNFFVLLPGPLVQCLQTNLGRSLEVDEAMSCDPAGKLPQEKRMPVLIDMPLDVTEGTIFKKILCKDIPVTVHRPLKDLYWLPGL

SEQ ID NO: 942629 - protein, 258 aa, Homo sapiens
PCLAFQCSSIWEMNLLAGAGESGGSLPPALSDLFLAPLLKKRSRPKADIASFEYCETGPVQKRVSCPRLPCSGQGAGGAEGANDAVCEVTEEPMGITLTLNEELSCTVARILHGGMIHRQGSLHVGDEILEINGTFVTDPSVDQLLVAMEEAKGLLSFKVIPNQQSRLPALQVFMRAQFDFDPPVDNLIPCKAAGLVFAAGGIFQIINKDDSYWWQGRVEGSSQESAGLIPSPELQAWRVASMAQSAPSEARAAVPLG

SEQ ID NO: 942630 - protein, 134 aa, Homo sapiens
LSSHETVLASLEERSRFFSDVIAPPGVLLSFPITFLLPATIPRPPPLPPPLPPLPPPPRPRPPPAPPPLPPPPPPPPPPPPPPPPPPPPPPPPPPPPPSPPPRPPPPPPPGPPPPPPPPRPPPPPPPAPPAPPP

SEQ ID NO: 942631 - protein, 155 aa, Homo sapiens
PQPPAPVPTDPSGTMHPAHPTQPDPRSPPPPPETRTPVTTEKTSPETEKKEEKKNAEAGNPHADGGRPQMWQPNLEEAPEGNKEETPNEKQEGVARVEEQHPDKAQRNRKSKNPTPKSARKGRMKRENRGQRAKAAEYIRQQKRDPQERDAETTP

SEQ ID NO: 942632 - protein, 69 aa, Homo sapiens
DAAPQLGKRKREWEVEEEEEERTEEKEGGVGNGICALVGLVSSGLGEGGGGGGGGGGKEEFGGGGGKGG

SEQ ID NO: 942633 - protein, 155 aa, Homo sapiens
RRRRRRKAHKPGCKCLKRPSPQKSKPKSTGRQSPEGAPRRTACHTPGPPPRGRTSRARPMTESPVQHPRMQVKHESPEAPRNQHNPEAPKHKHTPKAAKSDHRTTRRSPPHAQKRSKPGTGTPKAHRTPPTQPPSHPPEQTHRPPQKEEEKRQPP

SEQ ID NO: 942634 - protein, 34 aa, Homo sapiens
MLYTHWMLRLWDSRWGKVIFLLVISRLSDQAEVL

SEQ ID NO: 942635 - protein, 314 aa, Homo sapiens
GSGMKPPRLPTLSSDGATPHESETTSYPPHANWHPGPNASTNGGATTIHTDTRNGTSGDARNADASGACDRSDGSGADTARALLWLGQALRGPLWSEHVAPDGRIYYYNADDKQSVWEKPSVLKSKAELLLPNVRWKEYKSDTGKPYYYNNQSKESRWTRPKDLDDLEVLVKQEAAGKQQQQLPQTLQPQPPQPQPDPHLCLLAPPQCPQASWNLSQVGVKIVMCWRPPAPGTGFLQQLEEGPAVLDSISHSRRRRNQSQNQRGLASVGATVEKAKQAFKELLRDKAVPSNASWEQAMKMVVTDPRYSALPKLS

SEQ ID NO: 942636 - protein, 154 aa, Homo sapiens
TKGRWAGLRPPPLLQGPLRASAAGATRSPNTMVRYRVRSLSERSHEVYRQQLHGQEEGHHGQEEQGLSPEHVEGLREGPMAQSHYRRKHCSRRRLQRVSFFVVLLRITLARRRKRRLLAGHREEEQRRLQESSEEEHARKATKASLWPPHPPVW

SEQ ID NO: 942637 - protein, 255 aa, Homo sapiens
MKFLLILLLQATASGALPLNSSTSLEKNNVLFGERYLEKFYGLQINKLPVTKMKYSGNLMKEKIQEMQLIIGSDGPPGPLDPSPLKDDGSPIRMMRVPADPSFQGNARGARIEENYITYRVNNYPPDINPEDVDYAIRKAFQVWSNVTPFKFSKINTGMADILVVFARGAHGDFHAFDGKGGILAHAFGPGSGIGGDAHFYEDEFWTTHSGGTNFFLTAVHEIGHSLGLGHSSDPKPVIFPTYKYFDINTFSPLC

SEQ ID NO: 942638 - protein, 138 aa, Homo sapiens
IESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQVDLKIIEEKRKVHKEAHQKAREKYGHLLWEFIFKFFQINP

SEQ ID NO: 942639 - protein, 272 aa, Homo sapiens
AQPRQQRAPRCQPIFRTPPAGTADAPGAAEGRPGGRTDARSRALSPAAPRELGGDPSPASRGAPSPPRAVLHAVPQLRAPAGAPPRRPRAPRAPHRAAYLSMHRFIGVNSTAAAFPCHPNFFFTCLNSNTLFSINMEITELEFVQIIIIVVVMMVMVVVITCLLSHYKLSARSFISRHSQGRRRYALSSKRLLPSESTVSGNGIPEPQVYAPPRPTDRLAVPPFAQRERFHRFQPTYPYLQHEIDLPPTISLSDGEEPHPTRVPAPSSFGTR

SEQ ID NO: 942640 - protein, 281 aa, Homo sapiens
EAAAAGRAAGPGGARPAPGARGAGGSRGARPQPPGQGPAREQDEEAQPPATTARRPDASRASEQGKGGGAPTAAPSGARGRGARDAPSGTRDGQHEPSKPGKAGGERARQGGEPRRSKDRHAGPENRAGEERPGDDRGGGSAPEASGTADGAEGPREARNGNGRGASRERAEREAEESARQKTEGRNKDNEGRRAKGKKRKTKGQEGTAGGEGKERRKAARGNRPRDTGNRETSAGGRGPPRKGKEEESSRGEEEEERAKGRGGEGARAEKGKERRGKKWK

SEQ ID NO: 942641 - protein, 173 aa, Homo sapiens
GGAGSSELRAAASGSHCGRRRCPAALGCRTNKAWATAPQKPTQLDAGADKKGGRSRVGGRRAGRRTGAKGNSRGRRDQPLAGPAGEFDDLTRIPLPRVGEETEASQENQDPEKYSFIATRYTKDAQRSKSQFSWMDMAESVTTTPPPKNLGREIFCSRCDLHSSFHLTANSFI

SEQ ID NO: 942642 - protein, 264 aa, Homo sapiens
EGERKQEKRRGQRARGRGGGSKAGEGEGEGHGGTGGRAGGRGGRAGGARAGQAAGAVGEDEGEKHGDGGQVDEAAEPSAERGDRGEPATAQRESRPPRGSGNGPQRQSPGGERPQERGGGGQRQQQSGERGGQGPGEGGPERAGEAPAPPRRQGQQGTQAGAREREPEGQRGEGAGKRAAGEREEADRDSGHGGPRDRGRDEKPEEKQQPAAGTRAAGERHKPRADTGSAAQARGAGHEGRDGRRRGAQPGRARAHTDGQGGRG

SEQ ID NO: 942643 - protein, 101 aa, Homo sapiens
TPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 942644 - protein, 289 aa, Homo sapiens
TWWIFKHSEEEIMTREEECASISPELFHRVFLQRDIKSGVTLGKTSYLPDSGEPPKKDGALEERQRHAEAQAGEQGHERGARQPRPARGKGGAGHSRPRRGRTGAGHQAQRKGGGGGETGLGQGGQAGRKRRTARDPPAAAAQRAGRTGRSHDTGPQKGGLDPKRERRRKGEVKGQSGGLAGTEERGKTVGPRGQQLKEHKFLEEGKNDKERKEPSKGKRGAEGRSRKRGRKGERAREKKAEKKKKGGAQAGHQRPGRAAQHGGRPKQKEQGGQGGKTSPGNTARAQRH

SEQ ID NO: 942645 - protein, 115 aa, Homo sapiens
MGEFISSGTTRKKKLITLKNVKKYGGNSVGDRGPLGDPEKEMRYWGELRKEAKSPPGAADDIKEPVEKQTERDETNAENQTEGQITGTAKPNFPNHGGGEAKGGGGGGAERKPPH

SEQ ID NO: 942646 - protein, 115 aa, Homo sapiens
SSLRTNTSLSCLKLQVFCNILGLNIYPLIFHPRQICLYHGNLVQESDILMYLIQALSATLRFKDYTNLAVFPLQPAKTAFALHSASSNEATTKFTKSGIEFDVYSCILCVFLCMK

SEQ ID NO: 942647 - protein, 108 aa, Homo sapiens
GGALPGEGSSELLAGTSSVMEQMKRKSSEACGLERQLSSCGYYRCHCQFLTAGPCGWSAAPRTQYAFQPRLSVYIPSESVCLRPEPVILPPIQTCPWFLGARALAFDN

SEQ ID NO: 942648 - protein, 159 aa, Homo sapiens
MAPCLSARVLLFFPTPGRLRLAEAWGEKKSKIRCHCRIIGISYAVALIVGEEYIPFNQYAGKYVLFVNVASYGGLTGQYIELNALQEELAPFGLVILGFPCNQFGKQEPGENSEILPTLKYVRPGGGFVPNFQEFEKGDVNGEKEQKFYTFLKNYCPPN

SEQ ID NO: 942649 - protein, 118 aa, Homo sapiens
MPLRVCSELADRLVALKVGWEVAYAVHGLHQLWQVGLDLIHGADFQAHLFMTVMKSETTFAMQQLRLPFWSLMVMGRSSLIRSMASGQFRRNLRQILSIELISDLWTCLKAALYWTRS

SEQ ID NO: 942650 - protein, 221 aa, Homo sapiens
GRRPGAEAPGARNAFTKREGGKEEAAEQRQQREGQGTGKAQPAPGQAAGAGGAAGSRGGKGGARRRGGAKERQDPRKRAPARMREGNDIERPAGAGRKGISNGERSGLIQGGKKPGQGKDSSTQDRGEGGPTQGSGVGRINTISDQVRGGGVSVRPCPCAALMQSELPQPCCLLTQKHSPVMGLVTYHIPKTTTFLVLLHNAKNSLTHQIGEIVAILSSDQ

SEQ ID NO: 942651 - protein, 274 aa, Homo sapiens
RSPQVPARGPRRRPPPGGPEGSGARRHHAQLYRARRASPEPPLSPTASSTPGPPGRTMSHGPSPRLESPQLSKGSLLTILGSPSPERMGPADSLPPTPPSGTPSPGPPPALPLPPAPALLADGDWESREELRLRELEEARARAAQMEKTMRWWSDCTANWREKWSKVRAEPNRAREEVRHWRQALDALTKELAGARRERQRGAGASCEGTGAASSARLEGAPGGVRRPDAPTAPERKRDPEPSCVDVWFRRGRQEAKELEVGGRACLKSMPEEY

SEQ ID NO: 942652 - protein, 353 aa, Homo sapiens
LRDEETSSEQLSDFPRNRTAAWKEAENGNYWAQAPALEHVQGCPEENPAREQSPSPNHSPDPPATGLCQSTQTHSRKRMAFRFPFNGQASTAKKSSCLTGPPTLAPLSLTGGIPVQSWCGASSQLLQQAVERAQLLLEVALVLTILLLQAGQHLVLSLQAGQCAAGLGVLRVGVLAGGLGEAQCVRHLLRGIKVGRRRGWAVISPQRCAQQAWEEVYLEIVLQLLWGHLLGQLSLLLGEHLLRDQVVEQCDHAHGEHLRALLLHQGPQDLQPPELQELPLGIGEVAQRGAQCKQDLLLCSERLLRGQDDQQLLQGSPFDGLHLDLGVAGKAAPAQTPILFTRGSVLFSPLITL

SEQ ID NO: 942653 - protein, 242 aa, Homo sapiens
SETSGSRQTLFLDHPPTILGTMAAVAAASAELLIIGWYIFRVLLQVFRYSLQKLAYTVSRTGRQVLGERREEPPTEAPAPSPGRPYDEVLVCIWASKGESEEEECGVLCVSLEEEELERSVRRKVEERRRSKENEEDKRFIDKEFEKVKIRGGVGRGGGIGGEEECRFGDRQRIVIWTKSGQHHPSPEAKAMPAGPTMEIKTPTSQQNGHSDIASRRPESWCSTNSVPVWRDWRAQLRKEGG

SEQ ID NO: 942654 - protein, 130 aa, Homo sapiens
MPQHSTMLRIISKIMITATTMAAMPMRYSFPEKRSSIFWWQSSLKRLLMMLLPEGHKLFLSTEVVKAVSVLEPQQSSVSWKVFTTALALLASSSTTACCEGLVIELLHILGDLVLVDKAQMPAAAHRQQD

SEQ ID NO: 942655 - protein, 153 aa, Homo sapiens
NISFHQTPPPTHTNSSQLSSIHLILITLSTNNFNLFTSFITSTLQYIYINLSSNFHPQTTKLYHHIKSTNHHSHPYNNIFLYKLIKLLLYINKITSALTTHFLSYSIRSLLSAASPHHLRFFTHVSPKHTIQNSDRYKTQRLLSQNTITLRDV

SEQ ID NO: 942656 - protein, 107 aa, Homo sapiens
MAGVGRVRELGPCASIAFGQATGVVDGNVARVLCRVRAIGADPSSTLVSQQLWGLAQQLVDPARPGDFNQAAMELRGHSVYPTAPTVQPVPCGEPVPGIQTVEQDSS

SEQ ID NO: 942657 - protein, 106 aa, Homo sapiens
FFSFCIMPILESSESWARGSVVSGGQGTGHFSYHLLPGSLPLRGEFFAEMDFQNGHQPISQELEVLRIHMQLVTVQFTQLGKGALDIIQVLFGFSQWFFAPSSHFR

SEQ ID NO: 942658 - protein, 82 aa, Homo sapiens
MQPEASSLSENRDASGPRRGCWLWGKERAAQCDRASAHGSGSASHVCGPGPDSTPTPSPAGTGLPLLPVGRCPRWATSPGPR

SEQ ID NO: 942659 - protein, 44 aa, Homo sapiens
MVAWGAQALMVASSLAVSRSSCSWGLKITELTTSSCRSLARQTV

SEQ ID NO: 942660 - protein, 146 aa, Homo sapiens
MVIALVSFLVLLSLGFFFTVSLAFSEWSSGKKLIGRWKPTEFPGVAVLGISSEWGMFKPTVTQATKKIIFVLVVVKKLLKDHGRVPGVVLVEMLLLHSSDSRYLVTARGYLAQVMACSSCQPGGSPWSAMEWLCRRYCACGPTGSP

SEQ ID NO: 942661 - protein, 134 aa, Homo sapiens
MAAATGPSFWLGNETLKVPLALFALNRQRLCERLRKNPAGAGRRPFVVVQGGEGRPAHCTDTGVVFARRFFFYWRGVVREPGVRGGNRVEGVRRVLLSGVPCQAKCQPLEMDKEVNFQKEAPFTRKKANARCDR

SEQ ID NO: 942662 - protein, 133 aa, Homo sapiens
MWLVMEGAVVQVGLALGTRGLAQLHVQEVVHPSHDLLAGAHHLQRAAVVHVVAGFVVLADGKVQFTPHTLLLHAGVHGASHQERRLAGTRAGSRAHGQGHGQDEQQEQRGAQGPGHGRLGRGKGELGAGEKLE

SEQ ID NO: 942663 - protein, 118 aa, Homo sapiens
MYFAVFLASVSATCFLAGRVWVCPDGLERGGGGPCVFGPGFGGRFGFGGCGAWLVSVRPVGGFARRLAVGVPPRWVCGSNVGFGVCSCVCVCACGGLGLPFVFSLAPLPVSHPFPSGF

SEQ ID NO: 942664 - protein, 127 aa, Homo sapiens
MALFGVGKVDDEMLSITPLTFEVSIIIGKKVLFSEMVMVVDVSDLFQGTMSKLRRAKIYKWSYEGQPSMKKQKLMREEDKSSQRSEDLAAKSGAGVGCCDGEEIKQRLRSMHWGPLFLVVRVGKSKR

SEQ ID NO: 942665 - protein, 279 aa, Homo sapiens
ALTPSTLQDAAREDPTTRGRLRGPREPRRLRSPTPPPPPLTGPRSRGRSRRLRGGGGRPDEPSSARSRRPASQEDMFWNFYLHTSSHLDTLLQREDLSLPELLVRVKIFCRIANVVKRKFAGTSCFSHTILQAMVAWVTQEPPDSGEERLRYKYPSVACEILTSDVPQINDALGADESLLNRLYGFLQSTGSLNPLLASFFSKVMGILINRKTDQLVSFLRKKDDFVDLLLQHIGTSAIMDLLLRLLTCVERPQLRQDVCQLAQRGEDRPAADLADPPV

SEQ ID NO: 942666 - protein, 239 aa, Homo sapiens
MAGPRPRWRDQLLFMSIIVLVIVVICLMLYALLWEAGNLTDLPNLRIGFYNFCLWNEDTSTLQCHQFPELEALGVPRVGLGLARLGVYGSLVLTLFAPQPLLLAQCNSDERAWVGSGVGCVLSDGGEGGWGPLPRLVWEWVQVYHPGAGFDSLGQRQAFTPLLDHSLAVFPLRAVEGWEQAGELLKAYVIARVQFQPWSEVAHLLSHLILQLTLISSSSDGTTTEEVGPLCQRGRGEAR

SEQ ID NO: 942667 - protein, 223 aa, Homo sapiens
ARGGYLQRRSSVFPFISREPGVPPRAPRRSRQSALSPPSAALHARGGGSALAGSEGAAAVMLSAIYSVLPGLLFLPLLLNLCCPYFFQDIGYFLMVASVGLVGFAVRAAVAGAHPPAGVPGEFSPDATQGFSPLLPQDSHLPAGGLALNQVARALLDHLGLCQGDCVALLMCNLLSYVWLLLGLVELGLCHGVPQLQHPREVPAALLPVLLVRMCCWCRQNYK

SEQ ID NO: 942668 - protein, 247 aa, Homo sapiens
LNTLLLPGTLLSGPCPGSCRAAAPFSEKRSLVGSRTGLSVEGGAVRGSVLGCGFLCLWAACFGLSLYVGVYYKWLLCQTRSAPHLDTHSPVAFQCSGRKPVSLDVKLTLMGWGRGLGRRRGRGRKSSSRHAKQQKRSQPKFSYIFQTKLLPEKSLPVPSWSCPPQGVFLPSLSWCGLKGHSQTRSPSSEAEACTHPSTATSARPRGSWRASFAIPIVTAMAGLTHGAVRAASWSSPLPSACPPLPAS

SEQ ID NO: 942669 - protein, 177 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKTISVFMKRSMQWSRTETQVGIYILSSVEMGPNTETQRSSGKSRRKRQIYGYDTHGSRTFLGTAFPAHPPLILTPTVKYVTRGWARAPCVGRENMS

SEQ ID NO: 942670 - protein, 65 aa, Homo sapiens
EGSSELLAGTSSVGTDERKFSEVVGSTPVASSGTQGHAVTAGPGLVSSLVRKVPAAVSLKVCAAT

SEQ ID NO: 942671 - protein, 205 aa, Homo sapiens
ISTASRHNKRLKRTHTTSKAQCFIARRIPITPQAKTHFQPLSCSLLLSSFPPLPQAHLPFSWHHQLMPAQCMPMALLQCITIFNSTHRAHTIFAQPAHIAPSFQHASLHPLAHRVFWIEDKVKTCTGTACCIISKLMNMESMQAFSQSFNVPHTFTASITFLLLEIKDALHWAAPPSPRTRPSLAITGQDTPQVLDPQDCNENPT

SEQ ID NO: 942672 - protein, 119 aa, Homo sapiens
SPRGRSPALALSAAAAAAIAKPRAALLPLLLLLLAAPASAPCPGPAARRLWPPRCPNTLRTGALPAATGTMRRRPGPGSVRLLRSVRRARRRRVRPASRPVRRRAAMRALRFNHHKHFL

SEQ ID NO: 942673 - protein, 273 aa, Homo sapiens
MVPRTLLLLLSGALALTQDAGRASQSSGGYFYYLQCASRPLRRGVGAAFIASERLSLASRRREFVACFGTRDSSRAHRDGAEGAGGMMSRRAPDVLCEQETRECERAQSQTDRVDLGTLRGYVTEQNEEGSHTIQNNVWLSKWGRYGALPEGDREDAYNGKDYITLNDDLPSWTAADIASEITITHIEEAVHAADSMKAYLEGRCVEWLRRYLENGKETLQALDPPKTHMTHHPISDHEATLRCWALGFYPAEITLTWQRDGGGPDPGQGARG

SEQ ID NO: 942674 - protein, 65 aa, Homo sapiens
MAGVLLLFRRHQSRPLLEGSIPCRPGLHELRVLGLLLPIPLPGQCDLRRLEAQGPAPQGGLMVRD

SEQ ID NO: 942675 - protein, 211 aa, Homo sapiens
RWPPGGWTSRGRWELRCDAVRWFQPRCNGSRAKVRQRYFFRSFLVSSLGGLLAVALSVAAAYPRALSRLRRYPLAEKGSLMGKEALEKREHEARRDTNTSVCSSLNNSRTPRWDRCVGTVCWFQVLRRPLPAGRLGAPREPREGVAGLSGGARGSAVGGGGPGKGGENFLESSKEGPYLAWERVGIFVWYSEGREYSAPPGEKKWVPERTT

SEQ ID NO: 942676 - protein, 280 aa, Homo sapiens
GKRGGPNPGRQQPPLRIQTFPAVRNTEGNRSTTPHRAGAHQRSQHRAHHPRAPQAPRRSPPARSRVGGAQGPKEQRKQPHHSLGALGEAEEAPPASPTPHVGGARFNRKHNRQQQHPHQQGQGEAVVQALGAALVNGQNPLHQGQQEEGGAKNTRDTEGRNKTESQKHSTHQHKHKGVQGQQTNGDLGQQHVGERMADMRRALFSSLLRQDITFFDANKTGQLVSRLTTDVQEFKSSIKLVISQGLRVHPGGRLPGVPVHAVDSLTLLLMVAHSPDGSGT

SEQ ID NO: 942677 - protein, 244 aa, Homo sapiens
MSDFGAARNLLEKEELRSELANTDVGDLVLTTLCPALHVLVAEGLKPFQKELINGKRKKKPLKNGGGVGENQSSNTRSLGTLYNKVNQYKPAEKNYRGFHAFILGLLNTKQLKLWFSSLQEDAGSWWEQLTQASRVYASGGTEGFPLSRWAPGRHGTAAEEGAQERPLPTDEMAPGRGLLVGKTIWSAWGPAENENGALKSRRPSELAAPDSECVGSCEAGGPPEMPSPQSLRLSTKMGNPEAV

SEQ ID NO: 942678 - protein, 218 aa, Homo sapiens
PNGGEARMVRHHLRHKDDRPQVSGISTPRRGGGGGEEGATPQSAAWSIREGRAWGRASDASAEMVWNRVRNRAQVQRRALGLPPESHLGAEHRAAIDMLGQRGPQRWLCVGTRGKWLTLAVDRYWMVPEGLDWCSAVGARTRSSSFNGELNHCWAQQDNAPKVGGPQQHFQVVGHLSPTSQNCRAPARKKLSMAEWKKNSEKATYTIRSSSCSWGSLP

SEQ ID NO: 942679 - protein, 103 aa, Homo sapiens
LGALVSEIRESEIGESDTGQSDTGQSNTGELDWASGGERLWDNYCYNFEGSRKKIWIILKKNLEKKKIVCVSTLNEEMDSIKSKQNEEKKKIEKNTERKKKLI

SEQ ID NO: 942680 - protein, 195 aa, Homo sapiens
WRFAIVRPKLASTGVISAHYNLRLWVLAALLPLPLVSLGFRAHASTPGYFFVFSRDGVSPCWSGWSRTPYLRLSHPPLLLCCLGVTGVGDSPAFFFFFYKKGAGEIFYRGEDRSSSRAPGVPSPGGAGTGFLGSVPAGRGSGGGGGFLGSVVFCDLCRKVFPPGLVPWEGNFGFLFGSTLLGVWMPTGITAGLWC

SEQ ID NO: 942681 - protein, 262 aa, Homo sapiens
MQRNERWERIQRALKLEYPGSCALGLIGQTILTHSKNKEKRGGVAVPPGSSPVPKVPPSSSQWEADAGLVDAEIESSLEPNTISCMVFPPGWRGDSYHNATTVNGPPVNRPAFGAPQVVGSHQPLLAVTAVVSLITYCGQCLGHVLLPGRRASSGQLTAITCSALRCADLIIGIFSMNLYTTYILMGRWALGSLACDLWLALDYRVASDASVMNLLVISFDRYFSFPRPLTYRAKRTPKRAGIMIGLAWLISFILWAPAILC

SEQ ID NO: 942682 - protein, 228 aa, Homo sapiens
MSGPCTCLSWGCGAARSSWAVRLGCGGLCQSGCRSGWGWAQCGGCCLPGSSSGFGCFPVGLFGGAILGVSGVSYTRLLANIFLGSRTGSSQDLLGSRELRRALGLDFCWVSSMLEGVGVGSGRQKGVWESCRIDYFWSFGVVGFFKLQVGVNGQLERAMGLEHSVVKKPGKRNGLDGTSLLKPGQAEQGKSQEQGRPGAWSHCHQVGCPQDPDWFGELGLGILEPVSC

SEQ ID NO: 942683 - protein, 266 aa, Homo sapiens
VPARRRQPWPGGRARGSLHPRRPHFLYEVPPWVMCRFYKVMDALEPADWCQFAALIVRDQTELRLYERSGQRTASVLWPWIKRNARVADLVHILTHLQLLRAREIIKAWAPGPPLLSPGTIAPKPSSIPPPAEAEAWSPRKLPSSASTFLFPTFGGSQKHSGPELGLVSSPASLWPPPLSSASFSTKLGSESSVFILGARPFPFCWPLCEISRGTTTSRRSSRSGRVALGACYRAVMRNTVYAVKRLKENADLEWTAVKQSFLTEL

SEQ ID NO: 942684 - protein, 128 aa, Homo sapiens
KRGIEKNMFRSHGAKHMRGRPQMRDQQNPPPWPKSDPSSLHHPPPPPPPPPPPPPPPPPPPAPPPTPPPAPPPPPPPPPPPPPLRAPPPPAPPAPSPLPRTRRTQHSLSPPTCPPTTRYANTQISELF

SEQ ID NO: 942685 - protein, 121 aa, Homo sapiens
MLFFRRSTVAFLSRSQCNEQITPLVIDNLSACKPSFAWDDTPLNRVSFQSSGAPNTKVVMVRMGQNHSYVGDETQNKRGILTLKYPIEHGILTNLDDIDKIWHHTFYKELLVVPPGTPIAC

SEQ ID NO: 942686 - protein, 297 aa, Homo sapiens
MLGPCMLLLLLLLGLRLQLSLGIIPVEEENPDFENREAAEALGAAKKLQPGEKAAKNLIIFLGDGMGVSTVKAARIQKREKKEKMGPELTLAMDRFPEVAPEKKEKEKKNVPKSGAKKKGLNVLGEGKPEKHWLKCNRPIKPMQHYTLKRGDLRNESGQKNREVNGNGNNHTNKNTSPAGTYAHTVNRNWYSDADVPASARQEGCQDIATQLISNMDIDVILGGGRNYMFRMGTPDPEYPDDYSQGGTRLDGKNLVQEWLAKARGTRYVWNRTELMQASLDPSVNHLMGLFEPGEMK

SEQ ID NO: 942687 - protein, 300 aa, Homo sapiens
RKGVGSRRCGRLGPHGASGAAPRTRFLALDREAALFLLEPRASQARRSRLSLELAVSGARACAPRGTASAPERPSWQSSLGRAYRAASPALARAWQMGVNACVDVVPSGVKLLQALGLSPGKRKEESIQHSRNDLEERLHIDFMGKGAELLSASFSDKETFHDIAQVAQSLPGAQVLLCGPVGPKLHELLDDNVFVPPESLQEVDEFHLILEYQAGEEWGPVKSSPANRFIFSHDLSNGAMNMQEVFVSSLEEFQPDLVVLSGLDMMEDKARSSEEEIFGGCNSISDIPLVYSSPRAGSM

SEQ ID NO: 942688 - protein, 229 aa, Homo sapiens
MRDRRSANRSVVFLEPQWYRVIEKDSVTVKCQGAYSPEDNSTQWFENENLISSQASSYFIDAATVDDSGEYRCQTNLSTLMGPWCMLEVHVGLAVVSRPLGGCSRRKIPIHLRFHSWKNIALHKVTYLQNGKDRKYFHDNSDFHIPKDILKDSGSYFFRGLFGSKNVSSEIVDLTINEGLAVSTISLFSPPGYRSLFLLRDGTPFSSGHRTIFLCEEKHLKLNKRLVGQ

SEQ ID NO: 942689 - protein, 114 aa, Homo sapiens
RPQHMVVREKILDLVISCFKRHGAKGMDTAYVIELKEISSTEKYLRRVHVWVSCTDLKDQGGELFSRRYDLTVPFARDLAKNKVKKMKRYHVGKVWRRESPTIVQGRPWEFCAV

SEQ ID NO: 942690 - protein, 125 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACQPPGGTEHTWPEGEYS

SEQ ID NO: 942691 - protein, 76 aa, Homo sapiens
MEYMSTGSDNKEEIDLLIKHLNVSDVIDIMENLYASEEPAVYEPSLMTMCQESNQKDERSKSLLLSGQEVPWLSSV

SEQ ID NO: 942692 - protein, 111 aa, Homo sapiens
SQFPPHITLLTPFTFYSSSIISHHNKFNTHLTTLLITLSKLPPQSSPLSIHSHHSRINTITILHQQNEQLNLIQQRLYQINNDITDTHNTLTQLNKFCVLSLFPSNITNNF

SEQ ID NO: 942693 - protein, 71 aa, Homo sapiens
GCCVTGDRVEACAPCRDQERRGERHRAALLPGRVSPSGCLHTVDVPGPVLWSPAFGPHLCLLLEIELLSGT

SEQ ID NO: 942694 - protein, 121 aa, Homo sapiens
MGVFEPSWEIWPKTSSWLVSPAPAALVGEAGLAGVWVLQAWPGQVVGDQGALGVNPTVEAAGTYVVPLGHPAPGLRMSHMPEFWRLHPPRGQLVISGPWSHRPCPFPGGTLGISPWPLFVC

SEQ ID NO: 942695 - protein, 125 aa, Homo sapiens
MGGGVIIPESQLGSGQATITGTAPMRLKPEEETPPGVGIGWGWAPSVVGGLGEGRAWLERLGVGVNAQAVGGPWGGRRARAEVTEERVPFLEIVSELLGQGRVRGAMASSLISLDGSSRALPRRW

SEQ ID NO: 942696 - protein, 289 aa, Homo sapiens
TPWGPAPWFLLLPLPPPDPSGPACSAPTGLQPASHRTFGGPRLERSAGVGAPRPQMQSSYREEARGIGSHILFAEKKGNKGSICKTSSLSQYFSHSCIQSSYKGHNLFTIPLTVHSALYKLKLCEYSGPPDENLQKKQEYMEYIITGSENKKEIELLIKQLKKSKVKNIMENLYANEKPAVYEPSLMTMCEDSNQNDERSKSLLLSGQEVPWLSSVRYGTVEDLLAFANHISNTAKHLYGQRPQESGILLNMVITPQNGRYQIDSDVLQIPWKLTYRNIGFDFIPRGAF

SEQ ID NO: 942697 - protein, 108 aa, Homo sapiens
GEGGRTAHDETTTPKATKTASNKQKQKRSRTRTRTGIPKGTNGISSRAFEDVIAEMVEKENIMKKCGKCNNAHHLKIKKKVNVKNELMCAWPSAWPSLKEFSLTASNV

SEQ ID NO: 942698 - protein, 105 aa, Homo sapiens
PRSKQGAGSWGKRRQESYRAREGYGGSGSLTGLLRKAAGWLLGARASPEKARAGTQSGHRSGELAARCSEAWKGPADTPQKAWAARMCTKKEKLFYKEELEKDKG

SEQ ID NO: 942699 - protein, 33 aa, Homo sapiens
MAAKKEYPAVLSLDEKELEEQFVKRKRSKGAKQ

SEQ ID NO: 942700 - protein, 208 aa, Homo sapiens
MEDHENVPIDIQTSKLLDWLVDRRHCILKWQILVLTIREKINAAIFRNMAMMMRRDRPAAVWVLHLLISLPKEFLDLLNRHRGLHEEYFWPILFTADEGLAGDFSLLYEKDKHSILCWTFYASWFVNVTFKIPSLKKKIAEVPSMLAKKQAARTDGGATARGVPKNARKKRTTSLQRTYWHSRGEKLSRRKNLHGPLGEGTLPEISLA

SEQ ID NO: 942701 - protein, 161 aa, Homo sapiens
MEGEPEDDVYLKRLYPREKYEVEKAVHLLKKFQILDFTSPKQSVYLDLTLDMALGKKKNVEPFTSVLSLPYPFASEINKVAVFTENASEVKIAEENGAAFAGGTSLIQKIWDDEIVADFYVAVPEIKPELNRLRKKLNKKYPKLSRNSNGRDIPKMLELFK

SEQ ID NO: 942702 - protein, 168 aa, Homo sapiens
MTLKNVTMRQGTVGMQPKKKRWSIPAEGRHLMVQKKPQQYSQRNSNSANPEEQCRRSWSSDSKKSVISSESGKTYYRVVLIGEQEVGKSTLANIFAGVHDSMDSDCEVLGEDTYRTLMVDGESAAYILLDMWENKGENEWLHDHCMQVGGRIPDCLLNHRPSELREGI

SEQ ID NO: 942703 - protein, 112 aa, Homo sapiens
MGAKEIFSYEESKEKFGKPKKRKGFSEGLWEIENNFTVKAFGYKFSQKKSCVEEPEPEPEAAEGEGDKKGNAEGSSDEEGKLVIDEPAKEKNEKGALKRRAGDLLEDSPKLP

SEQ ID NO: 942704 - protein, 137 aa, Homo sapiens
WGWNSRDCGEGHGGEIELERPALQEAYVRVVTEKFSMDWAFFIYEGKSNDIRVVGTGEGGLEEMVEELKSGKVMYAFCRVKDPNFGLLKFVFIKWKGEGVNDVGKGACASYVSTMASFLKGAHVIIKARAEEDVELE

SEQ ID NO: 942705 - protein, 198 aa, Homo sapiens
ALSPRREEPEGARALNHCSQSFSISELLSCDQGTRGFRTASSEYENNFKWDLVLSPILYFISIIISHYILKLLASTSPPTSSSQLPETTGILVLEDMDLAANEISIYDKLSETLYFFKQTFHQFGISDKAIKKFIKQLLEKNEPQRPPPQYPLLIVVYKVLATLGLILLTAYFVIQPFSPLAPEPVLSGAHTWRSLNH

SEQ ID NO: 942706 - protein, 208 aa, Homo sapiens
MPSEVARGKRAAIFFSALAILLLLQLFSNITKKELASFPNPISFALILFISSSFFILLLCLGGREGTGKRRSSPKKVEQGKEKEPGKRKKGKSKKPGAKKAYAEGLRDQGGREGPGERGSGQRRQKAMQKGGRKEESGGAALNWRTGEKLEQLQQLADPKDKEGSYNGGPKEGQAVGGGGEEGHPGKAWGNMHVGRARMNAKVGPKAM

SEQ ID NO: 942707 - protein, 171 aa, Homo sapiens
MSAVTHSPMMQVASGKGDREPLPPGWEIKMDPQTGWPFFVEKKNSTNTWNDPRVPSEGPKETPSSANGPSGEVSRLPLAREGHPVYPQIRPGYIPIPVIHEGAEKRQVNSFHVYIQPGMQRFRTEAAEAAPQRSQSPLRGMPETTQPDKQCGQVAAAAAASPPASHGPERS

SEQ ID NO: 942708 - protein, 88 aa, Homo sapiens
MASPPQLGSRALSTASSTQMQADERAQGGRGLPPRPRPAWREITTPTSPEPHPPANQHRAPRARARRAAAHAQAAQRRRPLAPAAAAG

SEQ ID NO: 942709 - protein, 223 aa, Homo sapiens
MSLSDWHLAVLAYPLTPKSILRLPNTKLYSLGYIILFLKQLIAGKLQESFPDPELIYLIYFGRKLKDDQTLYFYGIEPGSTLHLLRKFWPEPDQKPEPVDKVAAMRDIPGVATALHSSSSYREAVFKMLSNKESLDQIIVATPGLSSYPIALGVLQDKDLFSVFADPNMLDTLVPAHPALVNAIVLVLHSVAGSAPMPGTDSSSRSMPSSSYRDMPGGFLFEG

SEQ ID NO: 942710 - protein, 136 aa, Homo sapiens
YLLPLRKSITLLSQKNNMQQAASMYSFRCQTQKYAFTPVSIIKHTTLKHACELAGPEGTALCPPAVRRQPGFSSGTFFPRVCYEIMLSNQSSSSSSVTFFEVLCCSGSMFFSSVTDGFAQTSSSWTTSPSSLDFRS

SEQ ID NO: 942711 - protein, 155 aa, Homo sapiens
MVLKKHEKAFEGTICAWCGLLKALLTKGNQSELTGDQKAAVAFQGGKGDRMKLEKFKRRKKGALLKSCLRKCKERRCRNAGLKMLNFCWGPMQKWILYDGNCWDFVKIKIKSENVLRSRGRGWLDDELKDAIVYSGENVGFMLKIVLKGLGKKNG

SEQ ID NO: 942712 - protein, 156 aa, Homo sapiens
SSRWSCEGPWTPPTPRFMQSLRPENQGTFCPKKLRHLPPPSEQEGDLEEAKQQLIRTQKKEAAQSNWLTANSPFIQKERRKKQTPPNQRRHTTPSRKQRPPRTGEPAPHSPRPHGATSQAARAQCLPHKPSNPGRAKQPPPTHPPRNLHLPQMIGL

SEQ ID NO: 942713 - protein, 319 aa, Homo sapiens
GPPRGAAQKAEAQPGPDPKPGPETLTAPGEAGSPPIQGRRAKGVSGAWAPPALSESNKTWRKEQKGRATGLLLKENSRPLQPEESIETPQDQDTKGPSQQANANPQEKAPAQAPERHPKHIGKTWAQLERGPEPPERGKSPLTHYTIFWTNAQNQTFSAIQNASARGLCHHGLEPASLYHIHLMAASQAGATNSTVLTLMTLTPEGRELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDQEQF

SEQ ID NO: 942714 - protein, 292 aa, Homo sapiens
HKRPLGGAGWSMNWSLKDADRLAGPAYGDLEEREMLVTGGESLGWGSFESWAYGPPPQLQRAEEFKRQAQEGNPRKPYEAPQRRQPMDPDPPLEGEVEQWPKDTVALLAWGWGYQGPQGGGLEPEGRRGEGAGGEARQEGLSGETAEREPRPWGSGAAQERAIKDLSAGARPGEGGGGNGAGGTLEQIGLDQSGEATGLSAVMGLPGHRLLFILLLHCEPGDGWRAKAGQLEGILLHDCGHQEPRLLLAGSGTLGQRGFFLLGLQQSQAVTTEAGEPQQEAEQAQDDVYSGP

SEQ ID NO: 942715 - protein, 133 aa, Homo sapiens
LLGVLVPAVPAVSREAGAGRGSGGVTCPLPPQVVLSAWGSRGPQPWALGLLLFSSLPWEPWAQKRHPPPLPEPPYRGVPRPAPGTPAFLGAGWLGPQQYLSHNSLRAEAEPVELGSGKTRCPGIGRKRPHELM

SEQ ID NO: 942716 - protein, 209 aa, Homo sapiens
MRQKHKRLPGPGGGQKTCSLLPHSIPPVRLGNFGPRFPSFLISGMALGKKIFKGSLLFLERACPDELNSENVVSANMGTTEEEIPCKMPRCLGVGPWGDGMEKDLLCQGSPGVKGNNVGEQPQLGSNVPCKKGPRSLNQPKMGSAVSHIFQGPGEFVVVCFVVCMCLIMKWIMRCKENNNGNDLYSNLYLFLYQCNLLRAFCLKSNMFK

SEQ ID NO: 942717 - protein, 208 aa, Homo sapiens
TPESLKSYHGSKAQSIHYPNGRGRMESVRWVLASQPESSLDEEFLGNKKKQLVQVAEMVTTCCSNKKPMGEIDGMKLVQTRSILHYIADKHNLFGKNLKERTLIDMYVEGTLDLHGTAYHASFLKTMISKRKWLTWPRKALFPVFEKILTGFTEQRNYLLCNAAEALAECDYSKTIFSSRREKFHKNPCLNFLSSWNKHVKLKYYPYN

SEQ ID NO: 942718 - protein, 135 aa, Homo sapiens
FICKYFRKQIYIQVLNFIREVRSCSSAHHEVETKMETSSPLLWNRKDDQGGNTGQYGEGVTVDTGVGCLSTSSHYANRNADTFRCLCRKKFHKLLKSQRRGVKKSCISVPHRQLSQALQAMRDSSEPWALLLEAA

SEQ ID NO: 942719 - protein, 164 aa, Homo sapiens
AHQGRAPSEPTEIRPQKRKKGPAPKMLGNELCSVCGDKASGFHYKFNCGGCMASSRALLIRELHYICHSGGHCPMDTHMAFGNARMSASQMRVSGMREECVLSEEQIRLKKLKRQEEEQAHATSLPPRASSPPQILPQLSPEQLGMIEKLVAAQATGVTGRSFF

SEQ ID NO: 942720 - protein, 235 aa, Homo sapiens
EAGWHRRGAAGGSGSEAEDEDDEDYVPYVVLRSAGSYCSRSSCSEDERKAAEEEQQDKGSEARGDEDDIPLGPYSTNVQTSWIQHQHLKEKAEARKESAKEEEDEGKREDPGECCRGPTIDVSEGDGKGITYDDPIKTSWIPPRYVLSMSEEDMSTMRKKYHILVEGDSIPPPIKSFKEMKFPAAILRGLKKKGIHHPTAIQIQGIPTILFGRDMIGIAFTGSGKKLVFTLPVIM

SEQ ID NO: 942721 - protein, 151 aa, Homo sapiens
VFELDNHYTKTDLIILFTVVIVYRPFTSYFLCIFLLSLPLPGSPLSVCDPPGGLVSLSGVLLVWGALDGCCWCLRVGWGGGPGWGGGGLVLPALLPAGFRFVGLLLDLLQVLPPILLLPHLLLFRLLWVCWVLSPLGQVGGRVPEHQGWCS

SEQ ID NO: 942722 - protein, 71 aa, Homo sapiens
CGERVDVPQNFWNCFLVPAALVTLSTLKRTVLLRGRHSPTVTMSPIWTSLTPGDRCDMFLWRFSKRLYLRM

SEQ ID NO: 942723 - protein, 253 aa, Homo sapiens
AAAPPPPSHTALATAPPTFAQSLGHRPPPPTQKKAAPVCCSRLEMSKVPVARVWLVLLLLTVQVGVTAGAPWQCAPCSAEKLALCPPVSASCSEVIRSAGCGCCPMCALPLGAACGWRLHAAPGDSFAARCRGSSKLCTPSAEAKAPVCRTLTPPLPMLQRQGALKTPKSTEITEEELLDNFHLMAPSEEDHSILWDAISTYDGSKALHVTNIKKWKEPCRIELYRVVESLAKAQETSGEEISKFYLPNCNKN

SEQ ID NO: 942724 - protein, 120 aa, Homo sapiens
MKGAPGVQRARLPSLGGGPARCTETDLCVLDQLYPHQTDGETDRQAAFLNPGRGKPQNKTASRAWAAGFQGAQDIGRANLWVYVGGAAGPGASCPGTLLCVCAGARTPWELEAGSLSEPT

SEQ ID NO: 942725 - protein, 178 aa, Homo sapiens
MANRDPCRLKGERATITTQRKGCSRGAVVDLGGPACPACYRRFLLVRTHDILTKVSERAQSVGDDGPTLATRGPMDTGGPASHRLPEGGEGGLRHSGVAVGSQPGPWEPWVAQGTKSHGYVWQGCTQRDKAMAGDLIRVDPCKKLYRQYCMRLPNNLNGTPQGATAVAGRTGHTSSVN

SEQ ID NO: 942726 - protein, 234 aa, Homo sapiens
AAAAGDSDSWDADAFSLEDPVRKVGGGGTAGGDRWEGEDEDDNLKDNFDHYDHQKKQKPQVKPEVKISKKKKIAEKIKDKKQQQKKRQEEIKNKLEQPKQPKVLTPEEQLADKLLLNKLQEESDLKLPKETFGVNNPVYGIHPINPSSTHHFTQFEKLLKHKITQYEKSLYYASFLEVLVRDVCISLEIDDLKKITNSLTVLCSEKQKQEKQSKAKKKKKGVVPGRGIKSHHER

SEQ ID NO: 942727 - protein, 319 aa, Homo sapiens
GAFAAESRVRGSSGLGGAAVMAAVRSDEFTMGKACVLSHSDGPSGPYPPRTCSDVAQSRRGFAPPGQQKREAPVDVCDREIGRSVRGKLDAWIGPETMHLVCRVFVRASVVGDLISDLLWTFFALSGIAARLLNALGLAGDYLAQGLLLSPGQVQTFLLLWEQGPVVVSWVAVSAPRLGAVALLGRILWGLKLVIFLAGFVALMRSVLRDPSTRALLLLALLILYALLSRLSGSRASGANIEAKVRGLERQVGGVAQAPEGSGQGGLQCGGGESRLPHTPPVSYQRAELLRGHAALLPAPCPFLALSLNLQNIDLAAAH

SEQ ID NO: 942728 - protein, 183 aa, Homo sapiens
LSTLQLSSADRLPPPPPPDSGGEERKDEKMDVNIAPLRAWEDFFPGVQITLPGRTSGTFPDWNNRVVSNMIILPEQQYLVVAALMISFVGFLSPFNIILGGIVVVLVFPGFVWAAHNKDDLRRNERKRSPHDVRYGGHVGALFPSFHVWRRNRIFVFGLTFPLLLKINHGWFKLRNLKNKLGE

SEQ ID NO: 942729 - protein, 107 aa, Homo sapiens
MKLAKSRKKGKEGNSKMKLNEKEKKVKEVEMDRDKVDEKKYIPMHPCRRRMSPGRTHGSYTLHIIKRGDGTRGVTGYFTFTLYLETPKPSISSSNLNPREAMETVIL

SEQ ID NO: 942730 - protein, 142 aa, Homo sapiens
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPMGRQQMRCATPSQPPPCAQPQAGARGKV

SEQ ID NO: 942731 - protein, 189 aa, Homo sapiens
MSIDIYYVVDRLKELNMGLHIVDEKQHIANASLLIQTCHPREDRRDSSHLYTIIRGRMGTRWSNKDVSPFTVTPERLLKPSISSSNLNPRETMGAVSLTCDPETPDASYLWWMNGQSLPVGHRVKGSETNSTLKPFGVTKDIAGPKEDEIRNPVSASRSYPVTLNLLPELPKPYITINKLKHQGELRMY

SEQ ID NO: 942732 - protein, 239 aa, Homo sapiens
MERASCLLLLLLPLVHVSATTPEPCELDDEDFRCVCNFSEPQPDWSEAFPCVSAVEVGHEGGVQFVPCVAAAAAAGPSAALVAVGVGGFLWVLLRFNDKIMVGEMGVLEFSSLEGLELGFAGPLLLLPLGAPGLALSRLRLRPVSWAPGRSWLAALLLWLTLGLPVLRLAPAPSPAFSCAPVRAFPALSRLALSSPGLGGRGAGGGSLSPPVPGPPASGAAPPRGGGAPRVCAPWAGRV

SEQ ID NO: 942733 - protein, 51 aa, Homo sapiens
GAIIFRFALLHSKYDCYSSVGRSDRAPSVPPVRAIVILLTELPPLYLASTA

SEQ ID NO: 942734 - protein, 248 aa, Homo sapiens
TVADGLKKLEEVEMDFAVGLTAVTTAGAEEMVVSLAKPKHRVTMNEFEYLKLAGQGHFRQGRSWCKEKATGAAYYAMKILKKEVIVAKDEVALPTLTENRVLQNSRPPFLTALKYSFQIATTASAFVMCSYANGGRCIYPPWSRRNDDVFSRRDRRAYRIGRMKIGDQPRGTYPDISEESNDGGTRGPSEAGRNLNGWDKGRGTIEESRELSGLMQGGGLKGRVATIERAFLRAHPEVPGPPECGWEG

SEQ ID NO: 942735 - protein, 215 aa, Homo sapiens
MWDLTDESLVCWALGFDEAPPMLWAELPLGNGSGPIMLDEVHCTATEASVADFYFLAWLKNNFRYDIYAGVVCTNDIIITHTLDLSRELSEALGQIFDSQRGCDLSISVNVQGEDAWRFCGHTVILTANLEAQALWKEPGSNVTMSVDAECVPMVRDLLRYFYSRRFDITLSSVKCFHKLASAYGARQLQGYCCNLFAILLPQDPSFQMPLDLYA

SEQ ID NO: 942736 - protein, 285 aa, Homo sapiens
AGNTSTSGGDSNSICPAPSTMAKAEEAKKLAGRAAEENHVRNNQVLGIGSGSTMAQAEQRIAEREKQENLNRGGIPTAFQARQLILQYGLTLSELDRHPENDLAIEGADEVDADLNLTKGGGGRLTQEKIVAGQASRFIVIADFRKDSKNPGDQWHKGIPIEAIPMAYVPVSRAVSQKDGGGGELRMAANKAGPEETENGNVTLDWKFDRGHKWSEVNTAIKMIPGVEDTGLFINMAERVYFGMQDGSVNMREKPFCVTLQEQSVFTLSLQPTAKVDVPLQEPLP

SEQ ID NO: 942737 - protein, 146 aa, Homo sapiens
NKRKREGLLTPHASNNKGTEKKRKKKKKMRKKKERSKGRHEGTAGRGQYWQAFLGNGGQQQEEEETPRAQQKGNNIFSLTAYIPSHSIPYRSTPQFYKPELKRKPGTKGAHNKNKLKTNQREAEKKTKNPGRHQETTAGGPLTLPA

SEQ ID NO: 942738 - protein, 228 aa, Homo sapiens
MTLTTHRSSDHERGRGRPTCELLVPIHAAVLETQSPPWCPGIGLEPGPHFLLFSCPCSSQHLGHTLQGPPMVWHWVAMASKVRVPYIWPGSVHSLWLLGAVLLMEAYCNGLPTTRTTQRESSQQGGESDPSPQTTCTEVKLEMDGHLNRGFHQEVFHGKDLGGFDKEEERGGGKLMDIFSKVDVNTERKINAKEMNRWIMEKKAEHFQEAMEESKTHFRAVDPDGDGQ

SEQ ID NO: 942739 - protein, 178 aa, Homo sapiens
GRAQLSEHRVGSRDPSGAGSWDGNLGGRLATQTFGGHQHPRNPEARPLKVTPLERKKMGPARTMGRARLAPATIPALAFWLLYTLGLQGTQAEATPAPPGLPGGADCLNSFTAGVPGFVLETNASVSNKPTFLEFPTVRRGWDCVRASCTTQNSNFALVELQPDRGEDAIAACFLINC

SEQ ID NO: 942740 - protein, 200 aa, Homo sapiens
MSPNFKLQCHFILIFLTALRGESRYLELREAEEDTFLFKLKEWGRAALWVLDMLSLQGQFTFTADRQLQCADFFISELEEFINIHYEQVSIDCQGGDFLKVFDGWILKGEKFPTSQDDPLPSAERYIDFCESGLSRRSIRFSQKVAMIFFRVHEPGNGFTLKIKKDPNLFPCNVISQTPNGKFTLVVPHQHRNCSFSIIY

SEQ ID NO: 942741 - protein, 157 aa, Homo sapiens
MSGGLLKALRKSYVELSQYRDQHFRGDNEEEEKLLKKSCKSYVGNISFYKNEEKIYELLRKSGEIKKMIMGVDKMKKKDVDFVLWNINEEEMRKKAWGKEMGSVWMNELFEKNGKKDLRREGNKEVGDMGERFGMSIGRNIMLGEEAMEKWKRKSKW

SEQ ID NO: 942742 - protein, 113 aa, Homo sapiens
MALALFLVLVLAPVLALPLLLGFGFGFCWGLGLGFGPGSDISFCARFVVARQGFPGRAPCTFVLYSRPWPWLLRAASAAALLRCRRSNRALAYLRLSQFLVAFFLFDTSAGQT

SEQ ID NO: 942743 - protein, 198 aa, Homo sapiens
RQHKWKQKSQPARDSHSKSMVGAASHWKRKAAGTCDQSTSSLKSGWQGRSEIALERTTGAHSSEGLPRNQRAHVRRGRADSTQSGSVGGIRQSRPVFSTWKAQNVGKAKRSVRVGRNLFWCVVEASRSYRKQSRWRVVRKGRVPAFVGEAAEWNRWEVTGQQGICGQGAHAPWEMTHWASGQENGISMEKAEADHLLD

SEQ ID NO: 942744 - protein, 306 aa, Homo sapiens
MEAAAQFFVESPDVVYGPEAIEAQYEYRTKRVTARVAFSKKPNNKAAESSGQREPGPGGRRPRSVRNLQRGAAQGGAQKIRVRGLGNLVAETGRSEAARESAGMGAARTNVAAHGSPAAPAFCLKPRTQRGQTERARAQTHPKLACAQLGADPQDIRDFRSSAGLDKVIVLWTANTERFCEVIPGLNDTAENLLRTIELGLEVSPSTLFAVASILEGCAFLNGSPQNTLVPGALELAWQHRVFVGGDDFNSSQTKVKSVLVDFLIGSGLKTMSIVSDNHLGKNDGENLSAPLQFRSKEVSNSNVVD

SEQ ID NO: 942745 - protein, 196 aa, Homo sapiens
AGWGSLMSTGGSFHAFWGPEISMACGVWVPPGLVDGQSGIDTGLSRRGPFLGWRRLSSLLAEGKAVQLGVGHILGGFRCSSLSVHLSVLFSLAVLWAQEFPSSGEGGEAISDKGLEFFTFPYVTAWVVFIVFAPIFHFHPILILFVYHGSPEVFSLDVSSGAGPPLYAPILGLWLGIPWKTFEISLCAGPIFFFFP

SEQ ID NO: 942746 - protein, 146 aa, Homo sapiens
RVQGYSWAPDYDRSQWLDVKFKLDLNFANLPYLLDGKNKKTQSNAILRYSPPKKNKCGETEEKKIREDIKKNQIMDFRTQLIRLCYSSEPRKTESLNDYEKKLPGQLKQFSMFLGNFDGFAGEKLTFMDFLTYDILDQNRIFDPKC

SEQ ID NO: 942747 - protein, 182 aa, Homo sapiens
TGLFRSSSGSGVQPDGPLYPLSAGKLLYTQETDSGDKEMAEAISELRLSSPVTGDQDFDRENLPPNISDNLCFLGPLRSYSPPNAFPTPSPSYITSSEECSIPSRLPPFTSMELRMGNNKPPCENCTKNPPKYPEETRFAEKKVEGVYTNAWKQLLLSARFPIVLNDKEEKDFHPGWAWSLS

SEQ ID NO: 942748 - protein, 286 aa, Homo sapiens
MMEVDRRVEFEEFGDEEGKKDSSGIVEELSEESLKDGEERGEEDKEEEHELAVDMETINLDRDAEDVDLNDYGIGKIEGFENVCLRKNLIKCIENLEELQSLRELDVYENKMKKIENLEEVTELEIVDISFNVVRNIEGVDKLTRLKKLFLVNKKISKIENLSNLHKLQMLELGCNWIRGMENIDTLTNLESLFLGKNKITKLQNLDALTNLTVLSMQSNRLTKIEGLQNLVNLRECTLATMASRSSRAWENNNKLTMLDIASNRIKKIENISHLTELEEFWVDGH

SEQ ID NO: 942749 - protein, 312 aa, Homo sapiens
GGTCSEEWRRGFKHCLPVGPDNQSQELGSDAQSLLNKHDVERRKASLDRPFKKLEAAFYSSVGLSSLGAQVPDAKKECTYIKDKIDASNVDSLFYAAQASQALSGCDISISKKTKELLLAAVSEDSSVNQKENAVAALSGFGLPLASQEELSALTARLSKEETVLATVQALQTASHLSQQADLRSIVEEIEDLVARLDEFGGVYLQFEEGLEKKSLFVAATYNLMDHVGTEPSIKEDQVIQLMNAIFSKKKFESLSEAFSVASAAAVLSHNRYHVPLVVVPEGSASDTHEDAILRLQVTNVLSQPLTQATVK

SEQ ID NO: 942750 - protein, 107 aa, Homo sapiens
YLRHAIVLIKIYRERKLYKRKRRNSTRRKATGMHTAVISAIPIPKAVLSCESSFLVASSLPLMFLENWKPKSLGYSTRMLNKQHIHMMEYYLTITKYDRYVPIAISP

SEQ ID NO: 942751 - protein, 255 aa, Homo sapiens
LGSSFPRRRDSPAMESHDVITNQPVVINNGSSVIKAGFAGDQIPKYSFPNHVGPPQHVPVMAGAPEGDILIGPKAEEHPGLLSIHHPMEHGIIKDWNDMELIWQYVYSKDQPQTFPEEHPVPPTEAPLNPRKNPERAAKVFLETPNVPPLFTPMQAVLSLYATGRTTWVVLDSGDGVTLAVPTYEGFAMPLTTMRIDIAGRDVSRFLRPHPPKEGYNFPPPPEFEIVKAIKERACYLSINPPKDETLETEKAQYY

SEQ ID NO: 942752 - protein, 161 aa, Homo sapiens
LNIFRPRMVISPPEGDGFQGGGGGGRGGEDHGGGEKAKGKGARGEEGGGEGGAGNQRAREGSLSPKWLVWAGAPSADKPTGARRGSPVMASVFVPVSEQKTPDPRHPAARNTSSPETDKALQCLLVLVFGRDVKGLKACGTEMGRRSGIPKMPSYAAWVNS

SEQ ID NO: 942753 - protein, 212 aa, Homo sapiens
RDSWVPFSAPRVTDPQWEVLWDTLALSHKEGVDRTTWAPADQCPLGPRGQRNTESQLQGPDPGGLPERICPTKLSPVDTILVAASVVAAVVPHTVEVGVGSGLVPPASPLVPGPVTRIGVSVPHGAEGLVIVPGKVSRLLVLAPQAWSLSGSKEKTIIMGMCSTAPPVLQENQPLMVPKAGQLIDGFKAQPVFSVWPPKARLIVLPGSEEVD

SEQ ID NO: 942754 - protein, 231 aa, Homo sapiens
MRAAPDRTGLLLCVLLLAALSGGGARAARKESVAPRYGLVIIKMLAEVLSLPRFYVSEGIGVATTAPKKPPAGRATSNMDAGAVTEPAAMNPGNTTPPRTPEVTPLRLELQKLPGLANTTLSTPNPDTQASASPDPRPLIGRGRDTTAHQNPPAGRAITNMDVGHVTETAALNPGNATPPRTQDRYSIAAGAAEAARIGPRNLEYPNPDNQVTIKVVEDPQAKCKSTYRLR

SEQ ID NO: 942755 - protein, 76 aa, Homo sapiens
MVEPARPVLTHLLVALFGMGSWAAVNGIWVELPVVVKELPEGWSLPSYVSVLCGSGELGLLVVTSGGAGPGRTRGP

SEQ ID NO: 942756 - protein, 283 aa, Homo sapiens
ATQASLEWAPRKKRQEAECSSSKARAGKQWLPHGKMATPVYKQIGTQANKKGKKKEEQNAENSSNYLDKTNNPGPKLEGGPYTHGEEAKRQSVENKKISSKPEEDSKKEENNRRKHSQKSSLGEGVKKQQEQKQAKIISKKRHPSTQSPPKYNFSHTTQGHELTQKANGLHGFMNWPHNLLTVAEERADVLGPFSGVKGPHLHPLTALRWGFPYDKKKLEKTEEVSLSEVTEEGVRFRSPYDGNETLLSPEKSVQIQNALGSDIIMQLDDVVISTVTGPRVEE

SEQ ID NO: 942757 - protein, 288 aa, Homo sapiens
RGPSLQSRPGAFSGCGGISFCLRLGLLFLFADVDSGTPVVFSSSNYPEWMQFSSPSIEECPKPLSRVSIMDASLTGLLLLQAVSWASGPRPCIPINLPGYSSVVFVCNSTYCYSFDPPTFPALGTFSRYEITRIGRGMELIIGPIQANHTGTGLLLTPVSSDTDSSRNLKWIWEGAMYIVLLSLTILCPGHPLAQNLSTLNRYFLCKKVTVYNIIRATHGPAVDFSIRTYTYADTPDDFQLHNFSLPEEDTKLEVPLIHRALQLAQRARFTPCQPLDITHFGSRPMER

SEQ ID NO: 942758 - protein, 213 aa, Homo sapiens
MSRRRRRLTDSGAQSAPLPMEGVDIMPQYRTKRSEGHQDIGHRYRFALFLGTDFLFHYMVGFYVGTEFDSSLDGKDKFSFDLGKWEVIKAWDISISTMKVGDVCNITCKPEYAYCSSGSPPKIPPNATLVFVRWSCLSFKGEDLSGRGKMAGMLPRIPDSAVKGYAKPQWRVLSSEVALERDYKDKLFDQRELRFEIGEGENWICLMVWRGHS

SEQ ID NO: 942759 - protein, 191 aa, Homo sapiens
MGDWGFLEKLLDQVQEHSTVVGKIWLTVLFIFRILILGLAGEVTYERLTSSHESSSVTSGPRQAAHNVCYDQASPASRHIRYSGAAASVLRQHTPPLDLPGSKSFNLLSAETERAAGTKGGGELRATAGPRYPQDGAARLAAEDAIPEANNVGGRRLVACASAEHVMGTYVASVLCKSVLEAGFLYGQWRC

SEQ ID NO: 942760 - protein, 154 aa, Homo sapiens
ARRFGAALTRVRARPPASPLNAPLASRPPWIRTRRTRLLRSLFPITGPFRLSSQFPARTRSGPPNLQPNSGGGSCGKKMKNEIAAVVFFFTRLFRKHYNFKKKAVERFAEKFTLILQEKYKNHWYPKKPSKVHAYIFILFNKFQRVDPYVLKAY

SEQ ID NO: 942761 - protein, 153 aa, Homo sapiens
DLLGEKEIKGQEPTDISKKSKKRTTSSSKNDGLKAERIRKTRIEDMYKEDEYPQITKTKRDEMKTPRMSEEEGLDLGEEKGFIVKLFNGKIKDEVKRMKKRKNIKPKGKESRKKHNRRGRRVTCWGAQRALLEQQVRTVNSGLHRYSQLNWVY

SEQ ID NO: 942762 - protein, 68 aa, Homo sapiens
MPPWCPPGVPRGKGNCLVKKRTGPPGGVSNGPPTLASQGWATLSVGCMQRAGALPMPSLPWCPPLAFL

SEQ ID NO: 942763 - protein, 133 aa, Homo sapiens
YRAWKVQRPEPSCRPRKTSPPTLPFERETQYQKDFRAWPLPRRGDHPWIPKPVQSSAASQASAPITTGRPRRRAEPRATRPVTAAAEGPGRQEERPPAERVGLGGRRASGADKRQNNQGKSTGPAWNSRRPRP

SEQ ID NO: 942764 - protein, 124 aa, Homo sapiens
MPWAVGRRWAWAALLLAVAAVLTLVFWLWLGALGFVFQREEIAQFARQYAGLDHELAFSRLTVELRRLHPSHVLPDEELQWVFVATGFLMGAIFLLHASLSEYVLTASAPPWAPAATAGRYWAD

SEQ ID NO: 942765 - protein, 122 aa, Homo sapiens
LIAVVLQLSQQLSGINAVFYYSTSIFEKAGVQQPVYVTIGSIIINTAFTGFSLSVEEPPGLLTLHSHRPRWHGGLCHTHDHRASTAGAATLDCPTLTHSWPSLALWPSLKWVLAPSHWFTRG

SEQ ID NO: 942766 - protein, 235 aa, Homo sapiens
VNKTPRGSQIAAVAGGWCVAAAGRPPCPGHEVAAAGGAAAQAAAPPPRCAARSSPGGVVSAWTWLAASLDWYFFLFFQAAVWLSEEQFLSLKGLKKLPEHFEMNVLVPPDPYVPIDSSDFALEIGMLGVKPKKSDRYFCMSIRIPVDEEAFVIEFKLRASMDTVHHMLISGCNMPSFTGSYWFCDEGTCTDKTNILYAWARNAPFYLVSPKAVGFRVGGETGSKYFVLQVQYGGY

SEQ ID NO: 942767 - protein, 217 aa, Homo sapiens
MEPSSKKLRGRMMLAVGGGVLGSLKFGSKIGVINAPQKVIEEFYKKKWVHSYGESILPKKLTTLWSLSVAIFSVGGMIGSFFVGFFVNCFGRRNEMLMMNMMAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPASCHQP

SEQ ID NO: 942768 - protein, 91 aa, Homo sapiens
ADGDWQDFYEFQEPPRSLLDQEKFNGNPEPGAEAGAGAGGGAYCFPALACSLEEKLSLFFRPSNPGAEPPRTAVRPITEGSSCRGTKFGMP

SEQ ID NO: 942769 - protein, 108 aa, Homo sapiens
MLEQPRATWGDPAGSHGPPCSSTTEEGAERPAMGPSYSSPYVNLKKANLGERSLDLLVPWLRGDLCNPEKTAGGNILIPGLSQKPISSFADFERHFLPASRNRTVGAT

SEQ ID NO: 942770 - protein, 130 aa, Homo sapiens
MGLGVPAVRSGREYAPDLGYYLSRSGRATRGAPVYTALDPAMPCRNSRGRSATRDAHWWPPLRVLGSRQPQSRLGVWGEPQRCQSPDAWLDSMAHEDMRVTGGERIQDQLCTSNPGERLRQEVSSFYGVS

SEQ ID NO: 942771 - protein, 306 aa, Homo sapiens
GRGRGGAACGTEGRSGGGGGDMHVARRSAWLSWWSVLGEHGRIFRGERSGLDSSSDDEKELTPSNFNREVIQSDSLWLEEFYAPWCGHCQRLTPEWKKAATELKDVVKEGAVDADKHHSLGGAVMEFRDFLTIKIFGSNKNRPEEYQGGRTGEAIVEAALSALRQLVKDGFGGAKLEDTVLENKAEDDSSSKKDVIELTDDSFDKNVLDSEDVWMVEFYAPWCGHCKNLEPEWAAAASEVKEQTKGRDELAAVDATVNQVLASRYGIQRIPTIKIFQKGESPVDYDGGRTRSDIVSRALDLFSDNA

SEQ ID NO: 942772 - protein, 163 aa, Homo sapiens
SFFFHFTHKLPSVKLGIRPAGTSFHPRFLGVEATLGLSLPSLPPPPPPHPSHLVPLDQGLLLSRRRGPHFPTPDLSDLRIPRATGSSSFSSMALPPPPHPQQDEGQGPPSQKQQHQQGPPHGPPHQRAHISGRGLGAARTKRTGAARPRPTAGGPGQTKGEGT

SEQ ID NO: 942773 - protein, 257 aa, Homo sapiens
RRERGASVFCCLHQRGPRAIMRKPRAAVGSGHRKQAASQEGRQKHAKNNSQAKPSACAGLARPPEEVVLLASVSSYHLFRDVAVVTAFRGGLLGWYDLELRALPWGRRAVAVLALARRAFAVWVSVVLLLLALVATVVIFSAGWLLEWPALLALACASLEEVALLWAGLGFFSRGRRLLEGAREVVEELGGLLPRAAVALLLLLPGVGRFPAGAFASFAFGLAAGVVDGIVARGLCRVRAFGAVPCCSLVSLLLWGS

SEQ ID NO: 942774 - protein, 158 aa, Homo sapiens
KLGEAPSSAPSFPNNSSTAQPPGPRGRAGVRQTVQHKYVEATARISSVRGQGNWVWEEKWVALGARPPVLVQSPGAQREREGKSGPAWNVALARPAQGGWEVDMDVDGGGGGGGKSGKEAELALALCSKDKMKLLFNEELKEKENKERDGGRGGESNI

SEQ ID NO: 942775 - protein, 108 aa, Homo sapiens
MPRLTALGVPTYLPDLNRAPILSVVCCLCVVMASLVRAERIGRERLHGKKPLDGVIDALLPPYFLSVPAIVHAARVGCRTASGMRYRGPRRASVEGLSEDSCTTRLRS

SEQ ID NO: 942776 - protein, 249 aa, Homo sapiens
STWVRREGHIRSRRSMKMLWKLTDNIKYEDCEDRHDGTSNGTARLPQLGTVGQSPYTIFPPLFQPNAFHFPYFSPPYQPIYPQSQDPYSHVNDPYSLNPLHAQPQPQHPGWPGQRQSQESGLLHTHRGTASETNRSLKIIRHGTYKAARGPPKVFYTHSTQDSETSRSTPYLIAIEEVPHVEDPGINIPDQTVIKKGPVSLSKSNSNAVSAIPINKDNLFGGVVNPNESSVQFRVASRSSAPPRSTKSR

SEQ ID NO: 942777 - protein, 310 aa, Homo sapiens
ITFIIIQRLEHAMSSEEGKLFLGGLNFNTDEEALEDHFSSFGPISEVVVVKERETQRSKGFGFIIFTNPEHASVAMRTINRRGGASYLQRDLVPICELPSFFLFFPLYVMLGADVSNKATQCPLTEDMTAFCSRGWMAKADKAIGRLGGDDWSCMRPRSHLMDGGAAYGLRIVESADTVGLARRGTRESSDIDSEASNQERCLSSPDSGAASEEWGGELSLSSVKILWMVVRSVWIMQASLLGGTEEVALGPMGVVAATLEVVGTGLWEWKYYDSRPGGYGYGYRRSRDYNGRNKGGYDRYSGGNYRDNY

SEQ ID NO: 942778 - protein, 134 aa, Homo sapiens
CFEPSRALSMASADMRTLRSGGRLKLPRRSNSFWFIFSSSFLVFCTLTSILYFSSSAASILACSFLEISCNSEMEPGICSGGHFSARYFFFFPSWRLFSFSSSVAAICSITLFRCCLRAVMALFRFSSSPILRS

SEQ ID NO: 942779 - protein, 277 aa, Homo sapiens
MRGDGVRRTPHPWRGGGRRVPGVTGQKHAGWVGAWPEWGGAVPPPPGEWAPTAPGGARATNSMYRTSNAPGASVRGLAGAPLLDGRASSGGTRGLSPDLGRCRDRRGRCPGRGWTAGGLYLGPQVDENGHCDPLTTWARARPMRAGAVPTLNAAVLQNCKAGDPRAVGTPRRLGLGGLRARERGGARVLINGQEQRGDARSGTRTRSGEHAPPQGCAPSKRKWGIARCICNGAVNETARGRPAAQPPDKTNVGQGALKLRGAVGPWPRPGTALVPSS

SEQ ID NO: 942780 - protein, 234 aa, Homo sapiens
SFASASRITLLREDGEGEGQESTDLSGIGCLVTRAAFNSGKVDIVAINDPYIDLNYMVYMFQYDSTHGKFHGTVKDENGKLVINGISPSPSSRSEIPPKSSGAMLVAEYVVESTGVFTIIEKAGGHLQGGAKRVIIFAPSADAPMIRLWVSKCEDMKTASRSSGMLPVTTNCLAPLAKVIHDNFGIVEGLMTTVHAITATQKTVDGPSGKLWRDGRGALQNIIPASTGAAKAVG

SEQ ID NO: 942781 - protein, 171 aa, Homo sapiens
MWHTGQAPLLPPPSSSTGARVALSSVPTKTWPREEAQTCGEREGKRSRNSSSEFPQKVRWNRALAASARGSNPLKPQERGQRRDWDGGGSAQKAPRRHWLQNGVADLARKSACGGQVGLRIPGAASDIGGTQTHPSLQLWQSEVWKCSQGHLAMAQGQGANKNPGASRPSC

SEQ ID NO: 942782 - protein, 244 aa, Homo sapiens
GIAAGSDSRPAMGCDGGTNPKRHELEKGPKKVEKVDKDAELVAQWNNCTQSQEKKRRPKVACELGRLENKEAVKEFPLDKPAEKAPGKAASHKKIKKNVTEPKPSKKPAREGEKGNTKGDKHDDPQRARFNRPVVGLEMNGRHRFRLLRCSGCVYSEPALKEKKAEVCHTCGAAFQEDEVIVTQKSTKEDVDVLKTRMEEKRLKAKFFKKTKKPKAAESVSKPDVSEEAPGPSKVKTGKPEEAS

SEQ ID NO: 942783 - protein, 135 aa, Homo sapiens
IAIPYAEGQRKRRNTIHEFKKSAKTTLIKIDPALKIKTKKVNTADQCANRCTRNKGLPFTCKAFVFDKARKQCLWFPFNSMSSGVKKEFFHEFDLYENKDYIRNCIIGKGQSYNLTLSIINIFIKFHPFISIIPH

SEQ ID NO: 942784 - protein, 160 aa, Homo sapiens
MLLLLLSIMVVEVAVLVLLFVFKMVSKWMVGNGKENDLWQNCSSSSSGNVQECFSSSGKEWLQSVQATMMLSIIFSILSLFLFFCQVFNLKKGGRFYINGIFKILAGLCVMSAAAIYTVRHPEWHLNSDYSYGFAYILAWVAFPLALLSGVIYVILRKRE

SEQ ID NO: 942785 - protein, 278 aa, Homo sapiens
PGSRQLLGEMTGERPSTALPDRRWGPRILGFWGGCRVWVFATIFLLLSLAASWSKAENNFCLVHPLVTMEQLLWVTWTQIASLDTFLIPLITPTPPATLLPFPHPRKISSSNDLANFIPLPTSMDHLTTSSPTPFIVNHGDVPHLLNLPPLLTHLHTPLLFLFYSLFAHKAGSPGGLYHVGMEKDDGVSWSTPRNLSLDIGTEVFAPGPGSGIQKQREPRKGRLIVCGHGTLERDGVFCLLSDDHGASWRYGSGVSGIPYGQPKQENDFNPDECQPYE

SEQ ID NO: 942786 - protein, 280 aa, Homo sapiens
MLSEIVLVSAPGKNTIQGEYTVVNGKVTVAVSMNLKKFLRLQPKSNGKMRPQLTQKLYEDGPEDVARLQSLEKSFLEQGDVTKITSEEVEKTKEVAGLDEECTIIEGLAVLAFLYLYLSICRKKGQTKENLELINKWAFQGERMIHGNPPEWTMLSAPGEEPSDTIKEKISSLKRSPALQILLTNTKVPRNTRALVAGVRNRLLKFPEIVAPLLTSIDAISLECERVLGEMGEAQPLEQYLVLEELIDMNHHHLNALGWATLSGPALPGDQGRGLHSKLT

SEQ ID NO: 942787 - protein, 263 aa, Homo sapiens
LTGGAARPLAESAAGGDAALGGRGGAGNGRLGAARRGMWSGPPQPDQGLPPPLAAVPVPWKTTDPCQGHRESPRALVETSAGEEAQGQKGPAAAQLDLRLRISSMEIRKKGSEFLKEELAQSTKGLNYRKKNVTAVQVRDTKKELEDWGHLFENSQKVREPAEAAAQKTLKELGATRQLQQSDNLKTLVITSTPPLPTASLTQLLSPTKAGPERPLSPQEHQQHLCPPCVPLRDTPHPRQRGEEVDTCCFAEFQAGGNAPPWT

SEQ ID NO: 942788 - protein, 260 aa, Homo sapiens
MPGRVSAWPPTAENRRGRSEALSVFYCGRKCPSPSSGFGSWASRSAGLSGGGGGGDRGGLCEGGGRERRERKGGSGGGVLTHLNKALGQFCAMEALPAPPSSPIGRPPGTGTGWPQGVLLARAWRLGWGVPGPAAPRPFLVNLGCWFWGLGGRWLPQVSPPKGWGPPHVAPHSLVFGAFFKPPGGGKNPWGKKGGLAVQSQPVCPQLEVWCWLNAASLACLSLLSASGSRLAPSPRLPVCRLVLGWVLLCLQIPSSLGRA

SEQ ID NO: 942789 - protein, 306 aa, Homo sapiens
APGSSERVHAWQTEKASAQLEGSVIFCSGPKKKKMENGRHEKDLFVVVLSFAKKRQKKASKKFKDTVHVEKEEVQNEVKEGILYLEPYGLVYCVNRICSENGNVLCSRVKGPKIQGLSPVQIPQLCCPRCPEESLPPVNKKVTSKSCEYNGTTYQHGEQFVAEGLFQNRQPNQCTQCSCSEGNVYCGLKTCPKLTCAFPVSVPDSCCRVCRGDGELSWEHSDGDIFRQPANREARHSYHRSHYDPPPSRQVEGLSRFPGARSHRGALMDSSKHQEHCAIVKIITEHGQVCVSMEDYLMRVWHQTPA

SEQ ID NO: 942790 - protein, 285 aa, Homo sapiens
ASAPEGPGQPEAPRPPDPELPKPSRAAHTPGLHPLFQHPLRFERQPVSHRPSCPRDRDAAACEGPNESPRCYPPAPVVLSLLITRAQAIMLLRLDLNDTYSGKREPVSGDHSADGFEVTSRSEKSSGSEIAPVSEMTLLVVNPYLRDATIDYCRRGIDNRNHKIPRLLFVRLISAQECEQGSVTPPPKNKDGNSAKIRSRITPHKRKEKEGRAKNEQKNSKKTRKERKDPVFMLAISKISCYSQEKCKIVYEQPEKQVTLQNVSQEIFRVKLDVGEKSNENLTAM

SEQ ID NO: 942791 - protein, 300 aa, Homo sapiens
PRLLGGSYGWVCRTGAGAGAGSPNGNTKCKRQKLYNFLPSGSIPYSNMQLAPKEISVELQKTGQICLSTIYLSLGAEMWGPEAWLLLLLLLASFTGRCPAGELETSDVVTVVLGQDAKLPCFYRGDSGEQVGQVAWARVDAGEGAQELALLHSKEELHVNPAYEGRVEQPPPPRNPLDGSVLLRNACKADEGEYECRVSTFPAGSFQARLRLRVLVPPLPSLNPGPALEKGQGLTLAASCTAEGSPAPSVTWDTDVKKKKNNRSFKHSRSAAVTSEFHLVPSRSMNGQPLTCVVSILACS

SEQ ID NO: 942792 - protein, 192 aa, Homo sapiens
ASDSECVRSGSGGGGGGGVGGGGGGMRSPAPLPPWWYKAKVWEGREKEELQPAGELRLHFRKKKGVYGNGREVEIGPPRCELSSAGFCGVNALFIPPYVSLTLTASQCEKSRAVKSGGRLKASIPTSDPGKATSETGPKKLPVLPAELSPVRVLDPRSNDPGSLFIASRSPRSLLDPGMPGISARGLSHEGR

SEQ ID NO: 942793 - protein, 81 aa, Homo sapiens
QQHSERSAFRKKSSSGGCFSGGRAPKKPRAKNLGRPPKKPRRRSQSEAKAPPPQKRKKSNNRLQGPIAGGCPNAWEAKKKN

SEQ ID NO: 942794 - protein, 307 aa, Homo sapiens
LPGAGRRDLAPNPGGPGAVAQGPGRGPGGGALRARPGAVPGGLAPRFLPSLRAQSPFGRAANRRLNDKKARAFPSKTYKKKERKPKAASLLSPPPLKQKLPGSIKKRTHLNFPQEAALRDEYLKKNGARIWKKLAKDLISEGSGLGAIEVMGTQDPGNMGTGVPASEQINCAKEDPQVYCPEDTGGTKDVQVTDCKSPEDSRPPKETDCCNPEDSGQLMVSYEGKNMGYQLPPFGWRICLAHDFTEKRKPFQANKVSLSNMINHIGMGLRYLQWWYRKTHVEKKKPFIDMINSVPLRHIYGCPLGGI

SEQ ID NO: 942795 - protein, 257 aa, Homo sapiens
MSRQVVSSSKFRQVFGQLAKADQCYEDVRVSKKNWDSGFCVVKLKFVALICEASGGGAFLVLLLGKNGSVDKNAPTVCGQKAPVLEIEWWKNNENVIASGSEDCTVMVWEILDGGMMLYLWEPVVNFEGHTKRVGIVAWHTTAQNVLLSAGCDNVIMVWDVGTGAAMLTLGPEVHPDTIYSVDWSRDGGLILYLLPDKRVRIIEPRKGTVVAEKDRPHEGTRPVRTVFVSEGKILTTGFSGMSERQVALWGHKPPRE

SEQ ID NO: 942796 - protein, 299 aa, Homo sapiens
MSFFPELYFNVENGYIGGNGARPEGGVLSQADYLNLVQCEKLEELKLHVKSTDYGKFLAKEEEALKVKVIDDRLKEKMVVEFRQMRNHAYEPLARFLEFINYSYMIEKVILLIKGTLNQGSIAEMVPKCHPLGSFEQMEAVKIDQKTAEIYNAIVVEKTLEAFFQDCILEQDLDEMNIEIIRNTLYKAYLESFYKFCTLLGGTTADAMCPILEFEADRRAFIITINSLGTELSKEDRAKLFPHCGRLYPEGLARGLGLTTMKRSKTWPITTRSKSCSSRVQVATLGDKKLEDRFFEHEV

SEQ ID NO: 942797 - protein, 132 aa, Homo sapiens
LSPSSRAKERAPRARPASTSPSPGAHGRRGGPEGKSSSRSPARTPAPGVPAARPLNIARLWEKRRHSPSSSLSPKKPLSRDKDGEGRARHSEAEGTRARRRSRSYSPICKRRRDLSSFMERRRITSARKRPI

SEQ ID NO: 942798 - protein, 290 aa, Homo sapiens
AHSLRRFWLQTALRKDTANGFGYIIKKGFNNRESTQNQEHSVSWTPDNSTVSTLCSEQEQRHGYFLFLKRNAPGGCVPSKNEAKKEKKKKKKCKIGSKRCKKGCMNGFHAMKHLNSLHGNMKKREKGLNKRVGNFWKNKTQIAKKCGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEPVSSEGDVGQQVVASDDAQSSSTWR

SEQ ID NO: 942799 - protein, 269 aa, Homo sapiens
PSPLSPGDPIPGPERIITVESLSRDWIPTNRGNAGGEPGIDESTDAPTGWWESPSSGEGPPAVPTGRPDARRGSGGYGACGLTRRTGPGVTGIRGSHNDSTGPETELRRDTPEVVGNVSGRTMIGEEDESHVSLSAYENCITVYGKRGLGKDRGQVTMSAETFRGTRNGRGSGTLANPGALHGRDPRRPFYDIPRTREQLGLDGGGQFTSDLRFGGGRLTRSSALDLVPETDASVVGKPVVVVGLALGDVVEGLSPGPVRVKRVEKVDE

SEQ ID NO: 942800 - protein, 335 aa, Homo sapiens
IRTVADPPHKLRRLVTRDPLALMLSVLPPEIWGVVLRSHKVPMALLQRADHLSRLFRRHRIRAVWPSLPLRRLRRPGPVRKSLSRLNNRDIRDWGMVVVPPRRTSVVDKAPRVDRLHDVWVLAGVSNFSLCLATLAQILGRVTRLIRGGTARGDLASFSTSGFSSFRGSVILDHILGRNGGNPVLPALLWSYLHNEVRKVFRPRSHGDGHPGVGVQMGDRWGDDLDASLHMVTARKTGVILVPTDRVVRGSCRQNVARRLRRFPLGSLVPPIRAPVLPAKEGVEMARKATRRVNNRLLILVRPGLSQLAVWYPALVTETTNMMMLNADAQHIFVK

SEQ ID NO: 942801 - protein, 291 aa, Homo sapiens
GGRAEGEEQGDGGGDQQGGGGGGDGGTGPRGSQPQKQARRARGGGTRRPPGSDAPQEDAHGNGQDDQEAGGGREGAKEGDQRTPEESKARRGRSGDRRDRAGDGRRRGGAGERRAGSAHTQQRHRRDVGSAAGDTDETDRDGRGGGEERRKRTEGHDAPGEEGEDGEEAETDKKRRARDDRGRGADQEGDARATREERTAGRHPEEGPHRRDRGRAETREDRDRNKEGEGQGEEDSAERDAAEPGGGGAGGGADGEAAGPGRLGEEQGGATGRGRKGATGGGPRPKTNPGG

SEQ ID NO: 942802 - protein, 201 aa, Homo sapiens
MNKIKKLKVKAPPSVPRRDYASESPADEEEQWSDDFYSDYENPDEHSDSEMYVMPAEENADDSYEPPPVEQETRPVHPALAFARGYIDNGSSQRLSPPFSKTLPSDFFFFLYKLMLTSILLALIVFHKPQVPPKPKGLLEDEADYVVPVEDNDENYIHPTESSSPPPEKAPMVNRSTKPNSSTPASPPGTASGRNSGAWET

SEQ ID NO: 942803 - protein, 275 aa, Homo sapiens
MTVEDLGSKRLLTCSLNEEVGDRWLKGGVVLKEDALPGQKTEFKVDSDDQWGEYSCVFLPEPMGRANIQLHGPRVKGVKSSEHINEGETAMLVCKSESVPPVTDWGWKISEDKALMNGSESRFFVSSSQGRGEIELNMEADPGQYRCNGTSSKGSDQAIITLRCQHLAALWPFLGIVAEVLVLVTIIFIYEKRRKPEDVLDDDDAGSAPLKSSGAAPEGQRQERPPEELFLRQVARGRSLLRVWAAAGVHSQCLQDSKFSPLKENPPVDSHQTLP

SEQ ID NO: 942804 - protein, 109 aa, Homo sapiens
HTYVYCSTIHNSKDLESTQMPINDRLDKDNVENEKKRKPGKKKKTARKRRATQSQQQPKEEEEEKKKEKKKEKKRGERRREKEKRIKKPKTYLKRKKAPSWKGGGLGEG

SEQ ID NO: 942805 - protein, 280 aa, Homo sapiens
GDPKSQWSQAQFRSPVRHLRGTKAMESTATAAGAAEAGGGDKKEEVPAPTTTAEKVESLDVESEAKKQRGLGQKQLGRGERPAAVNAFQEAARPGGKKDGETAKEGGEAFYGKTLLEEARMENGVWGNALEGVHGEEEEGEKTEEESLGEKKDNIDETEGSEEEEKENDKTEESQMYSVLENKSLQENEEEEIGNLYLTWDILDLAKMIFKKQEAKEAQLYAAQAHLKLGEVSVESENYVQAVEVFQSCLHLQEQYLEATAVSLQRPTTSWAWLMGTLSV

SEQ ID NO: 942806 - protein, 204 aa, Homo sapiens
PGGEEAPGAARDRSGAGGQPGQPGKRGEDGGGPGGREAGRTGTRGEAAGAAPGGTGGGGDPSRGDTTGPGRGGGGGARQQKKQGRKRKKKRAQQQQSVGGDGGRGGGGAEPRGGAERQQPPGQKRAEALRRQGAKQPAQRALPAKRPPPLACGMRALAWTPFQKKGEKRGKKGRGIGEKKKKKKKAQRAARKSARKKCKKQSFW

SEQ ID NO: 942807 - protein, 187 aa, Homo sapiens
KATHGPPRDTRPRAERGGERGGGGGRRGRAGDSARGKKPDENTGDRRKGGPRAEQKRTGALRPGGGRGGNGENGRATAGLREEGPGVGGGGGVEKGQSGERRAWSSQPVCVGQAGGSTGGGSVRGEQEENQAAGGGSQGKREPRGGTGGRGEGPREKGPEQARQGRDNGKGEGPGEGGGKERRGNRG

SEQ ID NO: 942808 - protein, 103 aa, Homo sapiens
MARHRLVVVRVAGEKGLPSGVCGQRAKLSVSPDSAYGAPGHPRNLPNSCQSRLRFGASFTGMTGMASSFSFFFFSFVFVGSGASSLVHMNPYGAFPDVPLHFV

SEQ ID NO: 942809 - protein, 185 aa, Homo sapiens
ERTGDRGKGRTKEEQRGRDHRGRKGQEKRTKRRGGEKKTESHDLDAGTGGAGQGAAKAGLGKRGRGAGRGTGGPPGRQRRRPRARLGGGEEREERAREIGKSHAGGGRRRRGGAGGAAEAGTAGGGGGGGGTAPEPRRRTPRAQPAGPRGEGKGAAPRATAAQGRERRDGRPRGAAGPQTAAPRP

SEQ ID NO: 942810 - protein, 195 aa, Homo sapiens
GPGRKAREGHRGRGAAGGGQEDPRGSQERRARHREKEPGGSAASCDQGKGRRGPWGEPAGRGGGPRPPPPPEGRPSVGSHKQATQEEQNTASGEEAKGPGKGSRARAKEKAGLERRGSPGGQQGPKTGTGSAAKEKPEPRTGPRPPGTAARAGEAEDKGAAQPSGPGRRTSAGGPSKGVEVGRNFKMCPVLPRPL

SEQ ID NO: 942811 - protein, 195 aa, Homo sapiens
LPPSWYFLELPVLVLPKCPDPKQESVAEIGTWERNNLGNMKVMLVAKGRQLDSVEKGCSRSIRCLDLSMSTGEEDSDTVTGETENPVTLTQDTEGNLILHSPQNEAEEIDAEESIEPPQKRPWLSPEEEQSIEESTPCISVVALPRSENDQSVEVTMTATTEGAEEEGTEGTVTQIQSLQNEQRDEIAPFGNEEV

SEQ ID NO: 942812 - protein, 259 aa, Homo sapiens
APNLVLAVAPAPRSPTAREGGRRGPGARSAKRTRNPERRRGGVEPDDAQKGPRPARAAGMSEARKGLEEAEESKYDSGIESLRSLRSLGEYTSAPASGPWEGSLEKWKDDEGEVKEEKEKEDADGERADSTYGSSSLTYTLSLLGGPEAEDPAPRLPLPHVGALSPQQLETLTYIFEDGDTLVHLAVIHEAPAGRRGGRAGRPQEALDIQNNLYQTAHHLAAQLDQPGAVRALELKGASRALQDRHGDTALHEACQRHT

SEQ ID NO: 942813 - protein, 168 aa, Homo sapiens
SGRLAAAAAAPAIPAAATTRTRLRPGEQQQPQPQQPPLQLERQQQRQPQQQPPRRAALGRARPPEGSSPPPTAAPSGVFMPPGPQGAAMARARQEGSSPEPVEGLARDGAGFIFGRLVPSAVSCGLEGLVAAIHPTLLPAAYLCSLTAPPAVTAALGGSRWPGGSPPP

SEQ ID NO: 942814 - protein, 147 aa, Homo sapiens
MRTENDVGRPPPGPPKGRELGARNRKDGAAGAWMLAFCPVCLVVSGTWSWYLVALPRLGVEGRGPQRPLPACGIQALPGQARLGGGNTGEKEVATSAQAGTCRSASLQLFSSEIAPSSPASSSFSSDCALPDPESPCSIKWLILIFV

SEQ ID NO: 942815 - protein, 66 aa, Homo sapiens
AALSLSTLASPKGGSGTAGTEAAIIIPLRTTENNYCPHYEKVSGDYGHPLHRSKRPAPRSPAKQSN

SEQ ID NO: 942816 - protein, 170 aa, Homo sapiens
YPSHTPSTLFSISHFLHHPIDLNQTKFKFQSPSTQPYSQSDEQYPFHLTFQNQLPFPELTQEQLISLIPKMHLLFPLTLVNSFSSDIIDSPHIFITSSLTFYLQANDKKIFIFQSKPEIHYPPHFHHHPTNLRESSLSKMSSDLQMRNSQAHRNFLEDGESDGFFKMPLS

SEQ ID NO: 942817 - protein, 97 aa, Homo sapiens
RLDKLMFAGAPCLARLAPPPPGLEAAAQPGCLLVEAASAVEADVVLGGSSAQGFRGGASSCSLSGGSSGAFGGSFGGGFGSCSVGGSIFWELLGCCH

SEQ ID NO: 942818 - protein, 85 aa, Homo sapiens
MDEIIDVGSENNYSGQSTSSVIRLNSPTTTSQIIERNKKKEIIKKKRQYQKNNSLSELRRLVPTAFEKQGSAKLEKAEILQMTVD

SEQ ID NO: 942819 - protein, 143 aa, Homo sapiens
EEGGRDKAPVQPQQSPTAAPGGTDEKPSGKERRDAGDKDKKEELSEEDKELQNELEMLVERLREKDKSLYRPTLEELRRQIRSSTTSLTSLPKPLKFLRPHYGKLKEIYENMAPGENKRFAADIISVLAMTMNGERDCLKVIG

SEQ ID NO: 942820 - protein, 141 aa, Homo sapiens
MGMQLPWLHGMLTRVRAEDQGAWGWYLLEFFSLTDQSSLDEMEKGQSSGGGKYSWVRRSFIDNLRNSNSSGIQYVGEAKEDIGNVCRKPHARIFTVALLVITKTLELTQMSIKQRLDEMYGGDLLNGIIDSNESGINKSYM

SEQ ID NO: 942821 - protein, 72 aa, Homo sapiens
MEEQKEEVQLKEFGLTVKTETHLHQGKSIENELGENPRVVAPQCNVGVQGVKTYRGGRPLRVQLESRIVDWT

SEQ ID NO: 942822 - protein, 83 aa, Homo sapiens
PYLDPKGTSLLGWLSVSLLSSGEITASSAPRMEPPGRRECPFPSWRFPGLLLAAMVLLLYSFSDACEEPPTFEAMELIGKPKP

SEQ ID NO: 942823 - protein, 214 aa, Homo sapiens
NKRFIILDLITSENFYIKRIPSRLDKYWKKKVDQILFYTGNEGDIIWFCNNTGFMWDVAEELKAMLVFAEHRYYGESLPFGDNSFKNSRNLNFLKSEQALADFAELIKHLKRTITGAENQHIVIAIKGSYGIILAAWFRKKYPHIVNGSLAASAPIWQFEDLVPCGVFMKIVTTDFRKSGPHCSESIQQVLGMPLIDSQILAVVCSGLLEPFTY

SEQ ID NO: 942824 - protein, 244 aa, Homo sapiens
MSSFLSAGSGYGRVSELRAQPGRRREGLSSPGGWLEAEKKGAPQKDSPGGVLEESIQIERMLLHSLQKFVPTDYASYTQEHYAVCRNTDDCHSTESTTTTLRSGGVARGYGFVSYLEEHAEELNFQDAKILEIGAGPGLVSIVASILGAQVTATDLPDVLGNLQYNLLKNTLQCTAHLPEVKELDGGEDLDKNFPKSAFYYDYVIDSDVGLESIIPGEDADQHGVNLEEREGDDLGKKIKYERI

SEQ ID NO: 942825 - protein, 97 aa, Homo sapiens
PLRLLRAQWRRRMRKRGRSWQAALEEADRGAPAAPGALPDLCDPSRLAQLAFGAVTDVLPWPMAAVIDQASSLTALTNSTPTQLMTHVPYTPPYPAE

SEQ ID NO: 942826 - protein, 151 aa, Homo sapiens
LVLPTWDTGEVVGDLLVAPVVAFQLFLGAERSGEWGDIWWPVVDGPCREEGGRGGEPAVRAVLGCAPVLTTLGPRRLNNTLKEVESGEKGRMTVRQPVEVPCGAGEGGGALRARLVSRALVNRTPSSPLKGDCRATKKPFAVASGAFVFVG

SEQ ID NO: 942827 - protein, 142 aa, Homo sapiens
MSAAGSCWLEARGLPRGPSAARRGHGSGHPGTAIDPRPMALLGVAAALQDPKACPMVTLRAGRCGAAANQGRDGLLLEAVWGTVCDALWGLTDARRHAEALRLEKNAYTQHSEVLPFGGSRAPLILAGVRCSGSRSLPGRLL

SEQ ID NO: 942828 - protein, 138 aa, Homo sapiens
RPQSLAFHGCPPPASSLPGSPHCRRRCHTMAFLTRHFIRPVSSSSTASASAKKIIVKHVTVIGGGLMGTFLCPQVAAATLHTVVFEHHTHDILAKSKNKIDENLKKVANKKFPQNPKAGHKFVEETLATPPPSTAAPS

SEQ ID NO: 942829 - protein, 82 aa, Homo sapiens
MRGEQEIGLVCDVTEAIEQIAWAVIVITREVNSQPWQLLSRRAHPNFHKFSLVGLFEYQEGINIIHADVIGIALDPTLGHMG

SEQ ID NO: 942830 - protein, 108 aa, Homo sapiens
MVAAKVAAAWLLLWAAACASEEREKFQDFKAVKIRGKLVSLEKYREKVSLVVNVASQCGFKNQHNKAMEQLQRELGPHHFNVLAFPCKKFGQKEPESKKDIDSFARCT

SEQ ID NO: 942831 - protein, 67 aa, Homo sapiens
SAGLKGNLTDRAHVSTRPEKSPARPASPAPRPGGTARAQENHIFVPAPEAPVGKNVSQRVPEAPPGR

SEQ ID NO: 942832 - protein, 110 aa, Homo sapiens
MSASRETQAQHHNPGLGLQLMHQWHNGLEDTERRCSAVVCVVVGAHTDHHNLGPDVCQLPILQPPQYMLWCPLHHQCQSQAACRGEKSSRNSHWRMSGTKEEKKTAGSLF

SEQ ID NO: 942833 - protein, 65 aa, Homo sapiens
RAYVALAVLALLERNNADSMSAHSMLCERIAIAKELIKRAESLSRSRKEWQKKWCKAVQQIEGEN

SEQ ID NO: 942834 - protein, 104 aa, Homo sapiens
MSTENESFVENKVAFKNEAAGFGGVSTALLVLALLFFGAVAGLGFYYVKRYVKAFPFTNKIQQKEMIETKVVKEEKVNDKNPNEESKKTDKNPEEFKIPSKNIV

SEQ ID NO: 942835 - protein, 282 aa, Homo sapiens
PGPRGPQGALGEPGKQGSRGDPGDAGPRGDSGKPGPKGDPGRPGFIQTEPRGAAGEKGEPGPGGPEGGRGDFGLKGEAGKKTKKRKPADPGPPGEPGPRGPKRVPRAEGDPGPPGKPGLTEDDVMNYVKENCGCCDCEKRCGALEVVFVIENTENIGYNNFTLEKKFVINVVNKLGAIAKDPKSETGTRVGVVQYSHEGTFEAIQLDDEHIDSLSSFKEAVNNLEWIAGGTWTPSALKFAYDRLIKESRRQKTRVFAVVITDGRHDPRDDDLNLRALWTRRH

SEQ ID NO: 942836 - protein, 335 aa, Homo sapiens
CIVLSSEAGESSAWRSPLQPSRALGVGATTGHRAQMAPSVLNQQRPRQRYCSLGCKNWFREPQQDALSSCAHIARDAVAGLDFQRALLAHTRVLRQDGQSSSYYEDRHSALIYSKTMYLGDMGEYMWDQLLFASQDNPKTYISYGRLGDKTSPHLGIVRDYKNSIATVEHKGEKFNICMEFCWGRPFAVSKKDDEVTFIDAKTHRSKAEEQFKFEVNEISWNNENNMFFLTNGNGCINILSYPELKPVQSINAHPSNCICIKFDPMGKYFATGSAEALVNLWDVDESVCVRCFSRLDWPVRTSVSAMMGKCWGQIRKIILFDIAEVETGDNYGEY

SEQ ID NO: 942837 - protein, 194 aa, Homo sapiens
MAPPLCPGNPPLLAPPGAPASAPPPHCPPTHPPPTHPPRTLPGPARSAAPSNPPPRPLWARRCRLPQWACRCWMFFRGRAALGLGGLFPDRFSRRLFTAAYEGSSPPPTFYATPPFSLGPFRCSGTMGLMFPPELPIPKFVFRPIHFGGSPSSIIFGPAALHCPHTIRTHFPTAVGPPPGGGAPRGPIGGTSPP

SEQ ID NO: 942838 - protein, 141 aa, Homo sapiens
GIPAFPSWIPGSFSPGKHDRRQYLLPLPRPPPRAPPRHPPPRQPPPPRAVPPPPPPPPPAAAPRAPRSPSLLRPRFPALGRCILPPPTTFGPPPPAAPPPPGPPPPPPAPPPPPPPAPPPPPPPPPPPPRPPPPPRHPPRA

SEQ ID NO: 942839 - protein, 203 aa, Homo sapiens
MAPVPQLTPSKAAPGSSDKKGAWELLEAVTGSPSVWASESVAKKSQSSLRLSRTQTRGPHKIKHKSTKMAQPDSIGFRQAGHGAPRVTCYFPQSGKVLALTSGQLRRLFRPPGHDSDPEADSTRGRRQHAPGLSLNTSYGKNPKEQNPEWRKPHTFLKKKEVYEGNLRGGFSLRGEILESCKHWEWTPAAAQTGAVERPRATC

SEQ ID NO: 942840 - protein, 149 aa, Homo sapiens
MDEKGEPSNEEEDKEIKGSSKEFRKKWGFGRRNIAKGEGAGEAEAEEVELKKKKKKLGMFLRRSGRKKKGTEGVEQFFTIVGGGGRRRMNVFLEDFGEETCCAATEAEKEFEGSVERGFEKRRGEKYDSKDVKERKEYYEKVKGGDDHD

SEQ ID NO: 942841 - protein, 171 aa, Homo sapiens
RPSAPRAEKRARHRWERRRQLLQNPCWAETGQSGEKSEAAQLGARVEPPPGKTPRREPADTAPGPGSQGPASRAWGLIGLRARRPGPRTRQLRRAVATAQSGAERCQVRKAEANGRRFDLLGQVSANKEARVKAFGTNRELRSIRARSPFRPDLYLPGACNPLANESAADR

SEQ ID NO: 942842 - protein, 181 aa, Homo sapiens
MPSCWGDQVFTCETGVGHLNPAPGLVEDVVTAPNWGSRPIPTQLLPLSMPPMIDPANQGDYVPWENLGTQASLWFQPLLLFPGCLYSPDGPFPWDVIHISWEGSLADSILEEVASPLVTSKLLKTDLAPEALEPPTGSKEAAPSAPLSGARRAWKSAFAAPPRSRLRPQKGVPWTEKRAPG

SEQ ID NO: 942843 - protein, 104 aa, Homo sapiens
GSRHVSRQVAARLALGSGGAGALDALAVVAESVSSLTIADAFIADRGDELSSDPSLLTRASQWVHVLLPCICQSPIKLNLAIPFMRCHSLHIYVGDVLQVDYYS

SEQ ID NO: 942844 - protein, 150 aa, Homo sapiens
PPSRDSSAPQMDIWKKFFSKFEENLHNLKKEKKKQTTTAKKKEEEKQGNNKKEAAKNKAQQKQRQRKTRKNKQAAGDAERRKDPREPSPHQKPAETNSQQKKPKARNTKGKKKENPRGRRSKKPANPERRKPPGPERWGECRPTCRVCQT

SEQ ID NO: 942845 - protein, 133 aa, Homo sapiens
RCIPSSTSRCSQSKAVRYHNAVSRRSFFRETAEFRGKLYAAFRYARHVLTFPWTSGLSGWSSGGRFTEASLVELTRISRSAALRRMLLLPSLKMEDVAAPLPGSARLGGRVERRNAWGQSGEGKVGASCSQDV

SEQ ID NO: 942846 - protein, 248 aa, Homo sapiens
PAPFFILEPLPSVLPSSSLLHPPTTPLLALLSHCPPSILLSPPHCAFLPPGLPSLPRLCKFLFPHGLPPPLFLPLLAWLSQEATTGATGPAEPRVLGRCVHVPVASPLRRYAASSGFGLSAVQRSLKLREKPELNFEMEKEAYPCACEIGHRFEYEEPGSEVQVEHIKAYVTKGPVDAGKAVIVIEDIFGWQLPNTRYIADMISGNGYTTIVPDFFVGQEPWDPSGDWSIFPEWLKTRNAQKIDKEIS

SEQ ID NO: 942847 - protein, 104 aa, Homo sapiens
ADSRAQRVSGYSAYLHRGEHTSSRDHGNPVSPSLHSAHQMEEFTADIITFINLEKEKKEIMFLATKQKITGTPFPAEVLANFGLLEGTRMSLIPHLHPKSKGIV

SEQ ID NO: 942848 - protein, 195 aa, Homo sapiens
LDKYGVRAGYIDLCDSGPRREDISAISPPVGFLRTEPVSGPQQRLVEMLLPLLLLLAMCWSRREVNSAPGRLPSTEMQIICATMEITDDLSPADRGTSFGPTQSSPVNLEIQADEHNCRTCQEKWSSCTEARGTDSPCSVNGQTLRDVTQAPGPEYSPLVIIPHPYPELNRVDDLLHCVTNGDKTELQTGERSVS

SEQ ID NO: 942849 - protein, 295 aa, Homo sapiens
RSQVKSFTSPHYEGWQGQGWEVSCGASHQSGGPKGGAMSSFTHLWMVCMGPGNVDQPRLGPSAGHEAPQRSLCSPQERMWQQCQRQAQKGGWTALQRAGFMAFYVRFVLRPIQLDLVIVVFGGCFRRWLRAGGWRHHAPMRSLAATARSVVLGHHGLFPAQEAHGGGAVGALPAARAFLILHGTELFVVWANPSSPGAKAGGTPPEFGFLPDKLEGAEAVDVFVGGGLVALAVQVRKLPVGAKVKRNLLLHVPDGILHVLKRPPGLLELVAGLLGSIDEGLRLLVVGRHFVFLSR

SEQ ID NO: 942850 - protein, 300 aa, Homo sapiens
TGAAKRRQGTGAGRRRGGSRGASQAQQQEGSAPDTTERNNNGPEKTDGPSHGDGGRDTAESGTRQAPTDSRRGHRKQGGPQGSSQRQNEGDRDQGARSGRDGGRHGADQGEGGSPPGSDRAAGSKNRQGSSAGRRGTGTDGARANRTEQSRQDRSKGTGHGAGGSTDGHGTGSPGGGSKRQAERAREEGSRRGAGAPNQNRKEQGLRDIASTPHELYRNDYATMLPDSTENDQDTINRIIKVMKHEAYGECNKVSCLEIPGPSGPKGYRGQKGAKGNMGEPGEPGQKGRQGDPGIEGPIG

SEQ ID NO: 942851 - protein, 330 aa, Homo sapiens
PKQPGAGRAERGRAAGGGRPGSRRRAGGDRGRGGGRGDGDPGGGAGEGQAQGGGRGSSGAGRGGPGPAEHQGRGGRTTRDGGARAAARAEPAEEAGEEAGGRQAGRGRRGEHGGAGTQAERGEHGQGHGAAQGQHGGDHGRRAQGGRRRGQTGGARDAGREEHEGQRGGPPGPATRRRTRAGRAGTTPAPTGEKELQGGGGRQRRGEGREGGAQREGHRRRAGATKRQQRHAGGERGGGPPGQRHRRATGATKRRAGGKGGAPSRAEPASRKTRATGRGGHGATDSAGGAGKGGAHERRGRAEDGRQGSEERRSEQGGEQRQGAHRRGRG

SEQ ID NO: 942852 - protein, 139 aa, Homo sapiens
RPGLFPWFPVCRLPLAEALGRRVPVVVRQLLPLHQLRALGCGDLAAVGGGQAGCWGLPELSGGGDSEGPRGLSLAVAAGFLSVHGRCSPGARRRDSSCWPVGEFPTATFSNGSPKWVAQRKSSGCQETSESISVRRGRS

SEQ ID NO: 942853 - protein, 251 aa, Homo sapiens
GELCACMSSRVECESAGSRGGRGGRSGGLEVGPGYLVTCRALCGGLQRILGGAGLRCTRSAKATTSRCFLRYSCSAFSATVSINLGFFLETFYRDRDSDGIRVKELDDHLSNGRNVRVRSVGSHRGDPQIVLVALRECQRGQPVKLLVQLHQQGGGVEHLPLVGLQQPVVFSGQPLSDLEGFVELPPQLSLGGVVGGTVQKEDLPALVKLVLQPQAARGVVADLPAQSPVIVAFSYEFCWRVLEGRAVEID

SEQ ID NO: 942854 - protein, 112 aa, Homo sapiens
PTSPPPKHTHTHTYTLPKRTARVGRDALAMGPLGAAVAWSAARWFGCELSTFGGGWRQGEKEVSDLPRTQEKVLAKQADKKATGTQKRDEKKEEWKKRNKVGAAVTPVLPAT

SEQ ID NO: 942855 - protein, 237 aa, Homo sapiens
DELATKLSRRLQMEGEGGGETPEQPGLKGAAAAAAGAAEEAAEALGSADCELNAKMLRRAKLKKIIGEPQWLNSRVFKDYKKFKDFSKKEKKEKEKKFKKEEAGREGFTKLKEQKKKKEKIGAPQNKLGLKKKTKKVDKEFEKKDTFRDFLLIFRKEAAGELQEDNGLCVLARLSENKVSNKGVKGAKTFFEDKAQAINVSSRFEEEIKAEQEEKKKQAEEMKQRKAAFKELQSTFK

SEQ ID NO: 942856 - protein, 267 aa, Homo sapiens
KRRAANNQRQLEKGRGREKEKKDGKEEEAERDRKGSGGERWEEGQGGERGRGGGGGDREKEGERRRTREKGEGKSSGGSPAPGGGARREGRKRGKWGDGKKKRGRGGRRDGGEEGGGPEKGEVKRGGESSEEKEKGEVCREELCVYVKGSEVVCQWGKQWVVEWWKGPEAPPLKAPQSGASLPYSGPGTLKPPKERCLNPERLREVAGSPARGYPSPHPLSHVCRDTPRFAFRTSEEQGGCPSPRGPPGEVRVNIQCPIGKNQRLVG

SEQ ID NO: 942857 - protein, 206 aa, Homo sapiens
MAWVVNSLPQPSCPLEGQFSWVLVQGQAGSQGEEGERWWGAGEEELQAATRAPGAEKGKRKKKEKGGGRKGGGELRERGGEGADLEGKEGKGEGKGGEGRENGENRRGLERRGGKIISKGKGPGEGGEEGGGAGPWKGKRDKLKLLGFLRKDRLKSRASWKKFWLLRTVEMRMTLRSWPWNSSTEPTFKSLMSSSPRSSLSSLVMQ

SEQ ID NO: 942858 - protein, 245 aa, Homo sapiens
MTPYDDKLLGEKLKYYYSSSEDEDSDHEDKDRGRCAPASSSVPAEAEDKEGEGISVNTGPKGVINDWRRFKQLETEQREEQCWEMERMIKKLSMNCRYHLNEEEEQQKQKDIQEKISGKIDSEKEFAIMNEDQDDEEFLQQYRKQRMEEMRQQLHKGPQFKQVFEISSGEGFLKKKKKEQKKKKKKDHIYEDGIPGTEAMNGCMICLAAEYPAVKFCKVKSSVIGAKGQFTRNALPALLIYKGGD

SEQ ID NO: 942859 - protein, 152 aa, Homo sapiens
MGQQSSHGDIFSHFFGDFGFIFGGTPRQQDRNIPRGSDIIVDLEVTLEEVYAGNFVEVVRNKPVARQAPGKRKCNCGEELRLAQLGPGRFQITQEVVCYEFLMANSDEERTLEVEIEPGVRDGMEYPLLEKGAHVDGELEITVRIKVSKPIF

SEQ ID NO: 942860 - protein, 172 aa, Homo sapiens
KTAPPAHRQPPPQTPIATGLGPEEEEEEEKKTLQEETAKKFCKKGEEKCSELEQMKKEEEVGKNILDDGKEEELKMMQIGKWDGKSGENKDEEKEENNSENGKNICNAMGERIKAAGKRFPGWEADDVGKIKEKKGPSHLAALLLGNKVCIRALREICGLWGVGQHMLHLHQ

SEQ ID NO: 942861 - protein, 293 aa, Homo sapiens
LRLSEANSRVQSSQFDIGELYDSITLALERCYVGNRRPISQQNGAIIFQPINRTVPLRCLEEHYGTSPGQAREGSLTKGKPDVAKRLTLTMGGVQARAAEFRPRGKPPQNTKQKTLCIQPACLGSHRMDRRALSLKAHQSESYLPIGCQLSTSVLGCGHKPLPKLTCVQDGKRACPEPTSGSEGLLRRQGWGGAEGISTVNCALSPRLSPPSAVPQGSLVSLCLANSEANYCELNPAFATGCGRGAKLPSCAQGSHTELLTAKQNEAPGTRNSGVNYLILDDDDRERPWEPAA

SEQ ID NO: 942862 - protein, 149 aa, Homo sapiens
LKEQQRHKVREEVVTVGNTVNEGLNQPKDDIVHLTPKEVSHKAVGDEWERMSESGIKMWCQCLGFGSGDFKGDSFKWCQDNGVNYKIGEKWDSQGENGQMKSWTCLEKGKGEKKSDPHEAKGEDDGKKNHVEKTEEEGISRCHLLLHKL

SEQ ID NO: 942863 - protein, 267 aa, Homo sapiens
MAAVAVAVREDSGSGIQAAFPLALGYLVGNDQIRKSAASEGKETSSKKKRKEEKGADTMMTGLCCYLQPNVKAQPENCQNRAFSWALLGRKFQLVGVRPNFGLSVEPSREARAGPETGKKRGQGGPPPKASPSTAGETPSGVKLLPEYPQVDDLLLRRLVKKAERQQVPTRKDYGSKVSLFSHLPQYSRQNTLTQCKSIPSPEIHPAKERLGLQYSQGLGSGPNARGIALLRALQQVIQEDTTPPNEELSRDPVNKLKPYMSFLTQC

SEQ ID NO: 942864 - protein, 210 aa, Homo sapiens
AVTSVRRPPEEYEKAERARLRESAEMKGFLLPPAQQRDSEIMLQKQKKANVKKEAPKKPCGFVSNPLALRLGAGGQGHHAPLPPVVLTGPSTEGIVFELSLLRAPAAPPPPPAATLPLGHFRGGGGYPSPEEEKLVGPTPKKKKKRRELVGAREEWGPGGKGLEEGQPPPHQKRENSLDSDCGYVDLISETSQKKPLLYNDNQTSTPDMQ

SEQ ID NO: 942865 - protein, 184 aa, Homo sapiens
FTNGEIEAQKIKHLTKVCTATDMREREYEPRGASTSEDETNLATGGGAESNTLTAGKDRPKPAGGEEEARTVGRRLGNRGGRQRGGLREGPEEGGGGGGGPEEPASAGTKGGGGVGKWGGSSAAPSSQGGAPGQRGGAAGPADQETPPAPPGQGQQRADNEAAGHGGGFLASLYVMVTLTNWFR

SEQ ID NO: 942866 - protein, 111 aa, Homo sapiens
MFFVHMDLTTESVSDSLKSLLLDCPSSPIMCPAFLKARYPWSPWSPDASSYTRDFLFLFLEDTLENSSILKDGKDILLMALFLPLRYLFQGSAGIPAHTNLVETYELQEAN

SEQ ID NO: 942867 - protein, 195 aa, Homo sapiens
QYSKLTGYLLSDKEYKMIDRERLEANTTIGTRLPVHLNTIRTLSSNLHITFPAPAPPHPSSALSIFYLLNGYLSLSPAWLNIKTREYRPPPPPPAPAPPPRPPPPPPPPPPPPPSPRPPPPPPLPPPPPPPPPPPPPRLKKHTSLLSPIPLSLQALSKDVYLDILVGMKKIDSEKGNRDGIKNIQQPIQYECCSR

SEQ ID NO: 942868 - protein, 321 aa, Homo sapiens
MENRATLSNYFLKIIQLFDYYPKFFIFGTNNLGSKQMQQIPISLPGKAVVLMGKNTMMPKAIPGHLENNPPLEKLLPHIPGNFGFFFTKEDLTKIKDIFLANNVPTAALSGSISPFEVTFPAQNTGLGPEKTSFFHALSITTKISKGTIEILINLQLIKTGDKVGATQTTLLNMLNISPFSLGRDNQQEDDKGSSDNPEGRESTEETRQARGREGGRKGAKGGRQRGDPTGAAGPQASSNWDKRLRALAGETEDTGPRAEKGKAGGAEPAAGGAAARGRRHHNGAAAGHPNEGGTKEKRRRGQERGGGEGGKQKKSRTRGG

SEQ ID NO: 942869 - protein, 109 aa, Homo sapiens
MKFLISLLKSMTMKDNESMQEKQQEEQRKSSAKELPPKPLSRPQQSAPVQLNSGSQSNRNEYKLYPGLSSYHERVGNLNQPIEVTALYSFEGQQPGDLNFQAGDRITVK

SEQ ID NO: 942870 - protein, 273 aa, Homo sapiens
VCCVVYCVGNIRVKTAINLGDGRGCLVPNTNYPDLSGFFLWSVFSPRRSWGEAAELSPGNRAQARPCPPMWAGTSGAAGAFWLSLALGSGGLCGGGCPFFFPGPPGCVWAGGARVYWVGSGSGSVGGGVGGSYSSLGYSERGVALCCLMLLLASHRATLSSWQKPRGLDPRRQVALGPSAFGAIRGPWGLVDLQLLPLWQSSLQSWLLRALDLSSSDLLQADAGGLLGQAQVSELPGLQLQAELLQLLLYLPVAPVHLDVVVLQLLLVADHLL

SEQ ID NO: 942871 - protein, 318 aa, Homo sapiens
AQAAEPSEQLGWEQRNPELGIGSRARGAAQPGRSTRAMMSTYKRATLDEEDLVDSLSEGDADPNGLQVNFHSPRSGQKCWAARTQVEKRLVVLKELLAAGLVACLAALGIQYQTKDPSVCLNETCVSVTNSILNPKDPTVDPCYDFISNACRGLIKANPVPGFHSRWGTFSNLWEQNHAIIKHLLENSTTSVSLVERKAQVYYRACMNETRIEELRAKPLMELIERLGGWNITGPWAKDNFQDTLQVVTAHYRTSPFFSVYVSADSKNSNSNVIQVDQSGLGLPSRDYYLNKNENENVLTGYLNYIVQLGKLLGRGDE

SEQ ID NO: 942872 - protein, 324 aa, Homo sapiens
PERALGGGLGKLPRSQVSLLACGRCEERQRLLAASASRPCERTVRPRHSGRSGAEELLQLQVFQLERERRRLLADLGQLLREGELLERRCATLVRGAAGARAEAWGDKVGGVPDVRRDLPAVAAACEGLQAELVRKGGELVVVCGWRCGGPVLRCGSVRARARGLRGAARARELELEACSQELQRHRQEAEQLREKAGQLDAEAAGLREPPVPPATADPFLLAESDEAKVQRAAAGVGGSLRAQVERLRVELQRERRAREEQRDSFEGERLAWQAEKEQVIRYQKQLQHNYIQMYRRNRQLEQELQQLSLELEGRELADLGLAE

SEQ ID NO: 942873 - protein, 103 aa, Homo sapiens
ATKGTWEDPTSAFVTSEVRKRPTFPWCAASAFEVPSSLADVLSSFFSDIFFLFSTDGVFLFFVDFQFYFQEELRFLILLVFLKDFDFFYFGSALPSLDCCGIF

SEQ ID NO: 942874 - protein, 111 aa, Homo sapiens
VAPLPGVLEASQRKKVLGTTGATENPYEAAADGGSPGRGQNGALKANQNGGKNWGTRGRCCGSWLDLWDRRLRRAGAAQGRERRLGRRMCAPTRARLPIPPFLGWGGGGSG

SEQ ID NO: 942875 - protein, 316 aa, Homo sapiens
LPGRRSLRDLGSPGEPPAVSARSAPPPGPLGRSSRGRRAGCEVDSRRAVCPVLPPVFPLRSDLLITMSTLYVSPHPDAFPSLRALIAARYGEAGEGPGWGGGGSRLCLLPPPSSGPSFPPPLAAVPCEQGRRWALGRGGPTCCGQLLWPAGLGGPGGRRAAVLVLQWVSYAGTEFIPAACGAYAAGPGTPKLGPGPPGFAGGPWQGPESLGGVASAAELLGWGGPTLADLAAVTALLLPFRYVLDPPARRMWNNVTRWFVTCVRQPEFRAVLGEVVLYSGDRPLSHEPGPEAAALPKTAAQLKKEGKKREKLEKFH

SEQ ID NO: 942876 - protein, 242 aa, Homo sapiens
MAMKYLEVIKLFCVIMQEIQKPEKKIQFNEKVLWTAITIFIFLVCCQILLFGIMSSDLADPFYWMKVILASKRGTLMEPGMYPIVTSGLIKKILAGAKIIKVGETPKNRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNL

SEQ ID NO: 942877 - protein, 135 aa, Homo sapiens
LLRGSLDPGLISTGENTQAAGAMGPLSAPPCPQHITWEGLLLTASLLFWDLPTTAQVIIGAKPPKVSEGKDVLLLVHNLPQSLTGYIWYKGQMTGLYHCIASYVVHGQIIFGPAYSGRETVYSGASLLVQDVTQG

SEQ ID NO: 942878 - protein, 178 aa, Homo sapiens
VGLGGGAFQGSAHFPVGGCGGLILLIIWASGVGSFSSLSGVWWGGRPVLFLGVSVGEAIEGALVGGRGGGRGLGRVGGGGVPGGGRGGGRGGRGAREGWGGGGGGGAWGRGAGAAQGGAGGARPGGEGPRSEGKAGGAPGRGGGGGGGGRGGGGAGGGGRGGGGTAGAARVGPRVARG

SEQ ID NO: 942879 - protein, 84 aa, Homo sapiens
AAPRNSDLFSGGYLSSRRSPEAIPPTLLWSLLLLLELFVATAAPLEPLFQLPAPQHPKIRMENAEKVLSWELMALKNSTRPVVY

SEQ ID NO: 942880 - protein, 274 aa, Homo sapiens
VRVRFLALRAGGPWWFRLTRARPGDAESEGVAVSGGKGYGARFELTGESAGGRKHPSPADLLLAPARLSIRLLLLLGYRRRCPPLLRGLVQRWRYGKVCMRSLLYNSFGGSDTAMLILPFSLSTDLVDNVICWFGVVFVVLVIVLTGSIVAIAYLCVQPLILRTYSVPRLSWHFFYSQWNLIQYIVFHYYQAITTAAWVPPQGRNDIATVSICEKCIYPKPARTHHCSICNRCVLKMDHHCPWLNNCVGHYNHRYFFSFCFFMTLGCVYCSYGS

SEQ ID NO: 942881 - protein, 74 aa, Homo sapiens
RWWACSGVRFGVRRIEDKRRSCSKEGPGGMEAKRGRRLKWAIKKAGKEEEEGVEVNGEVERKNRYKKKEKWKRK

SEQ ID NO: 942882 - protein, 155 aa, Homo sapiens
MAISKTVAWLKEQLELGKERLLLMDCWAQSYTVRRTLSRAVNVAIPGIMLRRLQKGNLPVRALFTRGEDRDRFTRRCGTDTVVLYDESSSDWNENTGGESLLGLLLKKLKDEGCRAFYLEGGFSKFQAEFFLHCETNLDGSCKAARRRCQCWGSG

SEQ ID NO: 942883 - protein, 124 aa, Homo sapiens
LPVVVASSLRALRVRSAAGRSTTAPFARANAHVLDAPDARSRRPTDRRNALASAPTPAAAAAARNLPTAPPTADPRERTAHARARDRDPHAARRRLPLDANLRRRTTPNATQLNKLRRRHCPND

SEQ ID NO: 942884 - protein, 103 aa, Homo sapiens
MTVFPKKKTFDPYIIIAPPPPQSKKIFSFEQAVRILQDDVACYIIKIGSLVRNKERFVKRRQRLIGPKGSTLKALELLTNCYIMVQGNTVSAIGPFSGLKEVR

SEQ ID NO: 942885 - protein, 99 aa, Homo sapiens
MGQVRGNSERGHLGRFFGLDLGGECAGGAAGEIAMERRRRNFSSTSPFSASGLVAGLVPLVRTSAAARGCGERRVVANGGGPSRRSPSQIWRQRHVQLF

SEQ ID NO: 942886 - protein, 302 aa, Homo sapiens
MAGERTRRQVNLEIEKAQIHLSTAHNKKHQQESTSERHHQGTTTKNDKELNYWRCARDVGPQGHIEAKIHPLKNRRKENRRKIWEINKKMRITSKARLHSPGSPGAELRRFFFNCLDAFLWCSSFHSSYSVQTGRQYKKNVENRTYSAAVIYDFLDVDDINGERIQDVLFFIKTPTEEKISADPVDEGFSSPCTFAAAVSGANGSTLWERAVAQDVALVECAVPQPRGSEAPSACILVGRLNAFNAVNLFTGDNLWNHSSSFSENASILSPLLQVPDVDGDGAQILLVLTQEREEVSGTSTR

SEQ ID NO: 942887 - protein, 267 aa, Homo sapiens
APGFLQAEFSSAKPRGPQRARQRPSLGDAGGGLRGDLIGAPRGAPRSTGRGPQAGGAKEKRPGGPGASGVRFKRKTGTHREDGRCPAAPESGARWGEGADPLLAPGRAPTSSKGAGLEVGFREGEKRSLGWKTLAARTAFRATKPGTAAGPGPGPGPGPALALSSPAAAFSLPDAEAAAGYLGFADYAMLFSPPSFTGKRGRWRILLLKGRVLRFFLAPSGERSTFCSGRGESPSLCFIRRLLEYMDSGQGPHGRTSWFKSCTATLR

SEQ ID NO: 942888 - protein, 292 aa, Homo sapiens
GGVGEEGQGGGGGGGGGGGGGGGEGGERGGRRLRGGGETGEGGGGSESAGRGEAGACNAWGTGPLQGESELQCVLRGDENDPKKLMSTASALGYSEQMRPEDELRHHVRSTCERPRGVSSRAGPQPILLGETLAPGFLTGRWSKGPSRHPPCQRIPLWLREGLRSGAVSGSRGGPGPLSAMTPWGTEPRREKGNGLLQDGVGDGLSRGHPGSFYAMAALAWERSWQGEGTGKDGVLHDPALPKVARETTMKAAWCERDPGGVQNEALCGDSGRDAGRETGPGCPLTHPGPWV

SEQ ID NO: 942889 - protein, 333 aa, Homo sapiens
GERIEDEEVKQRLRAAAVAAAAAAVAARGSRRYAAPRSALYLPSDPLTLLQADTVRGRGAWAPAAPWAVEFFASWCGHCIAFAPTWKELAEDVKAWRPALYLAALVRVLQETNSAVCRDFNIPGFPTVRFFKAFTKNGSGAVFAVAGADVTVLLCVERLIGGPCEYPYIETCAPQPCAPTGSLAQSWEEDYMGFFCRENKRKSDLGSESFEEGESSLPRGERSVGSSDLVPQPQKGGGRVAQGLLERQEAQCWLEESLVVHRPSPYFAHQLVPGNGLLCSRSSPWLMGIPGPFYNRFTCKKLSWGSPGEAAPGPQFAPTTAEQDSSHWFGKLG

SEQ ID NO: 942890 - protein, 68 aa, Homo sapiens
QRVTGRLDRRAAEQLCRAAAVIDGERLERTQRVRAHSLDPKAAAATPPPAQRPSAGRDAAPLALVYFI

SEQ ID NO: 942891 - protein, 65 aa, Homo sapiens
MSGGRHTVTMIPGVGIGPELMLHVKSVFRHACVPVFEEHVSSNASEDIRYAIMATAGYRVALKGN

SEQ ID NO: 942892 - protein, 104 aa, Homo sapiens
MVDLKHNKGGDRTRGVTGYFTFNLYLKLPKPYITINNSKPRENKDVLAFTCEPKSENYTYIWWLNGQSFPVGSSGKRPIEKRILTPPSVTRKETGPYECEKRDR

SEQ ID NO: 942893 - protein, 120 aa, Homo sapiens
MMVQNPGQVCAWEVSASAMVPWVSPPGYLVFEDFAKLTPFVKEELRFAIQNKHLCHWMSSELELVTVSERALGVSIKKAEVAPEEDESKKRPRERNKIADAKCRKKKKEKTECLQKVSAF

SEQ ID NO: 942894 - protein, 52 aa, Homo sapiens
TFCLEFPCTPGEHLVLQESAEKSTYEKTALLLPCFAPSTPPLGPQSYAHPAQ

SEQ ID NO: 942895 - protein, 142 aa, Homo sapiens
KKKAKREKRNMKRWGGGVNNPQGGQGREQRPTPAPRTREHIKQPPVPSTKKKTPGNCWIEGPSLPGPDRGPEYPPRPQLPTASPRHPKPPRTNEPGRKGDEEYTGTKKKKRGGKGSPPTKGCKGTKESRKGPPHGHYGVEEG

SEQ ID NO: 942896 - protein, 286 aa, Homo sapiens
PAGAEAREREQQEQPAPDNGRAQGAGGGGGGEGSAQARGPRASHAREQAGAAGDAAREQAERRGRRRGGPRRRRRQAAAPRQQGGGAGAGATPGPGAGRKPAGGTPEGQPGPQGGSGGRRTPARRGAGGGAGGTGGPGSGPGTSGGQRRPEATQRHGARRERAEPGGPQGPADREGPRETKRRPPNAGPKGAGEGAREEDRRDARRKGEGARRAPGESGPKRRGGAAGHPRHTPPTGQPGERPGPDRGTHRHGGRQHKQGTGGGETTTGNGRGGTRSRGRSGGAGA

SEQ ID NO: 942897 - protein, 340 aa, Homo sapiens
KRAQGRPGPRHAQPDGRQARAQTGSAERGRPRTAGPEGGGGTGRGRRGSTGRRPRGEGRRKGARHRQRGRRGQEGAGAEAGDRNRAGGDRPRGGEGKGESSRDRGKERRRGEGGSEEGPSRKRADHRAGAGRQGHRHRKRPEGREKRRQAREAHRGHKGEGTQGQEEAGEGGRRQAQGRQGGPSGGRGGVRDQGGGSGQRSAGAHRQQRAGRNGGAPQGGKAGGDRKGKEAPGGEAAGGRSGAAGGRGGSGSGAGGGSRGGGGERRKATATPHRGGSAARENAAGAKDTGAEERKTGTPRTAGAAEDAATARERDGAGTGPRTEEGGSGGRTTRAAGRRG

SEQ ID NO: 942898 - protein, 209 aa, Homo sapiens
MWMHKIFQVSCRCRGVWIRKKGRKLGSHSPMSPQLTGHHLKQTLLREQVEEGQISGFLPWYNLAKGKELGLIFQGFPIDGDPGHILVWWLESIFSLGVGVHQQPRSPIASMKVFGDTWGVELQAQWQSSLHVLKLFHAENGQEGKLHVKIQAGLHLVEFALLFSMLALELPPATILFLVSVGTSVKRIMNSVGKSSRIRKARQPPHSAS

SEQ ID NO: 942899 - protein, 300 aa, Homo sapiens
RRRRRAAVPASAPSTCSFTYPIRAGNDPGVAPGGTGGGLLYGRESAPPPTAPFNLADINDVSPSGGFLAELLRPEFDPVYIAPQQQQPPGGGLMGKFLLKASLSAPGSEYSSPWVISVSKGSPEGSHPVVVAPYNGGPPRTFPNIKQDAVSSFTHLGAGPPLSNGHWRLHTNSPWGGSSPAGLHLTLGLDEVLSSMDCHPALPLPPGFHPHPGPNYPSFLPDQMQPQVPPLHYQELMPPGSCMPEEPKPKRGRHRGPEKDRTHTCDYAGCGKTYTKSSISRTLRTTQVRNLHCDWTLWMK

SEQ ID NO: 942900 - protein, 164 aa, Homo sapiens
MERIEPSPYNCTFKNKETCEPRLRTKTYHTQKARRQTKLTILPKDHVIELSTSLDSRIISLSRRVTIAGGIAHQRSADPGISYWAGHITDKGHAKDACVISSDFHERDTFYIFNHVDIKIYYHVVETGSMGARLVAAKLEPKSFKHTHIENQTAQGPHGHKYKD

SEQ ID NO: 942901 - protein, 85 aa, Homo sapiens
HPASIFLLTTTTLPYITFHLSTITFPDFSPPPAATIPYIIFPFLLLSPLYFIFPLFSLLSFTSPSYFPFLLYILLSFSFLSLLLL

SEQ ID NO: 942902 - protein, 251 aa, Homo sapiens
DPPSHPTIIFLLSASTLPEITVHLSTITFPDFSPPPTTTNPKNICPFLLLSPSDFKGPLFSFLLLLLLLTVQFYVTTFSPFQFSPFSSKKLSLFPPLSSSFSYLTLSSFFFFFPIFSLPLFSTFFCSTSLFSLSLSCRALPGEQQTLHALTRGQSACVQESDASAPHAAEAGSPEKPESTEITEEELLDNFHLMAPSEDDHSILWDAISTYDGSKALHVTNIKKEKEPCRIELYRVVESLAKAQETSGEEI

SEQ ID NO: 942903 - protein, 71 aa, Homo sapiens
EAPFALPAASACYGPGNAPRDYISLHPFDLETVDRSFRFEFKESIGALKKLSNRPQMYPRGRLNLLSNGEV

SEQ ID NO: 942904 - protein, 119 aa, Homo sapiens
MNDIWNEEDDEEKEKKMRENERIGVMGRYRWEKKRLKNLEVNGSEPVSHPLPAWCQSPFSRCFQSAALLLLAGPPGSPARGFLLSVSSLPPCPPPPSLLAPDPCLQLLSLSAPPCGHSD

SEQ ID NO: 942905 - protein, 51 aa, Homo sapiens
MARYYRRIAALGVREQYRAGSPDERGALTTTRQFTWDLLARVHRLESLAPT

SEQ ID NO: 942906 - protein, 302 aa, Homo sapiens
HSSSSIPNLLFPPFLPEPSKTKYQISTLHPAARRLLLDTISHPLSSRAQEIPEEKAPGNIPPSLPFPSIHPSPASSDPISLAHYFFFPFLFLLFSFAWGHTKPVDLLNQDFIDFSTNPPYLPVTVVNTTMSLTALHHQIQTQNLSSYIIPATYAHINKYIFQHDERRAWITGFTGSSETLYDFKKAAVFTYSRYWTQAERQMECNWELHKEVGTTPIVTWLLTEIPAGGRVGFDPFLLSIGMLFLQSLNSVHANEGDSASLGYKEKDLGRKKGRWDYKDKDIEIVVAECFADEDVFMDCVIK

SEQ ID NO: 942907 - protein, 203 aa, Homo sapiens
YCSVLHFIGLGQEDNGILCLALALAEGSEFLLFLSSGGLASAVEGGPCGGARQGPCCPGSSAARSGPSRSPPLTRSWCCPSGDSGSCWIRGTPRAAAAWFVVSHWFFLRKVEVMVEATIRGKGHHRLAHGQLRLLLPEPARVGGEGRAEPAPQELVLLEVGLHGDLGLRCCLLVTQHPQQGQFHPQRVMSSHSPAAERVFGAW

SEQ ID NO: 942908 - protein, 261 aa, Homo sapiens
DPALALKRRLRGAASGSAGLRVPSRLSEGESLTVLSSGSAPQVESSSSAPGLPSVSPPVPSPTSAASPEEEEESEDESEILAESPCGRWLKRREEVNQRNVPGIDSAYLAMDTEEGVEVVWHEVQFSERQNYKLLEEKVRAVFDNLIPLEHLNIVKFHQYWADIKENKARVIFLTAYMSSWSLKQFLKKTKKKHKTKNEKAWKRWCTQILSALSYLHSCDPPIIHGELTCDTIFIQHNGLIKIGSVAPDTINNNVKTCREE

SEQ ID NO: 942909 - protein, 67 aa, Homo sapiens
NGQAIRAKYKEESDSELSPGQPSEATRCLDAFPGDRLLTFPCYIQIFLTSRDFLFICLHIFLKENQN

SEQ ID NO: 942910 - protein, 176 aa, Homo sapiens
EAQRSPPHGRKAEAKTPEEMDRVTRYPILGIPQAHRGTGLVLDGDTSYTYHLVCMGPEASGWGQEEPQTGPTDHRAQQGEQRQGVPYSVQANTGQPAPRGLHSENREDEGGQEERRGGREANHGPPTVVMPLRGRGGQVEEDDSREAGAADFRRRVDRERECGGLQLGLVMHEEYR

SEQ ID NO: 942911 - protein, 273 aa, Homo sapiens
PAAAPARAGAGAQAEPCPGRRPGRGRAAAPPRLRAVTLPPGAGTAPGPRRRALRSAEGRPSRRGGRLEKFARQGSPGVGTFDPGEPCPSGPHAPKSYSGTKGVRLGAEAMSAGKGDGRYRVPAKCCPHGAEALVAMGGSSNRNFGPVAADAQGQKVFTNTWAVRIPGGQLVANSVARKHGFLNLGQIFGDYYHFWHRGVTKRSLSPHRPRHSRLQREPQVQWLEHRVAKRRTKRDVYQEPTDPKFPQQWYLSGVTQRDLNVKAAGRRATQGTE

SEQ ID NO: 942912 - protein, 271 aa, Homo sapiens
PAVGAFDSEGHPLSSTAEGSSKGDPKGAHAGLGPPGRRWERPLPARVRAVSLSKACARGAGTRLARAPAVAGVQLPTFCPDLWLISPGLRRLKPSGYAAAMPVHTLSPGAPSAPALPCRLRTRVPGYLLRGPADGGARKPSAVERLEADKAKYVKSLPRGPTTAQEPCASPLPVPNQPASFQPLETSPATSASSPSPPAAPALGPLPDRPPAWDPVTIPPASPPSDFVVNSPPGSPLPGGPARHSLGTGPEGEPGPSLPPSPPPPANRQPQ

SEQ ID NO: 942913 - protein, 157 aa, Homo sapiens
GCFYQHLLVLCCQSTKKLIEEARGGCGLSDYYMWACAGRANNSHVEDLKPRRSARGDEPLPTLDATVQSHEKGKQAASAPHSPGLNVCARAPSWLPRVVAPSGPGGRAVILGEGVSQSLSAAAQGAHGPSSEDLQAAGRVLAPQLGLQQEGRERRRT

SEQ ID NO: 942914 - protein, 187 aa, Homo sapiens
EEREQYGRVPPGGGSSGEFGEGAEREGEAQGEGEGSQKDEDQTAPEEKEQAHRGSRRGAIGKKREDGSDNTKQNKVPQCTDPEYDWADLSTAKEEEQDPETFLTIIKGAGGKAFCAGGEIRVTAEAEKEKQKIEPVCVCQRRIYDEYCVGGGARNRRVHVVMEVQWVGEVVSQSMGNFEWLQKSVFL

SEQ ID NO: 942915 - protein, 115 aa, Homo sapiens
MTRPNKGCPFAMEDDDHCKEEMLLKAMLAHGGHASENKAETNFLLTENQTENKKALEASPSPGQQLKTKKRQIIYKQMSIASANKALYENAENFHAMKYEELTTFPNQSKRRKPF

SEQ ID NO: 942916 - protein, 290 aa, Homo sapiens
CRRAPPRLPGCVLFSLLRFSCSLLLLAPLSASSCPCVFFFLPLPLSWPFPPPPSFRLPCWFLVFSFLSFPPSVPCRGSFPFPGVGSVPCALFSAPCVCLGLCSPPFALGVCRASPRCVRLPPLCSCSLPFRFRGFLFPWSPGFVPLVGFPRFSFPAPRCFCPPAHRLLPLSARGRPLRLGVRRCFGAFFVFWLGVLAASLWVDFSGSTVADTWVLYGTSHKSYTSCTLFFEFLLMRNIHFCIDSDFQIAFSAFKGFLTSRAHQNCQVPSGSEAVSFGWALASALSLSFTD

SEQ ID NO: 942917 - protein, 318 aa, Homo sapiens
LFGFLGGFGIPFFIPLSSSRLPSSGAFAARLSLRACGGFSASPVSGAAPVARPSFPFPPRPPLFSALPHAFPFLVFPVSSWFLSFAALRLSPSSASSPLFFVSPFSLACWCRVALRGVPVFSVLCFLFSSCGFPGGSLGGWLRARLVGVSSPPGPARGAPGGGGGPPGSPSLGAWCFPFFLLPGGRFFLFVWFRCFWGPPSFLGCPLPTLCPVVCVLVPVGQGTSYGGSQCGQVLWFRTHTRAGYCQIRITPERRPVSLNDLWHGKRVNCISKGEQNFFCFVMPVSDVISGSGLEFASELSVKLSESADARAHPKLTA

SEQ ID NO: 942918 - protein, 199 aa, Homo sapiens
MVDGAPPADKKLMGFEPDLRSEQQILPHVYVQVHKIRPLLSIRSDKQLQDIVYKLVPGLFKDEMKRRRDFYAAYPLTEVPNGSNEDRGEVLEQEKGALSDDEIVSLSIEFYEGARDRDEKKGPWRMGMGRRETGVRFWMPSSHDRHASCKFLRNKMDVPSKYKVEVLYEDEPLKEYYTLMDIAYIYPWRRNGPLPLKYR

SEQ ID NO: 942919 - protein, 284 aa, Homo sapiens
MALRSVAATLPSARRWPAPRAQGGVAGRAAMGCIGSGGAAGSGISGDQQMAEAQRIETAAPAKGELLETQSAMLLKYTERALTIQEIAALDRSSLHGIFQVVKEHVNKPTDMAQGRLAHLIEWKGWSKPSDSPDALESAFSSYSDLTEGEQEDRFAAGVAEQFDIAEAKLRAWSSVDGEESTDDSKMRTLFGEWTQTWLGSCPWGRTSRNCSPATGSPGLCAKAPWSLESDSSQTVSPDTLCSKICSLEDGLLGSLARLASQLLGDELLLAKLPPSRESAFRSL

SEQ ID NO: 942920 - protein, 123 aa, Homo sapiens
LAKIWGLPGGERASLKPWTPGALSQVGVLWDLERLGWVVSGRPFSTSSHFGWSRFLLRSLRTCLGARCPLIAPRRISAWSPGSVILPDCRWDSEAHTGLWSRWRYYGLFELLLVSRFSQATWR

SEQ ID NO: 942921 - protein, 263 aa, Homo sapiens
AVLRGAARRGTARWECLRLACRENTTETSNPGSSVMESVTFEDVAVEFIQEWALLDSARRSLFKYRILYQCRTLASKKTPPCKPNYFSQLRQTAEPKPTKPEILRATDISLESQLKPKDFPSIQNLFEECILQGHSNAAWAVALRMQLVPSIEERETPLTREDLASSPGAALVSGMHGTEGRYADSEGGDTSAYTGPPQPMGGQGFWEQFLDLSLVLLFSIFLRVTPLLSSDGEMGTGNSHKENTDPSSVELTVSWVVRVRNE

SEQ ID NO: 942922 - protein, 254 aa, Homo sapiens
SQTRSGGGSEAGVRGGWAGSPSGGRSEFSHSHFLPQAAHQPPSPPAGAWAEPGWLCCAVPPGKMVVALRYVWPLLLCSPCLLIQIAEEFMEPAVITEQSPGRLVVFPTDDISLKCEASGKPEVQFRWTRDGVHFKAKEELGVTVYQSPHSGSFTITGNNSKFAQRFQGIYRCFASNKLGTAMSHEIRLMAEGAPKWPKEKVKPVEVEEGESVVLPCNPPPSAEPLRIYWMNSNILHIKQDERVTMGQNGNSTLP

SEQ ID NO: 942923 - protein, 75 aa, Homo sapiens
RGLREEEEPLDGEDAAVSWGGRGGGGLPLDSDPGSTGLSILQQLSATVCELGVFESFHTMSWKKVVKSVAGCADD

SEQ ID NO: 942924 - protein, 315 aa, Homo sapiens
VTLFLHNNVVFHDPHIADSWPQLQDHFSAVELVGPEEALSPGEARDMAMDLCGQDPECEFYFSLDADAVLTNLQTLGLLIEELRGVMAPMVSGEGKLWSNFWGALSPDEYYARSEDYVELVERKDVGVWNVPYIFQAYVLGGDTMWMELPQRDVFSGSDPDSDMAFCEGFGEKGIFFHLSYQHEFGRLLATSRYDTEHLHPDLWQIFDNPVDWKEQYIHENYSRALEGKDIVEQPCPDVYWFPLLSEQMCDELVAEMEHYGQWSGGRHEDSRLAGGYENVPTVDIPHEAGGVRGPVAAAAADVCGPMTETCFRFT

SEQ ID NO: 942925 - protein, 93 aa, Homo sapiens
TAVSERNWISLDLNYEEEAAAAAAAEALGWGKLAVEAQLRLHSPSAASSFFGRYLLVLLILAVLLMGGLGGPESVWLTELCCAAGAWWRSELC

SEQ ID NO: 942926 - protein, 60 aa, Homo sapiens
PPPPLAPNPLLPLASNYASPIIGPLSGKPETLTSPKVSKPPTTPASRNPGLRAQERQNGK

SEQ ID NO: 942927 - protein, 144 aa, Homo sapiens
MGCGEIAVHAAVGSGELFSSVRCRVGKQQHGHRPTLNPPTGTGSHNLGQRNSGALVVIKAIHGLEAEDHVQAIGEDEEHEQGGEQQKKKKKGEEAGPVAGVGELLPHYVESLALAVLKHQLPGRGLRAGQEETTLLAQAAEILA

SEQ ID NO: 942928 - protein, 165 aa, Homo sapiens
MEMNRFRLIGPLSHSILTEAIKAASVHTVGEDTEETPHRWWIETCKKPDSVSLHCRQEAIFDFLGGITSPAEIPAGTILELTFDDPPINLPQNNSKAFPNPEKFQDNYKIINLLLDGFPFEYTHNFIWNKNIFNIFTDNKISDEDLNRMMNEFLVPGSQLILGPH

SEQ ID NO: 942929 - protein, 191 aa, Homo sapiens
PVRTPLPLRFGSRSFGPWAPNTSPRQRVAHCITPPPGCRETEKDGEEEENGKKKKKKKSKGGWKEEEKWVKEENGKKKKEESDGRRRSERRGGRRKKRRCRERQQRQKERQRLWGNVFVAGECLGSESVKRGSSDREAIVDGNLKRILGVVWKLIIYYFIFMPVWEDEGDDDAKKKKRKEKVVGLIEKKMG

SEQ ID NO: 942930 - protein, 212 aa, Homo sapiens
MLVDGPFQIPPGYYSFPIFSVPGAQVLGFDVEFFQVSGVSFGICWWLRKVQVGEGCDGALSIPTLRPTRPSSCAAPLLGPNQGVGAACQGLCLCVSPPTVHKGPFLLRLGYPSPGPLAPHHLLHLSPDPQLAQQCPQPPLGRPRRLPRPQEQGRSGAGRYAKRAPCPRWLPSAAGRGRRDPHSRATPGAQQVEGPHVHMVQLRGAPDPRLIA

SEQ ID NO: 942931 - protein, 309 aa, Homo sapiens
FPAPVHSPPEAPRLAGFAPERCVLRVTYPISGFLFLSSAMASESSPLLAYRLLLVEGVALPANGAGGPGGASSRYLFTFLGVVVPTVLSIFSIVVFVRIGFVVGHAGLLLALAMLLVAYFVLALTVLSVCAIATNGAVLGGGSSFLLSRTLGPEVGGSIGLMFYLAERLLLCVSLLGLVESVLDVFGADATGPSGLRVLPQGYGWNLLYGSLLLGLVGGVCTLGAGLYARASFLTFLLVSGSLASVLISFVAVGAEDIRLTPRPGPNGSSLPPRFGHFTGFNSSTLKDNLGAGYAEDYTTGAVMNFASV

SEQ ID NO: 942932 - protein, 179 aa, Homo sapiens
GCSTVLAKMKCVLVATEGAEVLFYWTDKEFEESIRLKFGQSENEEEELPALEDQLSKKLAPVIIYKMKMMEKLEEKYTCFSTENGNFMYVFDMDAGPRPGAGAPAVGALPEPAVDLQPPAGEKQCFAVEVITGLREFSRLEAVSQSAISLRSAELLALILLVQDLYPSESTAEDDIQEK

SEQ ID NO: 942933 - protein, 95 aa, Homo sapiens
APVPTATYDTRYCAYLNKNGQGSQGKPQGMLRTGKPVLLGTNGARGRRLPPPGLRNARQAARCPGIKVVSPVVLGPKGGGHWGCRGLPPTHRRGK

SEQ ID NO: 942934 - protein, 96 aa, Homo sapiens
FCAGVAPWGRGRAATAVRKRKTVGGSGNRSPEEGNQPLLGSRNGQQSSALAYAIIQFLHDQLRQGGLSSVLRRVGSRLQCLEMQFGVTVEDSELDT

SEQ ID NO: 942935 - protein, 298 aa, Homo sapiens
GCTPYEVRFKKDHSLLGRVFAFDAVSKPGMDYELKLFIEYPTGSGNVYSSASGVAKQMYQDCMKDFGRGLSSGFKYLEYEKKHGSGDWRLLGDLLPEAVRLFQGGRARRRTLPAPSPVLGRACATCLPNMLMGESEPAPPKRNPPGEPGPFACPACARSGPGGATHKALRKEEKALFREAPGTSDRRGASVSVGRGNKPEASKLDWRTKEQRAPESTPNVLPGEAFAGAGGTRAGGVRPPPAPTLLGPQFQPGPPPPLSEPPPETGLSPNGRFSMSVGRILWAQRTRPKDGSSVHSTT

SEQ ID NO: 942936 - protein, 126 aa, Homo sapiens
MVIFQTEVFPEENGTPQPPPGDERYLLRREKIRGAALMIFQELYHRVEAAFQTGNNTPQEGERGFFSILFLFALVYHKLVVQKWVLLTAPRPLPGLPRASIRGCHHWGDAELPVTATRTIVNSVPV

SEQ ID NO: 942937 - protein, 164 aa, Homo sapiens
HDSTIFSCRLGLLVCCLRDAHVPQSYCPKCQWAVQGMGSSFQMVCSLWDHAATIPFLSSSDAISGSKADLRGKDFKSTEVECAMLEWPQEVSRPMTPVFVYISGRGLPVGQKGGSVYPGANRSEKPWCQAKARGTRTLITLQPFRMAGTLNQYSGNVGGKTKEN

SEQ ID NO: 942938 - protein, 166 aa, Homo sapiens
GEQSDRGLLRGPAGDWGQAGKRGDGGRPPGGSGPPPPSSRRRLRPRRGGGGGGAAAAAPQRRRSPESRSEPASRPELPAGFHITDPAKVPGAHTGNLEILLPRPQLWRNSGVEQRSFLVFHAGPHGGVLAWKELNDTDMNKKTQIVILMELDWKEKKAPWGPGGRT

SEQ ID NO: 942939 - protein, 269 aa, Homo sapiens
GQTRRFLDASYAWRESCLSWHHHTAHDIFAGKPVDPLPGSTRGQDSAVCSQGQFLDVRPEAEDQEAAPKMGERKGVNKYYPPDFNPEKHGSLNRIPQQPPALGAGLEAITGAEAGKSKKQLAEGKNHNGKGVRYKSEKKKEGKYSTTPNTRRKHPINNKEKQTDPANIDNENSCAQRKEERVDSADKQQGLTTEQEKKQKRETDAMFRPEHAEADRSTHKKAPSTRCHNQEAQSAVKTPGPYSSRGEGSGKEKATQEEEERDRPSGKAS

SEQ ID NO: 942940 - protein, 266 aa, Homo sapiens
YYRWTRAHDLRGFLNFTLALSPSSFAAAHNRTCRYRAFRDDDGHYSQTYWSSLPIRLGPSNCCFEGPKATLSWFPTPVERPDPVLCLIRARGEGSVPSLPAVSSWSNQSSSLHLRFPCLASSLGCGVDIVGVSRSPRATKAGVASAPSGVPFPAQLLSDSTHSWEQVPEPRPPGPVKATLGVWVGVSAFLCSQHVVFSVGRLLDLLVPDPPHVCGDGGEERYYLGIAGLGDTFSCFLADRGHPASAGPLCTVLRALRGLRFGPWLA

SEQ ID NO: 942941 - protein, 312 aa, Homo sapiens
RSPCEELGPPGRREGFDLKKGTPGALLEVGVLWDLEGSGRVVSGRPFPGSSQLGWSSFLLRTVRTCLGARCPLKAPGRILAWSAGSVMLLECCGEREEKKGLGLLLEEKGLAELLLVSRLSRRGGGRFPEEGNKTGGWAQPGKMEEKIKKEEEMALSLTRAVAGGDEQVAMKCAIWLAEQRVPLSVQLKPEVSPKQEIRLWVSVEDAQMHTVTIWLTVRPDMTVASLKDMVFLDYGFPPVLQQWGDWAAAGTRPGDLHSHGVRQNGGSAYLYLLLIRKTSLNLRGAGAGHCRYGKSGFKTQLHAGPLEQPPN

SEQ ID NO: 942942 - protein, 108 aa, Homo sapiens
QASGQSLIQASAAGGSRSLPLGQAAKEKCHSRDAKEEALEPFQRRMEETMKLSTMEDTFYYFLFLIPYYSRDSDKHKEILQKYIERIITRFAPLVPYIWNPFNLKYKP

SEQ ID NO: 942943 - protein, 99 aa, Homo sapiens
MNRGYTGFWRAVQIEDHKHELHLGNTDSPPPPTRAGNLGPNSEDTTAGRGLQHARRTEVAGGGDPQPLEPGIAPGVGYPAPPSQLLGSPMALPMLAFAA

SEQ ID NO: 942944 - protein, 231 aa, Homo sapiens
MRKPPILLLLLAVPLRRMPEAGWAPKLQGTTGEDMGYAKRYDVNHGTGGGWGGVDSGEDTYTQTLPLSGYSTGASISAPNSSHENIRERGGVQKDFEFFYHEASAEKGWVKVPGLCLQGALSLSKGGFFGGHQLSLFAFCVHVAIAFVLRVNQLPGYHHFKEPGGLGGALAADVQAAGELIFYLVLELKILGLVASSATINDSRTARAIRSAATSAEERTPGATLTSHLDA

SEQ ID NO: 942945 - protein, 302 aa, Homo sapiens
RGSAPRGAGAPISRQDLGGPRPALIPSGFGGPQPPFPGPLAHPNPLFLPFPDSLALPILFAAPSWIASPVSFPSAPFPRDPEALLPRALPGAPRAAAAMAAVRGAPLLSCLLALLALCPGGRPQTVLTDDEIEEFLEGFLSELEPEPREDDVEAPPPPELTPRVRKAQAGGKLGKRPGTAAEVPLENTKEKGKKGKKDKGPKVPKESLEGSPGLPKKGKEKPPKATKKPKEKPPKATKKPKEKPPKATKKPKEKPPKATKKPPQEEDPIVAPQKPGLAIPPPPALARGATQEGGGPSQITGK

SEQ ID NO: 942946 - protein, 95 aa, Homo sapiens
KIKGKKGWSLLRAVLLRPKKAIWIPEVHDEKADVSAWKDLFVPRPVLRALSFLGFCAPTQIQALNLICDKLIFGVVETGSGKILYFLITIIYVVL

SEQ ID NO: 942947 - protein, 159 aa, Homo sapiens
RSIVKVSLHPAVISNSDSPKDPQQLTNLFIGPFTFETTDETLKNHFHPWGTLSACVVITDPNTNPSKGFGFLTYPTVEEVDATINAKPHNLDERLVEPKKPLSTQHSQTPGPHLTVKNIFVRPIKQHTEEHHLTHYFQQYPKIQLIIIPRPNKKDFAFV

SEQ ID NO: 942948 - protein, 221 aa, Homo sapiens
NNPDPEWTGEEEEDLPRRGRCEERAQGRRSREPGSRAPKTAAMPARCVAAHCGNTTKSGKSLFRFPKDRAVRLLWDRFVRGCRADWYGGNDRSVICSDHFAPPCFDVSSVIQKNLRFSQLLRLVAGAVPTLHRVPAPAPNPGQKGDPPGRLAPPRALLATRPSVAAPGPVSSARPPTGKHAAASQVKRDHRSWCKDPWTLAGLLHLVSPWERHLISKVPVF

SEQ ID NO: 942949 - protein, 106 aa, Homo sapiens
MVTAAMLLQCCPVLARGPTSLLGKVVKTHQFLFGIGRCPILAIQGGNCYEMKIKEKKDGGDYEFWEKGKCKLMMEEIKDGKSKIVQKADPRSPGRCEAPFKKDMNR

SEQ ID NO: 942950 - protein, 168 aa, Homo sapiens
EPTMVLSPADKTNVKAAWGKVGAHAGEYGAEALEREEPSPAPTRGPRPPGPTGHPHPSWARAQGPPLTLLLPRRMFLSFPTTKTYFPHFELSQGSAQVKGHGKKVGDALNKAVAHVEDMLNALCALRELEGEKVGVEEVKFKLLSHCLLVTLAAQLLIKLKDAVKEEV

SEQ ID NO: 942951 - protein, 36 aa, Homo sapiens
MRASEMVWCHFSEDIREYQLIDNDSALQQQEDVEDP

SEQ ID NO: 942952 - protein, 251 aa, Homo sapiens
KGGNADSWQREKLASMESPEEPGASMDENYFVNYTFKDRSHSGRVAQGIMKLCLEEELFADVTISEEGREFQLHRLVLSAQSCFFRSMFTSNLKEAHNREIVLQDVSESAFQPLEEESYQGTVKLRAEEGQEKEEGADKEQRTARREEGGGGGPAQGKGETAGRGGGWQSGTGSAERETAAKHCAKTHLAQLQNTEEFLHLPHRLLTDIISDGVPCSQNPTEAIEAWINFNKEEREAFAEGGGGGGGGGGE

SEQ ID NO: 942953 - protein, 109 aa, Homo sapiens
MPRVYIGRLTYQARERDVERFFKGSGKILEVDLKNGYGFVEFDYLPDVTSFYFFSECANAFFVMYLFFIIAAAQCNIAFDVLLLIFFFIFYFLFIYISLLFSHFFFFFL

SEQ ID NO: 942954 - protein, 40 aa, Homo sapiens
MVDLTIPTYVVIPALEPSRFLSSLWVTAGLSTKAFCLFCC

SEQ ID NO: 942955 - protein, 202 aa, Homo sapiens
RLSHLSPWPFSCLDGVFLSSAENDFVHRIQEELDRFLLQKQLSKVLLFPPLSSRLRYLIHRTAENFDLLSSFSVGEGWKRRTVICHQDIRVPSSDGLSGPCRAPASCPIRYHGPRPISNQGAAAVPRVCPGLAVWYRGRIACPAFVCALWVSVASKNGLNLYPRVLKERWPQRVEGTTERGLRVCFGVCETPNLCTQGYSPG

SEQ ID NO: 942956 - protein, 91 aa, Homo sapiens
MALWRGSAYAFLALAVGCVFLLEPELPGSALRSLWSSLCLGPAPAPPGPVSPEGWLVGSLGRVFCAANPVLAPRGSGSQMHVLMWCSQGVK

SEQ ID NO: 942957 - protein, 109 aa, Homo sapiens
APPPASLPPCSLISDCCASNQRDSVGVGPSEPGAGYILVVRLFFKPVGKAQYLGRSDPIFQVPSVTPFFDSERELPDPLRFPSEDNASPCFGSRTVLAPTDLRPLSGTP

SEQ ID NO: 942958 - protein, 177 aa, Homo sapiens
GGPRRGRHTCLSRREMPFDLCFLEQSLAFKVLGERDPLREYFHRVPFHREDTISGNGSVQLSYISFQNPRTVPVQPAFSTEPCSQPVCVPPRPRGRRQKPPGAGAANPAPITQTVIHTVQSAPGQMGTTAAIPPMMYPHPAYAMPFITTILGRAVPIQVHPPVRHCPAQCSEGPHQP

SEQ ID NO: 942959 - protein, 118 aa, Homo sapiens
GGRKGSAAECSSAPPGGPPPRAPANPPAGRADPAVPSPEEGARGGIQKPLKRKKKRGNALWGIGGSGIIVLLVLRSVLRPLATPLAKTKQNSIWGKKKKREGLTITQNKVIALKKDVR

SEQ ID NO: 942960 - protein, 226 aa, Homo sapiens
ELGPRAGGKKLLTAENRTKYTPIYGNDNGGQLEEKKAELRNKDRKIEETEERHQVEIKVYKQKVKHLLNEHQEKPEQKYISDFNLLMKLAQKEHRIQESSDMRKDIEALKVELKEQELANEVVVKNLRLKHTEITQDGNDFERQVREIEAKYDKKMKMLRDELDLRRKTELHDGGEEKNGQIHKLMQRHEEAFTDIKKYYNDITLNNLALINSLKEQMEDMRKKED

SEQ ID NO: 942961 - protein, 143 aa, Homo sapiens
MTGGKSNQMKTPKTFYVPAQYVKEVTRKALMPPVNQVAGLPNNSTKTKQSLHLQRSTENVNKLPELSSFGKPSSSVQGTGLIRDANQNFGPSYNQGQTVNLSLDLTHNKGKFKKDSHSPKFSSQNMTRSFGHFPGPEFLDVEK

SEQ ID NO: 942962 - protein, 236 aa, Homo sapiens
PETESQIAPFPDPYGKTNPGAVLERSKHLSGLFSVDPASSQAMELSDVTLIEGVGNEVMVVASVVVLILALVLSLALYLRNRQRYNQLLGAIVSAGDNILLHLGHVDHLVAGQGNPEPTELPHPSEGNDEKDEDAEVKVGTPHWVWGLVLSPAVEECVDMKRGEEKQRRWKEEEVQKAPLKIFRIRPGYLRSPGLITVRVKFVNDKEELAVARPEDTVGALKSKYFPGQESEMKLI

SEQ ID NO: 942963 - protein, 136 aa, Homo sapiens
SPPAIPRPARHIPSMVMLASMSSDTQLSESFVSTTFATVPLYSTENSQPAGYLSPPYPHQSLGNHRQPFYSSSFSAPFFWEEVRMFKLFWSSSFFPSLILFFSISLAIRVISDAGKSSPWSKIFPMIFRYCSAHFF

SEQ ID NO: 942964 - protein, 102 aa, Homo sapiens
MGSMDIKIGQPPSQVGDRAEQSLSSGNRLHTPPCHRTQERRSVRVQGAKRRKECGVVVSSTLNYNFVEEGKLLTNSLLIAQAAKQYEGAFDAFHPSRIVSPQ

SEQ ID NO: 942965 - protein, 246 aa, Homo sapiens
QTDAGLRAGELRSPAIPPPPGPPASFSPSEVQRRLAAGACWVRRGARLYHLSSFVRHHPGGEQLLRAKAGQDNNPDLDGPPHKHPANARRWLEQYNMGKLREEQQGSKENKPITLEKTQKTKPAKEPRFKMVDWDKDLVDKRKHLLWQVGHLGKKYKKWVHQPVTKPSRLFHSHLIEGLSKTVWYSVPIIWVPLVLYLSWSYYRTFAQGNVRLFTSFTTDYTVAVPKSMFPGLFMLGTFLWSLIEY

SEQ ID NO: 942966 - protein, 245 aa, Homo sapiens
PAVLRPRPAEAPRVLCHAWRLFASGANFEYIIAEKRGKNNIVGLIKLNRTKALNALCDGMIEELNEALKTFEEDSAVGAIVLSGGGIRHLQLELKLKKYEKLSFQDCYSRKFLKNWDHLNQVKKPVIAAVNGYAFGGGCELAMMCDIIYAGEKAQFAQQEILIENNYSAGGTQRLTRAVGKSLAMEMVLTGDRISAQDAKQAGLVSKICPVETLVEEAIQCAEKIASNSKIVVAMAKESVNAAFE

SEQ ID NO: 942967 - protein, 101 aa, Homo sapiens
DEQTEEKEKCTGGRESDEGVRAECRRKTTGLDRSPVAYFAAKRIPEVATVGWRPSSVLWSPRFKTCTCLCLKKKEKKRKGMRRKKENPRVKEEFRKKMPKK

SEQ ID NO: 942968 - protein, 112 aa, Homo sapiens
MNTSLSWFEKLDVLLNANDGNVVRNKKWLYNLGVSKEIIGMCICFFCSSGCIFLGSPPQNSTAVTPAVLWEESEIMQKELKLLQYQLSQHQELLLKQLAEGRQAQVGSWKDL

SEQ ID NO: 942969 - protein, 111 aa, Homo sapiens
EFSELSFRISELAREPRGPRERKFCWLSGGDPVQIFIHHPGDQRTVLLSLLLSLGAPHPELGGPGDEGTKLQAGGPGKGGAAAPGHLAAVATEREQRQQQQTGGVGGPEEG

SEQ ID NO: 942970 - protein, 154 aa, Homo sapiens
MALNDLVDVEFRLKAVVKVEPDYSLFVVHLLPKLQELEESPVRTSERKASRMHFALKDSFDSKKSVPASLKKGKQNTPKTKCTEALAKQSLVMDADDEAVLNLIAECEWDLGRPPGSTSFSQKGREADSRGSQESRHLLSPQLVQYQCGDSGKQ

SEQ ID NO: 942971 - protein, 282 aa, Homo sapiens
AGPGGRRARWALGDAGASGEDWGPHAPGEQCHFWVRTGDLLDGVGLRQKMAGRDVHLVVRNLKERITVVTSVTALSEIVKMEKYSIMKSLNMPPKTGKRTLLEMTQIPPRPGYCPQGEAINRLDFSSAIPDIQSSIMWSNCCRKLPNPREPPVSGVAQKNYIDLLDKLIPQVLDDHHPPRLIKDLLQDLSSTLCILIRGVGKSVLVGNINIWICRLETILAWQQQLQDLQMTKQVNNGLTLSDLPLHMLNNILYRFSDGWDIITLGQVTPTLYMLSEDRQLW

SEQ ID NO: 942972 - protein, 88 aa, Homo sapiens
MHSFHIAGAKQILMWMGDGGSWTGRSELNSNVAGTTLWTQGNLPLMEDVCLGRGGQGEVPDLSVSGGRSHWLCMGSSVRAVGALLRVR

SEQ ID NO: 942973 - protein, 200 aa, Homo sapiens
RARAMEEGASSPGLGCRKPHLEKLTLGITGILESSPGETEETIIEKPPEERNMISSWGQKNNWEMPEDVKNFYLVTNGFHMTWGVKLGEHIIPLGSMEINSISKLTQLTQASMDLLPNGPTLGDLGGGTHEASDDQPERPHFGSRREEFELGSCNGGGEVCIVYKSGEPALAEDTEIRVLDRALYWHFLTDTFTAYYSLL

SEQ ID NO: 942974 - protein, 281 aa, Homo sapiens
AEAPRSALGLVWRPSEAEEAWTLAHTDPGTDERGFFHAHLAVHLLPGAQEAMGFWTAVVYIAVAEVDDYSTGEIVVSFSLSSIVQIEKEALHFVFSSITILEKGHAKHWFSFLRPSGNVVFSIMEHFLRELLLCEPGAVADASVPRTRGEELTGLIAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFE

SEQ ID NO: 942975 - protein, 166 aa, Homo sapiens
DLGTFYVIFQGLQPMLGGARGGGWWNNIYFDKKLQLPAEEKHPLSFRPRLRPSFTCFLAHPAPSSFSLDGGPRLAETPCLPAPGTGSHIQSSEEGVWLVGWQLLPRAITPPTTPRLLFGVPGSLWGVVGRGGGTVVESPDTGCVKKKEEGKIGGWAAPQWEPRVFS

SEQ ID NO: 942976 - protein, 282 aa, Homo sapiens
LKHFHPLFEYFDYESRKSMSCYVLSNVLDFDTEIVSEDQVDFIMNFVYTLIQDEPDEPVEDPVAEDFSDEQSLFGRFFAVLRSEDPDQQYFVFNTARKHFGAGGNQRIRFTLPPFVFDAYQLAFRFEENSEVDDKWEKKCQKIFSFAHQTVSALFKAELAELPFRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNEGGASRRQEGNGV

SEQ ID NO: 942977 - protein, 42 aa, Homo sapiens
MGAVVAPLTILGGPLLIRAAWYTAGIVGGLSTVAMCAPSEKF

SEQ ID NO: 942978 - protein, 200 aa, Homo sapiens
VWVFLIKKGYQDVDTSLQSAVITKVKGVGFTNTSDLGEGIWDVADYVIPAQNEGIPDGASSKDSDCHAGEAVTAGNGVKTGGCLRRENLARGTCEIFAWCSLETSSLAEEEFLKEDEDFTIFIKNHIRFKKFNFSKSNVMDVKDRSFLKLCHFGPRALLPPLLTGVRDELGGEGFPGYSPGGWGDRINIEWTVMLISCSE

SEQ ID NO: 942979 - protein, 231 aa, Homo sapiens
LLLSSLHPLPSPTSKDPYPNPKPTPFSPISHTPPFIPTKPPFTLKIHSYINTPSLNLTSLSNHHIHHNPHHLNLQNHPIQHSQNQSLPTLTIQPIPFHYNPIYFFHHNSNNTSEVYQGSRTLPFICFITFAQLKQSNTLNHPIIIIHTLLIILFIIFPIFLLLDKDDSKAGMEEDHTYEGLDIDQTATYEAIVTLRTGEVKWSVGEHPGQELRARSPHDLGAGSLASVTAS

SEQ ID NO: 942980 - protein, 282 aa, Homo sapiens
GWRLAQPGPRCPLPWALGRSGLGKAGTGRARRPGGSEAKKASGKRAPPTGLLELRAGAGSGAGGERRQRVLLNLAEDVLTVNPADGNPGPEPGAPREQEPAHSTPPRNRAPGPLNCQKRYCSNGAAFTLRKADAGGLGINIKSGREKKIPILISKIFKGLATNQTKALFVGDAILSVIWGILILCYPDEALQVLKKTGKEVVLEVNYMKDVSPYFKKSTGGTSVGWDSPPASPLQRQLPPLAPHPGNSSRPNTCPSKWHMSRRGAPPMTRSPGIWRSARQMV

SEQ ID NO: 942981 - protein, 152 aa, Homo sapiens
PLYSIALPNLFFYPLPSHSISILSTTLSLPHPIFVDPSPHITPTTLTPLHPHTTPSNFLPSSPSTPPPFATPAHHVLNTNLTSPEPPSHSTSLVLETGSAITQAPPKQSLRPRTLHPRHRATSLSLLPFFLTYPLHFPFPHPHYVLIFGCLG

SEQ ID NO: 942982 - protein, 89 aa, Homo sapiens
MAVIGEYLCMRTELKEIPLNSAPKSNVYESGPLDILLTLGPLNTLGCSDPPDEVQPRSERNPGNVKSLFVWERYEGLSKKAGSSQHDSC

SEQ ID NO: 942983 - protein, 52 aa, Homo sapiens
MPLRRGAGAVHAPPCQALHLGGLQAGCWHGPEPGGRPGPCGSGHILRHRALA

SEQ ID NO: 942984 - protein, 143 aa, Homo sapiens
AVSSTERRALTIPTEASDPTSESDQLGGPALHPRGCRDTHPDGSETAAELTRGPHKGEAFGIKGARAVLGPPGLRSRPPALPSEIAAEACVLEGAATPPGRDPGAHVAWIFNATTDGKDIRVAAESLNEKGGLFQVGLSQLHL

SEQ ID NO: 942985 - protein, 229 aa, Homo sapiens
LDPPIVKGSMVVGYPLVVGYEEVLPLEGLMDDQLVEGPMDTPILGYSPLELQKDHMAVQLSGSPYGQPPPSSYGPQQPGLYGQGGAPGNVDPEAYSCFQSMDSDQNGYIFIKKLKQALVNCNWSSFNDETCLMIINMFEKTKSGHINVYGFSALWKFIQQWKNLFQQYDRERSGSISYTELQQTLSQMGYNLSPRFTQLLVSRYCPRSANPAMQLDRFIQVSTQLQVLT

SEQ ID NO: 942986 - protein, 310 aa, Homo sapiens
MACAPPLLAVSAEPGASSGKAVTLPAVFLAPIRPDIVNFVHTNLRLDPSLPPAVSELAGHQTSAESWGTGRAVARIPRVRGGRDSPLWPGCFWKHVSWRPNVCTNLPLDAVGIESEHKPPPAAPPGLPWLPQPSLHWSCLKVIVLREVPELPLSSLEDKVDGYQKPQEAVLLLKKLKAWNEIKKVYASQRMRAGKGKMRNRRRIQRRGPCIIYNEDNGIIKAFKNIPGINLLNVSKLNILKLAPGGHVGRFCIWTERAFRKLDELYGTWRKAASLKSDYNLPMHKMINKDLSRILKSPEIQKAFEPTQEN

SEQ ID NO: 942987 - protein, 151 aa, Homo sapiens
MGTKDEGECVCVTVTKTLHYLAVRGCFRWVSGVGDKERKSRLSSSSGSSRGGGGRAGPHLLAGVEVMVATEARLLLGRGNKTDGPGPGVIKDESGSIFAKAENEELQPPPEFLFLVFFFLPSSCFFFFFFLRKKARDLNLASGGGLPVALY

SEQ ID NO: 942988 - protein, 253 aa, Homo sapiens
SGVGINFSIFCGQFPEINGYEFFFDQLNYVDPKFPPCEEYSQSDYLPSDHSPGYYAGGQRRDSSFQPERFGRRAACTVQRYAACRDPSPPPPGALPPPPPLVFPLSPSPGFSFSLLDEPFHLYYIIFSPPPPYPQEATTLQLMSFLVERGRRLPLDAQCSRGGGGGGLHLAFTQALSNRLHALEKKKKEEEEEEEPLPDPGPEVFYGYAFFLYVRRFYVVPNLAMKWKLTQVANTRSLGGAQLSRGPWRPMRP

SEQ ID NO: 942989 - protein, 174 aa, Homo sapiens
IEKFVKNQAGTVRNIPGIPEGGDGEELEAGAPLRSNSVFMSRQTKEKFLRQYKMSDPKTQAKGYKKYKKKAQFISKKNPKNIKKMVVWKGYNNFRKMHKKDGLQTQKIFRRLEKFPAFPRAQMFGRFENSIIKKWRKRAKNLLRFTVHIHALKNRPQLKEFFRGGEVTRPLEVS

SEQ ID NO: 942990 - protein, 282 aa, Homo sapiens
KLRRESELRTAGAGQTPKKGENITSPRKNLTEKEERGKAGDQAKGGSGAKKRKEPPGQEAQEGQRAAKGGKRAQGGAEAGSGQPRPGAAPGPPRPKKQKAAQAEEQKGQAAPDQEPNAGAGGQPTRPEATHPAKGQRPPPSNAPAAPTRPSSPNPAPAGERAPAAPERAAEGGPGAAQAERRGGRKRISKQRSKAASSQIEGSTRNPQAQQEKDQQSADAQKASKRFKITAKETLEKAQPGATPAQAKTKTGARAQEAAQRQQRPREPRGPKTPSAQEETTK

SEQ ID NO: 942991 - protein, 114 aa, Homo sapiens
ADGVPGALRSSGRPRPRRPAQNPARPRRPASKAGSAPFPEGWKKGCFALQMVEKELTADSVEMVPAARAAKQLLACGKYETAAAGGPACRPPKTKVSKTGGWKKPSWAWQKAKW

SEQ ID NO: 942992 - protein, 198 aa, Homo sapiens
LRNLTNLQAGNRVFSPLSARQNHPVHFQGPSREADLREVNSFSDYPVDSISAPAPAGLQASLMWGSRALTRRLPPGFLVGGGFVVSGSVPLPLPGEGRVAIGGAGGQGAGWVCFFWVRATVTCDGCCGLRPGAILPHALCGWLPSTLGSGMALPIVILSAFMQGVGHSLAPFRSAVLVPRLLGKDHVGARCRERVQPG

SEQ ID NO: 942993 - protein, 163 aa, Homo sapiens
MGPKSMFCKNTGLNQIKKRNTVDKMAAMREFRVLHTALHSSSSYREAVFKMLSNKESLDQIIVATPGINSDPIALGVLQDKDLFSVFADPNMLDTLVPAHPALVNAIVLVLHSVAGSAPMPGTDSSSRSMPSSSYRDMPGGFLFEGLSDDEDDFHPNTKSTPS

SEQ ID NO: 942994 - protein, 273 aa, Homo sapiens
TYLDGEDDLFTPAQSIKYLFSGFQVAVAALTLHLHVSAVVAQILQPVVLATVPTWGLITAPFTAPLLPFLLAVTVTVTIPVPELLALAPVVVSSLPLTIPFFFFFFLSPSALPWRPIIRGRVAASEGSAMSPPPPRSSSLRSRSRRARSRLRLLRRFRSRSLSLLRSLERSFLLLRERLRRSREREPRRSRSLSRSRLRSLRSRYGPGPGPSHRSGRCHRGLNAGCSHQPLLFWYHRGLLLAAGASSPSRFGPSPRPQGPSCHQSSCHLRVCK

SEQ ID NO: 942995 - protein, 139 aa, Homo sapiens
VLRGGGAGILVKSLLCGLVDLGGTTLRPKPKAKVSSGRITSTVKSDKCTQQKGSSNVRNVMAAFATKERLRAQHSTDTEEKMPCQVCGKMLSSAYISDQIKVHSQGPHHVCELSKKGTGEVCPMAAAAAATRTVSSGSS

SEQ ID NO: 942996 - protein, 206 aa, Homo sapiens
MSLDIQSLEIQFEELSDARWAELLPLLQQCKVVRLDDFSITEKRGKDISSALRVNPALEELNLRTELGDVGVHCGAQGLQTPAYNIQKLSLQNCCLTGAGCGVLSSTLRTLPTLQELHLSDNLLGDAGLQLLLRRTPGTPSAAWEKLQLEYCSLSAASCEPLASVLRAKPDFKELTVSNNDINEAGVRVLCQGLKDSPASWRAQAG

SEQ ID NO: 942997 - protein, 78 aa, Homo sapiens
EVPAGKLSLAAQLLFNSEELVVFGQAVRSERGKSFDVASEEPQNKVSDEGIFSFPRTMRKDDALSNWNGKAWKTEETR

SEQ ID NO: 942998 - protein, 305 aa, Homo sapiens
NYVGDGNRDPVSAPVAFASKSPATMRKYISIHVGQAGVQIGNACWELYSLEHGIQPEGQKPSKKIIGGGNDSFNTFFSKKGAGKHVPRAVFVDLEPTVIEEVRTGTYRKHFHPEQLIKGKEKAANNNARRHYTIGKEIIDLVLDRIRKQADQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKA

SEQ ID NO: 942999 - protein, 291 aa, Homo sapiens
HTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELTTPQYNNHPYRAFPVWVGVVQQAQLPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVD

SEQ ID NO: 943000 - protein, 213 aa, Homo sapiens
PAPPPGAARKSRFRRRARQGKPGAARDLGPFLRTREAAARAAAPDAAAAAAAAPPSVLLSGAMEHRAPRLPLSPRRKAPPPLLPRRRGPDPRVLARHLLIDANGVFYTYTVQLEEEPRGSPQEVPSRRRSVRAKAARSAHVVFASTLLLQSHRVLHSDLKPFTCGACGKAFKRSSHLSRHRPRTAPAPAFSTPGRSAHAAPGRRGLAQTVRLH

SEQ ID NO: 943001 - protein, 174 aa, Homo sapiens
PARSQSPRRRPTVAHALWVELHGGTRRTPNRTYGYHETHMPCAQPVQLVHVATYTEHSMLSADEDSPSSPEDTSYDDSDILNSPAADEVTAHLAAAGPVGMAAAAAVAGQTRNRPPVFASPPSLRPGPHRLLRPLRAFGASPPRVGRPAVLCLSPSPPPVFHVFGAAPLATVVR

SEQ ID NO: 943002 - protein, 177 aa, Homo sapiens
MAKTLPSWASKREPPSGTFRPASGRVFRVSSDKLALCHLGTAHGIDRIFLKGFAPLDGEGTSARTHNELQRRKVVSTIGMLCRVLSGRHSLLPQVPREITGNVAWDQERVAEGENQPEGDGQRRRLKPRRRKRACGAQVEKYNSARADFEQKMLDSALRFQAMEETQLRDMKGTAGL

SEQ ID NO: 943003 - protein, 180 aa, Homo sapiens
RSESRAQPLGMGLSLRGVWASGRLGWEAPGSGRRAGGGEPAPGRSVELGQQHLRVQQLTRYIPVANLLFTACGTVCPPVQVHARQSGPLAGERVCSRRGVGCAGLLRAAPKLDRGLAKKPCLLDTICEAFQVSRFSSRFHGGWVTVVVQASPTGSRSLDVREWCGHSRGTGPEPYSTETW

SEQ ID NO: 943004 - protein, 278 aa, Homo sapiens
KKDGSGLIRARGGVTDASLRSSDPERGEADTTVKLVPHPAAVLEDTEPSVVTRGLDWSKNITFFFLFLSHVLPRHLGQNHCTPAPMGMAHGLADGVPGWGPLNWPWRCPFVPCGALLLNGSIPCQTTTAHHRKEEIAQPGEGELRLLPPTTTLKPGVTPGKLDRAPSTRRASTQGRSFPRAKDPGVAFEGGTAGAAGGNREDTRESVTLFPKGGMVKHLTRKESDAKGELQRLESMEKHGRSDFPGRPMGGRANHTLSAAVGPCTGDGHVFLGTSIKV

SEQ ID NO: 943005 - protein, 178 aa, Homo sapiens
MDPAPSPELPGYSFPAEFNLIFYNSFQFFKEMEELFFPTGAGGPWEVCRAQEGSGRDAVSAFGRMEEIFFSEDEMPRFRGTREGGRRRGATAQPRAPRVTTKAPPGCALQRGHAAYNWAPRSVGRVAGGREEVGSGSLDPGVHPRRPAPGWLPWGGRQRGSGPAPPPKPPSVARLARR

SEQ ID NO: 943006 - protein, 202 aa, Homo sapiens
MQPGLGVHPAGGGPGKGRGICPVFSLWFLDSFGIPACHLPMAPTYCFLGGPPVPAFWGGGGGFFECGRGGGLFPFGWASPSPLGGRVPPPFRFLAGLGAGPLGPLPPPPPAPFPLGFRLPLSPGALARPPSGPCGFHYGQISTCLPQSLLHQLFSTCTFGFGMMERHRDICPRPASLSTPRLGPHPSRLCLAHYVAGACFPS

SEQ ID NO: 943007 - protein, 192 aa, Homo sapiens
QKDVIIKEDAEDNLLLEKHADYIASYGSKKDDYEYCMFEYLRMSGKEEEEKEKKLIPKSKTINKEHSPPEKNPKEQQAKAKKKTKPKQKKKEEKKTQQNSSSPQQTKKLKDKKKEEEEEKPKNKQQALAAGDIWGEIADKQSPFAERCAKEELGLPQQGRQSKGGQKRKEQEGGGESRGKGGKPAQGAGQTK

SEQ ID NO: 943008 - protein, 112 aa, Homo sapiens
MVVPYLLFFACKRLVWGGSDSIWFRYDILEGGSAAVGGCEVVSFAVGMGGAGGRLSFSDLLRDGDQIFRVLASGGGVAWARGGAVLGPAWGWGVGRGRGRGSGCWVLGLVPG

SEQ ID NO: 943009 - protein, 46 aa, Homo sapiens
MRDPPSKPLRLPPVLSQPSFEKRAPKTAELKICRVKRKPGNCLGGD

SEQ ID NO: 943010 - protein, 126 aa, Homo sapiens
MRARGLSVSQGYGGGKGGGARPIPQGGGGSAGGAGAGEGTATASLTLCSIPLLKKTRLSRVGQPLFIGLAGVPSGKLRQSFLSCPGSHLPSPGGSSHIPGGESVLGRGGRQSGVKTPGLGSKWGSG

SEQ ID NO: 943011 - protein, 140 aa, Homo sapiens
MYSAARYWHCTQDLLLAASISFARELTAQKRKKRARRGAGDSSQSMGPPRPKSSGEKVYNQETRSIPHTEQGARGRVSLAYVLLELLLNPPFGVGIFLPAFDPKEPDAATAELFPGCSAGAFCRMCVLRRFIVQPAGPIR

SEQ ID NO: 943012 - protein, 265 aa, Homo sapiens
MGQKELMGTAEEFAEQFLRVKKKYLPQVARLCLIINFLEEGIRMWFQWSEQRKYNRKQLEMRLNAGLVLRLPQIAGKAEWLRPGVDEEIRAVSLLRALWNNTSAEDCLKNFMGIEVFDEEPGPGRRPVAAPEQNPVLNGKACLRASPPGVKAPPNSKCSSEAVVLLVLMFMNLLQFEASFFSIVQKIVGTALMILVAIGFKNKLAALTLVVWLFAIKVYFKAFWTIPVYNPMHDFLKEDFFQNMSVIGGLLLVVALGPGGVSMDE

SEQ ID NO: 943013 - protein, 109 aa, Homo sapiens
MLSRLRCVGVTWETVKVVIPGSGGSGGRGGGEGEGRAPNCRHFWPFPWEIVVHVRRLCFPKRRGLGGGLRDLGGGPSLRWAFGGGVERSAWRATGLWHLGGWWVGGGFG

SEQ ID NO: 943014 - protein, 265 aa, Homo sapiens
EPRTWSVGANMSLRRHIGNPEYLMKRIPQNPRYQHIKSRLDTGNSMTKYTEKLEEIKKNYRYKKDELFKRLKVTTFAQLIIQVASLSDQTPEKYLENSNGWKQIFFLTPLASTTCQDQMGKENKVMLRGPDASITTARRGTPSRLNIFKKCHQVGVGGTGIQTKGPSEESRAPIPKTNPYPDCPFLLLDVRDRDSYQQCHIVGAYSYPIATLSRTMNPYSNDILEYKNAHGKIIILYDDDERLASQAATTMCERGFETSSCFPEV

SEQ ID NO: 943015 - protein, 146 aa, Homo sapiens
VFSYIIQLIFQVFFMYKELLYLERKFKKKGQGRLCILWRRGGGGGRAVPVPTPRAADSLPLGSPHPPRQQRWAGETQGSGNQQHFCAWGKGHGGEAWRKLMAGQGQGWSSACVCTHPPCVQLGAQLAPPPQDGRVGSLCPLVHPHC

SEQ ID NO: 943016 - protein, 82 aa, Homo sapiens
TIRTGNFQWAFQKLVAMTKSTIYSSVPYHSYDHRPYKLTPLFSIRFQNSSSLPEAFCSPNSNGMTCQSLHDNSINAVAKFRP

SEQ ID NO: 943017 - protein, 197 aa, Homo sapiens
CAQNPLHPSPSHSACKEPVVYPWMRKVHVSTVNPNYAGGEPKRSRTAYTRQQVLELEKEFHYNRYLDPGAGRVGVRPARWPSAERQMQKMWGAKPGLVGNRDHKCGPTPMIRLLGWVAGMAAGGPLGQAQLEGPRALPPHAGSRFGGGIELQGGRGGQEGAWGLGPRKIYIVPCPHTFIYRINRRRRWEGEALFYRK

SEQ ID NO: 943018 - protein, 212 aa, Homo sapiens
EQPQPAPPPPPPPPPPPPALRRPPPAPGSLSPFLLPLLTPFLLRTPAGPPSPYPPAPIVPPPASRPFSFRPLTFYPQWPRACIFWLSPPTSDQKLYHPKSSIPTLLDMDTGVIEGGLNVTVTIWLFIHGKEVGSIIRKKGESVKKMREESGARINISEGNFAEKIMTFAGATNAIFKAFAMIIDKLGRGHAALWTNKHSWPVEPPVTLEAVW

SEQ ID NO: 943019 - protein, 78 aa, Homo sapiens
LLLLPPLLLSAAFARAAVVTGAAAEECHCNQDRSARRREIEAAQARSIAARGVRSGSGPGREGKCKMAAAMETEQSGC

SEQ ID NO: 943020 - protein, 164 aa, Homo sapiens
GAPRSGRPNPIQLGEDTGGRAGHQDGELHMHGRETGARREAKQEEEEPETRGRNAQARAGTRSISGIKQQALSHSTGSVVFLWHTAKGNFGIPPRAPTGGQGGAEGDTRRASSKASRGCLSREEGGVTSNGRAITTFRDFGRGPEGLSQGPQGPRRAPAYQQTS

SEQ ID NO: 943021 - protein, 266 aa, Homo sapiens
LPGVKRVGNAPGGDGAEFTSRRGSSRKPGAACPGCRGAGSERAPGGMGRRRAPKLYRAPFPLYALQVDPSTGLLIAAGGGSAAKKGTKNGVHFLQLKLINGRLIASLLHSHKKKRRATINLALAGDILAAGQDATVSSCASRHINSRATKQKKLVPRSRGFEKRKEQPQTEKKCGAETQHEGLELRVENLQAVQTDFTSDPLQKLVCFNHDNTLLATGGTHGYVRVWKVPTLEKVLDFKPHERDIEHLALRPDGNLVTVGGDLKAS

SEQ ID NO: 943022 - protein, 253 aa, Homo sapiens
MGLRFAARATGEGAVGRGVGGGAPGGPRAVGRESGVGEWGGGARWRRGAWDMARPDDEEGAAVAPGHPLTKGYLPLPRARARWEKSVLEKRAQAGTFPVNGAPRDTFDDTPPGVIGRAYKNYQLGPRKKENPAPALSASRGAESWRPGPRGRPACPFTGALPRWRFRLLLDLSDLVLRWGQPPFQLDSSYKHSFSKVLSEGLSYGCSPLAGTIGLGLSLGGNMSGPLRCPPPSFPGPTLGCLGTPSRALRAST

SEQ ID NO: 943023 - protein, 259 aa, Homo sapiens
MEYEKKRREKGGGGDGSKNRGKMCEGGRKWRVVQKSKEDSSGVKKGEVEWRLLEGDGTAPPELDVCGINEKRMVIKREQLAKTISKKLESRSFCGGGKKRGDLFEGMEMMEFERLVVRVVWVKMEKNLAEFGRRGEKNLLIMCKEKEKVEKKGEEVKGRVVVCERKGERRDVVDAKMEMVSPLEGVETGFKEQYRTFATALDTTREELRVRPISFQVDGEELLDALEDELVTTQRVLGELDVGDWEENVEVLDLLSELK

SEQ ID NO: 943024 - protein, 97 aa, Homo sapiens
GGRGRGPTSPRGPGDREEDGVGLPAAVARYLLIGHIYHVILGTVGIAEPLGLKRTNNWKLETFLKNNVREENIENTFFKNKQKLLEISTKIRLPFLR

SEQ ID NO: 943025 - protein, 71 aa, Homo sapiens
RKSYSFLCIKVRVVGNSSSPVRSKVVSPVKAKSYVNAANVRVLNAHPLRSNAVMSTSAVSQPVSVSVVQLQ

SEQ ID NO: 943026 - protein, 102 aa, Homo sapiens
MLFCLYHRRGGGCFFRGCGYYVYLSFNNFSAFMSPIPTNQRSCAGGSRCGGPVICHIGVPSCRRFCWCFAVPSLCCFRWSAGAVCWPPVSHVFTSHKCITLS

SEQ ID NO: 943027 - protein, 291 aa, Homo sapiens
GTDCTMKAKKKKNKSNVHVAKINLKDHHERGEQPWLGGGSAELALHSLANFWVQWWGVVCASVDGQAGPGEETTMGGGVFGGGVGLGVGGGLGGAGIKGLGAVLRSGGGPFPEGDCPGTGGGGLGTIPGHRGGEEVCSQVGGVRPPPGASLFPGGVCMGWLLGPEAGEPSSQEAGGNLDRHTASKPTALLQPGRGWQRGAACCLQILPESRVCFPTGLPLARKVTKLSWVGYKLQGRELQWPVYREELELERLLWRRRPGDRDLRRTGDLRLGERDLLLIRGGDLRHIGGG

SEQ ID NO: 943028 - protein, 235 aa, Homo sapiens
MCFDPSSQIRYIPPPPPRVCRPAVIHRELCPGFFKGTHIGMGVGGGRRVGGLGGLGVKMEQGPGGYSMGGCWGQGGGRVRLLGGGAFRGGEWGWWGGGAGGAAAGGRGGGCGGVGEGVEFAPGGLGSGGEGALEHFLYPFWELCISPTPQATLAAGGGAAFGVGDFIFLSMARLSWSLDISGSYASLTSVPLWSKNLAMDFVNSASRCCFVLPLLKVSFQVYLSSNLLRLEASCQ

SEQ ID NO: 943029 - protein, 42 aa, Homo sapiens
RPGHCNERPGEPLCYLSQVEGETQAPSLPAILSRPPIPKPWP

SEQ ID NO: 943030 - protein, 152 aa, Homo sapiens
MSRSSRRKAQVLMFSEELSKAVTVPGGWSSKNHFGTLRSSFISQRAPVGKAKGPDWWVAARGVGAYFSGVLVPKPPCVYAKARRVPAAILVLLGGGILRGGKKGPVMAVAEVVPRIRWSNCTLVGFSKTFLRVGGVKGSSGVPGSPILGKEL

SEQ ID NO: 943031 - protein, 262 aa, Homo sapiens
KSEGSRGKSGGEEAGTREAGKGEGSRNEARQGGQERPGGAGAGGTAARRPRGAGGGGTNRDRSGGPGQQGRGRKTGGHGGGASAEEGGGGERGEKTPGAHRNRKTHKERHKGEERGGGTRGARRGGNDGPPGSHQAGASPAPEPGGGRQGKRRGQGGPREGKTGGGGGTEGGTKKRGQRGRKQPGESGEAPREEEAGRRKRSGAGQRRGGGAEEESARNAGRDRSKGKRDRTERETKRAGHGGERDTSRQAGGGARGGERGE

SEQ ID NO: 943032 - protein, 141 aa, Homo sapiens
MWLLLLLCSMRYMVSLISWTHEAATGEGLGTYIAGVTATNGVCRSLPHLTRLSYTSSIRLSIKAEQYQSRAQALQDTSQTQGPEELRSWGAGVGESRTTFGQGSHILFLGSHSGNVPGGRGDGSHTALPSQTRGTPGIMRD

SEQ ID NO: 943033 - protein, 197 aa, Homo sapiens
AAGREGGAQGPAGAPPAARPAGEGGAPKQEKAGQGGGDSNAAGEGGGGTGAKTGSGKETAKERAQRGARGEGAGREGEKGEGGAKESQTTTGNQQGGGRKRDRAETKARRAGAKGGGAEEKHRHGGSNKAGGRRGPDAKTTEGGERHRGGNHGGAGGRRRRDTRAQAKRNGGGTQRAGEGGGGAARRGQQDAAAWTP

SEQ ID NO: 943034 - protein, 126 aa, Homo sapiens
MTISTNTLKTWTIRYTRSILRTHFWVPSVIAKVLLALGELVVYVRGDSVPGISSGAVEMLWQCQSVGLGEATEGVGQVTFGGVCLRVYDGSGMCLVVWTRVLQRTVLEIQLQDGALLIQAATGMQH

SEQ ID NO: 943035 - protein, 271 aa, Homo sapiens
KGLPQPSALKPQPHPDQACVLCSWQAGLRGEGGRLGPLEWGRVRGTATSCPSPRGRGPTIDHVLHSSLIPSRGEPWTFWWCPSGEGSRLRPRLGQRACREGPDGTSQWRLNLPSFRRLPPGKTWGPSSTQRRLAVLMQWKTLQKNSYEKNMKPVERAAFSKRGDRPLKKPRAPPFCSTCLAQSMRPLLRWPKAALACSNPPTCSRFLKRSSGYVRVLLMTPAPLPHSRFWRFSFFFPSAGMAHLFRCFKELVARELQPGVGEDGDQGGSNP

SEQ ID NO: 943036 - protein, 140 aa, Homo sapiens
LPSRPPRRELGRPWQPPYPQDLAREGVWARKRPLCAAQAEKQRAAVKNWKRPVTCIEGGGAKGGRRRCWPVVWCGAAGPVWSMQVPGGCAACPAALRGEQRRLPMGPWGVLCCTALAEATRQPAVPHPTQHALIQCIALI

SEQ ID NO: 943037 - protein, 113 aa, Homo sapiens
MRHHIVELVQNFGGHVLDGGSSQGQMNTRPSREQRGRGRGGRGGGAQGTSRQSLCASSFCASFHWPSSSSFHSLMRLSQPPDANLYDVIGFLPRWVVYEASRYNSRGPADGIA

SEQ ID NO: 943038 - protein, 223 aa, Homo sapiens
SYLFQPPLLEGPHFGGTARHITHPSHPLKAPTGSGKSPLPPGRGPGVAPGGSEDSPSTHPTRAWNLPTRRKPTAHGNWGKQIGQRFRGRGPAPPKGWEPCMRHASHRQGRSPNRGPTPGVKDLRERSSKTLVIPGNIIVDENGIDTGRGFLELLHFAKGQAKKTTAIPGKAEYPHTIGQRGLSKDKIPRAPGVKINHCYSHNTEGIFRFLLFQELQDVPCMNL

SEQ ID NO: 943039 - protein, 147 aa, Homo sapiens
FRPKLTANNHCRQLNLRSGRTTVVFQEFSPEGTGCWVGGLGGGGRARPGCVFRVSESNSYSCRGTTLTGARVKNRSQAGLGGSCLLSQHFESSRQEVGLSPGVQDQPGQKVRSLPIPISSKIKNNLLGVVALTFSPNHSEGWSRGVA

SEQ ID NO: 943040 - protein, 325 aa, Homo sapiens
QPPNPGNPDPQPNPEQPRTAQKPRKPRKKQKKPPKPQQRPPKKKPPQQKRKRGPEQAEESANQSTRAEAKPQHQKTKKPAKETPPTNNRKPPKPKQQTRSAPAPPTKTNSKTTNERAETSGNHSPTPTPTKARTAPQPKRKQEKPEPAAPGQPNPHKGKSRTPEPKKPTKKKPQNTANKKEEAHTEDGQNQEEENVSPEEEDAQKRSEKPKQYLLYIRTKATSHTQAQAEKTKTKNGPTTQYEPPPPKAKPKTRNSKETPPKREQSEPSRQPSDKTKATTPKPPTKRPPKTYIAASKATNPSEAKQDQSPKNKKHHHKFPNPQAQ

SEQ ID NO: 943041 - protein, 82 aa, Homo sapiens
RNPKELASNLEVVSEAAGWLDWAQPLSCLNLAKERDYDDYADFYIVFISLCDYVFSFNKAFVPMALGLGGRLKECVEILSKM

SEQ ID NO: 943042 - protein, 163 aa, Homo sapiens
MNGSGRMQPIFQAGGTTGLRPLPRAGRERLQEKKARCLSQSCSPLPSCLEAEMLGTSENRPCGTRTMGIEKRHHPKAASRVSAARPGRLRVHKCPIEKQCSLHRWRSKRAGASKASKVKPRAAAGPPGRPKRPLQGSSSSGLEARCVAPSDGSKAAHGDLCPL

SEQ ID NO: 943043 - protein, 203 aa, Homo sapiens
MRPKTWPRYKAWLCCSRPLLSRLPCCRRGWSWGGLQGLGRRGWEEPVLKSLQKQQGPQCQRPAVLVRVFLSHVRQPGPGFQQIVHQVLQQARKEQAEQDGGDGRQQPLAHVGIDVEAKGPHEFQQGLAHGHSHRGVNSQAHQGPYGVRHLSENQLVFSQEVEGHQRTVKALKEGGKKKWPATELNLLGLPAGPCLWAALESRW

SEQ ID NO: 943044 - protein, 282 aa, Homo sapiens
RLLILVAGQETKESPPPNHGPTVAKPDLPNPAHSHLSLTSYRWHTGGGGEKAAGGFRWGRFAGWGRALSHQEPMVSTQPAPRSIFRRVLSAPPKESRTSRLRLSKALWGRHKNPPPEPDPELEQEAPELEPEPELEPPTPQIPEAPTPNVPVWDIWGFTLLYGNLIFFGGYYYFFLMFLSFNCSSEGSIHVAMGNFRDPDRMPGKTEPETAGPNQVHNVRGLLKRLKEKKKARPPSALGSRESLATLSELDLGAERGCADLATAPQPPGGAHCFQVAGRVEA

SEQ ID NO: 943045 - protein, 60 aa, Homo sapiens
MYRLSPLAYSFPELREGLDSKQGYVVENEPALDQQENEPTDCKPAQGQSPPSPQWDNRST

SEQ ID NO: 943046 - protein, 293 aa, Homo sapiens
SVCSQTTCDEAGWAAQVVSPLRSGCFEGLGWFLRPPRPWRELQALVQHPSAEPEFSPSHLGGAPGFSECALHCLLGCALNQNLILPARSLDVQILQLAPQCSFCSVKARIWVLIDSTRRDSTFCSSRIAATSHCSSANFFTGWCVPSALVSVLRLFYFSLPGYGGFRGSEAESIVGCWALGAGPMLREPLGRGQGPADWRRRAGRRTGTLCVRCTGRGRRRRRSSSGRGGPNSLSGEPAQRLALGDERGVLGEVPGGQEAGLLPCREAGVDLGRGQCETHCTDTSTGWLSQWL

SEQ ID NO: 943047 - protein, 119 aa, Homo sapiens
MGNLFLPSLPYWCDELKVERTQGRCFPLPGPPKLRPHIVDAKKNNLPKTHCPGAPSLFGKFISLWIPKSWSRGQLLLSGQYFYFVGVEVASGQKAGKTPPGLLQLQARYLAGEKEILSR

SEQ ID NO: 943048 - protein, 107 aa, Homo sapiens
SAAAGPRERNTAGGSNFEGLRPKGKGVPMDQSPRGQDKPESLQPRQNKSKSEITDMRSPTITVSDKAQISSMQKFGLRETIVKSHLLQKEEDYTNFFFAGTYNLNGS

SEQ ID NO: 943049 - protein, 130 aa, Homo sapiens
MYLKHSNTKSTQIRFPNTFSSEGGGGHTSSGPEEATTDKEEITTAGAKNGGEAIPPSPNSSAAAAQLNAATQGKKGFLQAAAAAKNKTNNKDRELLTQANPSSTRQPTPHPPPPLQGPNNHPPPSQTHPH

SEQ ID NO: 943050 - protein, 135 aa, Homo sapiens
VQDRAGGECARGRGREVAQSRHERPSGMRLARKHEGIGAQARAVREGVQHRVAYHAETMHLAQGGAPPAPPARRSARPKRLPHLERAQGCGVVVCEGHGPTVSPERLRRRQPRGRLAAGRALRSQRAARAPAPAP

SEQ ID NO: 943051 - protein, 109 aa, Homo sapiens
LFCCGFLGVFGSLFLPGLLPLSLLPLLLLRPRGGPFSLFLRCRGFVVGPGFVLPVRLCRFCFFALLCFLGFLSCPLWAGLRRLVAADTLHGLSYNLQYRFILIDKCSHI

SEQ ID NO: 943052 - protein, 314 aa, Homo sapiens
MRVGLVWGAKRRAPGPWFLLRTNVNGPTGKKLGAAERMECRPRLLGGALSSWQGWRVVAAGLCQPMVRWHLTLFSSFTSGPARSCTVNQAQVSFTACLKGVNLEVGQEGPQLAVTGCFLKLPNRLGCFKGFPMEVHGLHHRLGCLLEGELNSLAHGEDEGLHFIVLPQTQKKSWARTSEYINCLRGFPVPHNVRPSRCFGQEHLVDYARKHVAILDVEVVVGPEDVGGDDSSEGAAVLLEVGPVLHVDKPLGKRVPKIAVVGRPWWIKVSAVGEVVLLGKKEEDRKETTLRAPTLKAEFRTFVVHVHPGIRTGT

SEQ ID NO: 943053 - protein, 248 aa, Homo sapiens
ERCVDEECGCTSRSSLLRWSSGPPLDSPVPQRLTLVRVVLEPHKLAPQADLLDADATRGRGLLGQGEATAATRARCPGRLGRCPRAPPPPAAPAYGGPGARGLDKPPLLPEVARERVTREDGLGDSLSLSSSPSRSFREAWISMSRASLTSSSPWSASRCITSRISVSCPLASSISRNLSRSPAMASSSPRMQIFSGTGLLLEAGELVAEGLQAHAGLLQLLASSTGRLVVLVRAQLGAVQLGLVGLL

SEQ ID NO: 943054 - protein, 146 aa, Homo sapiens
MPIQVLKGLTIIIKNRGGCLLLMVLHPSKNSAVSCLGVAAAWLGKRCHPPTWAKAGSAPAAGKLSWLSRRFGQELQQALLGPGGVKLGSCLVPSSRKLLLLGDLMEPDKVPSSATNEGPEGKTKALPNWLLMDWCQLGVLPALGGH

SEQ ID NO: 943055 - protein, 224 aa, Homo sapiens
PTGEVGGRHPSIPVPLNMVSGCGLEGHRTPGCPRFFASPKMSRTFLMQLKQGAAPPRFLFASSLDHHVRWCLFLISKFRFHGGVMGSSSPYVWLQYVNWVCSSPSLQETLGISLIHLLLGLLNKVLFHLVGSQHEHGGMAGPGTMENSLLPVMAWISKTASSTVMPLTSYCWYRTWGTGMSLGVTGSGAEDEVEEEAGYLLSMVGWGWKGGSVASKCREDSSWH

SEQ ID NO: 943056 - protein, 137 aa, Homo sapiens
MTKITPIPGADVQLPEAMGASSLGWKPQEPPSYCLIFPALPRWPRLISQKPARPPPTGTGAPVSSSALCFSVGGPASAPPPWAPQYEAVLLVLALPPPPQHPPSLGHVAPPPHPRCSKVISCPRITSFWQFGQVEGR

SEQ ID NO: 943057 - protein, 169 aa, Homo sapiens
MTLILLLRNVLEYSGFVRFCEVPACKRHLLGRKPGAQEKFWYDYPACDSNINAETIIGLVRVIPLAPKDVVPTNLKKEKTLFVKLSWNEKKFRPLSSELFAELNKPQESAAKCQKPVRANSKSAESPSWTQQNMWPKGLNQGTPPPNLAKLLPILLPKSQKEAGAWQLR

SEQ ID NO: 943058 - protein, 211 aa, Homo sapiens
SGDIAPEQDTSADVECDRHQGMFALPKKGDRPWGDLYPALQDPKTCPPQGPGLKHQWEAPDGKKLRREDGVTEPRQQKQQRGSGPLSKFSQLTEVMPRPFPSNPTCTQLRIFRGSTAARMKTASSRTYYPGKMFWWENYGITKAQRTLIQGAPPRALLENLPVWVGVEGLSDVLWFSQPRVALIQQGEGDTAGKGPLKEIVKGTRQHTNVQ

SEQ ID NO: 943059 - protein, 315 aa, Homo sapiens
LRRRQPRYGCALREETSLEKDFKGHRDAVTCVDFSIKKKKLATGSMDSCLKVWEMKPQSRAYRFIGQKDAVTCVNFSPSGQLLASGSGEKNVGIWVKNVKGESTVFRAHTATLKSVNFSSDGKFFVKASEEKKLKVWENDRKKFMFSLSKHIKWVRCANFSPEGRLMVSASDDKTVKKWDKSSRECVHSYCEHGGFVTYVDFHPSGTCIAAAGMDNTVKVWDVRTHRLLQHYQLHSAAVNGLSFHPSGNYLITASSDSTLKILDLMEGRLLYTLHGHQGPATTGCLFKKGEYFASGSSDEQVMVWKINFDIVDME

SEQ ID NO: 943060 - protein, 210 aa, Homo sapiens
IPQSWCGASPQLLQQAVDRAQLLLEVALVLTILQLQAGQPLVLSLQAGQSPAELGVLTVAVPAGGQEDAQCLLHLLTGMMLGLRQGVGRGLAPALFRTGLAGGVRWGYCCGLLWGHFLGQLSLLLGEHASPERVVEECEEECGEGLRAASPGPGSLRACCRLELQELPLGKGKWRKGEHNANRTFFFAVSGCSVARMTSSFCRAPPSMAF

SEQ ID NO: 943061 - protein, 329 aa, Homo sapiens
MKTLPSSQRGRGPLAGQQPLCGLEAFLLQNKKKKKKEQQPPILNTLDEPQGCLEYTEKGMQTNNLRYGIGAGIRKGSSATKSGGKHQRGPGPPPPQKIKGLKKKLDGSGVAAKKYTQGYVEKYGKEKNHTGRSAKPPEYIKKELYFISKDAHKHLYSKTPYRTTKHPPYLKKAIEQHPYNTVLQSQGEDLSKVKGTLPIPPALGLGMSPQPRVLGRDVRANAQLVGDVAGPLLDPLSSPEPPSCVQHPRLSAVSQQEGAMEENGAIPPGSCPLPIVLINLEQMQGSWETARSKHLSGQATGFPSHGPGPKLVQSEHALAIYPKQKAVNK

SEQ ID NO: 943062 - protein, 203 aa, Homo sapiens
AGVTLDGARPCVAIRVLPLNGVAVEEMNLVGGPAEAGSEETALKKFGGLTGYGVFWWPQHSLSAWGLSKVHRLIGPPGAGHSPSGATGWADHQSPSGWSWGCYSPCQQLLSAQQGAGFEAGWAHQGLGGSRYRALWAGPFGLLKFPTRLFLQWSHHSLHPLFGNDGEVSRESQPGEGSGKAGNWPLDWLDRVDQAWDLGQQPF

SEQ ID NO: 943063 - protein, 113 aa, Homo sapiens
TPQNCRNVTKALVLGTSCWPRRKACGGRCAPELQGSWSLTRSREPLNSTSGISGGGITQKGESLDSEPGGARVVGEQNKGEEGLEAFAGALQPQLVVHLFVDVLQRWQPRAVL

SEQ ID NO: 943064 - protein, 198 aa, Homo sapiens
NNLGEWRSGGGESLTVESHFALTLSVHNPQGYLEVPQEEPEEEEEEMDVRKKGPKVYHHALLALCSCRSPVVRAAALAMPPSSLTPVLSALLAGRADSALFCLQGKGGVSEAGCCQGSALGWKSQKSCPGAGGRWRKLLGETPEATPGPLRGVFFFPPSQEIGPPTPTPQCHRDCGFQRFPRLQAGLGWWAAGPRPGS

SEQ ID NO: 943065 - protein, 191 aa, Homo sapiens
MFLALHLLATSFLTWKVLANAKWCKCSVDLGAVQQELKGRKVLNIAGSIHPWLDFTFQELPTGTTPSAHMAAFILRVPFGTASGSVSTTYDGDAAPRGGFQQLIYESFGSLGKSFPFKYPHRTILQNVISPSESLSILLAAFRTKVKADEESRYARSNSGLASLGILINLVSSGKVNRQGNLHTILLSFGH

SEQ ID NO: 943066 - protein, 114 aa, Homo sapiens
MRIHSDPPALHILVIKNRNFSADCVRVSKGGARWNLGTYWAPLKQKEKLENVKVEKYPLPPEDEETREINQQHAGDEVTKATILPTAQGDFTPQDLLPGPTPTKGERKQHTPAP

SEQ ID NO: 943067 - protein, 182 aa, Homo sapiens
WNHEGFTGENASELTGNPLGEKEEVIPREEPQWGRCVSYATPEGWRVPRAAADRLVLQELGAGEAIMHCGVQRQKHNQQEPRRRRLSSYNACLVPSTDKAYPLSKNSQLKKLNLEHKVNKSITSNTMGPGVPWPLVSGVGRRMLHVLQWAQRPCTGENHPCKVSVVPPVSVRVPARYGSSLT

SEQ ID NO: 943068 - protein, 144 aa, Homo sapiens
KRKGAGEGRGPRGWGQCTRGSSALQRGQHLHLLLLLLLLLFLLLLQLFLGESLVLALFLLEGAEEGVLVPQVLLQAAQVAFHVPRMGAQFLPELFHLLHQGFVEVFPVPGVAPPPAGPGPALPDEFCSPSVLPLRLLRTCSAKG

SEQ ID NO: 943069 - protein, 147 aa, Homo sapiens
MSSRFAAAPGVRTVFKAFVSPSPELEGDVGDGSLAAQEGIWARQVRPTPRRPVLPEKGPSTCSKLLLGAEPRKVALGPRRRSCSWRSQPRKCCAARRRPRSQGSGGARGARPCPRAPGRKRRPPGAPGTAAARPCRHSGSVGELRRG

SEQ ID NO: 943070 - protein, 212 aa, Homo sapiens
MTDDECYVLLRLGGEQAIPQGTHSLRALAPRAAGSLSPSFVCRSGKTRPRLNLQSQTETKTLCLHPHDQSQPPVRASCSTPCCWLDTWCFKAKTHLDSYVHVNDFGKKEGSVESCSTKVRSKNRKMLLIMIICLQWSCQHVLIFFKNKTLSSESSLNWKDLCLDVVFTGLTHCLVEHVGDFVRTEIFHSLEDLLEVVPEGGAALHGPHRLVQ

SEQ ID NO: 943071 - protein, 133 aa, Homo sapiens
MRKVACFVATGFLASSAKLVSLLYALLHFSTKAAKSSITAFSCSFVALGLCFTSSTSAVCFLICLSFSESVHISAWKVNVSALNSLGTYVSSTSRAEKHGRLFTKDSVQHLVTLSVTGLFSCNTHNWFRTTDR

SEQ ID NO: 943072 - protein, 164 aa, Homo sapiens
GGEILDSVKRQIFGVKRSRPVQCAQTSAPQSTSILPGRRGNNSLAKGLSSAGSHGPSKWPHCGRKSLSVPPWYPDFISRYSCPWRPSWSIPPAKKRVLRPLLVGTQTANWRMTDLLEASCFLGNELGQASSYGGWFCIDRSVPGSHLQWEQGGWEVAKAKSLLR

SEQ ID NO: 943073 - protein, 140 aa, Homo sapiens
AGLRSCAGVTMPEVPRPPLVQLGLLQRKKLHLLEGSVGGPRGLAHMKKLRPKLGPGFFTVRITHGSLEPPQRGVRKAPASTDFQNEVRNSFSSLASEVLACPFSTLATAFSSGVFGVMRALISGRLGSSMLGAWGQLALG

SEQ ID NO: 943074 - protein, 81 aa, Homo sapiens
LLAYEWLKHSTNKTLMKSSFIKPTRNITAKTHQNQSIAISREDGNSDSKTIIIIIVKSFITVFSNTLGTCLSWVSFFLMNI

SEQ ID NO: 943075 - protein, 177 aa, Homo sapiens
MLQFAAFQFVILGEQTEESCGPSETPRSLPSAYESSPIRHLVASIKIGSMFGQTLHDVVVAPGRGCQEGRLSFSVLDVQVKAGFTKGFGHRVIAVPSSTVQGGFFFLLDIGIGAEAAQSLSHVSMAIASSHVEAISPDLSFTSKGHLFSLRDFQGIDVAMPSSPVDGIGPALILDID

SEQ ID NO: 943076 - protein, 101 aa, Homo sapiens
RERLFHNFTNYRKMIFPLLYRNVTPKSERALLWLKPGGEEGAENTARRAPALWVARRLFLHIKAQADSQRPVTPLKEAPSTWLCGTLGLASVLLASWPQKT

SEQ ID NO: 943077 - protein, 182 aa, Homo sapiens
PWHCFHPLVPAGHPGTTGEDVKPPEHAQKEGASSQPIIAGLMIFYKLCFNSKCFCFKKELISFIENVLTLFKIIFNIMKNYSDSKFLAFSVYFFLSSHHYYIDCDVSLLEISPSTHAWHLFHKRASLGIFLAHDPALSQDDNSSSSKIQSSVSGEEKVDKQARTSAHHSSLQTASPSALFTL

SEQ ID NO: 943078 - protein, 170 aa, Homo sapiens
PSVGDYFHMAYNVITPFLLLKLIERSPRTLPRSITYVSIIIFIMGASIHLVDDSVNPSLLFGGFLPPLSVSENPIFKTIIAGDAARLPCLILKCIPGSLPVVPPILPPTLHVLPAYMLLLKRWLHGSQLLVGPVGCPHRSMDPRGTLFKLFQFHFFTLLLVLNTATGVSL

SEQ ID NO: 943079 - protein, 87 aa, Homo sapiens
MFLTPKPPPLTLAQKLGLIGPPPPPLSSDEWEKVNSALSCKGTPCNHAPSVKKNSSFVLRCLAYEGELESSWAVSKGRGPELEPKIP

SEQ ID NO: 943080 - protein, 105 aa, Homo sapiens
LKKMGFKTGGEMQFLFTFRPISQTICEAGSRRGEPKDPTRLIAIRLKDLLWIPIESIIPTPEKVFGWQERDGEAEAQGASDPKPHGWSENRVGPNVDFYYACMEQ

SEQ ID NO: 943081 - protein, 353 aa, Homo sapiens
AAPGAGGDLMAEPEDSAELADELGMEQQTVVGAVKSLQALGKVMEEELLSKKDFQLNEEGEEIAREEHKARIFRSIPPEGLEEKKDYIRVPNGKVGFTKAMSKKIGKNTDNGPRVFRVGGQHGGIKYSGGSSWSGGGQAEKLGEKERSELRKRKLLAEVTLKTYWVNKGSAFSTSISKQETELSPEMISSGSWRDRPFKPYNFLAHGVLPDSGHLHPLLKVRSQFRQIFLEMGFTEMPTDNFIESSFWNFDALFQPQQHPARDQHDTFFLRDPAEALQLPMDYVSGVKRTHSQGGYGSQGYKYNWKLDEARKTYCEPDHISQRPCALPPCPEEAFTPVKYFSIDRVFRNETWT

SEQ ID NO: 943082 - protein, 97 aa, Homo sapiens
MLTLCALLLPCLIMVDLGQVTSFHASVPHLSNGVNNTLPPRGVVVPCQSKLFFRVLCGGCLAPFPPPQALVLTELSPRLALLSDSAHFPPPPPPPSC

SEQ ID NO: 943083 - protein, 288 aa, Homo sapiens
RTLHRGGGVGRAEAACPGSQVPARCFRPGLRRGRLNWADPALEARRKTGRALPVSSPRSARGSRATGGGAGRWDSAQLPRPASDQGKKKYRLLPHWKIKKEDFLAAKNELNGIVAREEAESAQCLCPSLTIPNAKDVLRKRHKKRSRENQRFMARKALLQEQGLLSMPPEPGSSPLPTPFGAATELKLPAVEKQCLRAGSGSAPCSRRPAPGKASGPLPSKCVAIDCEMVGTGPRGRVSELARCSIVSYHGDVLYEKYIMPEMPIADYLTRWSGITRQQMRKAVPSRW

SEQ ID NO: 943084 - protein, 97 aa, Homo sapiens
GGQRRRRRRRLGGPEVNTMSSLHKSRIADFQDVLKEPSIALEKLRELSFSGIPCEGGTAVPLLEDSLELPSQSGTVSCFMIPLSITLPALLCWGALS

SEQ ID NO: 943085 - protein, 136 aa, Homo sapiens
PSVGCKRGGRRPPPAAMGLKAAQKTLFPLRSIDDVVRLFAAELGREEPDLVLLSLVLGFVEHFLAVNRVIPTNVPELTFQPSPAPDPPGGLTYFPRGPARPPPYCPASTRPGLPAARPTSPHYPSGERGGCLPSQL

SEQ ID NO: 943086 - protein, 132 aa, Homo sapiens
MVAVASSVVLLIAGVAWGRGAILRGQLAGVLGGGARNAWACERVRRIANRPQLMGQQGPPLPEPTMASGPLRAASTAPVNAPLVKKQGSSLPRSRTRPQSMVENRPPHTAKYPPIWGARILKHWHYLSTRCR

SEQ ID NO: 943087 - protein, 200 aa, Homo sapiens
DPSVDVLKATALPLLKQFGIDGESFELKIVRRGMPPGGGGEVVFSCPVRKVLKPIQLTDPGKIKRIRGMAYSVRVSPQMANRIVDSARSILNKFIPDIYISPQSFNSGKFPGLWVHSVWPTGFPHAELASNPGPEQQVPSRGPWQELCPAAAGSKSHRGGLRRFDQPKPGATTHDPWTAGCFKVLLGPLSPYTTRIFCGI

SEQ ID NO: 943088 - protein, 296 aa, Homo sapiens
KDSGSSTHTYMAMRATYLVGNREEANLEAALNELIQQKRRKGTQIHRLPCAKGERAGGEPGMDLGKGEIEGGGGGGGGGGMEEGGAWVGAWGHSVGGGLAARERRGKWGAKIQGASGGGGAQPPGQMMNHLFPVCRTEGQNRNSTLSELSAFPGQCDPHHLHQTCHSGSVNSFTPMGFSPGRVWAENLFPVINPQRFPPRSRWFPRLLGKEALVMGFCLLFPHTRGQGVHSRTWGASLAAPEAPERTPRVGLVPGMPKAPSMKAVMPVAGDSSSDRAAVPRLGPLVTTCFHNPPKA

SEQ ID NO: 943089 - protein, 98 aa, Homo sapiens
LEHEHAQLPRVGQQQLKVHLPEELVIQDTLSDRSVSLSSSQSRIWSEMEGGSTGVCVNITGWPLVLRKEIKYGAVMPLAIACCTLSRVTCATTMYGNR

SEQ ID NO: 943090 - protein, 74 aa, Homo sapiens
MVDGCPVLGPFRMGEDLRHVPAFRRRAACNPKRYILGVYRWPRLYLGGPRWVPGITWYLPGAGRVAPEEIGGGV

SEQ ID NO: 943091 - protein, 209 aa, Homo sapiens
GRGWEHCTGRTHSSKSFPPNEEVPVNNKIYSLVLCPWEGGEMDVKSNVVCPPVIQRSSPEHSPCNPPVPQGETQAISFSALSTESLPCIKFLPTCMQKSPRMAPGLESAGLGSPSMTGPVSTTLSPPQTMATTGPECMSLTRPAKNGLLQVNVVLEKSSGSLHEFQTNKAESFLPKTLENLSHKTPLDPIWFDRNEGTLTVGHGSCFTA

SEQ ID NO: 943092 - protein, 71 aa, Homo sapiens
PPPPPPPPPPPPPSPLPPLPQPWLNLELVQNSPVESADLSMPRCGILVLDSHVLCKSLIYHDYILSQVLHN

SEQ ID NO: 943093 - protein, 114 aa, Homo sapiens
MKVRIAGPEVYRKGENVRGPLTGGKMPAMAPQQTKRHSGAWGLGEANPVRAVLEIRRVVSGVLQSPTQPLYNGGSISETPKVWGILEARPTLLSINSRTFPHDGILRKSGQPMH

SEQ ID NO: 943094 - protein, 239 aa, Homo sapiens
MAFMDEKKESNHKEKEIAGFQLKINLEKCTDYWNKSLPLGCTTEGEIPQDYTTLFPQDYTTQIVFIPFLELEMDILNIIVLLQKNPLTTKPGYGQKYLDFSEGLSPSKNEYLALEFIQGNHHHPWNTQAALLFLAPARLAAVPRRPPWAATLGSPRLGSPPFPGPPFAYEATVAPWSPFINPAHGRSRTKARPPPPGRRPSQARRPTPATPALREAKADGSQGQVFETSLASMVKPRLY

SEQ ID NO: 943095 - protein, 145 aa, Homo sapiens
FPIVSTYTQTGLQKNFKYQIEKLSIHAPHDSSQFFQSLNFRPANNTKLNTVFVESVNQLSFGKARPPRQDPTRLRQTTSITQKTHGCLTQSHGGSHTASLWSFHLSPNLDIWFVLICPSPSAVSLTKECQPESGSINLFLCRASS

SEQ ID NO: 943096 - protein, 360 aa, Homo sapiens
GPASVPLPLGDPPIWSEGSKQLVTEEGAWLQQPGLGGDSPKNTPAGWVPGGLGEAGVGAAGSTASLLQAAHSTGDLQACGHLEAATPYRESWERRLCEPGLESVRPLFGAGVVEGQGGCGQMVEVQAPGGGRFAQWLEAAQAAVGHAHAERLAVRLVRTSQLCSPPSISVCSRTVWDLAVKRSRPPRPEGILLGEGVPLAGEWMGEAVRAWPPFSRALKSCTFPPIASHFTERASTRRCWWDVDASRRNKNAGVFRVTGSENSSATALLQAFTRKSMYFMNLRPVRVSSVCRDALDDHPGLALLEAGRGPEVGPPVLQPVCSNIAVLSRDAQTRVKSYFQQGLSKAITGPRAQEGLEFLL

SEQ ID NO: 943097 - protein, 197 aa, Homo sapiens
MYEETVGEGTEPPAGLERVHARATSMLGQWEQEGSKGRFLKQPEDQDLVLHALLEDRVPPGLADQIGPLDDNNAHKEGRVAGELHHLPLLVCSLLRVTVFQVIDGAVIPVQPDAHQVAGQEAIFCQAHKVRKEATESLGHSNLPVAQAEEFLIDQFVRARVPGLSLHEVAFGSFVRYEEGRDHVSSQIDAEDGEGAQ

SEQ ID NO: 943098 - protein, 58 aa, Homo sapiens
MVCAIFQLITMCVFLGFGGMLLCRVVHAEVGRPVDDDALHGDTEALVQPRMPSDLVIF

SEQ ID NO: 943099 - protein, 113 aa, Homo sapiens
MKHFPPFTQKVFSFSAHFTRGLVPVVDVDVESLGAVWRLVSVVCGWVADLGVLTSGFRVGEGKDGAVDGKKEKAKYDYSVWVPLRAQRREQLCYLALLLEPHFQIYPQRQVKC

SEQ ID NO: 943100 - protein, 103 aa, Homo sapiens
MERRKGQTDKAILTINAQEAARGSPSLAQEHLHLGVLGGGERLQGRTGKADNLLTVLQGHRAQAPRDTADDTGVCHHLCIQVGVPHLHLNVSGYPVAGVLLDA

SEQ ID NO: 943101 - protein, 205 aa, Homo sapiens
IQKDHKPHINLASKRPHVLKLSPVTIILPPVKVSRRKSLNIKKLPPKPTETFSHKPGYCTNNKVLSSIVNLFNFIHVCSVEWLNTAVKVVLDFHERGQPTYFNHVEGKAFFPKAPRPPQAVEGGLVRLPSLFYRETKVHNNPPNPSGTNISGDENLLFPIPKPLNEGSAPRHGSAPLNKDTWRPSCIISTVNHLAFRRVLQKKKA

SEQ ID NO: 943102 - protein, 72 aa, Homo sapiens
TQEWVWVTATSQQRQRSGFRIPQRDCVTGSNNYCGVTRGHFNTTETPIQLSSVNTVRVLFSMLLQVLKMEKL

SEQ ID NO: 943103 - protein, 176 aa, Homo sapiens
VGIAKIPWVELMPGPFSSLSGEKGKDEKEQQEKPPPQEEEGDLELLLELGTCWDVTSCQWSTVSVGQDGCGDTQVLWARGGPDGGGPGGGRGWGGLVLPPKVLGPLGSVWEGACLFWGWGGGASHLAVSPQTMFMWVWKDDFPFTQPPLPGAAGPSGVVGDLGSGNQNGVATQHTG

SEQ ID NO: 943104 - protein, 262 aa, Homo sapiens
MSNRIEQRMPLPARISAAWVVLHKQKREKSRELEVNPFLRECSLNPNTSHAPGSQQGSGGTLGYSSRVPEACLSLRNVREEVNTGREKHQAFTSLMASIRRAPVTVVRKMNLEPFSLPRNRRAEITENVQPPKNTTKKRRRDSLEALSSLVISVNAKSLQLEQPSHLTKALPASPPQHLPNDSAAQGHKSTTEEVSKVSGHFQNKPAVHTWDQIEPFAEGTKIAPLGQRTEGISDLSCSLVGDQPAHFTPHGSEGVPWGLPR

SEQ ID NO: 943105 - protein, 172 aa, Homo sapiens
MRKESTKTLCFSSRLGNSTKKGEGGLRTQIPSDPVQSSKLLRIWGGLLSKTPFQSDLKMGVPLGRTLPRTRLIGICEPTPQTQVWGPQAGSQLVRDGQEGGLFLGAQPGRGASGACGLTPLLTAPSHFLHVGMKNNCYWLAGQETPVNSLGAAHPNVQAPLSESDYGLRDRG

SEQ ID NO: 943106 - protein, 305 aa, Homo sapiens
MWAGLVKQLKASTMPPTVTTLPHRQGLPPQVAERSKDTGGGKPTNKTERARTELKAPPQGGQEQEGVATEVHQRPKEPFPQMSMGTACLAAKRGCGPPRWTGEAWTLWPSSHGKERFLPEWRAGRVREGAWEPTPAEPSQRGSLTLALRKEPVPAETGVGVGKDPPGSRAPEEGGPEKVGEQRRKEVEVGESTPVLGWEALADHRDFQWEVMWPPGYVPGWPLRCSEQQKVGHFGGPPSPPSDKRREGGGRMVVRQDVLILARGGQVAGEQLGVARRRENGPCWGVQLHLVQDGLLEGGWGKLPL

SEQ ID NO: 943107 - protein, 172 aa, Homo sapiens
CGVGGAGRPLSPHVQGVAALGHQFLDVVHRLFIFPGPELSHDVVEGVLFFAGHFPCIPTDVDVGSAFDQLPQVLSVLLQQVLDVDLVGLLDVGHVVLGDLSAPEELRQASRYRKSSSERRQLRYSSVSPTSLLCCRSLDRSWDEAYEGCHPGAGAHHDDRGGGLEGQAELGL

SEQ ID NO: 943108 - protein, 36 aa, Homo sapiens
MTVNFKYEAVSSSPKFRTGDEVLGTTRLLGPQVEVT

SEQ ID NO: 943109 - protein, 133 aa, Homo sapiens
MATSTITSRRLMSGSPFLPVSSFSMSSSSAPTSVTLITTFCIPVSVSFFIAVENTWRVTVITRPLSLSGASSFSVPITVSLSVSVSLSISVFLSGIIVPLLAGVHKTRPRRSRTRKRGKGNNAIRKCTFRTTI

SEQ ID NO: 943110 - protein, 127 aa, Homo sapiens
MGVQVLFELGGKGLEPPFRHGQLGSGVGAPGLSHTLLVLSRVWGDSGGSAVAPKAATGASSISLSSDSLGPGQNVSPRPARPSTAIQRRCSSSVSGLKYQLRWLWVILKTCLLSGRSPASGGPPRSQ

SEQ ID NO: 943111 - protein, 191 aa, Homo sapiens
RCAAQGTKLLHTVPVVPHADHVARKQGAEGLQPLQPVEGEPLGLGQEHSLPGGLVGLAEWHPFADQIGKGSCQHVGAESLSQVLLVNLQRRDDASCHLEHGTYNVLNFKHSLLVPLKVYVEGSGKILKGKQEPGTPPKHTPTPCTVNITKPGVFLLGHQAASRAVGILDLHEAEFLGAVEDEVLGHPAEMG

SEQ ID NO: 943112 - protein, 194 aa, Homo sapiens
MPRKDMGPENTSTSGRPRKTIHKDNRSKPEADTAMKSVGRYRSDQCLYWTRTSLRPRLCRFQSIRDHETELARASLPPPLPLAQPASGPPDPSPETALGATSDPRLQPFTVPVPGPVCPAGAGGYHGDPVETRTPESVGEEASQSSPPTRSRVSVTHVSFCSHGASKRVSNKVIIDYPGVCEYATHQQRDTTKL

SEQ ID NO: 943113 - protein, 255 aa, Homo sapiens
GTQFTPPYDHSCVRHCAKGEWRGAGGGWEEVMGDKQRWGSAKDWGRGPPQAQCPAAQQPQPPAPPSGLARDRHFPVPRNNSGCCPSPLLPWHLFLLSPPGGELGSSGLLATGGRCLAASLPPPEAFYPPFPFSGFPATVVLVFDRSVGQFGELTCPHTLGALGVPGPVLQEADRWGLLHPHADDLEIQCPAEPGGEAGEGLSARGRPPSATALFLGEFLLSGPLSWVWEKSCKTKPAGKLPSVKCRTSAGAAKVS

SEQ ID NO: 943114 - protein, 149 aa, Homo sapiens
AARSDSFEKKGIRPGLAPQGCQPLRLRNVPSGKLGWGLNETWGAGMALSAYSAPPTLHLCPSAGWGSQIPSIPELPETGTLLKVRAHSGGGRLNWGHLRARGPVVGAGWEEKALACLKLEASAKEKGGQAHAPPRPGLPRSGLGTVSIF

SEQ ID NO: 943115 - protein, 147 aa, Homo sapiens
MGKCLQMNALFYMSVRNLPLTGNYRVPRKVKFKKDLAIAKFFVDYGKKMALGLGSKDGPRLNGNASPWGRNVVDLGSSGLLEAEDAVCASPGAFWCPFPGGLAVSGSLGVFGGWGLWRPWALPRSSRAAEVNFRTRHNVVTIAKSKL

SEQ ID NO: 943116 - protein, 114 aa, Homo sapiens
MIKNIKIYDRMRYLDNKHYNVIFAKPNFTCCSKKQRVTRMQKFLIIIFNQLSQNSPLLNLPYNSYFSPPLQASEIKKKGNNSPSENTASFFFLFYSNLNCRQRFLRIQRTILKL

SEQ ID NO: 943117 - protein, 206 aa, Homo sapiens
GLGASAQGSPGPGRQVGQGTSVVLHPAIVRYECFNYLLHSQVGDELFLAFGAPGHGVKMTHTLQVLLDVLAVVGKATWRKERLPHHKALAKKVVGDVSLLPLLNHLKKKRVHVRQELVVLLNAGLQGPDVAFVLITLVVSLLQPLLRGNKPGEEGVQHALLDAPLLNAVPALLLRDLKSAGDVVPEVQPLLLGQAVSSLQNGEGLT

SEQ ID NO: 943118 - protein, 153 aa, Homo sapiens
GGGIGCGGLPSGPPGAPGGGWRWGVRPGGPGGGGLWWVGWLLGPPPLLGEGGPAWCGGAGGRQARARRGLHKLCLKRMQKVLLPVCKIETGVCRLSSGLLLLCRCSACPHGVPGSDQETAGSGGSSSQGQSYGDADQEGCRGSPAAAQPPRVT

SEQ ID NO: 943119 - protein, 128 aa, Homo sapiens
MGWAGRREEAVLPECDAGGGGTLGSPDGLPCPRGQFARLPSRLEQDGKEKTADGGDTEFCSQSQPGWLGSGWGRGKEPKKKKRKPPSLPQSGSKKDSISETFRAPYFCPQTQLSAKWAGKQHQRPWMW

SEQ ID NO: 943120 - protein, 197 aa, Homo sapiens
MPDPPGMAMAEAAQLPEDVVHSTSPGQGSEGKGERQILPETAQQPTDLCAPAPTTVLHWVHVTPRVREVEAWSHSVDRLRDKNTVNFGFVGKLLQKHNFRPLLKMIVFLAGALFFRRGLLLELAVLLKLGHLAEDLLRGFDDLGAEVGGAVGARFLQGVAVVGHQGAEAGDAFEAHIRHPVEAPQHRPVLQVGFGHG

SEQ ID NO: 943121 - protein, 254 aa, Homo sapiens
VGLWGIVQESQASVEKTKVLQTLHGGHVLTFKTLNTNRSNAIMYTFVLEPFFCSHLEKGSLFYVTNKLVGWLSFFLTCPALHTGSSLLSPFVFFFDALGGLLPLRDSAAHSMLLTLSLVGGVLFSSVWGWGGGRGGGGGSVVCWGLFFAGGFCFVGVGAGALQGAVFWGTGLMVCSAGWARGPGSAGQWRFDHKQPTGMGGSGSLQDLMLVNLFGRLCGLSLIRFKLKKNAVTTSPTLDAVIAQFLQVQLGVQN

SEQ ID NO: 943122 - protein, 118 aa, Homo sapiens
CACICHLLPGECFSSGFCLVFLWGRGCCGSGKGGVLLESSPGNQLPSHHAGQAHSHLFKIRADFPSHPQTGTPQDGLRRLESLPVWRDTLAAVKDPLAGGGGRGGGAVDSFVFFLSSN

SEQ ID NO: 943123 - protein, 107 aa, Homo sapiens
ELGSRGAPAALLVVLHVEARDAADLALQRPPSKGTAPSSSSSGGGGGGGETAPGAGSGGTGGCAGHALCALGDGCCFAMPKIFKGKEIRIIMLILLLGAVGERVLEN

SEQ ID NO: 943124 - protein, 39 aa, Homo sapiens
MDVTTGSPPNAPDWIRPQYRAPSPPQTSTTFSPRLTAVL

SEQ ID NO: 943125 - protein, 278 aa, Homo sapiens
QEEAWTQVKRRWGVNPSAAGFSGIGGDILPPHVPEVGTFPLTHDLKTYRPATHIAGGERDILEGQPHRSPSQQQLLHKIFHHLMAVDFGWCQAQELFIPGDIWVVDGLHIDAMLGEQEITELAFDCCIAHPDGDDVAGAGDDRKAPVHEELAHVLDIALVGSPQGLALLSLEQPHRFQSSREHHEGQRSGKDEACSIGAHHVHQVTGAGNVAAHTAKGLASSRDVNLMHNSITLPNPSAPGTQQSYSMDLIHEGQGPILVGHITQLLEGTDGTIHGVD

SEQ ID NO: 943126 - protein, 31 aa, Homo sapiens
MGGQSAEIPRLRQCTSHPDLPLLLHPRLQRE

SEQ ID NO: 943127 - protein, 202 aa, Homo sapiens
LQTPGRALLAAVQQEQEGNEMRGAFSRVSQFNNVHKEKRGKGSTHECRAGWAGGSRAERQYMDNAHAPLPLLFSKSKCSLMIGRGKISCSLVWAECSVAWAPNTGEIVSKGLVKVTGSSSCPRTDERKYVCAGNKAVLETRDSLEGKSKEQSVIRYWTAAKCWALSSLQLRQLRLLELELGCQPPWAWQNTLLTAPQGFSLG

SEQ ID NO: 943128 - protein, 66 aa, Homo sapiens
LTQGLATLPIEDNSVQRNFSYKNQETPVGLEIHPVGVYPTASNHNSGTCCCFNAFIYLKTCLMECF

SEQ ID NO: 943129 - protein, 35 aa, Homo sapiens
MAIDPSPPPRARPGAVATSLSQFRAACSPPGSPGE

SEQ ID NO: 943130 - protein, 156 aa, Homo sapiens
ENQQKKENKSITGSHENPYHNTWTLLNRMLPPKKREELPCLEEQELECCEETPLMSQQAPLKANEKIMEFEYTAPEPPMLNKESNKEEELPKCTQMHSLSRELQHEKFPYKQSKAQIPKISGYSGLEDMLQIVEIANDCKGACRAHRLSFGVHSLE

SEQ ID NO: 943131 - protein, 149 aa, Homo sapiens
MLITAPPPLNAGEQKEKKGSARVCRYGGAAPAWGEPVLPGPKDPCCTSWGHGQVDGPGRQFLQPEERVLLESETLHLVQVRGIVRLDQQQAGALSEGHLSHREVVLDVTPVLEGAHAREHGKDTEVLLSPRTPGARQQGEAFIFLGVDV

SEQ ID NO: 943132 - protein, 65 aa, Homo sapiens
GKVGTGHHIPPLGVRSEMQREGQEWAAQGPGSPETQLAAEEKAEKARVSEVVLLKAGQIFNNIYW

SEQ ID NO: 943133 - protein, 341 aa, Homo sapiens
DKKRWTAGFPGAQNGAVGGASKMGPGLRRLRGVEWRGPANTQGAYGTGVASWEGYENYNYYGEQNTSVTTGGTYSYGAASGEEAKANDGGLEGGEPAMDMGSYGPEPCTDNSDSLIAKINQSLDMMSKDGGWGGGGGGGGGIQDRERSFRFQQFESYDSRPCLLEHNPYRPSYSYDYEFDLGRDRNGSFGGQYSECRDPARERGSLDGFMRGRGQGRFQDRSNPGTFMLQSPFVPPAASSEPLSTPWNELNYVGGRGLGGPPPAGHLLSLFSQSMAPDYGVMGMQGEGGYDSTMPYGCGRSQPRMRDRDRPKRRGFDRFGPDGTGRKRSSSSLRGADTNWP

SEQ ID NO: 943134 - protein, 220 aa, Homo sapiens
MGLAEVVGTFVSHQMPGLIYGIHDSRLQGPFLCGCQVLPQPPQAGQAQDDRVPVGPLQPVVVPPEGSRGHTGGAGAKSGLQGLHQRNGLEVVLLPEAIPVGLSPAIPKEAAHRLFPVLVLILVLASQQAPSQVVGIEPQSKVPEAGEELRFHLPGGGVVHALVHSGQDPAIALAEGTDLGHCPASIVGEAKLHELALLVLLLAGMQRLFHRGAVVRCVWV

SEQ ID NO: 943135 - protein, 105 aa, Homo sapiens
MVAFVCTVPSFSLHKVVLVVLQTTVHGGNPTWAAVRCGGSLSSVGNIHSNCWQAAGRPPGEGVLGRAGLAGVLSAFGKCWAAKGLVHPSRECPVLDVHLFPSPWR

SEQ ID NO: 943136 - protein, 203 aa, Homo sapiens
NCLKDENLEEMMENREQAKGKQERGHSEPAGSRGERSHKAQQGHSIWPPYATTQSFQPGDLSLSRQPPCSCASATSSSLLGLLQQASTGSPPPLPHSVPQGTSATRRGGQGCPLPCLTLRPFLGCLMSLGPPPCKGCVAGLPLFSRGSMHPSGQGQAPWLPRALHGPVLHHLSNLYNHLYNPVSPTVPCKTLPPFPLLTAVFL

SEQ ID NO: 943137 - protein, 147 aa, Homo sapiens
MRWVLKKVTRSDGKSSSSSAAFLRITQQQRRDMEKNGGYEGKLNFFPFEDFGDIEVEDIAVEDCVDQTYHNGDEVEKPWNGSAEPVEEIERAVNAKRKQVVAGEGLRLAGLALHEQLRQDGHFLQVDGEGPEDLQKGEVMIDQAARL

SEQ ID NO: 943138 - protein, 308 aa, Homo sapiens
PVRLRDQKLQTLPCLEGGKEANPNYKKLCAAFNPPKQTSSKQVERSLACLEEEKKEKKGEEGKEEWKKPKQKKKKKMNGAGLWGKGGVARKKENNPSNQKKLLLQKKMEKAYRHWDQKNQQLVGPEPSLGIPQVGAWQALRTGPAVTFDSAPHFILWSSLLKHYLEKEGSAGAYPAKRGILFQHLGIPWDHSVTSLLVQMGKLRPESRGELVQSHNLSWGQDPATTCPEASTVCQDTPVWSGSWKETPGFWTKCIYRRCWCQACRSKSRAGMEAGPRSFGTRVSMPAAETLPRLRTQSSAGELLILTE

SEQ ID NO: 943139 - protein, 144 aa, Homo sapiens
YYFLMHEVDRHKSLDSVGKTNPAVKKLQPPPANPRALKKQLKKQPSKTPINSPPAKDKRTPRSHKTPKQSINKNNKTFAHEKRPGTPTDVPTRMEPSTPPPPPPPPPQAGGQEEGRGGGSTPRKEVTKAPPPARTRPTTDPPPP

SEQ ID NO: 943140 - protein, 130 aa, Homo sapiens
QNASLSDGERVVSHTPSPEPSLSGRKKQSPCAPLHCATQQRRWWGGPWGLGAATKGEEKDSKKPGAHSNPAEELATCLLYIQMIYFQPGSAFPKMWVPGQLLFPLAVASHFSLMPDHELLCRSQASTRPG

SEQ ID NO: 943141 - protein, 101 aa, Homo sapiens
MVLSVLAVGLILFVSISVGYEVFEIVCDCTLFALLLLPCLSGLVGFGSGGPVGVLFFRFGGLICGSGCGGGRAGAAPAGLEPFHSCLWGVGPVWLDHAFKV

SEQ ID NO: 943142 - protein, 122 aa, Homo sapiens
MSPQTRWAEGRKGFLDRATWMLAGPQGMKKANYRSRILCRLLLTWVGSHLYLDDVEDGDVAVVGLAARPVDTIKFLGCSSSLMKTRTVVFLTLATDWSVVKRGVAGHEEVELWGGNERGDEA

SEQ ID NO: 943143 - protein, 283 aa, Homo sapiens
MSWSLHPRNLILYFYALLFLTSTCVAYVATRDHCCLLDERFGSYCPTTCGIADFPSTYQTKVDKDQQSLEDLPPPVENQTSEVQPPITAIPRPYNPDESSPPNMIDAAALKSRKMLEEIVKDEATLLTPDPRIPNLPDKNPSPHPPPVTPPEKVAHACRTVPGTLPNTVPIPDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRT

SEQ ID NO: 943144 - protein, 104 aa, Homo sapiens
MVGILEKFLGFRIYGMHSELWGVVHWATVLSPTAFFGTLASLYVGALEQHNDKLQAILGVPWKDKNCTSRLDAHKVLSALQAVQGLPVAQGRADSQAQLLLSTV

SEQ ID NO: 943145 - protein, 180 aa, Homo sapiens
GQEANFATHDLQASPWGQGLGDQANGLQTNSRSFLRQVTCGPNYGTGVPREGVGFVFTLEASGMENVLFCKDEAGSGRPRDPRVRPVWRQGCAEFLADPKLAASLVYRPFDQHRLHLALQAGVLPLLLLHVDDQQRVADGERCPEPHGLRGGQEVLVDEGHSCQVTHGKGYGQGTAQQLG

SEQ ID NO: 943146 - protein, 148 aa, Homo sapiens
QLLSLGLDHAAKAKGARRLQRQICRLYDYTKPKTNCGVCLGLLAHRTKPPPAAGACPGQSAFASGDDHEQAVALNQTQDFLNTTSGRPMEVLGTTSSTYLAKTAELGRSNMTREEASGPAPPGLARSPGWQERIAVWRHESELCFQSL

SEQ ID NO: 943147 - protein, 162 aa, Homo sapiens
MVRDVVFLLLPVSNIERLVILQPGDGQYQGGVRDSDPTLPPAAVGAPSLGQLCTSRHPAGFLCEESFYLRGRAFVILLLPKDVEWRHKKYNDLNPLLRIILVSTTVRSPKHVVVATFLVASLPLLKPSQYGGWENQKKGQSSRVRLLRITRMIRFRGDTSEA

SEQ ID NO: 943148 - protein, 239 aa, Homo sapiens
WPGPSLTGSWSTPREREECQPNHEGEEDDSDVRAQQACVEAKHVRVHPTHMWVCLCARGVGASPPCVGSVPQGGGRGGVCPKHSTELFQDKFMADMDELFSQGDEKRKVSVCGLLPRAGRGACSPFQPLTVTCSTASNPDYLCKTSFELRRERCIKPSGITYERKGIEEHLLERLRLGEQGQLHGPGPHDFSLPFLLVQRVGYFDPVTWSPLTQQLTPNLAMKEVIDAFIFYNGWVEDY

SEQ ID NO: 943149 - protein, 139 aa, Homo sapiens
MALQQGTHVQERLLQVMRQAGGVVLRALLLGPQKEVDVGLHGVIADTIAFGDHGPKEHDTVCLGRDLAGGEVEVHGDGVGGVHEDVGHAHQVLNGLQLQAQQVSIKGLPADGPVGCSLGWACTAFRSSSTFWCSVKLES

SEQ ID NO: 943150 - protein, 337 aa, Homo sapiens
PQAFGTMKWVTFNTLLFLFNLAYAKGVFRRNAQKNEVAQRFKKLGKEKMKTLVLIAFAQNLQQCPDEEHVKKVNEENEDAKKCVADESSENSDKKEQSLSGEKRSTIATLRETNGEKAEGCAKEKPEKKKCFLQEKKKKANSPRVVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKLCWKNPLHCRVENDEMLLTCIISCDL

SEQ ID NO: 943151 - protein, 106 aa, Homo sapiens
VEKKNPGFYVSFRFHLTAGLSRHQAQQRHFSEAPLERQPWAHLAQPRGQQEQQLFLQEEHLHFLHFQEALQAQDVTSLQEQLGSIASRGEIGVPKREQQAAPAGNT

SEQ ID NO: 943152 - protein, 122 aa, Homo sapiens
AHHGQGPAPSCRRSIKWNKELGKGGAGSLLQAGGRRRDLGAVTSPEAPSLKLYNIQVEIELVPQLGGSLQWRGGLSRPPTPWPCQQKVHKHNRRKLKNSLPPVLKKTDEQKFLVCLAPHIAF

SEQ ID NO: 943153 - protein, 136 aa, Homo sapiens
MHREAETGERRAMSPRTTLQPLEARHERPRAGRTEPTQAREASEPGASLLGLQRRPQVALCPNLSHVPAAPWPSSAAGKGAGPPPSFVPGRQGPGARDLGGGGGPQHDAAPGGREGGPLRRGRRRLPNRGTESVTV

SEQ ID NO: 943154 - protein, 227 aa, Homo sapiens
MEFEKLGKGSSGPLTSPRSFPRDALVPKDQLVEEIRHQVPTLARGSNLLLLLLLLFSSFRSFMLRTWPCRCPQLGGWTLAEWPSHRRGRPLPWELPGLKEKCCCCCCSAWRLGLQGPRFRVGVGGHWPAPQELGVVGGAVGGGVSSPPCEVLVWKVGSSGIVPGGRGGNAGAQVGNVHEGVGNAGQVRKVGWNNNFRDLGQVWHKEVVLWDLQFQPPFFAEGQGGIK

SEQ ID NO: 943155 - protein, 282 aa, Homo sapiens
AAARGSGGRQAAAEARARPSLVPPGARLAATPPPAPGPVLSRPAAASPRPPLPASRRTSAPAPPPQALAMTNFKLGIVLLGRVAGEVSGAPPPPGPSRPSRPPPWAGGSCAGRGRGGGPDPGWAPPGRGRCAAPAAGPARVLLPLAGRRARTPRLSGPPRHPPPCPAGRRAHGPLPSRVRRCVARARAAFSRSPPSGVGDPGPSAASGLPVRPHGLNTAPFPRQRHFHTSRRGGSGVGSSVPPSSQQGFRLVLTLPGVGHVRLSLRLGAEEEEAWALMLQTQ

SEQ ID NO: 943156 - protein, 218 aa, Homo sapiens
LLTPVHAGLLERTRGWSRAGTRENKKPGKKKKYWRRRKIKKSSHQPASFSLPKKHKKGEPRELWKLNSKESGKYWAWATVPPSWRMQYKSKIKKYEPEKGGICYGKARHPRSSVCCAAFVSGSIFPGAGGNKHKIILSSVYYMLMLVMVEGFGGKEAVLRTLKDTPMMVHTGPCCCCCPCCPRLLLTRKKLQLLMLGPFQYAFLKITLTLVGLFLIPE

SEQ ID NO: 943157 - protein, 155 aa, Homo sapiens
MRVLLLPLSEFCSRKVSLELRKGTWPWRERRAAITFPRADSDLLKFCAFRRRLPWAPELPTRSEPAKFTRFSFPVVRRPVLQFTPCTVTMSSAFEREQFSFRLVNSVVRIVLAKSNTLLKLFTRCTWNSVSPGTDSSPLPFGHSRIFSFFLKIFP

SEQ ID NO: 943158 - protein, 119 aa, Homo sapiens
FFLIIFTSPLCHPRATSSLVCYLDNLVCFFSGVSFFRVLVSFWLSVLVEGPGFSLFWVLCYEFWVWFFAACWDFLRCGILVCAFGGWCAHFEIYQLECSPNGKRKKKSYDSFCLRQMFK

SEQ ID NO: 943159 - protein, 224 aa, Homo sapiens
MPLGRGGLGARALARPRSLRRCWVWAPPCPGPPDPAGGQKEKREARKLGCWEGPQEGGEAFGVYEARKLVLVRGTPWGQSGELVPVRGNAGAGWGRGTWGVVSIRPGNGLRLKEDLCILGVGWGGNDGAVGGMPVTRGWESVQGALEGVRGKSCGGRLQMLGAQVLGKEDVGGGPLPPTSAIAPHPILAGSKLPWRPLTPGERNFQGTFRIFWVLRETPTNQPA

SEQ ID NO: 943160 - protein, 30 aa, Homo sapiens
MGGTNGGPVAALAVVVAMRGERRVPCEYGG

SEQ ID NO: 943161 - protein, 203 aa, Homo sapiens
MGPSCSSRWEKGWPWSLTRALRARGSCITSSSFPASPAVARLPLGVASAAVVVEAGAPRWEEPGAMEGGLSENTLRRLIFRSRCLLGTEASRSEDEDRVGIPPAHPLLSLQGCLGPGCVGVQIILEEVRLSWHSHDDGLTLALMQFVEPGDLALADLQAPLGHAAHTPLRLLAGERVQEVDVGRLLCDLKVPDAGVTLAADVD

SEQ ID NO: 943162 - protein, 120 aa, Homo sapiens
MGSRETWGWRGRPLTAQQHQAQGDAVVPGYRQDAHIASEDGRLTQVLLVGVVVPVARARSDCCQFWGPGTQYSSHCHFCGDLVGCHKLDRAKVTGPWGDDAVTPSRAQVTWQHLTLRSSR

SEQ ID NO: 943163 - protein, 71 aa, Homo sapiens
MESRKTWWVAGGHYTAQQLQAQGDAVVPGYRQDAHIASQDGRLKEVLLVGVVVPVAREDVTAASPGVLVLS

SEQ ID NO: 943164 - protein, 191 aa, Homo sapiens
MAPTLTAPALGLALGLLQARRCRTRASCGTFSRGLIKTGVELYKKPSFSKLLFNGTWTDFNEVTVRWIIFMFDRENKAGVNFSEFTGVWKFIKDWQNVFRTFDRDNYGMIDKNELKQALLGFGYGLFEQFHDILIRKFDREGRGQIAFDDFIQGCIVLQRLMDIFRRYDTDQDGWIEVLYEQYLFMVFSIV

SEQ ID NO: 943165 - protein, 124 aa, Homo sapiens
MPIFFFFFFFFVFFLIVCIVFLFDPLLPAHEHGVFLALSPEGHHSQLAHFLVRVPSSCVGLALPQDSGVAEVLVLPHSQLASARCCISGGVGSPGAQTPQGWASWVRDGDGWVTCFFGVYRAPQ

SEQ ID NO: 943166 - protein, 236 aa, Homo sapiens
GAAGAYYLAWTVSSSLYKRFSGSSCPVAWSFRIYSSSRETASRERGSATGLWCCPPAPGVQAPVDPELPALWGYVAILEREKRRGPASRAPNHILSLLRVRVRALRWVGTGPPGTVRLSRHCNGNGAHTSAQCSLLNLATSHLFTIQATFGHVAHAPLGLLGTEHERDSDRERGLVSYLKVTESAVTLVFYVDDVEPGSKKGSQTPLLEASSCRDIGSSRRFVYHSATCRSLMRLK

SEQ ID NO: 943167 - protein, 105 aa, Homo sapiens
MPVRQIRQIIMLVYYITSEQEREGWVKKKKGDRKGVGYDTISGGVWGGEGRRGGGGRAGVGTRAEEKKRQKNGGGCALGKGGGGGPGCWARAGTQTVDSCALRKV

SEQ ID NO: 943168 - protein, 148 aa, Homo sapiens
MQEKSLTTSFTGAGISVHPMPLGQRGQQDQEDHSQALGSASEPPPAASPNPQSPEGGEFLRTRSRALSFSLCFTKGAWTAPKLLLACPSGVPGPHLCSSGKKRAGTEEWRRDREAGTQRKKSGERRDIRREDPSHKERGRENKGEGGG

SEQ ID NO: 943169 - protein, 148 aa, Homo sapiens
MSCVSVRNSGAGARLSYSLPRVFREEVNEPVIFSGRGSAGHCALPLPPRPVTASVYGRLARLRGCLEDSYPSALSAQVFLDSPAVGCGLETRLFIEAALGPPCRATVTSRGHLPDISITKSPGKPCFLCEDIAQPTFASFSSLCHTRI

SEQ ID NO: 943170 - protein, 173 aa, Homo sapiens
MGTVEAYSLVRSSFSLEGGRLSSQAWDGGGYRGHSGSIMKPLCCSRVRGWDLRCWSGAVTRVEQLSHSITSPERKRQQARIQRGRPERLPRPAGTTQLPRPGPGRPVPPVPPPSHPQGPATHREMQLRKSLSCGSADSSLALLLVLTQILAFLTLSRGPKGSTCTSRASGWEL

SEQ ID NO: 943171 - protein, 61 aa, Homo sapiens
MAVPNQHWQLTQPNPVHPLNLSKHFQRPSRNGRMGYVQSLVAQQPTEARTAPQAARGLGRA

SEQ ID NO: 943172 - protein, 152 aa, Homo sapiens
PGCLHPLPGGPKAFIHLKLGGKKGGGGGGGASFGIKQSERVLGRGWGAVVLRGLRGGGAAAAPERARGGGGPVSLGGGGGELGGEGGFQRRGVTCLGRLLGERRGAGGVLGRIGGWGGGPLRPAAVAFAVPVFGSGVGPGGGEKPGRGGKNK

SEQ ID NO: 943173 - protein, 148 aa, Homo sapiens
LRRRLKIEFSASTTQFTRKAVLSPPLCGLGRGLGLSPLRAVGWLLGWQGASCDNASPLWPDYSYNNECAIRVLGRLVDVWGLLAPTGCCHLRPFRVFEKSCVKPEEKKKKKPSLGGGGGLVKANAKSQSLFYRRKSGFFSKKGGVTAN

SEQ ID NO: 943174 - protein, 185 aa, Homo sapiens
PFLKRQASILEKEKKNNKTKTKTTLVPSTLFGKGRGNPGSPPPALRRPAAGGSPAPRAPPFVGAGRGPGAAGGGLEGGGGGGGGGGGGAGLGPGVRGGLGVPRTGKGQLALRACCTRVRGLRPRQTVGYTCSKWGQGRGCCASPGLPPLGPGLPSDPPGLSLPQISGQVSTKPGCRGGGGKPGMG

SEQ ID NO: 943175 - protein, 215 aa, Homo sapiens
MQTASNSKQVTALGVLAKDLSSARELGPPAWAFPPCPPRQAKRLVLAGLSAAPPRPLSPAPLVPCPRSGARWPPTPSATAPDLSSSAGACAVPLAPPGPRRPSSRLGSCSVPGVTPSPGGRVGLSVLGRAAATRSRGCAVLLLRYMLSRNNFYFEGLFQFREASMRSVHLPGANFYSQLTHAANATPLLGPFSSICGGQMEGPDSSYSCLLILIC

SEQ ID NO: 943176 - protein, 122 aa, Homo sapiens
RGGRTPLVWGSGGGGGGPRGGGGGGGVVGAAGFSLWGGGGGPALASGVGAGAALSVSGGGVAAFLPAAAAAPPPAPGCQRPFVGGGAAGLGGGGSLVWGGGLLFRRRLCSRLLRLGFRRLRW

SEQ ID NO: 943177 - protein, 35 aa, Homo sapiens
GVWGVRLAFWAFWGGLVALLAPAAFLSPALVAPPA

SEQ ID NO: 943178 - protein, 176 aa, Homo sapiens
MSLWSEPEMQLKGKKVVHAVDGTAERDPPPELLRGGRTHPQSGRGHAERGRVQGPGEEEIRGAVEGGSPGPGPPGREDHLVVARKRKGRGRVRGEGGDDEDGKGGARAGEEWMLHGVPEEWEDGGAEEEEGGGGVWQDEEWRGRSWVGGMAKSGGVEARKEGGQAGASGEWVGAGG

SEQ ID NO: 943179 - protein, 168 aa, Homo sapiens
DLVLEDKAKLTRLFKLKALLKVSSTFLFKKRRQISIFSSKVPLIRYFLKLTQIKNLPRFIVGIPNALSSSGDIGFGFDLGMVFWQVHLVDPVVPDYLFYLVLDQATYAVVAYGYGSSWFFVYSVPKRSPDIPKSLLVAHITWVLWGSGSLSRLRTLRYQTDFSNTDSM

SEQ ID NO: 943180 - protein, 41 aa, Homo sapiens
MLYHDHRSDIKNQNNKTPNVPSNLRRITEELRIQSQKNRLL

SEQ ID NO: 943181 - protein, 111 aa, Homo sapiens
YYFNNNLNPRSSRYCPHSLPWAAFRRHLKETKPWWGVSRAASYSPKPSTAPLSLLAGWGLVPSQRRPLKTREALPPPSRLGMMRRWGRAWGTRPLLSLELPPRGQGDIKAA

SEQ ID NO: 943182 - protein, 140 aa, Homo sapiens
GVVGVAALVPGLKGALLKPLRKCIEQGSPLGIFGGVLPLVLKQLVFFFHSFVCCFVPCLGTKSGILVRFWVILEVLVFSLFGVGVGIFLDGEIGLLPGLHTENAESGLVFDSCSRFNGHFFFQQRMMFQKAEVGGIRFYS

SEQ ID NO: 943183 - protein, 248 aa, Homo sapiens
GDIGKAVVGGVFCPTLYNIEDSHIDTLYVSHVSSFVSTYWLAGQGKLGEKEAGVFAPAPGPPPGPLPLAVPWGGRFGSLVGAWHGSSGRATFPVFSFPRARGGGPFNVCARPASRCVVVGVLLFTGALRAGPGRPLRSVFSSGGGGLPAKTIKSSGVKAPPPGPPGSPASCCCLRSRAMRRAKYLERWSTVAFPVVFTYLVWQSSPFSTSPWWGRNTSSISPPGSGGLGAQEGLGGQRSPSQSPSPVT

SEQ ID NO: 943184 - protein, 89 aa, Homo sapiens
MGIGDPSCERRSKEALGEEENPREDGGRTGGLKDAGGLGSEVGELLLAPGKGPLLRQGSGPEGLPWAPFALGATEVKMTEDAECLRVTR

SEQ ID NO: 943185 - protein, 171 aa, Homo sapiens
MVCILHCTNNILLLLKENELLIGFSEIVTPYSKDFDPLAIATAEGIEALRTQVFQWCLYLLPLREEPLRALSGPGPSPAPGPPGPAEGACRWVLFLFFVFSKPPSPLRKLTPLHGFRLDRQALGTDGQAHNENAHHKCHQGPEEAMQEANLIMSALQKHIIWSLMLIKIAN

SEQ ID NO: 943186 - protein, 111 aa, Homo sapiens
HLSCEGESSAREGMSGRNQRPPQAAFQLPAAMARDCKQTNTSKQSLFSGRGDLKAHSGMCESDLKSLHSPLHAYDTNNNPVYTRLLPAGPAPPLPSCHITSSAMVQRVFDM

SEQ ID NO: 943187 - protein, 166 aa, Homo sapiens
MATPSYFVILPMAKSSLANPQFTKEKANCPSVHQYGPFGLFGAVSGGAAALGWGGHGVGPGCVFLGGFFLCLSFVCFFGFWAVRVGVGLGSLFLWSRVFLLCSGFSVLPSWLVFLVCVSFFGFRWGVPFFPLPAPLVAGSLSPPTQQYSPGCDKTLLLRSLLSLHC

SEQ ID NO: 943188 - protein, 253 aa, Homo sapiens
PVPAIRHSVLPCPGVGTQRVGGLLLGLLSGPRWGGLPLFCAVSPCGAGWGGPVGAAPCALAGAPHPCLGLDGGCDALLLVARAAALFPAHGLRLPAANVVTAQPVPGGLLGVYGGCGYAAVLPPLGLWGLGGAVLFSAFGCTVPVLRLLLVILLWCFWLVFWQVGSPVDLRVLLVGPWGLLVLGGRLFAGGLASAAGRLLPVGELLLPLRAPTLLLLLNVTLPAVGCHQSSRRAWAVVTGQFREIHAGVLSLG

SEQ ID NO: 943189 - protein, 193 aa, Homo sapiens
MVLLSVAGDPTVSSYQLRGYCSVQLVILSPRFYHLYDVVIFCACSGWAQGFYGPERRKKLLLLHCAPLAGPEKAPRVSTLVRGAWQPSPQNSGPPWPEGGALLAAPTPFLLLPFMAAGLGSASPPRLAQLLAWREARQWKQTPLRLQGWRVKGAVLPGMAAGAGYRDALDLCLGGQPQLHLASSHPANLEEAG

SEQ ID NO: 943190 - protein, 187 aa, Homo sapiens
MVGAWEIGVLQRAPNTISPLISVTNVESYLLGGTGGTDGGTFILLGTPLSIPASLSCSLEMDGSRRGPQSAGAAGTPYGTSLQGEGRSVLAAVAHMACLHCNHRLGCSQDLVSLEDRSDVWPIQSFRPCLKLVSYVNLKNKMHFYPDLAPRTGTTGPRQIRSFPSTDRCVEFSTTSDSMHSDLSLSI

SEQ ID NO: 943191 - protein, 112 aa, Homo sapiens
MGGRASPCINQQAEVGGLCELLFAEERLGAESPGGPPAPAPAAWFFGLWPKPRFLVTTTPSLPHPLTHPPTQSLPTLPQPEPHNPPPSPPPPPLLPTPPPLPPSPCPRPAKQ

SEQ ID NO: 943192 - protein, 77 aa, Homo sapiens
MVAFRFDGTCDGAVIFQVLGGKLHEVRGILGSNEVQDLSDKLANDCNVSFQLFSDTFGCNCQQEVHNLDLAGEPSCP

SEQ ID NO: 943193 - protein, 189 aa, Homo sapiens
SYDPIWGIFYHGPRSLHGYSQGLGPNFQEKNHKEENEGGYENPPVENEKAGTEKKKRGKKTMQRLKELGKNWWKVARYTSKVTGLRMARLLHWQPLPRAQVLIMPAGVIPSTPYPICLPYSIPPSSHPAVAGLCLPPVAFPTTVGYMVPYTFFDFSCVVFDLFVFKAIQANSSRGFDWGGGWSAGAGLL

SEQ ID NO: 943194 - protein, 114 aa, Homo sapiens
MCQQGGWVLVTSWWAWPTKRPSGLTRPYLAAWQPGDEGGRTLTVRKSGAGGVILAMAREGKWWRAWRGLWYYSDLLGRWGGQSKPACWVVACHALFLFFLDLVLRGFSRLQKYR

SEQ ID NO: 943195 - protein, 95 aa, Homo sapiens
FLHFQCLTLIFVSAPPFATAFFPPQKNKFWLVLWLDGFFSLCWHFLCHVLLLAFSLSGQVFNVHQHGILLCVPLISGKQLGQLFIAFLGVAFGLL

SEQ ID NO: 943196 - protein, 169 aa, Homo sapiens
MTSWKNLKNELSEEIFGKDPPRLLQTLSPGPPGSATLPAVSICGPATSHSTRLFGLEEEQLLYPNGTAKQIPLHGPCKVILGSSVKATDSSAGPQGPPAGRLSAGWREEGTELEAKGGGQLGAGAPSPFQNRARYSLLTLRKYKNSFHCRSIPGLKPWEEFTTLKSEVK

SEQ ID NO: 943197 - protein, 80 aa, Homo sapiens
MTLEMHTKPNNVSSAEENSYEKVGFEVTQRKGITLEETRSSPGAMRGLEEQRARGALGPSERALHRPCAPYLCRHAHRSP

SEQ ID NO: 943198 - protein, 267 aa, Homo sapiens
IPIQILELGLLLTSPVNVQAALDREAGPALTGAEEEAPSSLVVGLLTTSESWEALEQLPQIHVPFVWGTPEWPLKATDWYKERIQMLASKTLSMEQGASAWGMFAPSYKLIDLVMFLDFWRWEEMANYTASSFPNLLKTNYGGKENQGMDGCAPQFASTAPKLTNPGVSQKGGGDEEIGMQMPFGDFELFWPLSHFRAHQTGRAKRSHHECQIDWYWLPRTLCWEEFDITHVLHLIGDVCHGHSHSPSLIFKLGCPLSLNQRQFTSL

SEQ ID NO: 943199 - protein, 121 aa, Homo sapiens
MGGGVPLDRMPLSMVNSPFPQRKWRKGAKKSMNPWNIVPESFQGWYTTGHQSTNVTGKGSSNRGWGWVGSSAGCFDPSSSFDLSLGWGELAWLSGRVHGGGIWFEHFLITGVGFFSTIIVK

SEQ ID NO: 943200 - protein, 133 aa, Homo sapiens
MGHAPPFSAGEGKRTFIIESLLVLREAARVVGSGIRGRGVVESFSVSGGPGLGVFLKDPGQELHDLHLGDFGPGAPKELVLGRLHVWDALVLQVIHLDELLSDELPHVPEVGVLLPGPQPRMRTVSRRRSLWR

SEQ ID NO: 943201 - protein, 200 aa, Homo sapiens
SWYCWYSDTRSFMLLSASVNSIWYMFSPVYQCWVVLYRKMEENWSEMGFFSSWLGVLLLMFVGFRPGGGMLHTAVFTLLGIHYTKKLLFLFCTLSICSSTSFMDMRPRKMAATVSSGRGAGSEAAIMFLESNICWVSSGSERPVLLAAPAGQGRDRGMKKCRRGKGTCSPPACAGLRSLAREAQQVVTRSWWATQVVEVP

SEQ ID NO: 943202 - protein, 73 aa, Homo sapiens
MREATGTKPGGSTAKASPGARSTTKGSASIWSTAEASSCARSTAEATGAWSTAEANTSAWSTAEANNRTGSTT

SEQ ID NO: 943203 - protein, 100 aa, Homo sapiens
EKAFENAPMDPGTRSTVAARHRLEASGVLEVRQVSQQHCWEDLGLTLLGLNIGRVHAMAFEPVSKFGGWEEDESAWASCGPSATPMSKVWFKNSSRSPTP

SEQ ID NO: 943204 - protein, 272 aa, Homo sapiens
QQSDTLDRAVEAPMGLLSADVVSQLVTFRIDLTHPPPWAPGDPGRGLEPPDTRRGGISPRAKPPSPPSLHIVLQAARQPGRLALHHNPDPPLPAAAPPQTIPDTQGLQLCLFSHPSHLIQVAPGSLHYLAALLLGHKGCTFAGLCTAGLRTCKGKEAWFIPAHPQEPHPPSPASRAACSSLLSLCKGRAGANGLSLQQGGYDCKGTASQRGEKRWAMVLPPLSPHCNAAWGEVGALTCLASDAKCGQGQEGEECEGSHGVSVAALGCCSGLS

SEQ ID NO: 943205 - protein, 117 aa, Homo sapiens
MDGSRTEAPCWSLSNSGCTELWGGVVAQTWAFLLSWDTEISAPTSLLHYGVSLWCGLGGSYQKRKALATATSPGGRTDLWPAFRQEGSWPCLADRQRLAPQREGVVGPSEPCFQPIW

SEQ ID NO: 943206 - protein, 157 aa, Homo sapiens
MVERCPALRKSPRRHALIIVQLFHCLKHGWSYTDDNDRDGQCGGADDGLLGLVSVISVVNIVLGAIRDLGCCPGHLDEDRGKGGGPELHCAQLEIALQHTLDARTVGVLIIVVFGELVGDPSLWGQLGPKAISWEELITVIVLDDLSHCLEGHGIGR

SEQ ID NO: 943207 - protein, 255 aa, Homo sapiens
SPSSSSNSPCSSTVVSWYYWYSDTRTLMKSFASKKSISSKDSPVYQSRKALPRKKAVNCSEMRLSSSSLAVLLPMAVADIFRPRGGMSHTAVFTLLGIHSTMYVVVFLLHVDPFLFHFLHGHAAPEDGSYRQEGGRGAGSRLPSCSWSRTSAGQTRAREEPVLLAAPAGKGRDRGMKKCQLGEAFSPPSCPGLSELAREAQPGGDPAHGGRDQVVDVPVRLGWSSSGCGKDVIKGLVINGVGFICVFHQLVDPRG

SEQ ID NO: 943208 - protein, 131 aa, Homo sapiens
MLFRGLHQVTEFLVAAFLSVLFALQFFGVHIPDVKNPIIGACKCIVSVRDGQSFGPVRTTLEAIGPEHLGGVADKKVDDLECVVSGPALVQLVVAAQGGPALHRLGAVGPPAVPEPDFLVIVGTNDDMVPT

SEQ ID NO: 943209 - protein, 116 aa, Homo sapiens
LVPVGSRSYLGPSYLPKPTRPLILRLPTLPTTIKANSPVTLCRLSQLLHYVGIISLAGVEACTVALDFFSVSLALPSFLPKRGHSLMNVTHWHNFCLSAGISWELGGTPVASCGPL

SEQ ID NO: 943210 - protein, 161 aa, Homo sapiens
MWALKARAVRLPRPPLPGSSGFFPEHGSGWGRRAGWATRSQMYGGNRSLSAENGRRRRPPVLLSGQPRAWFRPPHPANTLWGPFDCSKPGLLFSRGRGSTGSCPSWAPARPCRAHWEGWNEPATEGQQGGARGYRGGDGRRTCTHAGVEAQGSQVLAALQL

SEQ ID NO: 943211 - protein, 256 aa, Homo sapiens
MLPGDNLNEGARRQGPPVPSAAEEKPGKFPLLAVTRLLQPRSFMAVHCAWRVLVTGFLRLAFMGLERVTCARALLRGVLGRVRGRRSPVSPGPQWHLEAQDLWEAQARWEHRPGRPCWCRARLGVLGAPGLLQARPALLLPRLCLLCHPGFLWARGLPAPQWDRGIQGVLERQGDQWSLGVLGARGAAGPGRTMDPGAKGFLRCAANCAICSLIIPHTAPDALLAGLLPRNSRLPRDARNTRDALQAQRTGGPGDT

SEQ ID NO: 943212 - protein, 145 aa, Homo sapiens
MLLSASVNSISSMPSPVYQCRKALRRNMAVNCSEMRLNSSWMAVLFPMKVEDILRTRGGMSHTATFTLLGIHSTKKLLFLLWMASICSSTSFMDMRPRNTVATSVAAVARVAGGHHVLGIEHLLGELGHGQGPVLLAAPGCPGGD

SEQ ID NO: 943213 - protein, 274 aa, Homo sapiens
RIQGWGRLGGVGGLEAGAWLLGDVQSSSGGLQLILGGPGLRCPRKYKTNIYFSLFPVLFVVFLLPFLRHAFHKFEFLPGDFYRERHSDGIRVKGLQGHLSDTGGGEGVRGVGGDRGDPQIVLVFALREGCQEGHPVKLLVQLLQQGGGVEHLPLEDFSSSLYFLVNLSATWRDSSSSRAQLSLGGVVGGTVHRQDLPALVTLVLHPQQPVELWRISRHTVLVIVAFSYEFCWRVLEGRAVEVDVHGLLSLVYHLKEGLEHGVEVQGLYGEKGIK

SEQ ID NO: 943214 - protein, 260 aa, Homo sapiens
MFQNALECKDKKFSKISTNLYKPGEEEPFYFKETCSDENGESLSSVSLCEESTIQGLKRARPQGYTGKEDGEKVEGFQGVPFLSVYLLFVLEGPGEEGELGEGGWGGRGFGGRGGGGGGAWGEGSGRFIHFRRTFWVTSIAIEMEHNLGGGFSQRARGQGGGGGVFEVPEGDGLDDVSGTGSPLGDLRIPSSPSSICMSLKSAFPTPTMMTDMGRWEAWTMASRVSAMSVITPSVRISRMKYCDASLVLVSSDADLATFW

SEQ ID NO: 943215 - protein, 130 aa, Homo sapiens
AAHPDPMNEMKSKTCLQGSPGEPGWVLWASRPGALGGSLLALLPSSLGGSSCPSSPSGSVSSSLFLSLWGVRLWAGEGAPGPGGPWAGDGVGVGALGLGGVLFGGGADSGGLLSLGAPALSALGGGGLGG

SEQ ID NO: 943216 - protein, 147 aa, Homo sapiens
AAFATSMPSSRLAATVAGCGIPDSKGLRKYGNWWYRSLEIHKTWQLRLTPHASDSSCTTLFEEKIDKKGKRTPFPEGGTFKKELEAEALAAGGEPGLVYYLGLQLRLEPADKTKKPPHPNRIARKDLRGTKNRKSKKQPKAQGTKKP

SEQ ID NO: 943217 - protein, 198 aa, Homo sapiens
LGAGERDMELEGSGEETMRVLGEARSSSTNSTGTNLCVFPGIMYKFRVFDAFSPLLSLPLRAAHSGGILFFHIGKFCCVEEIFFVFLFLPHSLDFGFFFLFFVFFHVSLVLGGPFAFLPGLRSMAGSLMICCTSGSAMARGFTSSGLSCRLYCAIIQRWQPSAASLQLVSRSRAFWYTSMALVESFIASSAGLSVYNP

SEQ ID NO: 943218 - protein, 78 aa, Homo sapiens
MASMRKGWFSATARRRASFVALYTANTSLPSTRIDMMPYPGPRAAMPSPRYCSQVGVEMASSCFRQKKMMGHSSVAAS

SEQ ID NO: 943219 - protein, 43 aa, Homo sapiens
MAQEDNSERERWQHLADLADFALAMKDTLTNINNQSFNNFMLR

SEQ ID NO: 943220 - protein, 163 aa, Homo sapiens
FSKRLTVVAFGWSNLILSNIPIFSLISSNYNSNGKLFLLVPSAVSLSNKLQWLWPQFLWWSPLAHSPPIPRACAPVALLGASVLPPPSASLPLASCYFFSLSFLIREEAFLPREPSVRWHFIFFFFETEFCCCCPGRGAVARSHLTVASAFWVLAILLPRPPM

SEQ ID NO: 943221 - protein, 180 aa, Homo sapiens
MGMETRSTALSVVGRRRTEAKRGERRTQGFVFLKGDVRKCYESRVAFAKVLRSGGDRALLPPRLAPPALLIWVQKIARERAVLVIIASVSLPAIQLHIHFVPWIQVQHHAVTGVVVVLVGVLCNGAGPDLPVLAEVRPHAGAVAAAHEDVVGEEVDAAHLAAELARGGVIVIAEVGDHVI

SEQ ID NO: 943222 - protein, 292 aa, Homo sapiens
AQTPPGYRLTYSAQAPHHSYTRFIQTTPPKRGREENYSQRTGLEDDNDSKQECSLEATSRLNNDVCLDAVWQKRGVLGFGGSRGPQGAAAGWDREHSWGQTRATSEVKAITQESSAGLEAQGSCAPQGKGEIRTVGPFLVGESGLPTERAPFLVRVLPGPVHHLNPWARGGSFVFGWVDPSLAQMQDSLTKLSGGVGAGGLQELGLHTLTRDRTEQMSAHTGTGNCTSTAGKQHGKCYAWGLGLKASSSSTCMGLFTPPKLLCTAMPCFWSLLGAKWPTLRAEGQTLGPGHT

SEQ ID NO: 943223 - protein, 293 aa, Homo sapiens
FGMAGLTISKISLVGDTTGTRAATGAGTCSTKAREEPKCESGGEDGTSPEATTGAGTGTGTVIGTGTGTSAGTATLLGFGFSFCSSLDVGFGPGSDISFVPVAGGGSILRAEANAHSSSNLGPSLGFSCSLSCSLQIRFHRLWVLSCPFLGILLLYLAGKLEDFDLAGLIVRAQAPEELIFRGIAIGDSGIVQVLLLHKLISDELLHVPKESMMYPRAHQTCADLPDDSLTGPISIHEDDAKKHMSRPAWVSLSRSSMPASVGLSVRECTVVFLSFLQLNPILLQDSCSFMIR

SEQ ID NO: 943224 - protein, 149 aa, Homo sapiens
MSQHGLLCRIDSNKPFLVVSKLLSYGPRIQIGSVNNVNDARTTLFSLLEWKQNEGAPKALQTPRPPPLGPAGVGHSSHEEQAAGAMLVDEEKKGAVDSEADLGGQRHEPHRGHSGGLGAFLVHCDRALVLEQVDGDPFVLDACHVVIFV

SEQ ID NO: 943225 - protein, 258 aa, Homo sapiens
MALGHLLLSLLLELAARRSAVASWYCWYSATRPFMWLSASVNSISSMPSPVYQCRKALRRNMAVNCSEMRLNSSWMAVLLPMKVADIFSPRGWDVTDSRFHIVGDPLNKIAAVFVLDIKHLLIHLLHGHAAPEHGGNRQYRPWRGSQAAIMFLASNICWVSSGTVSARYCWLPRLVSGAKRDEEVQPGKRDHVHSQLPQSSIELAWEAQAGGDPTHGSRHQVVQVTIGGRGQLEGSEANVVESFVINAVGLVCVFYEL

SEQ ID NO: 943226 - protein, 167 aa, Homo sapiens
MAVNCSEMRLNSSWMAVLLPMKVADIFRPRGGMWHTAVFTLLGIHSTKKLLFLFCTLSICSSTSFMDMRRKMAATVSVAVARVAGGHHVLGVEHLLGELGHVSARYCWLPRLVRGAAGHEEVQAREGHMFTASLRRSAFTGPGSAAGGDPLMVADTGGGGPVVGVVS

SEQ ID NO: 943227 - protein, 62 aa, Homo sapiens
FFCPSDDLKLLKNGKIQSVKGLAVSDEANYTQRVGLKQLFDYGYKTEYVSKIPKIQETYNIK

SEQ ID NO: 943228 - protein, 155 aa, Homo sapiens
FNCSQVSVQVNLAASTHTQGEQKPSYISSWGTKKEERGARRLIIQHIKENKKILKPALRKMFAFTTNLHERRDAITSPVSDLGSRTGTILLTTRTWGVFLSWAGTSCNNAFHFLDDYYKEQKCANRKVSRAHLVDFGGCSLQPPAVTFTVPVFKS

SEQ ID NO: 943229 - protein, 151 aa, Homo sapiens
MEGPYSSYSCLLIHICWKVDSEARMDATIQTEYLRSGGAMILIFMVLGARAVISFCILSAMPGYMVVLPDSTVLAYRSLRMSTSHFMMELKVVSWMPQDSIPRKEGWDTPPDTGTLIANGDDLAIGQLVALLQRRGGCGGGHLLLEVQGDV

SEQ ID NO: 943230 - protein, 115 aa, Homo sapiens
MDWGGREELLARRRLGSLGIKPRGFSILCARAKIDLGENEEVTSKKIVAGERWRRAIAKGREECLLDNFCVLRDALVHSNWKRGVARRMERREARPSDSTYLKRLSPEDYVNTHP

SEQ ID NO: 943231 - protein, 221 aa, Homo sapiens
MLIALFFLAFPLFVGGGVLVFLVFGHQVVDVVVGFGGFHFVDDLALYQWRKDLGWNMAVKCSEMGLSSSWMAVLLLMKVADIFRPRGGMSHTAVFTLLGIHSTKKLLFLFCTLSICSSTSFMMRPRKMAATVRSGGWGGSQAAIMFLESNICWVSSGTVSARYCWLPRLVRGAKLGMKKCRRGKGTMFTASLRRSAFSWPGKRRQVVTPLMVADTRWLRSP

SEQ ID NO: 943232 - protein, 246 aa, Homo sapiens
GGAERWQQRAARVDLGRWGLCGGSRGQRGRDVGGSQLAQAGCQVAQQVVSSFGGPGLAAGQEFIYLFYIFFESGAVFSQKDGLSSDRGLYLHATQAPQFFMVIFIFFAFSSFYFLYSYGGDMWDVQVSCYPDSGSRAFAPDLPLFLGLQDEGFYLSYSSRYISTRGRFSMTGLEDCGSGTGCFPRPSRPPVAPLTPGRDPTLECSAALRGLSGVRLELAGAPAIGEELGFPGVSAAMVRPRLPVPG

SEQ ID NO: 943233 - protein, 109 aa, Homo sapiens
SSSDSPSSSAVASWYCWYSGTRSLMLLWASVNSILLLLSPVFQWWMALGRAMAVNCSVVGLLSSWMAVLLPILVAGIFVPPGWGVTDSRFHIVGDPLNKIAAVFVLGIE

SEQ ID NO: 943234 - protein, 187 aa, Homo sapiens
MSHRKCYSVYINPTPYRRQPPPGTLPPSWLPVPILTVCCAQALPSSIVVHFVCISTDLFVFVFFCQSLPSLFASLLVLLLFVSFFFGFWGRFRLPGGLPEFLSPRRIFDVFWGDIWVGHVGGGNFCDFSWVLLLGVCGFCFVIAVCFFLFKSWFWPRPHMGAHQRVSFFCFLPIPPASCPEQEDYIT

SEQ ID NO: 943235 - protein, 111 aa, Homo sapiens
YKIISSSLKHFNNADRFHFANTNKADYTMFEKQALFLDGLSLYICLTAHHPVTVSSSISSSPSSNGDLGQGGVCAECSNPFSVSTSARVEAFEMGFEIASTSPGEGPPFFL

SEQ ID NO: 943236 - protein, 269 aa, Homo sapiens
MEIFKLPRQTSYRGPPPLLLWHPSTFDTHRRVFVHIALTLGELHLVHALPCLPVEEGLPEVPGSELLRVGLYDLLACFSISNEGDFYLLATRWDFTDGCLDIFGDPFHKVAAVLILHVKHVLIDLLHGHPTTEDSSHGEVSAVAGVTGSHHVLGIEDLLGEFRHCESSILLASTAGERGKARHKEMETWEGDHVDCQLAEVSIELARETEAGGETLMVAEDKVVQIPVVWCGQLQSAEQYIIKGLVVNAIGLISILYQLMDGEGGMVGL

SEQ ID NO: 943237 - protein, 92 aa, Homo sapiens
VSWYFWYSDTRSFMLLSASVSLFMIPVYQSRKALPRNMAVNCSEMRLNSSWMAVLFPMKVEDILRPRGGMSNTATFTFLGIHSTNSCCFSGW

SEQ ID NO: 943238 - protein, 194 aa, Homo sapiens
MAFHKHEATIATKPSHTYYKVELKDMYRVLNKYQGEQLTSIQGQNQQQVLQSSADIRYKLQGQFLFEGLFQFGEASMRCVHLPGGNFYSQLTHGANATHLLSPFREHLRWTMEGPDSSYSCLLIHICWKVDSEARMEPPIHTEYLRSGGAMILIFMVLGARAVISFCILSAMPGYMVVPPDSTVLAVKVFADVH

SEQ ID NO: 943239 - protein, 83 aa, Homo sapiens
YFALQKGKWRQVNLQDIWNQNISYHNQCFAHETIHRYTKDNTPLFRHYSTLPKASEILGDGIRGGLLGASGLLRQQNRGTIFP

SEQ ID NO: 943240 - protein, 130 aa, Homo sapiens
MGSVGVFGEPRLTDGDERGEQANGYFTYARGVNILYQSRYALGSKAKPLVDLLANSKAVPWVRLFSSKKCTGGILLAKRGSEMAGGKGTRVGSGNFLQVKHSRDSHPNLQGKPVDGEGHQSGLNKGGFKG

SEQ ID NO: 943241 - protein, 220 aa, Homo sapiens
MQCVQKVTFKSLFKGFGLGVSGHHSAPHVYVILAFSSVFMYFVCCYFVVFIFTPAPGPSPPGGPRGPALGWTLVVSFLCQVFVAGSPPPPGFVPEFFLTRLVGASSPRPRPGPPRIPLVRRPWRRGFVGFRSLWSFLLLSASVNSFSSMPSPVYQCRALGRGGRLLGALAPAPGWRVLLRWRWASSSRGAGCRTRPSSSCWGSIQELLLFLLCQLKHCSS

SEQ ID NO: 943242 - protein, 205 aa, Homo sapiens
KAGCGERDGSGGLDTAGFGPGRHLPFIPVASSFTWGPGPPIPGGGFSIFGPVPGLWRRGISITRTPGRSFCSGAGWNSMSSMPLPVKRKALHRKMAVNCSEMRLKSSWMAVLFPMKVEEILRPRGGMLTAFTLLGIHSTKKLLFLFWMDSICSSTSFMDMRPRNTVATVSSGRGGGSQAAIMFFASNICWVSSGTVSPRYCWLPR

SEQ ID NO: 943243 - protein, 133 aa, Homo sapiens
MRESQGAVRRKGARASPQGGSVWRGCCPGQGGEAAAVAEWDVRRGGVLVPRHEWGDGFCARNWILGMGAVGFDSGGVEAGGFLLIFVAEGPSASARVRRGRPLGITFAPPSGSPLFNGCSLPPVFPGSMPWAR

SEQ ID NO: 943244 - protein, 195 aa, Homo sapiens
MFMSLWASVNSISSMLLPVYCRKALRRAMAVNCSVVGLGSSWMAVLLRMFVGIFRSRGGILHTGVFTLLGIQSTKKLLFFFCTLSIFSFTFFMVMRLRRMGGGRVGAVARVAGGHHVLGVAHLLGELGHVSARYCWLPRLVRGASGHEEVQAREGPMFTGSFAQVCVQLAREALQVVTLLMVADTRWLRSRSGGW

SEQ ID NO: 943245 - protein, 211 aa, Homo sapiens
HQPYFGGPGQYGSFPGPSSSRQATLCQGKRPQAIHIACEGGPPALHAQTQLLEDYFGIDIKGEFFVGWWVELGSAVGGCVHKQGHGGLVMGLGGASVRVKECSGFKNFKGDVKKRKCFVKNVVNEEKKGKWLQLLLDEVEVLGYHCVAFLRALEVPSFKIGIMKPCPLLQQAAAQVFWVHVEVSTQQNHVCLLGCVVDDLGQFPSLGHTMC

SEQ ID NO: 943246 - protein, 104 aa, Homo sapiens
IFSQSTFNHFSHFFRYTQVAAYYGHVSGWWPGKDPSPCLGRAVAVGLGLIIHFVCVHGGGVYRPLGDGVPKFFFLCFFGFLLGVNAFTGAGSVFLKGLLLAGLV

SEQ ID NO: 943247 - protein, 304 aa, Homo sapiens
PIFVVISSKNRVLRTKKTLHILKMYTFAGVDAYRFQLKASDSPLCSGQRHLPGEETGSWGLAFPTLTDPQVKKPGSCQPLEISQYIFFFFFFSLHFFLVAGHPVSPGHSVVFHKPVLTLATKNQATRTKGELKVVYRVLNKYQGEQLTSIQGQNQQQVLQSSADIRYKLQGQFLFEGLFQFREASMRCVHLPGRKFLFSINPCRKCYSDLLSPFRSICGWTMEGPDSSYSCLLIHICWKVDSEARMEPPIHTEYLRSGGAMILIFMVLGARAVISFCILSAMPGYMVVPPDSTVLAYRSLRMSR

SEQ ID NO: 943248 - protein, 257 aa, Homo sapiens
YFFYYTKHGDIASLKRFQTRWGDETDDGDKEGREGALRAEEERREGGRGEGLLPASMGRNILEAFSIFFLRRSGRELGARGVRLPRPPLPGSSGFGPKQVLGGGERAGWATRSQMEGGNRSLESANEDLIRRLRVLFLLSSSQPRPSCRPPHPAKTLWGPEFHGCSKPGLLAFPRAGRGSTGSCASWAPARPCRALLGGLERAGHRGTAGRGQRIPWRGRAEDVHARWVEAQGVTGSGTLQLVWALCVRGGRHCIST

SEQ ID NO: 943249 - protein, 66 aa, Homo sapiens
WAQVGVGEAVHPRRSWGGVGSGPCPLRVDRQLPDIPSLLGSVVGVLRNLAFPPPPSPQPCPGQGAG

SEQ ID NO: 943250 - protein, 274 aa, Homo sapiens
GGKGALGRGESRVSAARWLRGFRHCWLLPPPPPASHSSCQQLHLLPWASYSSSSSSYISPSSSAVASWYCWYSDTRSFIFLSASVNSISSIPSPIYQCREALGRNMAVNCSVMRFISSWLAVLFPMKEEDILRPGGGMSHTATFTLLGDKLHEVAAVLALDEQHLLVHLLPGHAAPEHGGHRQVGGRGAGSQAAIMFLASDICWVSSGTVRARYCWLPRALRGANGDEEVQAREGPMLTASLHRSALSWPGERKEVVTPLMVADNRWLRSRSGA

SEQ ID NO: 943251 - protein, 101 aa, Homo sapiens
MSGVVGGKINRKDIPEFVKLVFHPKKPVELWRISRHTVLVIVAFSYEFCWRVLEGRAVEVDVHGLLSLVYHLKEGLEHGVEVQGLYGEKGIKLRTMRDLGK

SEQ ID NO: 943252 - protein, 249 aa, Homo sapiens
ETPDTLKTENIVIHIIMWGSVSADRGCLRALSVPSKIAPFTPFINAAAKGREKRLSQRGIHLEHESPPKSCDMFENVPRGKELNGKWIKKARESEQDVVLKENGEDVDNEPPVIAQGGKQPRVRRGEVEGIDAVLVLLVGGDHVVLQGLLALLFRTVVLLVTDVIVVYKVAEGSDEMDTMLEKDDSAVTAAREDQLVMRVVVADVPHPVGVLLQGLHGFGDISDVPELHLTVVYAAGQVVLLIGIKVKV

SEQ ID NO: 943253 - protein, 144 aa, Homo sapiens
MGLPGTISTMAASPDFKNFGASSSFLPERRSIFSFSSANLHAMWAVRKSNDRGMAGAYLAWVVQGNHLACEASSFHWWVIFAVTSYVATTNILDRHILDIEAHIVPRKSFTQSFMVHFDRVYFLCNVDWSKGDHHTGFENTSLH

SEQ ID NO: 943254 - protein, 204 aa, Homo sapiens
MAVKKKNKMSRRQRTVRFCWSVIGGPPELRTVSKCVSNITVSPMNKSTLKWKLEKITGGKELLHTKLREEQKKLLFQLEQLCIQGHFVRLCCDVNVQQQQEEAGVGTELRCQLVVVRQQGEELNNKKNAGRGVSGLKHFGSTWNTHWNLGKKSQEVFSANFTKTLRHWGQDTGLKVTCCCRRESQQVKKHLQQWVLSLVISNPP

SEQ ID NO: 943255 - protein, 114 aa, Homo sapiens
MRFRKMAPQKAGRLATAAAHVEMSSEPMPRKINFSGAVHNSGGGYQTTCLYFSSSLFAIPCRPGPSFPLLFFPPRHFPSSPPPSSSPPLPLVPPPPPPPPPGLTTTSPWAPLTF

SEQ ID NO: 943256 - protein, 267 aa, Homo sapiens
RGKTEHHSLQVETPMLEDNRSSLRLHDFSEKFLDIDLALLFLVLPLFVGRGVLVFLVFGYQVVYIVFGFGEFHVVPGLARVPVQEGFAPEHGRELLGDALEQLLDGRAVADDGRHLQAEGRDVAHGRFVVGVLFHDYLLFFFCFCFFLFTFFMDMRPRRLGTVSGGGGAGLQAAIVFLVCEYLLGELGHVSARYCWLPRLVRGAKRGMKKCRRGKGTCSPPACAGLRSAGPGSAAGGDPLMVAETRWLRSRSGEVVSFRVRNRCDTG

SEQ ID NO: 943257 - protein, 168 aa, Homo sapiens
MAVNCSVLSFFSSLLAVLLEMKEAEIFRPGGGMSHTAVFTLLGIHSTKKLLFLFCTLSICSSTSFMDMRPRKMGATVSAAVARVAGGHHVLGVEHLLGELGHVSARYCWLPRLVRGAKRGMKKCRRGKGTMFTASLRRSAFSWPGEAQAGGDPAHGGRHKVVEVPSWG

SEQ ID NO: 943258 - protein, 135 aa, Homo sapiens
MGKENAWEEAKKKVGVGARPSAPRSLGSAYGFPGMDDSSLPSPQSTGQGDSHAWAAPRPRLTTMWSEAGVRGGGVLLVPVDTIPMTVLYCMLEVKVEVKDIKAVVPGQRRLVEVPFNHIPPQGACQGLELWQEET

SEQ ID NO: 943259 - protein, 250 aa, Homo sapiens
FFYKYFKYYIDVINITKKEKKNDRQHLRAPTQRTPKVDHVSFLPLPVYAPGKAPTPSFSSSAFPNPFRGGIFSSFYFSSFLFSPSSSAVVSCYFWYLDTRYFILLWASVNSIFFIFWLFFQCRKGLGGNMAVNCSEMRFISSWMAVLFLFVVVVVFRARGGMWHTAVFTLLGIHCTTGFFFFFLLLSFFFSLYLWTFGFGFWQPPSVAAVVRVAGGHHVLGVEHLLGELGHREPPVLLAAPAGQGRDRGM

SEQ ID NO: 943260 - protein, 95 aa, Homo sapiens
ATAQEFWGLGTEKGSFLLHPNLGCLGVGWGERALRRLLGKSLLFLLGAEAPPLHKGVRTCALIKHVHTSYYHTQAMFLISGLYCGVRYQPQSRGV

SEQ ID NO: 943261 - protein, 281 aa, Homo sapiens
GGGDERARENLKKTMLFSIPMKGYCPGKNPTPSLSSSVFAKQSRGGYAYFLFFYFFFFNCLLEEEAWYCWYLEHQVVYVVFGLGEINFVHAIERVKVKEGFGLEHGGELVGDGFEEVLAGGAVGDGGGGDFEGGGGDVGEGGVHVVGDAFEEVVVVFVLHVEYFFVHFLHGHAAPEDGSHQSVAAVARVAGGHHVLGVEHLLGDLGHVSPRYCWLPRLVRGAKRSMKKCRRGKGTMFTATLLQVCVQLGPGSAGRWVTPLMVADTRWLRSRRWGVVIFRVR

SEQ ID NO: 943262 - protein, 111 aa, Homo sapiens
ELQVTTVTISSTTTKVSERKWLLHPSRVVYKIPNKNLGITLDGILTSHCWGDFESWLLGGVYFLGTFGERDFFGVTIRLLHFAINSMGCKKENLHFNPLLGCFKLSTEQLK

SEQ ID NO: 943263 - protein, 306 aa, Homo sapiens
MCILIIRLTQLKNLILFLLFLYSSSSSSSPKSSSSSSVSSFYFLYSYTMSFIFLSASVNSISSIPSPFYHFMKSFLRNIAFNFSYILFKISFISFLFPINFTSIFMPLFWISHTALFTFFCIHSTNYLLFFFFTLIIFSSTSFIDILPRKTSATVRYRPLRGSQASIIFFSSKTFWFISVTFISRYFLLPLLFIWAKPVINKLRRGKGTMLTANLRRSALSWPGKRRQVVTPLMVAETRWFRSPYLVWSASECGTDIIEGLVVNAIGLISILYQLMDGEGGIVGLHHGVRHFVVKAHTEGIMMRSG

SEQ ID NO: 943264 - protein, 140 aa, Homo sapiens
SSIKKEKTFADILKPTLLYNRFEDLNLKMPTWIIMFLIHIYFFFEMESRCCPGWGTVERAWLTATSASRVQAIIQSQPPKLLGITGVHHHARLIFLCLVQKGFHHVGQAGLMHISYRYIGKLLPNHNKHCVQVFKMSLDT

SEQ ID NO: 943265 - protein, 105 aa, Homo sapiens
MGDYENDCAGEASGGLDENGCYYEGYVADEEYAMSDFRSVCRRQMELVIIMPHRDEYKEGVGYVFCKGVENECKEYYTISRLVLKILRQVLLTQEGGFDMGFRES

SEQ ID NO: 943266 - protein, 177 aa, Homo sapiens
GATSVACLLRVINCFLLGCRLLPLGNTGAAGGLFKIVTHHTPPLEEDFFLLGLEKEIFGSSILFLLGDLLGLLVFVFFEFFTHLLTLLWGTFVVFEEERASAASRLFFFFKRFFCCFSSFLVNLSSRFLCLNHCFLHDIQILSWYLSSLIEGQWLFNLFSKLLPEYTRGHLREAIDS

SEQ ID NO: 943267 - protein, 251 aa, Homo sapiens
WHMHYTPINSQLCLNNVVREAKKRRIWNNAPGVPPPISLNTVTFRRLLARGMLGGVNASLCWVGEGVGGGGGGGGGIGAPGHCALTQRRVLISSGGEWEWLGRDSVFTGCEENIVKMAIPSDVIYRFRAIVSGSQRGFWETEGLILSSYGSEGLATVLGESIGELTFFSFTAYYKSTVIKRVWYWHKTNRLLDQYNRTDLRSYKLVLTYMVNDCSTRWPSLVKGGKNSLFNSWMSVHRREIRPLPCSIYKN

SEQ ID NO: 943268 - protein, 320 aa, Homo sapiens
MNTILPGFKKNKTKTFRKCSTASRLPALPLTSCAWALPLCPHPSFPQIVWVAVVCWDVVGDSQSRVAQVAQEYVGTCCGVGVCVLVYGEGRGVGGCGVWEGGWGEPDEMNRKGEKTQTTELPTLTYLSQRRKSEARARIMLSAGGVWGQAGGLREEAGKRARSTDVRKRRQVTTEKREVLADQDAEAAVAAVPWAAGRQDCFLAECVLLRAWWGPSSLSPPFSYPSMVLNKMKVLRAIEGKEKKREPAPSKATIPTSIPRTGPQGGGCIVRRERHGMLAPGIYRTARERFRNAGKSNLQSGQMSSPHPAKPQKANQMVSE

SEQ ID NO: 943269 - protein, 175 aa, Homo sapiens
SYSHMPSAYQEIKREGENQKKKKILSHQEATLAPNQMGDSAHMEKDNSAIVFLGFRSTHSLAGAFKCHWCLAPNVVFPSSGLDGRSATWQGHSQFMAPAGHSVVELGSAPIFSSVAVSLCHDDGARGWGSLELANGICYEYGSGETAQPSCCAQALVHAVGGQQRQVEFIDLLGA

SEQ ID NO: 943270 - protein, 126 aa, Homo sapiens
FLQLLNCESQSLKIEAKYIPLVNEEINLFKSPPVWLPHSKKAWGHKRWEARDNGQICLQPAHQPAPTQGKHQSPGHGPGARVPALVTGGGEVSAPWEPWRNGSGCASNIIDARAGGNMPPSPVAAP

SEQ ID NO: 943271 - protein, 107 aa, Homo sapiens
MSVPNKGHTEGLLQAMSDKGLVVGRWQPGWEVDAGEEGTGGGPEPMQLSVAGKGGCMARAGIVGSHTMPAIATGWGSDRSPESMGAVVPGATAAYPPSVHGPPAQAS

SEQ ID NO: 943272 - protein, 209 aa, Homo sapiens
FSLLVTTQAPWWKDMWGQKMLRTGCELCSMWKLLFSCWVPSLFTTLLSSNLLRLALMSSEGFGALRVFQDRAEMLVTGLPSCTTKRLVLVSFPVAIIIEEREDTATVITRPEQPARGIIGQSKVKVCYLAGALLDFLACGDVHDMHVVLGVPHHSEVVVDRLEGAAEQFSAIGGQGISRMQRPSSEAQMRMVASSEVERGCLGEGQASR

SEQ ID NO: 943273 - protein, 225 aa, Homo sapiens
MRQAGRVPEGSRAPNTNSVRRNQGSSLHCSGATGAPEQWKCTFCHLPSRRYHTRVSSDWLVRGRPCPSMYCVKDVSNAGGILSNDVHVWVQDGRVDWIAVLGQQVLEVESVEVHPFNQVNQCFRLKRSQPWVTDFGVDIKVTVVDGLDELLRGLNDLLLPGFSVFILYGGIGTVRRILNPVHWVMDDGGLKIQGGRRKRPFGAGGGCTVFSAIRLELESICFLVE

SEQ ID NO: 943274 - protein, 240 aa, Homo sapiens
VNICHPMTGHNLVKRCLSCLLLFFTKVRVLAWQSGILLASLWWPRNGGVPRSASTLDPIVNCSGLERFSGFLLALLHTGYMLMYVQIRPEEHSENGPPPDVTIAHTQEKLEKGHHTQTRFLQIPLPPPYPSSTESPPIFTPPPHTSYHTTHPTPPLPISLHLTPHISPSIPNLSHILLHSSQLNTTHTSPPYPLPVHSHDELYTAREKWRYAFLREAFPGVWITVRQTLGSACSGEDMRR

SEQ ID NO: 943275 - protein, 276 aa, Homo sapiens
GSFVTCFAHIKAATGSSQQLCQERKGCPCSSCTLGGSAASSLLILRTTIRPRALLSSFSSRTVRESPSSRSRSLSLNDIVALHPSSRMCTSPSVQQQHSQRVHLRGVPDEDAAIGLDSQERQQPAPPEPGGRPGKGRRGPERKRALQRRAERQQAGGRAGKGKGKRAAKGKGKTKARQPGPRAANPKKQSKGKKAERKEGKAEERAKAAATQTPATKHPREKKNPTQESKGGEAAKAGQARNGQANTNQAPARKQPGGRKPKGENPTGTRRQKATK

SEQ ID NO: 943276 - protein, 268 aa, Homo sapiens
DLLKIFGIVPPSHSFLNCLAEVLNVYDVNARENTERSCEMTQEPLIGGLQNIMAFPGGGSAALLRGYAGFFRGEGERWAACTFPGVWRAGRPPRVPFPSCVAHAFFLLMGNCWGVSLPVLGGLGRVGEPWWGGGRAGWDWVRGAGGCRLLICLAVCGICHRGGLTGASHTTCRAPGGQRWCDNQSPMMSCSWTKYRWRGWPMQGLGVRFTRTSCRGTWLHSVAQQGFTKWTLHVTWAERWSRDWVGVSVARCGVRGRGSRASVLCTVL

SEQ ID NO: 943277 - protein, 125 aa, Homo sapiens
FFLNLDILVRLCQLSLFLPFHSIWVIPFNGELQVTTVTISSTTPRFLKTMASAPKQVVYDFQIGPGFLLEEFLFGAVGGLFGEGFGVGWFLKAHWKGGICSASRSDCYILSAWGAKKKICVGALC

SEQ ID NO: 943278 - protein, 154 aa, Homo sapiens
MVTRGSRSNRAMLISWQGIFHNAPEGWRGRDSIRTEKGQRGACAVLITQGSWQARDDRQPEQCWNKDSHPAPLVEQLLVMGSSTSAPPPSLQEMFCIGPMNSVFLAWRCLDEGRGQGIQVGMLQLASLGLPNLEFTWGQGTPQSHSPSCQRRRR

SEQ ID NO: 943279 - protein, 157 aa, Homo sapiens
RRRGEFFQNLTERKETNGSDGTDGGRGGGGEWEPGGLPGVGEYIAIWDEFSSAPGKFLLLKDAFEKIVSAYNVRNFSNVKSPKPKFVMWDGWLGSRGGWAYEVVAKSTKGGGGGLRDGQGDGVEFVQPPGLTGEGEAESVDDLSNSGGPSLFASPFT

SEQ ID NO: 943280 - protein, 137 aa, Homo sapiens
MPYKPPVAVFRKHARHFLKASQPRGWQGKEDCKESECCPQVEGNWANSTFEANKEPGSPGTLSLCIHCPRVASEVQLLPEMEGEEQTWEHQRDRADGLTLSSGGHTQGASASSVPPELYQQRGVFQPKGAVSKTNRF

SEQ ID NO: 943281 - protein, 109 aa, Homo sapiens
MSNNRGGTPKHKAPREPQAGRSVLGPISSSQSQGQHRGQRVVSLALVSFLSPGNVLGDSGEELREEDTQLQKNKQPLAQIYTGKAEVVLMTRDTSDQSLGSQEAHSMCL

SEQ ID NO: 943282 - protein, 242 aa, Homo sapiens
PGLIEFGAQEVRPPPAGPGFRGGKAGSRWVFKSFPGAGFKKFVGSSRVKLGEAGRNPRRGPGGGGSPGRRGAGVGSGPYVLGFTLFGGGGPLGIFFGFADRCVFFLNTSEFSGFRFIPMSAPQLGFRPFMFGFFFFFDCLFLAMSSVGLSWQPFSTKRILSPCDTCLSLGSRRCQQLSEQAKRNDDDADGPNDHQHHEERAYSLRTWLARAWQLLVLEYFWMPISSRLLRMSPSMEKDILSG

SEQ ID NO: 943283 - protein, 102 aa, Homo sapiens
GCRHRQILVKPEPCLHRSGQCHEPFYGTRCALNHHVLAFCSSAYGAQFPSADAQSPSYDERLPLHGVFPKLPVVLYSVLYKDTVAQGLISILHPKDISKHNL

SEQ ID NO: 943284 - protein, 130 aa, Homo sapiens
PTLRPPHIPYLPVTCGYYCCASWRWGWGGGWGVGLCVGGAAGEPFWGFFFLLPSNGFALGESHYLGLVWVAAAPGGRRSLSGGDACVEHFCTTGEGGGHSRVRLLRGPLIGAGGVSIKFFWVVLLLCICW

SEQ ID NO: 943285 - protein, 128 aa, Homo sapiens
HGLQISPRIPLITRYWARPHCLCLPSHMGAMASLKGEATEEEEGAWTGEDGSSKEGCEQSQDEASGASAEDTCSDDVVLLDLLSQVKAGKEEGQVDGLEPALQYHLCYSSPNARGLEVTTEASSKVHV

SEQ ID NO: 943286 - protein, 127 aa, Homo sapiens
MPSRLQVYTTAVPASQQQLHDARLVLTLMPKSLRTRVIDGQGPIQVANSCQGITLQKPKGSTELASLSSPSPKLGWEATVSGLKTPTTLPAGALTSLGWQSTEPVRIKLAILVGSNTGEWALVTLSP

SEQ ID NO: 943287 - protein, 76 aa, Homo sapiens
MRQEDGHWGAGWSLAQVLLIALDGLLDAHSNVVVSHWSSREMESYSFTDSVWLSTFCSSWASSNFFINLHSRESEK

SEQ ID NO: 943288 - protein, 267 aa, Homo sapiens
CWERGGCGGLCHVSQMRGVCQALEAAGLGPGPGRGLRVPGGGLACVCWGGGGGGGGREGGSLGLGAGAMPFLEPPRTQLLQGGFWVPGALGVLGGVWEEGLALLLTRGGGGGPCIPCLPQSQGHGRCLRQIMGCPRTEACLSGEAVTGFFPDRVTLGFLRASAPVAFQIIHWQKHHFLHVVFREVPNAERKGGVAGARLYRYTEVTLYKAGEAWGSLRWPKAVAVLLKWAAPTQGPHLPTAPESRGERPEGGPGLPCPGLRTRDVCL

SEQ ID NO: 943289 - protein, 97 aa, Homo sapiens
ANIPLPKNNIETGNRYLSNPPAGNSQNPASSQHHKFDKVIFVCVSYTGYPPPVHVPLLQKPINDIITFHVEIQKFQRAIPPSRHPPPGSPVAKAPPI

SEQ ID NO: 943290 - protein, 167 aa, Homo sapiens
MISGFTGEIKPRAAVNVPSQVPELAPGRAVRDQEEGLPGLKAMILEETCGAEREVEVVKGSEALEGWATPPAESSIEDWGVRGWGGRGSQLGSGWGLCCQSSLLSVTEGGKSPLLFSFTLLLVLLPLLLFLPLPPGCLLLPFPCSLLCLHFWCQWSWHLEDFKYKTL

SEQ ID NO: 943291 - protein, 263 aa, Homo sapiens
MGNWYSSPSSSPSPSTESAPASSWCVVGEGGIFTGVCEETFLHPLTHVPVNKGTLGIHQDKLVVQESPGLSNGCGVAQHAHSSLYLGQVSTRHHSGGLVVDANLDASGAPIHKLELRLALMVRNGSIGIFGNHVTTVQQAASHVFTMARVTFHHLVGWLKASIGDLCYRKLFMVGFLSRDDRGICGQKEVDAGVGHQVGLEFCQVNIQASIKSQGSSDGGHNLANKAVKVSVGWALDIKVSMTDVIDGLIVYHEGTIRVLQGG

SEQ ID NO: 943292 - protein, 73 aa, Homo sapiens
FCAFSDLVTLQAPPLFFSTFLMKPKDTVCIMSRTEKGRKEEYWEKLSTHMGFPETISTMAASPDFRYLGLSSS

SEQ ID NO: 943293 - protein, 111 aa, Homo sapiens
SNDRHKISGIRKTQKAVFHFVQILSPGIKCDIQLLPLLFSKCPMCAMTDNNFSLGLINFPVHHFTTYGVNAKVLNIISTNQKSLLCVKRPPPIFLCHAQAQAPHFPHILCM

SEQ ID NO: 943294 - protein, 187 aa, Homo sapiens
GLLSSFCFLFGAGSSLAGPSSAGGGGAWGGALGGAVGPALGAVRPFFFFLGLFLVFWCSFPPFSVAFGAFGAPAFGFLPLLFAAGCLSPFLCFSSFFLFPLLLRPPFPPFVPRPPLLLLFRSLLLFPSSVVGHLPQLLPAFFGGGGGGAIFGSSPYVNFLYSRLVLPACSSCFCCLLAFFELMLLRL

SEQ ID NO: 943295 - protein, 68 aa, Homo sapiens
TRALEAAVGAHGDTKQGHKYSNYELLTYIYFFHERRILIVLVGGDLIRNCSIGFLCCHFIFINTSDLA

SEQ ID NO: 943296 - protein, 139 aa, Homo sapiens
MVGFGFVFPLRSEQLLEWRDARKWKQTPLSLQGWRVKIAVLPGMADGAGYRDALVLCLGGQPQLHLGAPTPPTWKRQGFHLSLAPACAAAAASGRANSACSRLPQEQRGSDAQLQFGVAVSPAQEGGAPACSIEQNGWV

SEQ ID NO: 943297 - protein, 256 aa, Homo sapiens
KTPHEPQGGDVLSREQHQRLQKHSSDKQNNSLRTFTCLSQSPQSNAGGHREGKGAGGLFVDQGACPQFSHAHNSAIPSRGLLTKYKTTERAKMGKDGEGDGNTKEHAATDTQLALLGGGIWRGWPPIQFVPGGSGGGRGGGGEGHGRGGMGSPTWARGAEQGFEREGTLCQGSRCTGLSGGSHPGCAFPGWHKTKGRGMLPALPGTVLERKFKIPTAQPATQEQHEDEVAPTGHLQRGQDRGHRHNQKPRGKGLKV

SEQ ID NO: 943298 - protein, 258 aa, Homo sapiens
LGNFFVLGCPILMPFRPFWNPFPASFAWASLSIGGTFDAGVADTAPCRRVESVSGGWYTGVIAGETSVFVVFFFESLGNRAEGSENPLGLGQGWLESPLGPPGAVVEESTGSGLEERKPREDTWYTHRLGPASIRSPQAPEKVSQFLVGLGARSLRLGRGRVPAVVTLGNVPHMDIHGHSLGAVSRAIRQMQSATLVPTPGRMQRALWASSYEDSRSCCSQAEPALFFQDGSGTGTHVTGTIAQAQLPEMSLHLLASQ

SEQ ID NO: 943299 - protein, 147 aa, Homo sapiens
MSHTAVFTLLGIHSTKKLLFLFCTLSISSSTSFMDMRPRKMAATVRKRPWRGSQAAIMFLESNICWVSSGTVSPRYCWLPRLVRGAKRGMKKCKKGKDTCSPASLRRSAFSWAGKRRKVVTPLLVADTRWFDVPVVGGGQLQGAEQI

SEQ ID NO: 943300 - protein, 254 aa, Homo sapiens
MIWPYGHLPDSDDDSEVSVEEDELERQALFDFIMLLPEAQKIQVSDLLNVIYGVVGAGPAFFTYSRPWPAGPSRWCYLKKQIGAPSGGAHRKGRSAFTFPGLSVPAAPRVGGARSCLVRKSALQCLQVMFASWCRFRPFSHCFKEILETSYFVKKRGLVGSQFHRLCGKHGAGICSASGDASESVTVKAEWEQACHVATAGTRGRGRCCTLFFPFLFWRRISLCRPGWSTVARSRLTASSASWFHAILLPQPPE

SEQ ID NO: 943301 - protein, 270 aa, Homo sapiens
WRSGGPGRRPSKQRCWPCGTRARLEPWKEETQDPRLQGPGGGARDPADEAVEEAGLRQVVIFVVFEYVGAVTQAVGGDGVHVHVAAQGQLGGYHVVVVHGVRRFVQFVVARYAVRDYTKDSSACLRAPPRGMRTMALMACTTLAHVREGVQVLCGLQRLVDGREGVAQREGHLLLAGATKLQQRHACVERVVVPPGQRHRPRHLLHEAPGLVEVLLTQPLGAVQQEDDVHGPLRALCHGQLCLAGKVWAHDLRVRAEDVLHVIDELLSDQ

SEQ ID NO: 943302 - protein, 128 aa, Homo sapiens
VSCDERMVSIESPFNLLSRLGRKEQDLGQTNEDAETPCTPPLDLPPMWLQSHLLCSLLGCFLVKGPEGEGDGIFRNQNEVECSAHIAEVLDFNSEVLQHFDEEDGHFYSAIRRPPPCRTPQPKPKFRK

SEQ ID NO: 943303 - protein, 93 aa, Homo sapiens
VYYSVRVHIVLLGCLTIKKKNSSRRVCALCGVRVALLIAAASVRGECCCASFVALRVRENALLGFGPFGLCCVAVLFSVVAVVCERLILEKKY

SEQ ID NO: 943304 - protein, 246 aa, Homo sapiens
MGTGVTVDTRVGCLSTSSHYANRAADTFRCLCRKRCQKLLKSGRGGVKKSCISVPHKKAVSGFSSCERHFRALGSVAARRLCVAPSFFTCSVPPTHHSSDHSSDDHNCYGGQASYNAHDGDGGLGRRLSSDDIVLRQPLMLYMACVSLLFSRLYHHSCPLLEGSISCWSGLHKLSVLSLVLAITLPGQCDLRRVDTQGPAPQGGLMVRYGVVGACVFWGSARSSLFFPFSRYLRITPRTRPPGRLS

SEQ ID NO: 943305 - protein, 285 aa, Homo sapiens
PAPDNPLPPPGKARRSRCGICSWEERGRGGAELGAGVFANINTCVRTGKFSSTHHPSTFRFLPLFVEEEGAGAPGTGWLRFIASSGCSPRENSAAHCRRNDIGVPPDAWGSLVYFPGVGVYTPALPTLPVKKYLALFDVVQAMFVTVSDVQGVEVLYMPPLIWEVHGGDPLQDLVQFLLEGSAGRGWSQLLGLLQAKVMLATLAHLPVLLSDLLPEHGQLLHTRLEGLPASTASPAQHVHGAVHVVLHQASFCVVIAIVCYLLRAGAILGVPALLTSALAHDQRL

SEQ ID NO: 943306 - protein, 158 aa, Homo sapiens
LWQFLSGIQNQFFRSLPLRDVQIGWGAECYNGGSTGEQCRAKAGQSELPGDHLGCGVQSFARVWFWDDAKQEEERTDKEEGGGTLYTVKKLSLYLRGSRRFGAKEGDGEASFRKWAPAAVGPEQEDWQLSTLEQSSEYVQARAVGSYVGWSLFCGRTF

SEQ ID NO: 943307 - protein, 218 aa, Homo sapiens
MVLVPYFAFHVGTGLTVGFGSPGLVGALQVGVVVGCSQSKVVVFGPHSTPPVGGIIAMNLAGHKRSWKLLEELKQKGIQRYRMSARMSSRGPKRVEVGYSSQSNKRKKTEKKKNNNKLQLRLGPTHHPNEPLKGPGLQLYCFCVVPKVCKDSSSGAQCGDPGSLLPPVKNQWANSAATSASPKCSASRVTHGHPVPPNIAGPGAARLLKGVKPGGSHP

SEQ ID NO: 943308 - protein, 105 aa, Homo sapiens
MSSSQGCRNSPNKTTRSGGPWSWPLLKPPRPPPRPNPPLPPPLKLPPPPPPPPPRKWLLLPPRLKTPPPPPRFKPPRPPPRKDILSPPGATCPSGPGLAHIPGIP

SEQ ID NO: 943309 - protein, 170 aa, Homo sapiens
MGPYRSGRFRRWCCTKLWPGRGSSEHLIRSRTCEVSTLKKLLIVLKVQNPRLLLLLLLLQERGLVTLLLHLILGSIAATWAHGHSHVPLWGQLIASAGGGCIWGVSQKISGLLEFMEGQLVGRCHGRSGASPHPSLATNCTHGGLNSSSLPTGARRPPSTEATWAGIRGI

SEQ ID NO: 943310 - protein, 111 aa, Homo sapiens
MAPPREEECLNFIRVKLEKKWAWVSLPWVSAKTKPSFSRSLLFPPAPTPRGSPILPWHPPGSLSGNPALCLPSLSPAFLGVWGGGGSPCWAPSAFFRPAPAALPFSPSLYR

SEQ ID NO: 943311 - protein, 108 aa, Homo sapiens
MRREEKGHDPKGCPVQKRRGESPVKLPLSQDSSLSRCTGRANYNGPILLGQVSDYCRGEVEITSLERAQDHSVGDIPSRGNPVPFDIEHSRHNAKVFWREGIIREFHV

SEQ ID NO: 943312 - protein, 156 aa, Homo sapiens
MGGASDNNWVSSRRGSLTRSMLIIGLGCRAQWKGRLRTDWGVGGQGMATEGSCVGTFQTWLHILCGTVFSSLLDQILQKENNSRTESYIALMMRNRDVQSWSNQYQANSAISWFGREEYLNRNSLHCFHVGSLRSRSLVTMSSPELSSCRGQMVWM

SEQ ID NO: 943313 - protein, 306 aa, Homo sapiens
KPALTHPGSLCIDLLAADLEKSTNTTSPILAPVGLLLSTHCIDCIIWTKMMTHLKEETNADCLSKNGPSWQEKAHCIHRIENDRSSCRSATFHFFCLLTIKKASVGEAVSTEQTKWQLMILFVLFLRPSVLIRHPGESLRGRHEVQLMPLPMGIFFGDDCDHDIFVTPAGHHVQGAFSFDDVADIIGGDHGLSIDADYEVVFLETTSFCWGIRNYFNYYAPEITSGKSRCRSFSSLALLDVSDIIRIPIYFFLVMAFPLACRSWDSVRNFLILSDGIAKEIPAVTFKVLIPITSPSRFTNGPPEFP

SEQ ID NO: 943314 - protein, 105 aa, Homo sapiens
MSVASCYFLSYLPYPSAGHSRGSERGVKQQAGADWVELGQGELAVLGRDPWWGLRLDPGERPPRAGLHTCACGLLQLAKPGTTLSQSTLAGVSAPGQWQMGALAG

SEQ ID NO: 943315 - protein, 117 aa, Homo sapiens
MARKKKEKQNKTGGGRSCLESGQWLFSSLCQSRTRYYLHRGTHRCPSQILQTVVFNILWFFVRFPFFFEVGSRSVPPPGAQWCLLGLLRPPPPWLKGFSCLSPPKYLGLQAPATTPG

SEQ ID NO: 943316 - protein, 173 aa, Homo sapiens
MREWTSPSDACSCRPGCPARVAIFNTFRTPSLVLAEQLKVAKGTVVVRHVPAFLRPNGLLLFLGQLSPGVLVLPEVLLFDHQDDGHVGADVLNLWGPLLRNVFQAVRAVDGEAHEDDISVRVGERPQSIIVFLPCCVPQSQLHLLAVHLNVRNIVLKDSRDVDLRKLILAEDD

SEQ ID NO: 943317 - protein, 243 aa, Homo sapiens
LTLLSAGHVMGKLPVFLPGCRGGHWSATPSRFLVVGRRGGGCLQLCGQGGGSSLLFQGLCVPHRAYYAQPGPTCWHLPILGCGLLLLWLMGDQDSVSDCSFLDTKQPQNTFLHTVMAAGKLKALLARLKALDRDTRYILLPCCPQRPQGTLCDHPLSSGPLNPAPPYCWAMKRTGACLKGPWFGGSTGEEDEENKKGAGDLAKEQLQKDRRARALEEAKAAAEGSQLSHERPTAVMFAGADAE

SEQ ID NO: 943318 - protein, 269 aa, Homo sapiens
MTWAALLASGRGDYLPPKEVRGAEGVRKFLGCFQSKAKAEVELGWSGSKEGFIVPFKADGKSRVGTRLDVLPWNWLLEQGPKPAVFFSKNPGSPIAKWVEKSPPEAPSAEKPPPNQSHPEDLLAAMAGVMLGGELGMEEDGRKEHASAQMGRWVELPCPQDWAPLGPNRAVLRKICRVGLCSSVEARAQLALPRLAPGLAPLAMESFVCSSCIPSSSSPGLRLSSGAAMVLGRKLCACRTREQKAVMDGMRLADFNLQEVSVRVVAGGE

SEQ ID NO: 943319 - protein, 110 aa, Homo sapiens
CDFFFLTKNNLSYGSMFNERKVRPNFSISVSQIIRPIILALHYDTIMALRAQVPLGGDGASYVFIFGGGPPFGGIGIPLIILLYCANDFSPTRAASSNFHFGKLSRHETE

SEQ ID NO: 943320 - protein, 104 aa, Homo sapiens
LGPTCPTQKWPSPGGLGDRGGVGGAPFLVCWGVGAHHPLLLPSSGLQEGQLKSRACGFSTPLPPRLEGALRDGRRGGGQRKDVDQERCEPGVRAEGESKIKYQF

SEQ ID NO: 943321 - protein, 130 aa, Homo sapiens
MSCTCANQKGMGVSEEQRGLQTLGFSEFRKGGKIVSPGSKTQDKKGPPWTAFYIANAGGAVGGPFVRGGAIARVVVFEAFFLLGVLLGLWVGLVLPWWGLLGWLGQCVAKLSTKCGSINPGDGTFEPGSP

SEQ ID NO: 943322 - protein, 134 aa, Homo sapiens
KTPYGHNPGSSTMPELKTSYEWYWGFPTKRPGEDLGPPSALPPRWGACSRSDWERYCPMDLSTGNSQRQDTMQDMDKMNTPSLLPPGLRPPASPPPPTPSPAPAPPPAGLLKPPPPLAPGHPRALPPPSLLPTT

SEQ ID NO: 943323 - protein, 259 aa, Homo sapiens
MVYTKAVPHFHNFLMDIVFLIVLLHGFGYCHLKVFLGDMDSPFSEGINASICAHALHFSPCCCCDELSNFSQVDAPGVVHLPRMNVQNVQPGLLIGGWEFNFSVNAPWAKSAESRISILLVAMITLMFLVASKPLSWLTNSSIVRGTSLFPPEPPSSSEELMEWILSMRMIDGACARAMRNSSLTIFAPSPMNFCNSEPEKLNKGTVRMKSPSPGQQCLPSAWRSIQQHSLGLSNAQCFEELRMLKRQLDHFFDLLDLF

SEQ ID NO: 943324 - protein, 165 aa, Homo sapiens
KAAKKHPPPPPAPPPPPPPAAAAPRGRRGSTGGDQLAGPGPQLPGGWAGREEGGGRVANRGGESAGAGATRAWGQGARGLGAGGGGGGGGGWRLEKDTDQSVCRPSPSLSSAFSHGVALNKLPFPGSSFLIWEMSESRDSPKSLSPVRIYDPLNKRHNFNLDIPY

SEQ ID NO: 943325 - protein, 156 aa, Homo sapiens
TSPRSFPRDALVPHDQIVEEIRHQVPTLARGFHLLLLLLLFFFQFFFLYVAQLELLMPPAWGMDSSRVAQPLEGSTTSLGAPWTEGDVLLLLWSCLGPWPTGAAVDGGKGALDRSGPGGGGGGGGGGVSTPSCRSALRGSATSVWKVGSSGMVPGE

SEQ ID NO: 943326 - protein, 110 aa, Homo sapiens
MSKATSCFQNAYAIKVGITSFKKPDYSRLLIFHIKVPLFCFVQLRGPGNLGGSLIRGGHLSPGPVQKMLGRRQKGFMASSQETVAHASRALSSSSRRHAKGRLKDLQCIN

SEQ ID NO: 943327 - protein, 146 aa, Homo sapiens
MPLSGGLGDSSPRTKYIGNTNFKQKFIILGGDHPSTHDKNIWLARGERDLEGFGDLGFMASGEGAYAHSMHIRIHSLLGHFTRSLENTAYVHIKTKISKSCSNNFGPSVMAIWSHFPNKKTLPATFTFHEFMNPLDRRCYLFTFSK

SEQ ID NO: 943328 - protein, 82 aa, Homo sapiens
SEIPQNLRQTERSHLPLRTLPGLAEGKNPEAFSTTARFGISLALRRTPSLSPCWGVSLKDGYFLKSMNLGFNFWYEVGEYRE

SEQ ID NO: 943329 - protein, 119 aa, Homo sapiens
MGVACGSVGMSLELSWIIEVVPAGALRGHVVLGFSHHYSWESCSLTRAVLGGVRSSSGVYSERARGRLARQPPPAFSLAGSWSHPLGLRGEWPPHSSSRIGVRAGPREGRERQSSSWRE

SEQ ID NO: 943330 - protein, 178 aa, Homo sapiens
MATEGIPHFWVFLPGNFRAQICIQEEEDGSASEGIFQWDLGGQCAHTSLGERGQSVVKLMTSNQSGGGLNDLVFGSLYVKEFGARGTGGVSLPEPSEEEVVCVGCFQDLFGGDHNKNGFKMFDSSNYHGQDLLFKDATVRAVPVGEKTTYRGWLGLDYVAALEGMSSQQCSGAGRTGP

SEQ ID NO: 943331 - protein, 187 aa, Homo sapiens
MAWGGKKGKKGKRGKKIDHWDEGGEEENGKYLHYKDLLLEPGCATKLLMDIRKLNFYPLLHEAPICVGSAPGAHYLEDMMQDSAPSFGTVLHKERENVLLEGQEKKRCPHTSLTLRSQVRSLVHSTLHRWLGHSIREAVMVTKSSKLSRMLPCTAVSFSRKGSVSTCSWVHTWMKRSSCMAGLEERG

SEQ ID NO: 943332 - protein, 69 aa, Homo sapiens
QIEFLRSGGAMILIFMVLGARAVVSFCIGSAMPGYIVVPPDEDIVSIEVLPDVNITFDDVVVGGFMVVS

SEQ ID NO: 943333 - protein, 225 aa, Homo sapiens
MPLFHWFTHMISRVHEKLKFLLKIHADPIRGVVTLQTLYLLGAWPPGVLQRAPNTISPLISVTNVGGDLDGGAGGTGGGAFILLGGLPSIPESLFCSLEKGGWGGGAQSAGAAGTPYGTSLQGEGRSVLAAVAHMACLHCNHRLGCSQDLVSLEDRSDVWAIQSFRPCLKLVSYVNLKNKMHFYPDLAPRTGTTGPRQIRSFPSTDRCVEFQPPLLIRFHSDPVL

SEQ ID NO: 943334 - protein, 119 aa, Homo sapiens
FWEARKTALSHGGAHLTGSFAFQEQIRGKGKTAPGQGLPVAAVGESARQTRQAFSPPAIASRPVRPQTNTIRLGLHCKHSVSYEARLYFRFSGIDPIVAQVQRSFGKSSGPVNPSKKED

SEQ ID NO: 943335 - protein, 116 aa, Homo sapiens
MYVQSSTSSGLPNTFSMKAVCTGPHSIRLKLLAGEQRVEGGGRSEAQAQPHPSPAPPRPGPDREQTAGWEVRRKALEDNKNLNAGAAEQPPNHLSYREPGVRFDLRVLALCDLGSN

SEQ ID NO: 943336 - protein, 263 aa, Homo sapiens
MGSLNWAQLQLVEDVTFDDFSDFPWDTRLFGGARRNHSDQEPSYTATSGFAAEVGSKGHVAGGDSLGERGNERLREIHLLGLEQSTELFWALLEAILSEEVHERDVDGTTDMARVQFYCIRLRLGAQEPPLRPWIHQLEPLRFKVLQHLLVGLEQGAGASVALKTAGSGREGSDVTGWPSFSQYRKPPLSTDTVLVAKHTEHPPDPGSIEAAQVFTIIHHHVRFVAGAQEAHILGEEAIAGEHHLVGRRRVPALFYVKERGGR

SEQ ID NO: 943337 - protein, 294 aa, Homo sapiens
AGGRGGRGAAAPRRDPPEAKAGGGQAGGCPGSQAKPRAPWSSTRGPDTPTDRVERAQAGTTPESIEPPWGRAVPGTRKGFPSSVRLSTPGSPSGGGALGRLWQRRASTLSLAGSPLGTCASPANDRVRECRALDHMHLGAPGFTGARKVVAEVKAVGLHTCRRAVRAHACGRLHSCVAHARFWMAGNLWGQRAAISPRSPSPGLSDRSRLVRAGKARTCSQEKAGEFAWAMLSTLRPGLSHYCSSASQERPVAHDTLRRRNRESASSVASRGSGGMVPVIFRSSSVSSLRREAS

SEQ ID NO: 943338 - protein, 138 aa, Homo sapiens
RGWGGIQSNLEGVLVLTTWKLERRGGGGWWVGGLEGRGWEWSGRRGGGGGGGGGGGEEGWGGGGGGGGVGGGGGGGGGGGRGGGGGGGGGGGGGGGGGREGEGGGGGVGWGGGGWGGGGGGGGGGGWGGGGGGGGGGG

SEQ ID NO: 943339 - protein, 148 aa, Homo sapiens
LLLGLGGGEGGLGGCGVCCVWGCAAVSSYATFSGSAPHLFDFFFFFDVFLLFLPFLRFFRGRGRRGTVIGAGTGTSAGTATLLGFGVGVGAGLGLGGGPGSDISFVPVPGGGSFVGAPEEEGAELALGLGFSRSLSCTFKSASIASRY

SEQ ID NO: 943340 - protein, 93 aa, Homo sapiens
VVVMMEQVRGPKYTTVIKMKLLTQGTGQPKEQDVIDDGRVPFSKAQEPEPSEQDSHSQQQCRPKVDVQHVVGCLVMDVVLGITESITGVAFLV

SEQ ID NO: 943341 - protein, 147 aa, Homo sapiens
KFVSKLTRTGTGSSCSSLGLSGRGAVLEEEEVRAVWQAPAPYSTGLVWMCSYVGRSVRIQGGYCGLARSILEATLVHIFRLHVADRAQLVRYFLERVGSTCLPTSSKITGLDYRFIMSIDVSCVLARASSTVSTVPPIKINSFVMIY

SEQ ID NO: 943342 - protein, 267 aa, Homo sapiens
MFSWSLFWMLWRNRLWAYGAFLSVVHGQSLGIAGSVKGCFFVINCTLGVHLIGKVVFSVGWGGVWGGGGGGGGGGEWGGGWDGRPQFRLGLLMGSAVSGGLLGGGTALGPTEVLLLLVSRGVEGRCGEGDVGNEEGKLAIGCWYRLGASEHLSRLFSLAAQLCVGAPPGGGAAPRWMGTSGGGGANGACWGPPGPGGGGGGAARRVRLPGVGHGINLGHAVGQVAEQPVRTSVLTPSHVDRKRVTSFMHSLKLARYFPSTLGSVLSA

SEQ ID NO: 943343 - protein, 295 aa, Homo sapiens
SAQSPEKKSGSDKRDGEVILGSSYIADGLLKANKNTRTAPTPATAATTPTKKPQSAANPAKEAPKNNKQEKKEAAEEGGQPGEATNRAEEKRNGQRPETGQGNRAGNGAEPGEGKNQGHHNASTPAAEPRKTPKRQCRETTPMNIEEPAFVAKPSAEARRNTVTSASPAKAKPRSSSSAAAPMAAAEAPAAREEKPEKKATQAPKNSPPIPAAKGARKSNCAKTRRKPPPPHRPETTENTKDKKAGAPRAEPPPRPGRRRNEKRYPGLASRLRAQALSAPNAPEAPMGREQVHKR

SEQ ID NO: 943344 - protein, 145 aa, Homo sapiens
EIPSSPSAHHASVSLQSDPGLPAKAFGCSFLSPAPPGGTVCPSSKATSTGCLCSFSLSSPKSPLGSAQHPTADTVAWAGVLCEEAATCLPGGSGQRCSAGTDGSGLLPRASAWELRELLAKLTKIRVCTAPAQLLCPLHQRVQTE

SEQ ID NO: 943345 - protein, 271 aa, Homo sapiens
TFRNHVQVSEEVGGGEPEEKNQPEVDMSDRSISNIQEVNGLFTLSQITQVVLSHNKQTMVPPNIAELKNSEELNFLKNKIKEQPTQISSFEKLKHLNPGMNRLNTLPRGFGSLASPEVLDWTYNNLNENTLDGNFIYMTTLRTPNERKNFEILPPDIGKLTKLQILSLRDNDLISLPKEIGELTQLKELHIQGNRLTVLPPELGNLDLTGQKQVFKAENNALGDPIADQIQLGVSHVFEYIRSETYKYLYGRHMQANPEPPKKNNDKSKKI

SEQ ID NO: 943346 - protein, 224 aa, Homo sapiens
FSLVVFSGSRRVPCSRLLAGGWWALGFSSWVPGACFSLGNVFRGDVNTGREIHRAFSSLMASIRRALFVTAVVRKLNLLPFSLPRRGAGFSENVQPPATTKMGRRDSLAALSSLVFSVTAKSLPWLRRPPSSLPCPPRRSGSCSLFRQLWGSFAPLRTLAVSGELFVIILAVTWLFVLFADGTILAPLGQRTEGISNLSCCLVGHQLAHFTLHGCEGVPGGLLR

SEQ ID NO: 943347 - protein, 207 aa, Homo sapiens
EDEQSLSSGIQRWTQLGPLYRGHTITVSLDAILGSSGKKLNGRSRKPTEFPGVAVLGMSSDWGMCRKPTVTQATKVIIFNVLVVVKKLLKANGRVPGVALVVAAEAAQICLQVIDPCQGVPCPSAWQCSINDQPWGPDTHGRPMEWISQTVAAIVDPRGSSRGMVKRRSLGQFLLKRKAAWRSPDVLRLIQSWLEKAVSRAPGVGAI

SEQ ID NO: 943348 - protein, 304 aa, Homo sapiens
MDGNWNENPAGTSRKTQQSVVTVADPTWLPHVLQALHKKLPIQRVAALRLALRGEQQPTLLALVTANVKTWIQSNNSHSVLLTWLRDYGPTAHSAFWGKLPVKIINVVDFFRGIHCVGDAVEVAVTHHAGEDARVVGLPHSPQIRSRMGWEHVAHFSRVATSSPRNMPSSPRRRNAGRELGPACRTHKAAHVKDAIKGHNPSSIPNHIFSAATTLAKVLPAGRVGSCREPASSSAYPAHPLEAGSGALGPVLASSSSSCRPETQQLLFGPGLALSGLQQAPDSLGWERKWGREGQRLRGPRWVA

SEQ ID NO: 943349 - protein, 272 aa, Homo sapiens
AGSFNHLGTLPRLLFTGWAVPGMDGTSAPSSAAGSDLGAGSGAGNFEGDPAALDIFLATSSIGRRWGDGMLQQARLQVDTCRLLGSQVHQSGREEVRLKEGLRVVVQDCFWRGDEQDKMTARGSPGGSSQKSRKFPTVSLGRKKPCRTQRSGNRTLRATFGERSSFSFICASLKALVTKGASSRRFRSLLSWAKRLLTSSTVSSKNSSGSSAGQACSRSSRSGWHTPGSRSTGSRSTGRSRSCSCLGIPLPLLLLLLLGDPGPTWTSFGLEG

SEQ ID NO: 943350 - protein, 105 aa, Homo sapiens
KQLKRSNRKFSQRLGQTQFAMKKDINEKSESKEICVKKKAKLSPTIETTNEKDKKFKFKKAKNKKQKNEEKEENYYDHRTTAVIQNTIISENEEEEIDSNIEKIE

SEQ ID NO: 943351 - protein, 75 aa, Homo sapiens
GGGRKGGTCQKPYDNHPNVREEQPIHQLHFNNFTTLYISLLTLAFLAATAWQSLEPLGGALALQKPGGEKPCWER

SEQ ID NO: 943352 - protein, 218 aa, Homo sapiens
MHASGTKPYHAPLRHGTREHVNVRPLQENHPQRQQKLTRGRHCHEECWLKPQLPVSLLDANIPKDTAVLLPKQRDHDTVRVSLAPSLHQAQHASSPPDPSPETALGATSHPRLQPFNVPIPSPVCPAGAGGYHGDPCVDTDTGERGKGGVSELPTHTLKGQQSLMFPSVPMVPPKGFPNKVIIDYPGVCEEAKHQQPETTKIVTTLKEDELENEQLSD

SEQ ID NO: 943353 - protein, 122 aa, Homo sapiens
MSRWTVVSRNGGVSRFLCFFLWGLRSAGVGGLGRRLPVNIWTWAGAGAVGQSWGSRLEKQGPLQTQPWGDSACAPLPSSQNKTMVKNQNRCPEGGTWPLPASQTRAGFKQGGLLEPLPYVWS

SEQ ID NO: 943354 - protein, 217 aa, Homo sapiens
MGGKKKKQKALELDLGEQQKKRSIIPPCQIKRFPNIWEKNNRNVVGHPHRGTRLEQEEHRGSQMEVGGVQREGGLKKANRANGHTKVLSRTTNVRGGNSHNREAHSPAGPRPKDRRAPPPRASRATTPQNRGGETPSPEPTLTRPHQPQGPPHNPTGIHGGKAMLAGKGRGGEARRGEKSKECQPHIKDNRKFRIAVAKPKTHHPRTRQTKRVSSQH

SEQ ID NO: 943355 - protein, 109 aa, Homo sapiens
SPPPPQRAQRRAETQASNRRVGQAGQGRQDRRWRQPPGGDEEAAPQVEGKARRRASKGGGGLLAKPDRERKEEDERCNPCATATGRRKSNSRGAQRKEGTTKKTYKRGR

SEQ ID NO: 943356 - protein, 74 aa, Homo sapiens
MTHVLHAHAAPDAQHEALDVALIDAAHDAEVAPLAPGWAGVGAVQYLSVFHLERLLSPSCDLDLSGSMQAVSLW

SEQ ID NO: 943357 - protein, 164 aa, Homo sapiens
CGGLCRGVVRSGIPGVKKAATTGSGVKVPRDFRLLGGLEEGQRGVGDGTVSWGLEDGEDMTLTRWTGMIIGPPRTIYENRICSLKIGCGPKYPEAPPFVRFVTEINMSGVDGSNGVVGPGAISVLAKWQGSYSIRVVLRELRRLMVSKGNMELPQPPGAQCYGD

SEQ ID NO: 943358 - protein, 310 aa, Homo sapiens
SILLTIYGNRDLQNKYEDSSKTKECKSTAHRLIFFTLILSVSTKKEGLLIILLKESYVLKGIWQLAFFHPLTQVVNGGTPGVRRELVFVLFFSGFGNFCGFDQLAHSSLYLGQVSASFHFWRLVIYANLEASWAPIHKLDGTLGFDGGNGSIDIFGNHVTTVSQAASHVFTMARVTFHHLVGWLKASFGDLCYSKLMVGFLSRDDRGICGQREVDAGVGHRLVWNSVQVNIQGSIKSQGSSDGGHNLANKAVKVSVGWALDIEVSTTDVIDGLIVYHEGTIRVLQGGVGGEDGVVGLTTAVETGERVNGD

SEQ ID NO: 943359 - protein, 180 aa, Homo sapiens
VQKGEPPGQSKSKDTGREDGAGRGTQHSSSPQAGFASQAGPWSRGWGLLIPFSLLIRIPVLLSLLLTGAAQLFLPSRPFTLGPTLALQNHQLRGLWGTPRCFLFTVAWGMKTQAEAAVHCAAARDCWLLCTHHSEPPWLSCNHVSLPRLHRCPRHTRGWFRLRGPALCAGWSKAMQGKFG

SEQ ID NO: 943360 - protein, 140 aa, Homo sapiens
MTLLEADSEVDMLSISKSSQLSDSDYRKSSAENVSPDYAKPAPELPPPKAGATGAQPGPGAKDAGSPENPGGPKLEAAGLLDENDAADVTSGFPNPKAGAEVEIPELVEAAAPNAGELPKPAGLPEEAAANPEFVLKLKF

SEQ ID NO: 943361 - protein, 109 aa, Homo sapiens
MLEMLSSLPHKVGHKFLVVPSHLGSSGTSHACRGVLSGQTMSVLGPGTAKPLLIQVSPRFLVPMGKDDPSSGWYPPSHYPSDALTLHQVPILASLFTNSQRKGWINLNK

SEQ ID NO: 943362 - protein, 121 aa, Homo sapiens
MKGRKRHRYDSVPGKDSPLGPGRGADRRPPVLVWTCAVFVVLLVFFFFVTDNRRTEKQKRRGKKSQEKEKRREAGDHPGERRARDGEKNENGTAARDTGKAANGTSTPGTGDRAHTERAPR

SEQ ID NO: 943363 - protein, 312 aa, Homo sapiens
GGGGRRGEAGAGKAGRGTRAQPGRADQPRNGEGAREEEKNKGEGEEKEEQAKNRRTSQPKVLGKNNRGTIATRARGQRAKAHAVGGLAGRKQPVMPDSPGEEPGGAIKTEDDNARQEARTTALITVMPVRSKGVTNHPMGKRNGTERVRRNGVGTVAVGRRARRAEESPRMRALQGLPLVNHGRGPGGGMERAHHAIAKNFFFNSGGRGRPGAHRQATGGSPQAAKTRKGKEHKGGRGKEEGQTEHEREKGKRQGGGKAEPSRARATQGPRRQGAKRQRGKRKRGRGRLGEKAEEGRDTEKGRAGRKRGKGD

SEQ ID NO: 943364 - protein, 233 aa, Homo sapiens
KFFYTIAFMQWFTEFMELFFSVWDLFKTLNLCFVCFSHKPGQLVPAGPSSQLLCWALSRVLLCSPPPRSTPPPSWVPPPLLWGLGSGRLVAPVLPVGGFCGPRVGGAVLGVPPFLPFVLLCGFFLCLPAVFPGLHPPAVASLPLGGFIFFWGLEVASILKKCPQQLLMALGGDQLIGQVLLYLVPLPLQGLWQGWVHQQSVGVADKGGLGRQRVDAGARLGHMGQPVAFSTRQ

SEQ ID NO: 943365 - protein, 177 aa, Homo sapiens
SVPLAPFVQPSRLVRSGIPGCRGFPNLTTVIQATYGTDATYVGADGGFAPNILENKEGLALLTTAIGKAGYTDKVVIGMDVAASEFFRSGKYDLAFKSPDDPRRSLSPLLADLSKSFIKDYPVVSLDAPFDQDAWGAWPPFTASAGLPVVGAALTVPPPKRIAQAVHAKSCHCLLLK

SEQ ID NO: 943366 - protein, 128 aa, Homo sapiens
MDSPRGWGQGWEYWGRGRQRNLSKVYWNHSRPSHRGPAQAVLSLSLSLLEAGLAVSLLSRGGWRRIIYACLSGTMLQGPRGGGSSQGRKEEASLYKNTSFPLLLEEALFGFKADVEFPGSRVKEGRRN

SEQ ID NO: 943367 - protein, 138 aa, Homo sapiens
MYTWRYGMITCQLQTHAHCWVTFQVEEANITGVDGHHYYHQSNNVDTQASFHHSFDLAEPIAEDDGIRGIAHRQHHRKRNADDDWDQGVEGVNMQGFRQAEQDGQEDGDGCWVAHKLSDNGHEDACQQGDSPRWEAAQ

SEQ ID NO: 943368 - protein, 187 aa, Homo sapiens
RPPLSPKSKISEPKHPPKQRPAHRPAAFFLTAKGPQGKEPSLEEEKRTTAQAGRQQPRGSAAATGGEGGGQRAGEREGGPPGAFPFPRSQAGEGRKAEGAEGAATERKRGGEGGGQEGQRKRKPGEKDNKLSCVSDVEGRYGGGPAMALSNPRRHRPQIGIAKPNSLRKGEREGRETRERAVLWIFI

SEQ ID NO: 943369 - protein, 257 aa, Homo sapiens
HERTRGDKKAGAGPGRNARESRHHVPRGPPQPQPPPAPPAAGAATGGAGRGEGAGPRHPAGGPREEGGSERDHSPRAGPREGQRGEFERDHDNGTLEEGKKIDSSDERNTLGASGGGGGRRITGMDRGRMGRGGNERRRLIVPPHRGYGSSGLAGRIPPEATLYIEGELLEGGNKEDTGQGSTVLRPPHSPRKAQDGDAVRDHYNGTLLDGTSFDTSDSKGGTYDTYVGSGWLIKGMDQGLLGMCPGERRKIIIPPF

SEQ ID NO: 943370 - protein, 306 aa, Homo sapiens
MIRGPIPAGKKLSHHSERELSCLEAHFFLTIFMKETSPPPPDAVVSELLSRLLVQLLSLCRGHHPYAPPHATTTLVLNAPPHAPPLTCTLSLDPLLQVQDCGTLHNNHGHYFSIHLAHSDRHCLAVFYGYLGVAFFQSNLDRQNAEQRVLHHHSQTLLEHSMASECGTPLLRAHLPLAPRAHPRPPSPPGPPLSAGLCRTASPHWEAKRARSELGPAPARPPSHWRAGGDGAAAVTNDKLRDILQQGRERRIALPIGWFVSLEDARINVSPRRAAIGPERQLELREWELRTRDMRCAARLLERLIV

SEQ ID NO: 943371 - protein, 254 aa, Homo sapiens
VRNSRDISLVTCPLQCGIMWQLLLPTALLLLVSAGMRTEDLPKAVVFLEPQWYRVLEKDSVTLKCQGAYSPEDNSTQWFHNESLISSASSYFIESCQSRRELREYRCQKKLFTLSDPVQLEIHIGWLQPRVFKEEDAIHLRCKWKKNLKVTYLQNGKGRKYFHHNSDFYIPKATLKDSGSYFCRGLFGSKNVSSETVNITITQGLAVSTISSFFPPGVTSLFLLGDGTPFCSGHRTIFLCEDKHSKLNKRLEGP

SEQ ID NO: 943372 - protein, 116 aa, Homo sapiens
AGKGFRKSRSTGSLEMKPESVRGGGGGWEEVGRGGGSWGGLGGRARRRGPGGSPPPGVSGGGRGPWGLLQDGGVRDFSGPEGVGSQEAPAACLFTPGKFLNWDAGILSSRFWSTFS

SEQ ID NO: 943373 - protein, 178 aa, Homo sapiens
MRLLRVTLGRESCRSHLIQSCFDLRWGLGEERKGGGEGGGPPPHKTTRAQGQSLGLPFHSIQRDGGQGSKSQGPGKGPDCWGQGGKEQADRERGQGPWAGKLGGRGEERSGGGKGKRIGESQGTNREPQSRPGREELGTIERKSGEEDLEASGAEPLQGEVIAQELQKREGPWTGLTS

SEQ ID NO: 943374 - protein, 37 aa, Homo sapiens
VPEVNEGFWFDNWGYITRSFHQLEREGMGTSPQTTRH

SEQ ID NO: 943375 - protein, 214 aa, Homo sapiens
LHRSRHLSILHNISPAFRVSRNRKESPTVSLTVIQVNQLDVNTALLQGKSSYLKLIGKGVKRLRSALEEEVLFAYEKKPVSPLRISNGSILQSSTCFGVKNSDVALLVQAVTLFLLLRGAPFIRYHKAFICGIQNVYNPLQYRVVFPLVLLANQFNVPWLSEVEIPLFLQVFNSRFQYVDLRQQPSSLVVAVAHTGVLSHHTRASLRSRSASLC

SEQ ID NO: 943376 - protein, 286 aa, Homo sapiens
EAGVILIAGKSGFNVFHPTLYRCIDFTHCPDFILSCSFAWVQCTGPNKQEWARGRHCSLPPNSEQYKAAWGEWGGERNETPKGRRKDSGGEGWGGGGGGRRGGGGPRSPRARGPYATAQGCAQRGGEGDYKGPGSGGHRLLSRGSCEHRQWGTGSDCPPPPFLLPDPANIGEAFRPGKAEQAPVSLTLSLGLKVPDPAFKDDAETLSFSHGICDLGPHNSAEHHCVPLTWRGRGLWRSWDRASVKDSEGVLESPEDGRRRPQVGKDSDQACALQVLRQDAALLAGS

SEQ ID NO: 943377 - protein, 128 aa, Homo sapiens
TALLEAGLARVLFYPTLLYTLFRGKVPGRAHRDWYHRIYPTVLLGALPFRILCAIATGRYFRGVITINEDYYMRLLFNSSQDLNILLFYQLWLITLDITGITTFYNFQNLFQFSVNYHLLFHFFYFHF

SEQ ID NO: 943378 - protein, 117 aa, Homo sapiens
MGGSSDRLSLSGASWWPPRAFLAPRSAKTAGLCERAPRQQQLLQQHAEKVGGRLYRRRAAAAAAGEERGGGRKGSGRALVEVPQAEEVLLSHAERTGRACGCWGCSDCGGGWKKYKG

SEQ ID NO: 943379 - protein, 243 aa, Homo sapiens
LGPVAAHSQWRLGLKHRALMKSPPSSVSRGFPPLKAHSLAWPSLPPEAQRDAIWGGSDRVQIACVANVVGLQLAVSQAPYLDQLVPATGEDEGLLLWGEKRTQDTHSEWLSSWTVYLHTPRVFHSLMVLSRDPETICRLSEEKATVSTALVWPTNRLVVVPVVRTQKRRVPSQEPERANWPSEEITTSLTKWELPAEHAVEFHVGLIPGQFPHDDGLISRGGEDHVRELRGSSDLGYPAVVAL

SEQ ID NO: 943380 - protein, 187 aa, Homo sapiens
WPVSGPGLPAGLRRQGQWQGRSPLEEDHPGQDGVAQHQEEDLQQTVILLLQLLGQDLQEGDEEEGAARQALQQHGRHAARHALGALNAQAQADAQGDHGAHGDRQLGRVPQGGTSGAWLPGHGHQDVLLTGHPRQNRLYHISSPLPARPQGPGPSKGPGVGPDSAEGPGLDARRTGGWARETALDRS

SEQ ID NO: 943381 - protein, 67 aa, Homo sapiens
MRKFEKKRWGRNSGIRIRLRPGLICAGLSDEPTGAPPFRQAGQLEGEIARGYGAKEGGRSGIVWAPG

SEQ ID NO: 943382 - protein, 33 aa, Homo sapiens
MSRRRGAVRLVLFSVVFSVLLEGGGGDMLIRKK

SEQ ID NO: 943383 - protein, 138 aa, Homo sapiens
MGPASAGGSETVPVWELELVAPGAWDHGGVHIIRVLHWLGCFLPSSLHSEDEANTEENQGCDASPPGCSQDTTSPAFWFPMHKETQRDLQGAQRMLSTAGEISFFCRPYLRQPQDPGIGDGGGVQGGEAWNQLRCAGG

SEQ ID NO: 943384 - protein, 282 aa, Homo sapiens
EAHMTLDTWWKVRREKHIDLGQLNKDKDRTAKKSQALDSVEVLRKLYELHGGGALTEQGPLQVLAGGLELPGLTLLGSVPTGDRFIACPLTGQGVSDVPAGKLSLAAQLLFNSEELVVLGQALRSARGTSLDLPSAQPHNQVSNEGIFSLPRTMRHHDAPTIGLGQLARLKRLGHGANLVDFEQEAVAGLLVHGLGDPLWVGHCEIIPHYLDSCTGCELLPSSPVILVKGIFDRHHWVVLDEGLVQVSQLVRRDVAAGVIGRIEVQVNFPDLNNSEPLRPCR

SEQ ID NO: 943385 - protein, 116 aa, Homo sapiens
MLSEEPWGKTKHWASHRNSFVEMNWFGFCGFQVWSQDPSPKIPSALLKDGASKHTQYQACHAFLAEPILGLSVLQQFLPLSALWVFFQGSPKGRRVGPQGTLPFEMGSVKCSPAKL

SEQ ID NO: 943386 - protein, 70 aa, Homo sapiens
FCGALYGGDIYQCGNIAVFKSHSDLQWFECLSDTAGAGGLKLNSSHACAIPSEVLPHHRRTSSHSGVAGC

SEQ ID NO: 943387 - protein, 132 aa, Homo sapiens
GGWGACPQQKQRVSAATCALGLGWGAKVGGGGPASWLGWSGVRGPAGPSPAAPLANGSVFKDSVRLVFGVGGTFGGFIYWAGGGCGGGGWLCGRRPGPLAPLRAGPRGHLPSVARGSPRVGFVGCSPAGLGP

SEQ ID NO: 943388 - protein, 182 aa, Homo sapiens
MGGGKGAWGGEGRGELNGGGLVGGRVGIGSVTRVEEFGAIFQLFSRAAINLLVQLSKLACDVSGVGIQEGGIAGAYLAWMVQDNHLSSEASSFHWWVIFAVTSNVATTNILDRHILDIEAHIVPRKSFTQSFMVHFDRIYFRCNVDWSQGDHHTGFENTSFHSANRNSTNTTNFVDILERQE

SEQ ID NO: 943389 - protein, 144 aa, Homo sapiens
PSLSIFCFIIFINKADYNVALFCIIISCYKTLHILLKPHNDFLGPSPLFQSVTAEPTGRPRATSCVPMLCLTYLFARGAWLMWTQFQRNFHYTFGRRLPNLILLLVFLCCIFVKEYYFPFFCLDQGRLKYFVQNFNQIMSYFLS

SEQ ID NO: 943390 - protein, 256 aa, Homo sapiens
MERVRRLCLGPIHSLQLLKVFVGIGGAGGGAQKGSTDLDMITITYVYGGEDVDESSEVGIPNFHALEGSGQFTAAQLELFDDVADLLKPVDVALLFALVVGNNQECSSLEQQNFIGLNDLGKIPEVHLQLKNVGNELVDDAGPGFVERLITDGRAKASTLQRAERDASCLSLALYKSGHADPPEPDPFCAQGEDSGVKRVLEDGLQTRLVIMHVFFQCAALHVTHVNENSHVTEDIVSLAGEVIFMKVSDRTVHRS

SEQ ID NO: 943391 - protein, 107 aa, Homo sapiens
LVFSFPPPSSPPSPWLKKKKVKKAPLSCGGVADSRGGGLEGEGPVGGGSQVPGKPGLVAYREERGYGQWLLVSSATPAHCPGDFNTTGGAGLCGVRSDKRGAGKKNR

SEQ ID NO: 943392 - protein, 118 aa, Homo sapiens
AQSIGDVHLFPEEYTILLGLLVKRWSSLRLCAPGDFRAFSFQDKRDDVQLVVMSDIEGSYKSGCGDKIWKGVGGLGGGIFRIVRIKVIFFATRGIGKSSFRVLTGGRTGHLLFVFFGG

SEQ ID NO: 943393 - protein, 139 aa, Homo sapiens
RGAAMDLEKSEEFKERCTQCAAISWGLTDEGQIYIALLATMLQRNIRKLQTLELNPNTQKKALNRGLKKKNNTEKSWDWYSDVEGIQEIQYQEAEALKENLRVGPEIKKRSFTKFEEAPPSEEQAGHIVKNPVYTTEKT

SEQ ID NO: 943394 - protein, 216 aa, Homo sapiens
GIPGIAGRDSRRLKWTAGMAERAALEELVKLQGEPLPGPQLQKASPQLIQEEVAKHQKLKALLGPDESKQKFVPKTPQGTRDYSPRQMAVLKKVFDVIFPCFQPPGAEVIDTPVFEQKETLMGKYGEDTQLIYDQKDPGGELPSPPYDHPVPFAQYLEMNKLTFIKRYRIAKVYRRDNPPKTPGPYLEFYQCDFDIAGNFDPPIPHAECPKIMCEI

SEQ ID NO: 943395 - protein, 111 aa, Homo sapiens
MRGYRVLFQMTKMLCRGCACEDILVLETSALAGWGQQRSRGLDLSRRFQPLLAGYPQPLLSFTILGGQARLKVVAGAVTCPASRGQYAGLWQNSAPRRLGVPGGFPDHWGQ

SEQ ID NO: 943396 - protein, 69 aa, Homo sapiens
NYTSETEDGNIAKPQLPVKQKVMKTPELPPPTYPICSLNATITRATAPFILYRQPESHTVIAPRRKQLL

SEQ ID NO: 943397 - protein, 237 aa, Homo sapiens
LSDQKSNGAVGQEVLATDVADLLGLHSLGSGGVSDLLIQVPPDGTAAFFSNVQAGFIPAMELLLPGWYFLFGFLQQRFGAISSDSSHALLMKVVAMSVFEELLGVANPVYIVFNLFWYVIIDDVLDGRVVQVLGGNVCCYQDIFLALSECFDGLSPFFLVFVPMDGYGLNPLEQQVLVDGVHVCLLLCKDEYRRGCLLQALEQVHHLGLLLHIFYLLDDIQAGSPSAPHIDGHRLYK

SEQ ID NO: 943398 - protein, 116 aa, Homo sapiens
MLFLGSGEGKLALAVFCSVFFFLTRCFRGFERWVNGRWMEQTEETADDSVVEEGGKMLGWLANVPPFQRFTGNGAQLGHEVGLLPLCDALLRNFEVSLQLLEDFLLGLELLIWLAF

SEQ ID NO: 943399 - protein, 66 aa, Homo sapiens
LNPSCNQSGAIQPGTEPTEPIDLSPTTGALLAGIGKEEAGHPPQGLSDVLQFALDARGPHLYPKPP

SEQ ID NO: 943400 - protein, 104 aa, Homo sapiens
MEEQLAKNSQDTPRKNNFHVILETEVKYATVITPPGGILVFFRPFPKEGVIRAVLYWYKFSEIAVSESGDHQKGHTHTQKFFFCYLQCYTFFGKGCYFLLILQV

SEQ ID NO: 943401 - protein, 74 aa, Homo sapiens
MSQGGGQGTHQGPALASAPPSPLLHGYQKMSGKNRLALSRECGQVQRRAGARILAQKHSKTESDPEMIQIKQKL

SEQ ID NO: 943402 - protein, 156 aa, Homo sapiens
MLPKGHCQYGVHYLGQESSFPNVVYIVPAVIKRFVINDKASQSYSQTDYTKNTVSKCFFFWNLLRKFYAEEILKHFLLNLFDKDVNNIISGGGFFGVFQGLDVIGGGGCDPPFPSRVAGSSFFVIHFLAEVSSTLAMPILLQDVYRPSVIPAHRGG

SEQ ID NO: 943403 - protein, 138 aa, Homo sapiens
MSFSKVIIYANRQIVSQADPQVSAFPWRVIGKRALRQDSMLDVPQHRRDLLSGFQSYYSGWHFLFAAVSSSPSSFLSTPGGGGPACAILTAFPTCALLPAKFVSGGLLVGWTAPFLPHLASSSLLTDENMVTAAFDEP

SEQ ID NO: 943404 - protein, 311 aa, Homo sapiens
FSFSFFSSSFPPPGTWEGKEREPTATPHIQILTSMAHTSKLFVKEKQVHPSLLRAHQVWAWVGGPWAGSLNRCKGVGCKSFEEAGNFSRAPPSSSLCALLPLLAYRRKGPFVPSTPVTLAGDAAINGLAFGHKILLLFGLLTCSPPGRHLFCGPTPESQPFGPGFQLAGGRSGASHRRPMPSLLQVYTTAVPASHSSCPCPTAAYTDAKSLRTRSYMAKVPSWYPTAAIGITLQKPKDSTELDSLSSPSPRLGWEATVSGLKTPTTLPVVALTILAWQSTEPVRIKLPSWYGSNTGELALVDLSPFQYMDE

SEQ ID NO: 943405 - protein, 252 aa, Homo sapiens
GRGRGRGRGGGQPPAHEVEVQEGCLQQAVRGRAVAGRAQCGGFPGELLVEIADDGEPGERGDKRRCQAPGQQGFPTKKAEEGLLPHIFCISLLDPSLRSGITSEAAYLMMPMSFGRQEAGSRRTTSLTMMSKTSSSSSPGNGDIANKDLVEQHKKYPHSPQIEEYDVSISTSRAKKSGVPENVVVWAPYPIPFLAEAKCDLDVALGVQEQIVQVVPVDETVYNEETVGHNTTQADKDWQGLREHVAVDVHIK

SEQ ID NO: 943406 - protein, 233 aa, Homo sapiens
GAEQERKGPGGQGGGGGGRAGGPQTQEEGAKTRRRRRSEAQPPLGAAEGTKRGEPGAARARRRRAAPAKRGGRKKSGGHGQSDGGGGGGQSHRGGGGGAKERPPPPKGPEPPPPKAPPARGPKEEDGEGAAPKAGELATTAKKAASRTKARRASPTATRATTTTAATKATTTTEGAARRPKGAVSQPKTTVHDPPPKVSRHHVRTSFGKDEALANLVAFDRLRFLTSQVVAIH

SEQ ID NO: 943407 - protein, 139 aa, Homo sapiens
MIWSEQGSEPDVGVTKDEEFVGNGFVAVINNAVIMLWFPSREVGAGRGLQPDESQLKEDSASPFLSPFPRSAPPPKPKTTPNKVRMLILLAGSAVPHEGIERVAALTPLSPYTRVGGQEHVATPSKGKWEISKKGIKFE

SEQ ID NO: 943408 - protein, 100 aa, Homo sapiens
MTLLWSLLFFAAIFPHPHGNVCHHVKPPSRQLWLQSSPLGRKRSEGNVTPGFPCFLLPLRVGVLRDSPPPPLPSSLVASPKPFLKAVTMHSIPGRYFRGI

SEQ ID NO: 943409 - protein, 92 aa, Homo sapiens
MGPPHAPSTRSFARSSSGQLGANRMQGRPQPSQRPTQQGTQAQSTPPWDRGKRGGGGASQMSRTLSTDTREGKPLGRTDREDAIIPERSVKV

SEQ ID NO: 943410 - protein, 151 aa, Homo sapiens
MKVLEYHGDIIWRGKLCGRSAQASVQPWRQASLQLVLGLAGDIFLLIFLLVLLILLILIFVLIILLVLCLLLLFAFLVFFLLLQPLLLVLFVLHLFLCCLSYAPRLVAKLLSVCFIVGDEEVVKDGARLDLPEVQAQHAKVIIGIDTGIGR

SEQ ID NO: 943411 - protein, 265 aa, Homo sapiens
PGACMSRPNLVGEFTFRSSGMDLPQPHQQIISPCFQEGTYSPTSGLYGPGRMIGRGVWGSRSLQTEKYEENQVSIILLIVLLLPRCETEGRRKGRGVLQPLWPLLGCADCHSCYYDGLSDQQVAQEGLLDAGFFLLPPHACEVVGTWNPACLELQAQRGPVTFPRSHSLKGKGCSCFPSNTLGPASCWMLLLSPLLCVTAPALCAGRPWLCGSVLGLGRLLLFLVPSSPQYPVGPCVPGYFAPALSLCSCPLLCALASLAPFPSV

SEQ ID NO: 943412 - protein, 322 aa, Homo sapiens
FPGWTAQLTAVLRQLLDPKLISTEENTQAAETKGPLPTPSCTQTQHLEGLLLTTSHLNFWNPPTTAEITIEAQPPKISEGKDVLLLVHKVPQNPPGYFWYKREKKDLNQNKKTEKIKGKKKKYGPAYSGRETKESNASLLSQKVTRKDAGTYTLHIKKQGEKTKKKIRHFTFTLNLETPKPYISSSNLNPREAMEAVRLICDPETLDASYLWWMNGQNFFVFFLLQLSKTKKTLKQIGVTKYIAGPYECERRNPVSASRSDPVTLNLLPKLPIPYITIKNLNPRENKDVLAFTCEPKSENYTYIWWLNGQSLPVSPGGKSTH

SEQ ID NO: 943413 - protein, 139 aa, Homo sapiens
FSPLGRPLSNQQGGKPPQCSASAAPSPPGSAPRAVHVAEVAASRRGVEPHATVAGPRPSLRALAFRAAVRRGREEGSPARALDPAQRAAAASASAEEPLCPGCPTVGPQIDALPASEDFCAAVCRAWPSSAAPAGRSGT

SEQ ID NO: 943414 - protein, 236 aa, Homo sapiens
VPPVFPGCCLPASICPGPFCCLLGAAGYQPAASAALRAGGDIPRACGGPCLPGCAIPPGPAFPGFCHKGPGVPSAVCVFCLKVLPPQLVSCVGWAYPLCIFFVPCASALFLLGVLAFAGRYFAARLLCCFLLRCCLYRFLDVRSPDMALYPEKKLRCLCAEALRLWAVAASYGQGGYLYRELYPVLMRALQVVPRELSTHPPQPLSMQRIASLLTLLTQLTLAAGSTPAETISDSK

SEQ ID NO: 943415 - protein, 183 aa, Homo sapiens
MFFSLPLLLLSLPHPHIDPRAGGPWVGIVLLVEQVIGLVFDVTEAIHQMAWAVIVITRDVLAAPWQLLFRRAHPNLHIFSLVGLFEELEGIIIIHADVIGIALDPTLGHMGAFHPDPLKFHLLGMAEVESLAPRPPSLNLGFRRPLELLGFFHIGFSIVYAVGSCKDMLLCHLGAGAAVDNFT

SEQ ID NO: 943416 - protein, 182 aa, Homo sapiens
RSCLAELVGHQRGLLQAGDGDRREQVPQVQGSGGAQVTSGILSYGKLVLQAHSTISGPQLASVSRCTEGGRSLRTLKTACAEEPRNCRRRRHLEPAPPEGPGPPAPPGHCPAAAAWAVSSSTRWRPRTHAPDPFSIELKQYSASIVFEEHSVHHELQRAISQAAAPWERSVSTVSCMCAFVM

SEQ ID NO: 943417 - protein, 188 aa, Homo sapiens
MGDLSFLENFLVEVHKHSTVFGKVWLTVLFILRMLVLCTAAVSSLGDEQADFLCVMIQPGCQYVCYDQAFPFSFISYLVLLIFFVSTPSLVYMGHAMHTVFILWKRKLRVADMAKEVLSSGFYEYPLADEGIYCPAWRNGMEGLSLGILLNIYVCSIVIRTIMEVVSSLWASIFIYGIFFYHPACLSE

SEQ ID NO: 943418 - protein, 205 aa, Homo sapiens
MNDSMTAATVFMPMMASPVREFVKDLFFSVSFTIIFEIFEDDSGKLLVAQYPIGNLLMSGHIELICSQYLSVHLHVHSGHHLHKVLVHSGGLGRSDIGVVQGVHNAWIGAPQGGCVWVMLLPKLCKLWTCTWFWKLFPGAKWFSATLLSFKSIHLAAFILLLLHLLAEALSPALLNSIWVLEGTASTAICLPHIFTGVTALDIFC

SEQ ID NO: 943419 - protein, 359 aa, Homo sapiens
TGPALPGTPPPPATTAPTYCGRSCPLHGRPRAAHPRLGATRSGNVTHVTDALALDPHAAHLPWAPRTLHAGRGLTRLPTPDGLFSRVPCLAPFWWTLDPRNPWPVSAHGAFGPLFRPDHLSSLVRRGAGTHTWATGSPTTGRGRTLVDFGPGAVVRNGRVKHLRPACTGFHADPTSLGGGTGSGLGTVAHSRPVRDGRTPDPHSCTPFQRRALTQRCQTTVVEPYNATLSIHQLVENTDETYCIDNEALYDICFRTLKLATPTYGDLNHLVSATMSGVTTSLRFPGQLNADLRNWAVNMVPFPRLHFFMPGFAPSQPGAAAVPGLTVPSSPAMFDARHDGAATAHGATDVARVPGDVMR

SEQ ID NO: 943420 - protein, 118 aa, Homo sapiens
MPVIAALREAEAGGSRGQGIQTILANMEKPRLYQKYKKISRACGQAPVVPSTGSPNFPGGWGRKMESTRAAGPAVSRDYATALQPGRQSQTPSQKRGRYRNLIFQIFLFSLHSSFMPF

SEQ ID NO: 943421 - protein, 272 aa, Homo sapiens
MESAKIIRCRFLPVAFHLPVSLVFCFAGPQNSSPGYSLHPKSREDGQARSRRVSRGPIRFTGGPLYLLEMSASISFCSSLVFSSSRSSLGSRAACSSSASCCFCTISSFFKASSWDCFSFCWRNSVTRSTYLGEAKDHKQVLQLKTGKLANQILQHCHHGNHLLFGLALQDGWSQLELRDCLLTNSTLWAKKISSSHELIKELIPGLSVFKQCGIWALELLEPGVKVIESVSPVYPITSRIFESDSGKMPSRFSSLGRDARVSALRNGSTLK

SEQ ID NO: 943422 - protein, 148 aa, Homo sapiens
LVPQSPTSLGRGVFSHSEERREPRKEKLFFEEKKQSFFFYFRFFFPGSLPQSLKKMNYSFKKQGREGLGEEGGRRKLSGPPFRLLVGRGAVVDFDKPPFIGRKKGTGILKTWSCLENPVRTESGLWTGSNTAFTPKDSGKAPQGQGNQ

SEQ ID NO: 943423 - protein, 277 aa, Homo sapiens
SHTPVGLAHLGYTAGPGPGLARAVAPAPGTHTSSPPGYLRPPFCFPGPPPPLCHPPPPPTPAPLSPPLPAPHPPPPPPTLLLSPNLPPPITPAPTPTLLYRALLLFPTSVLLPLSDPNLPSSPNPAFNFFHPNLTAPLPNLLNFPITPLHSLLTTRLHIYFTLLTEGGGEINFLCPLENPSWNAQITLSLVNFKNQQAIQTLRARQILRDRDPRVLNHQAHHLSFMLPTTSLLKTNFIIPSGLWGHGCAPCGKVENINVWRRRWSCKKWTTLGGGQK

SEQ ID NO: 943424 - protein, 267 aa, Homo sapiens
MLGLLSFPGGLRYWQQSVAQCCGGLGPSRSQGSLGPSSGRDSLTLGGDGVALRGRTGPRERGRVRELSWVQWFLVCLLAGNGSSRSVGPEVVFYMGHRIRELGASLATDNFQASTRVTEKAAEMECVRFRASQAGPSFSPRRACGGEAAVGWCSRCLALSSLCRCLVTRPHLRCGMYRREEEGQPVLARTKSLLATPERLVLATVSVLVNGGCRGSPSPEKPAPHVAYEIPQMAVGSVPTQGLGGGTLGLANDSKTGANGGQYEGET

SEQ ID NO: 943425 - protein, 201 aa, Homo sapiens
MASWYCWYSDTRSFIFISGLGEINKVHLARVTVKEGICAGKWTVNCSEMRFNSSWMAVLLPMKVAEIFRPRGGMSHTAVFTLLGIHSTKKLLFLFCTLSICLSTFFMDMRPRKMAATVSSGRGAGLQAAIMFLESNICWVNSGVSTRYCWPRLVRGARRRMKKCKREEDTMFTASLLQVCVQLARAARQVVTPLMVADTGG

SEQ ID NO: 943426 - protein, 71 aa, Homo sapiens
TYQVNNFIKVLKVSLRKCWVKQITGKKCKNNLIIYKKEQSIEGKPSVIKPSLDVHGKEYGEPFPFSRLSPS

SEQ ID NO: 943427 - protein, 175 aa, Homo sapiens
MGKSPDQTFQNKASKEGGPAESYVQTQKGEEAEQGEEPGSASARLEVTIALPQGMYRLLPGSLQEGQHPWLSFFWFRASYSNLLVMMLLDYEVCGEVAATVNLTEDAPSLGLLVWVRAIPVRDNFYIAVTHQIHLEVTKELCCERIRGSNHTSDTYRQPAAQNPFIQIHDGVVLP

SEQ ID NO: 943428 - protein, 225 aa, Homo sapiens
AGAPPGLWRDSSGRSEPSAKISGVTWGWQPQIQVASGGCPFQVSPMTQCRFQGPKAMCNSQMDFYECLRGAPDPAALTALEFLSSAFAWWWWLGCPGLQSSQRVSCSGWAARPPLCTRSPPPSVWASWAAAGSSPPDVDVLLACFSPPFSRPVLPLLLRGGCRLPLSVLASPGLSSENGQRDFFFWYKSKEICPSPAPAELRRASLQSPKTLRRARSNTSEETRT

SEQ ID NO: 943429 - protein, 111 aa, Homo sapiens
MCVSTEVGISATRSHVAPQFIRLCLPLPALLSAPQVGGKDLALKSRVPGMDPPTQQWSIRSHEKHESSHEDVQGLARSSASHGLKEGLARGLDVSDSDLSGADLHTGKATQ

SEQ ID NO: 943430 - protein, 157 aa, Homo sapiens
SPPPPPPLPHSPPPRSHTIFPPPPSLHNHNPNPTTLSPLPPPPPPPSLLPFTSYPPLYNSPNPTPHSQTPLNSSSHFHASLITKPPLQLYNNSSNFHHSYFNHLTTPFTQNHLTYYSSYSHLSHFDQHLQNPPTSLSHKTLLLLLTPFLPPASSLHP

SEQ ID NO: 943431 - protein, 158 aa, Homo sapiens
PGMGLRGDRRPLLRQLAQNLGSRVRGTGNRRKGTRTALEMYLATRHIGRKWGNGMIQQAQGCAGRHLPGSSGSQMDQRGREEVRLKVSLLLVIQDCFLRSEEKLKSQLGVPQVAPHKVSQVPNCLAGAEEDLEEVAVGEQDPQSHLWVALKLLLYLRL

SEQ ID NO: 943432 - protein, 258 aa, Homo sapiens
MEQKERKEIDEYMADGKDEGARIRVEDIIREEYIVEGMEILELYCELMLARFGIIQSMKELDSGLAESVYTLIWAAPRLQSEVAELKIVDDEICEKYSKEYGKLCRTNQIGTVNDRIMHKLSVEGPPKILVERYLIEIEKNYNVLYERDSVVMEEAPPGVETDLIDVGFTDDVKKGGPGRGGSGGFTAPVGGPDGTVEMGMRMDMPMPSANTPFSYPLEKGTVDDINADKNISSAQIVGPGPSQKPLQSFFPDLQITM

SEQ ID NO: 943433 - protein, 49 aa, Homo sapiens
MGLLLLVLILTPSLAAYSHPDFPLRKKLSNCSKVQDPLTPPIAGYVTSS

SEQ ID NO: 943434 - protein, 281 aa, Homo sapiens
WEGYFLDTVKKKKKEHTHTHTHPHSRAALPGSKATLGEGQCQEALTGGMGGPSPSPGSQLSHGPVQGVHRPVIIIPAKEPALDGGWARALVHHGDGRPPLPVGWVRLDVTCLEEVKASVFSCFLQNPLPTQTKTWSQVSSSMRSSVAQVFLHELTRNLFVSRKRSNLVGGRQRGEEGWGIHLLVPSAVGDVREAAFPPRASQKPSGSLPSATCTGWARSTLSSSWAPVFSAFLAPVPTHRYAAEGVFRTKASLEFSAPALGNTSTARVGSSAVGADLEEAG

SEQ ID NO: 943435 - protein, 263 aa, Homo sapiens
MPVATQRSVFGSLTAKAPPLSPWQASCFERWVSSTEHVLKEHIHPIPSPAPSPHSACALSYGQTDKPEVMFYLLLHDPEATDIAHQAHGREKECVVGEAEGEEVGTQGDTIFQLQQGDVPLKIVGLILTVVRVDADPADGVISSFMSSSTFVWPRNTSKEALLCASCSLGYRVWAAVRIQRSPSRAPPPRPWMLVNTCQGKLPILGFLPSDDALPLFHGVHGLPTHWQAPRNLLSLLFILPNDLCCAGVHPLLRLPAASSGLH

SEQ ID NO: 943436 - protein, 144 aa, Homo sapiens
NHIPAPKIYNLGAAIAGRQRDCLESNAAPPWRSPAAPGPHQREVGMLTPPVSRQAESGRGRIDPRPAKGSLVSPLQSPNFTKASAWEMALSAAGRKLAQCASRANPHQTGAVCQLCKPPPAAPPPAAKENNFQSSPQDFMPRGW

SEQ ID NO: 943437 - protein, 338 aa, Homo sapiens
MSSGICVHTGGLLGLTGAGHPSVLGARTCAWVGTHLAIVLIAGPWCGFGGCEEVTSLDDCDPEEAWEERDVGVLALEQAAVGGDLLLQARLQAQLDVVLLVLAAPSRSGAGASCSSTRAKSSPGLGQLHAVATFGLLQAVLQGCFHAELGVQLNLQVLHGAPELRDLALAALHHLAVGGYLAVQLLCLGEEPFLGILAVLLCHLLILVTHLVQNAAQVHARCSVHLHIDISSHLASQGIHLLLVVLLQVGQPLLQALNLHLQVSSGQGQYVQHPAQAIDVGFHTHAQVQLCLILGAGVIRGQKGIVNLQKDIGNVHCGCENLVPQGLNGLEVGTVVFD

SEQ ID NO: 943438 - protein, 110 aa, Homo sapiens
MVVRRLCQTCCRCWPEDLAPGPGRLPSFEASAMRLDALVYGPLGGDSHRCPEVSYTRLLEKLLLRNRTGSSHGSDEQEGDAESSRLDFCGGSCMLEGVGIESEKQKEVWG

SEQ ID NO: 943439 - protein, 108 aa, Homo sapiens
MPCTELAHAKSLLTILNYIFGQGRWFMPIIPALWVVKVDGFSVVRCSLAAWLTLCDPVSTKDAKSLSDDSGACLLSQLLRWLRQDNRLSPGGRGCSELRSCHVTLQPG

SEQ ID NO: 943440 - protein, 114 aa, Homo sapiens
MTAYTSMSAEGEGECLEFSEVGNDKTNLLKNLEEGQHSPQYKMKSDPEEIFKNKQTNKTKNTTPKPPFSQSRRRAKGSRPSPLRQHLWAQVSAEGARAPGSDSSVPSLHTEGDG

SEQ ID NO: 943441 - protein, 74 aa, Homo sapiens
QRISGGEGDTKICKTIFKDLTQKEEEKAKKYFQTTSYGVSKENEISSNQGLNENLQKEAGISKEALRNKNEFHK

SEQ ID NO: 943442 - protein, 141 aa, Homo sapiens
ARQGNEEPPGEQKREAQRTGAQNGGETGGERGQEKGEPGEAEGGEAANNKRGGERAQRPHQTAKGDEDNKKEENGGQKQRAKKKKGKGRAKERNGPPHPINDEEEIQGDIKGEEKKSRPRPGPGAKTETLGLSLERYKGDK

SEQ ID NO: 943443 - protein, 49 aa, Homo sapiens
MLQVSFHAEGVGQENLVVVVAEPNGDGSGWTAKGRYAIKVDEDVGHPLQ

SEQ ID NO: 943444 - protein, 122 aa, Homo sapiens
DAWDTTASFCLPHTVDFTVTVLSSSGATGFRAMSTAATGCCGYFCGLTVYTGLRLFFHFTNVTRGWAWGHSGYDCVSLPMGTLYLNSETRHKRVAQDSITSATHGTGSGCYGGLRDGRLGFG

SEQ ID NO: 943445 - protein, 204 aa, Homo sapiens
MASTSISNIIKNSLGPIGLNKILVDNISDVTITNDSATILKLLKVKHPATKILYKLAKLQHKKIGHQTTSIVIILLKNTDKLIKHKIHPTSIISGYRLACKEAVRYINENLIVNTDELGRDCLINAAKTSMSSKIIGINGDFFANMVVDAVLAIKYTDIRGQPRYPVNSVNILKAHGRSQMESMLISGYALNCVVGSRACPRES

SEQ ID NO: 943446 - protein, 174 aa, Homo sapiens
GRGVVRAFLITAPVRKQGEEGASYSFSGLSGGSVPPMAEPAAEPAPSFLCLLIHQSPHLQSHVPLVRRNRGCPAWRIQEEAEVLVGLDDKARWCPKRFFGFLFYIFFIFGAGFEILGKFLANFKFSRSPGHPCTPWLSNRWRSQLVPFITTVHVCIPCPPSELRSHTCLNLCSH

SEQ ID NO: 943447 - protein, 294 aa, Homo sapiens
KTESTLESGHRGRQEAIAGGHLSLDGSSLVHTVPKKGLPLGPRNPSQPSQAEPHPGFSQRGAQEDPSCPKSEEQQETASEVRHSSVLLPENVHFLFGDHGNQKTMAVQCVWDGGAPSSLGTWGGDSSDQEKRGEPWEMLEGPREDGGQEKGEICSQVMAPLGLRGKWWVSARGRKEWSHPSAPGCLSIWWPDSSLKSPPQGLRGSSEGKGVWGKQGWPTRARGRWGLAKTDGRVSSGQEALQGEVIPLTVLPGLWRQARALGLEQPPLAVAEGPHPIRHKDEMQTSRWGIIRTA

SEQ ID NO: 943448 - protein, 118 aa, Homo sapiens
MHLGALACCAGGGQQCSARAPSSSLFFSASLSAFFSLPPTWGGRVRRHCRRVQTSNGSKELEGDFKNLPPSLACRGFQATLFNPFYFSKKLGNSNGNSEKLAGGGNIRARGSNWVNLP

SEQ ID NO: 943449 - protein, 119 aa, Homo sapiens
MVFGRTWSRHNIGVGSGGAGPPTGPSCGDGCLSPSVPRGSGYGWLPVCLFSRLSHPEKGVEQCICCYEVGGNGVCDWYLCFSGGLQADGGRAAPGFLWAGLASRDPECLHALGDSGWQV

SEQ ID NO: 943450 - protein, 120 aa, Homo sapiens
GALAPPSKSAPPAAVSLGRGPSRLEFNSAASVSPESSSMLMKMPGVSHSGPSSRKSMASSDGGGPGPGRRRGRGGGEGCAPTPPGLSLLFPPQLPLEGLLLGQLQPMRSEGGRGGWGRRK

SEQ ID NO: 943451 - protein, 49 aa, Homo sapiens
KSYYYKGLYQATAVSSPIPSDGSRQEHASNFVFDVKSCRSEHPNAKPTE

SEQ ID NO: 943452 - protein, 179 aa, Homo sapiens
SKVAPFCVLRTQKSRSCTFTKAPCFCKSRFCQITIRLRFFGVWLCVFPGSSQVFPLAPQFRLSPFDPSISFVLFLGDSRAAGFSSFVWGGYLDWVGGRGGFFVWWSVGRGFVLHIHETSLIFAAFLLDLGYDDTRYKPVAAPGVWVALAGQLARLPNASGSPQLFIWHMTDNTGLTVAG

SEQ ID NO: 943453 - protein, 84 aa, Homo sapiens
MREGKAEPGKTRGGEDEQRRVEKEGDRAERQPGWQGKGNKAKRKTEQAERNVKMAYPVKHLSVGACNCEKYVEGKRSDTEDIPG

SEQ ID NO: 943454 - protein, 168 aa, Homo sapiens
MEGTCMLSIQDAMQQTPGSTEPLLEHFLPLPGGLRQKCFTYLKKVNTVSCMQLKESCQNINPRHWKLKDKVSSESQSPGTQLSAGSQKLFALQHSSPESSTAGHVRLRKPAVEEHKLLSDVANVPHKWEQCLRRMKNLKTKFKKLILIQEFHFPPRQAFNMDAAPEVL

SEQ ID NO: 943455 - protein, 153 aa, Homo sapiens
MGVLSFLVSAFFLVVDAYFPQKSKRQLPDNNWSFVNCTTENKENDNWFVGFCFLINPKGSHQTRRILLVGADSVRAAITFSFFSIFSWGVLASLAFQRYKDGVDDFIQNYVDPTPDPNTAYASYPDASVDNYQQPPFTQNAETTEGYQPPPVY

SEQ ID NO: 943456 - protein, 211 aa, Homo sapiens
WVWQGKRDGCCQGAGGGPGSGLALSALTVDLAGSSVAFHAGLGGPSFAAHLEANVILSLLPLALYEFPLMLLRFLHKPVGISTVVPIILGHCQAALSHPGPLPCCHVFAFKEVNILEHVSVDDPIVLSRLQELSHLLICFKTMEGGFSGTFTGLEPSGYRAVHQLAQNHAILQPELEAQAPKVWEATAGAQCTMITPPPAPPAPRHTSSRF

SEQ ID NO: 943457 - protein, 97 aa, Homo sapiens
MGLVEDVGLTGAQVEVVTDVVEATVVGSGGGSRTRGGIPGEKEFLLLRSELQRDPWQQEPLSVNPGPVIPYRVQNSSWTQPRTGKDTVTLAGVKVTC

SEQ ID NO: 943458 - protein, 299 aa, Homo sapiens
PQGEEGGCQYELAEAGQVLSGPRLGQERRHCALGAPVPGQRPGLPGEGSAGSALRGLAGFPAAAALLIRRWGLIGVAPRAVLWGENQGAGSGRWPPGALCKVGDSGTFDMHYGGCYGSDEGLPSWGQGSGAPGTELYVASMGCRCVLLFVVQYTGSNLWGLPSAASASASSLCGAEGTTGVWPQEAAPGLAGGSWGMVHSNIANEDREGHSSFRRLQRDLSVVVDVDEAAARQAALGQGRHQDLLVPLRPPPALYARTLQLRNGPYVVDTALGLIRHFLQQTGYTGLVSLPDWFSTSAC

SEQ ID NO: 943459 - protein, 193 aa, Homo sapiens
MPLCFEKEVGHPLNARGMCLDFYFGPSTRNRKHCLSELWLVNATHIWEAEEASPPFSSTTIEKGNGTDHDEGTCFCSASPGGLGVPHPMEHKQIFGSVVGWGGEKHKLHQNKEGPGEYRGGEGGGKQDPPSPPPHTHQPQFSLLRPWEPIQRTLCGVGALYPSQSCDLGELGLIPALLEEAALVKNGRKPGDG

SEQ ID NO: 943460 - protein, 133 aa, Homo sapiens
MTDFLSQALLRKTSCGNQARDKNSSLMQLGDRAARDFFGKLFHTPFMCECSASGTVRSLQGRGEVQGGGTFDPAKCAEVIYVVCLFPLPVPAALQQLLTTPMDWNIELKAKAELADAVVSIEKEMDEMEQKNT

SEQ ID NO: 943461 - protein, 201 aa, Homo sapiens
LPIRPGAVGVGCCPLCAAPGFVSSPILELPDMQHGGLSVGGGCLCWGYGWGWGRCVGHLLRSAQPEFIARENAKVNFVGKWMVDGLVAFCMGGYDVKGIIYVSRGRGIFWLRSFCQSGEAKLQGEKNESGCGGEPGPGLGVVKTLGGFYVRWLRAAGSAMLGIGGWDGREDVGPVLWAGGGKCEWEKGGCDVKEYEEKIGG

SEQ ID NO: 943462 - protein, 223 aa, Homo sapiens
MVLFSLGIHLFLVEVGHGRLHQGEASRGSLLSTRAPLARSPPLLLLPFVGWGHMIGRQGVGCFLLLGSKHSHVSVKRSSSSLVSQPTSATLQPRVSSTSVAGLMDGLGEGGGTGAGGGALGSITAQEQQHGVGEAGARAPSGQHNDHISLLEEASGLANIHGKVHPEVHVLSPGLLDWVLAQHKEDATVQVGLDELSGGFWVTAMMGARGRYLATGEQTAILV

SEQ ID NO: 943463 - protein, 180 aa, Homo sapiens
FYLNKILIRMEAMDATFHLGEDVLFSIFSSPEFFLARAWVKLLAPMFWPECGLEAIISFLPFFLSGRGVRCGSRGVWRVLVCWGCPPAVVVGVLGVALLFCRARLRGGAGSGPFPSFGRLLGLFLLASLWAASVFLGPLAFFVPLRALFSGPLPSVPRPCGLPGVAAFALLLFFGGRLAA

SEQ ID NO: 943464 - protein, 183 aa, Homo sapiens
MGIGIISMLYNLFTLDILFIDKREKCELEKISSKRGVVEINEHMKCPLKEESVFLGKNQDSLEATLCRGQSRTSINISWFTAFPKDTSGGAAFLSHWCRLSTELAFAETANPNPAVLSAETDEKKRPPGGDKISGKQSPTDAGKEEEANPYPRPPLTPALPPAPYPPPPPQRSSCPPLSLPSA

SEQ ID NO: 943465 - protein, 226 aa, Homo sapiens
MIAPCSFQWPCSPSIPQLWPLLPVGQEELPLPSGPGRDLPIRSTQGPRRCPWEERCRSGRSLDGNWARRVFEPLGRTQGVAAALSPVYGMGPSYVLRRIGLGGRGRGAWIPLVSAVQILWAGSAMGFNLLRIFLCNSRAGRKERPRPSSSAPQRGLVVLGRMGMQFWGAVRGVDPHSCPSLLRKPSASAQPRLGTPQPPSPRSPLDNPPAPLARSLGTAPRRILGL

SEQ ID NO: 943466 - protein, 240 aa, Homo sapiens
MQGAQEASASEMLPLLLLLLWAGALAQERRFQLEGPESLTVQEGLCVLVPCRLPTTLPASYYGYGYWFLEGADVPVATNDPDEEVQEETRGRFHLLWDLRRKNCSLSIRDARRRDNAAYFFRLKSKWMKYGYEYFKFFVRVMALTHRPNISIPGTLESGHPSNLTCSVPCFSEQATPPSSPGFQLPPPPWAPGPPSPRCSQSPHGPTTTAPTSPLSSRSLEPLLNMQSTIQLNVSYAPQK

SEQ ID NO: 943467 - protein, 144 aa, Homo sapiens
MDAVLVLLVGGDHVVLQGLLALLFRTVVLLVTDVIVVYYVVAGFVEMDTMLEKDDSAVTVVRDVQLVMRVVVADVPHPVGVLLQGLHGFGDISGVPELHLTVVSAAGQVVLLIGIKVKVPHQLSVGILYAVDLAHAPGVQPGWG

SEQ ID NO: 943468 - protein, 316 aa, Homo sapiens
NYSQYSELVAGRQQSPERLQGSYQAKASTVERGDTTLPPKDPKRPLKAYRTKTSFNWKELALFKEREDMRRFKKTIFSTLENKPLFPRPPGTEESLEKYRKQNFLQCKQICKYNFINIEECFKNTLKVPALIQCLDMYKSPLAAKYLLHSLVFSSAVYSSGSERHLTYIQKIFRMEIFRCFALTELSHGSDTKAIRTTAHYDPATEEFIIHSPDFEAAKFWVGNMGKTATHAVVFAKLCVPGDQCHGLHPFIVQIRDPKTLLPMPGVMVGDIGKNSGKTVWIMVSPCSTRSEFSPEPSEPDGRRHPEGTMSAPLKK

SEQ ID NO: 943469 - protein, 300 aa, Homo sapiens
PTFSPPPPPHPPTHHSPPLHHHFPTLSPTPPPHHPTHHPPLSPPPPSTSHTSPFLPSPSYSSSSLSTSPSHPPLPPTPPPPPPTTSPSPPPSPPPPPTSPPPPPPPLPPSPPSLSPPPPPPHSTLPPPTHFPPPPPPPPTSPPPHPPPTPLPPPPLTPPLPILHTHPPLKPHTPPTVTHHHLLHNFHLIPPSQHHHSILSHPITTYHPSNPLHLTNIKKSNHPSPIQLYTLLHTLPNPHHTSPQQISKFYLPNSNNNPFYHTTHSHTSIHPHPPLSSSLYPSNPNTIPPSPHITPHPTPT

SEQ ID NO: 943470 - protein, 96 aa, Homo sapiens
TPPNITTPTFHYLINTFTFPYTSTSNLSPPIYNINPPPSNYLKNYSLLFHFPFSTHYFSILFKDTPTTLPTPQILLLTYNIITTLSSDTNSHTTTH

SEQ ID NO: 943471 - protein, 311 aa, Homo sapiens
AWLSARLLFSSSSFLFFVSPSFCSGLALFCMALANASTSPLLAASTASPGRSNWHMRGPSCPEAKAALNMPRACWYWGEVRVFWISSAVCGSDPEGKLGSRRSWTSALARVGAIFSGVNHWPGPLAGRLLARLVRSLWPGCSGGQLSWMAWVGLAAVLAPFPELGAGLGLVAEAAAGAEGAGVARVEDVVDDGVTAADWLRELEEELLPGGPLLPSELARPGPVRAPSPPSSPRPAGPMNCMNRLLLMFPIWVCRAPSPPSAESSWPPLPLAPSSPGIGGVVQKLVDFAAMLLNLVCLGFLPPEEKPLGPC

SEQ ID NO: 943472 - protein, 128 aa, Homo sapiens
GSRIGIRKMCSRRCLSDDDESVHGRLSSDGGALSRPQRQRGHSLVEGLGLRCVHLHLTDTSYGGMKPGQEHMCAQAVFAFMYGMRVGCGGGWQMRDRTENGPSNPTSSPGVSRSLFSYYFASPYVTGT

SEQ ID NO: 943473 - protein, 103 aa, Homo sapiens
FIPYSSFYPLFPLLFSSLNPPPTPGKYETRPWRTSSLSTFFSYNKFGIVHHLSFHHPLSLPSFFIAPFILPNSTFSDTSQPIVPLASHSHRSSLCNTASPLMP

SEQ ID NO: 943474 - protein, 32 aa, Homo sapiens
MNVDLSPTAWRPRFPTDHRDTVTRDNGTYTHL

SEQ ID NO: 943475 - protein, 179 aa, Homo sapiens
TLNYQQNQPQEHRQTNHTKMEQKEACMDITPLRNNNGLSPLCANGLKTDIPARILKLPSFKQQHKEKLGGKNKPLTNLITTFKKNHDHLHALGKGTLFYLRLNNKRRLWNDRKKVTLGTQPTVLKTFRALSTINLFTCTNRPTVIKSSNHKKVFPKINLKEVNNMYPLKTEGYPDSLAQ

SEQ ID NO: 943476 - protein, 101 aa, Homo sapiens
MAFASTFLCPQEIHTLASMVYTHQARATGCARQSQEGLGHITAQVQVHQLQFSSVPFTSIVSQSRSRMEPSRGWVLPVWHWSCPQMASLRGAGHITATGGF

SEQ ID NO: 943477 - protein, 115 aa, Homo sapiens
MVVELSLLPAGAMQGQDKRPPVSQHPSMREKRGTEAAMSARGYGLLPDSNATIKDTEIGEVGEPYFYNKVKQICAFIPPDTQVEKNQCCGFCQDGIFLLLVPHMAFAMLEKHCTG

SEQ ID NO: 943478 - protein, 69 aa, Homo sapiens
GAAELHGMRSASEILGLYATPKSPELFQDTAAPPPPSWLELGREAYEAVISQQTAVQGWRQQLSSGGLQ

SEQ ID NO: 943479 - protein, 194 aa, Homo sapiens
SPLVLLSPLLFGGLRGKAEGGPTYLGERRPIFGAKTRWCGSRFREGRAYLGAGRGWGCLLECGGHRVLALWEGKEREAHKKSGRVDGRCFLGTEHVHCPGHEGQDKAWPEGVLEGIENVEEADLRGVAQPVPGAQQPHGQPKAGYLLAISQLCPTQLGIAGVPGEEEPGRCVKDEGGGLDIKVYKIRKIKKFGG

SEQ ID NO: 943480 - protein, 209 aa, Homo sapiens
MEGAASGGEGEPSGLSTEELEEEGLAVGLAGALLEGPLGERAEEEGACKVVRVEAATQGRNAAGYKECEQRTASCVEMVRLVIKKAASREGREDPADETVRVPERAEPEMYVIQDGALAALAARGEQLQEVPAAVGAALALVETLISEGLPATDAAEMLWVPVSAQGGHHLVSDGLVAEATSWREALKVARGAEGGSILLEKLLPPRAV

SEQ ID NO: 943481 - protein, 30 aa, Homo sapiens
MDSSILIVRSLCGEDSTKHVFVDWKPKVAQ

SEQ ID NO: 943482 - protein, 112 aa, Homo sapiens
MLRIAFLFPETLGLQANHSYSISFSLSAFLLLSKGYEVLKPYQEVTSLSGINTYPSVLKAHLLGIVLVVVVASVAGASERGLRRSDCFEQQKPTEAGSRSNASGSLSSPMQI

SEQ ID NO: 943483 - protein, 104 aa, Homo sapiens
SRPPVCWKATTALLIPYFLNISIDWKKQGEPLRSRFSEILSHSLTMVSLDSMSPVVNQDQAPTRLFSLSEERYSPKHTGSWSVMEANDKLDGELDREDRAFCMW

SEQ ID NO: 943484 - protein, 137 aa, Homo sapiens
MDVSERWGSVWQAVPFTKSMGSTSLGGGQGHPHVVRGRAAACQALGPLVRAAVGWEALDLTVQVEAGDGIPMWPWLSAFQWEVGNEFLIILVERKAKEAAHIVGSEETRVQLGRALEDCVLIGVVMKTVGLLAVTEW

SEQ ID NO: 943485 - protein, 234 aa, Homo sapiens
LPRGTVCQNGLRRPVRAQVPQRGLGYSRQARGADWAVGSPHCAPKVCPRLKEGPEEPHACNPQGCGSLTFYRIKGTWGWGKKHQVRQGLWAPDPRARAQDASTLAAPTAPGTGGCHGLAQAAAGHHATFGLVPTEVSLEELLMGTHCNTDLLVNDVHTAEAVEADLVETLSARSVCGVAAGARVLFLTAVKRPRLCGLQRCIFWFWGWGWDDFLLDLLLGLELELFLGGPRSDL

SEQ ID NO: 943486 - protein, 76 aa, Homo sapiens
IFQKIGGRLGWFFFNGLLQERRREDLAHYPGKFPLVPGRREERRRGQRGGRGAKAVMLWGKKLRLRLGAQGGAAQE

SEQ ID NO: 943487 - protein, 180 aa, Homo sapiens
FQTSRKQQEATSTQKHPCVCTHSSKAIPLARTQSPPSHLRAKENSRKQTSLIKGHTQVIFDHNGQEKEIKTKKKRKGRSFLESGQWLFSSLCQSRTLINLNTEGPNAKLQKYFRQLSSTSCGSSSDSFFILRWGGALPPRLVQSGAKLDLLQPPPPGLKGFSCLTPPKYLGLQAHATTPG

SEQ ID NO: 943488 - protein, 172 aa, Homo sapiens
MGQRGGEGGRRVGLVAPISLGLVVGRGSRVEEGPERQGMGGKRKEVPSCRKPPSSSQKEEERGEKREEVEEEEEGGVGEGLLEKAKDVKKGGEGGKGGVAVRGASGPEGEAQHPLQPLRHTRREKEGQRPTQPVYQIQNRGMGTAAPAAMDPVVGQAKLLPPERMKHSIKLV

SEQ ID NO: 943489 - protein, 116 aa, Homo sapiens
MSRGTFEFDTAPSTRGIKFSFLLMARKLLLLARELKASVIFPAALSVTSLLTLLSTAVRVSRGPAPLEPGSSQIGRRLAGAQGHSSADTVFSEIGNPWGSNLLSDGQKAHEALLSI

SEQ ID NO: 943490 - protein, 151 aa, Homo sapiens
MTTISWIFEDKMSKRAVKLEFIAFMLWKEAANLLQLSLNCLMMLADLLKPVDYALLFALVVGNNQECSSFEQQNFIGPNDLGKNPEVHLQLLNVGNQLVEDAGPGFVERRIPDGRSKTSTLQRARQTPQVFLSLFKNQVKLILLNQIHFVH

SEQ ID NO: 943491 - protein, 180 aa, Homo sapiens
MGYLNRQSQYDLIFFKNSTPTPFQSASFHCTIVEEMEEQDGFGWLESHLGEAGQVGFATGVVLISSHEDISFVSPVFSPAVFNYPVLVSLLDSISYCENRMVQIIAIAAFIIIHTFAVKLEGGQACINGHRDRSHSGHCPLQRLSHSPRGISLYPLDFSCLACWGCTYNSLPVLHMGRHL

SEQ ID NO: 943492 - protein, 44 aa, Homo sapiens
PLTVILRPLLVDGVCRQFKLPPLAAVVAPLAVEWGLEVGWVAGS

SEQ ID NO: 943493 - protein, 90 aa, Homo sapiens
FQAKCNTLIPCFRNDTDKPGNPRGVEQVLHTSLGSSTTFSPRVHHGGAPPVRPPFHSLLTVVDGVALYIHFRGQRLAAQCYNCRYLFDLE

SEQ ID NO: 943494 - protein, 125 aa, Homo sapiens
TSPLTIVSASNGESFVLQYDCYWWGTSGDLGGGGLLGKDLPVICYTTGQISIYSNSHFQNERTQEFILSFENVSWLDFDFLEIEITDKWSKNKLVKIVLGGVSVETWGGVDEEGGILEEARRHTG

SEQ ID NO: 943495 - protein, 103 aa, Homo sapiens
MHLLHPGSEAKGEVKRPPRPVPKGGQTAACDVKGQVGDTLAMDPLKALLLLAPPGIVEMNTTATGQGPDLGVGGSRPPGTARHPRPLQSGLSLASRGLLLLVF

SEQ ID NO: 943496 - protein, 109 aa, Homo sapiens
IITRTHVINGYQFVSPLLPPTLGDHPLGNLPYAASLGRSPSSFGPAPEAECHCPWTLFQSAPCCGEESLWDLEVTRLGWRFFFFFLGEPAPGASANPQAKGVFCVGSFF

SEQ ID NO: 943497 - protein, 203 aa, Homo sapiens
MGPAGDIGAPNGKALPSFPSSSRSHHRSTGMRPCLNTVAVLWQSADSLLSILHLYLCTFSISAGSCRILLRASKKKGCLMIAINNIFGSAETSHPGLQTEHFYSTIIDEFLYTSHCLILLIKPSALLEQESHSAFSANCSCTWLMQNLYPSFRFLTTCFTAAAGLSFPPLVCALARCREAASSCAALHVQEQLLQPPPVFAQL

SEQ ID NO: 943498 - protein, 191 aa, Homo sapiens
DCIGRQYICCFNYTQKPADTKITDIQNERRSCTCMKPDAEPQCMREGHGASIKKKNDQRTAESQFGAIPGKGAPGALVEPGTHTSWAGLGSPRSQPVFSHSFCVLIYHQQPQPLGAKPYTPPSSPLLVGYIITSPLPNLNVTSDSVITWGQAWQPPGGLVIHERMLALSHDDSSVDPVAQPSERLGRTSHR

SEQ ID NO: 943499 - protein, 72 aa, Homo sapiens
VRVSLFLWCSCWRLVVQRGLTPIGGTCGTMRVHHPVAVAKDDVIPGNELKKVVVKGNNNKQQSKSGESEEYS

SEQ ID NO: 943500 - protein, 164 aa, Homo sapiens
EEGGVLREKENISGSNKVREIYFIGDTGGNSHCVPELFNGNGGVKGGGGGGTFCKFHRDDACLRPTWQHGGWLDGPPRGSNHVDGLLDVHLFLILTAVELEEDVFEKVAPVQYFHGVNDAKIQWLQDSSSVGGQITNLNPFQVWKHVMSRAVVYEQEDPAFRPL

SEQ ID NO: 943501 - protein, 56 aa, Homo sapiens
MPLRFLHKPVGISTVVPINLGHCQAAQSHQGPLHCCDVFTFKEVNSLEHVSFEDPI

SEQ ID NO: 943502 - protein, 181 aa, Homo sapiens
AHNKASKTRSRPGPNVKRRWGVNPRQLASQAEVVKKRRPHVPQERRITHIHELKVYRTATEIPSNHRHILEGQPHRSPSQQQLLHKIFHQLRAVVGGGCQAQELFTPGESFAVVDGLHIDAMLGEQEITELAVECCIAHPDGDDMAGAGDDRQARLSISSWRMCLTLRWWARAQGLGPPLP

SEQ ID NO: 943503 - protein, 210 aa, Homo sapiens
WFSPRPQGQSPQLLVENMESAKITIRCRFLPVAFHLPVSLVFCLEGPQNNSPGYHLHPKSGEDGQARTRRVLQRGPIRFKGRTLYLLEMLASISFCSSLVFSSSRSSLGSRAALLLKCLLPASATHQPPFFKAQPAWRTAFQPFACAGNSSPLSSHIPLRAGPGIHKTRLLASLQALAKPCHNLASLPAPAHPWLTHPSSLWLWPLPGMA

SEQ ID NO: 943504 - protein, 66 aa, Homo sapiens
MHTLFPEPSPAIYKQDAAGKKTTGISRRLKVRTVRGFYVVLLVPHGVWVCEEEAAALKITILELIE

SEQ ID NO: 943505 - protein, 190 aa, Homo sapiens
MTRLKRKGDCDGVVWPTALGGPQEASSPVGYGVRSYEPGGVGGRVGASSPHGPAMGMEGPYLGLEMIVWSARQLLPSFLWVPAGVAWCPVSAVLLPGGGSAGLARPGGGLLWGLLPWVGLMVQKINVGIILMLQGASCAPWGSDIRRCWDSIYPFDDAVVVQDVTCQQLHPLAASCMLAETLLGPWASVL

SEQ ID NO: 943506 - protein, 109 aa, Homo sapiens
MILSLGPETPSCPLGQPPHSGGGKGVTLSLVCGNAPIKVRGAPGERLGDVGHFLFLWSHPVLRERRPHPWSGVPRGGWGVIFPSYYGRTPKSCLSKLPTPHPKGSKCNP

SEQ ID NO: 943507 - protein, 215 aa, Homo sapiens
QLRGQAERQQKQTGQGGGTKGDGTKGGRKKGQKAGEENRQRSSTGEKKKGGKQEPGEEGGQEQGGGGGGGWKGRKGAAGAGAQGRRGGSQDGDTGRAPGQGPETVTGKEEERAGPGAEGGTEQAESPPGGPGSGGRKSGGPEGRNGPGRGQKHAAGGGEAGKQDKARGAPEREEGKEGEKAGEGGTREDREEDGGTAEATRAGPRGHRERALGQG

SEQ ID NO: 943508 - protein, 279 aa, Homo sapiens
DTREQGGTKKQAGPGRKAREQRTAGRRQRLEPRPSSTEENTQAAETRGPPPAPAGTQRTTGKGRRPTAARGNGGNPPTTAEGTTEAQPPKEAEGKEGRRRGHKGPQNRPGYFRDKGERTDRDQTGESEREDGKRSRVGAVRQWVRETVDGQLSPAEPEEHPEGGRNRLRTQHKARGGDERIKATWHLHRSGETPKPDSAGGYGNPSEAREAGRLIVEPVYAGRKRPRREEEAERPGGGGGAPGQNQQDPPARGEHKGEGRTRGRGKTEPREVQVQGPRD

SEQ ID NO: 943509 - protein, 250 aa, Homo sapiens
SECVFSNFATDRVGKLCSGVSAFSFCSNSVIFSAYLSSLVEYSSSEAIRDLRAWSMVRSASSSCVARLWATSALCSERSSPPSRITSFLATSPDLRSESAMCLASFSCIFCSISSTFKARFSDELNSSVALISGLLGLLQLLQGCCELLGPVQLLLNQLNAAVQGGHSCLSISCLLLGLPQFLLGLLHGFRILFHLILCALDLLLEGLLLLLQPLARFLSLLFVGFGLRGAVDGVLLYSFSICISSEGVM

SEQ ID NO: 943510 - protein, 189 aa, Homo sapiens
GGGWGRGGVGAGEGGGGGGRGGWGGARVGRVVGGALCGSEECAPFPGGWAGGERGGVGAKGGGGGVGALALGAGLQGDDRPVLGLLSVTVLEKAQQRRGLHGLDLGSAVPEQTLELGLGPLSRALSGGFCRALGVAVQVVVSVHIAVQALCIQLLLPPSFFSMPLGLCQVLADSLSDFHIAQVTFYLCI

SEQ ID NO: 943511 - protein, 72 aa, Homo sapiens
AEELVGKHSALLESCQAMPGHRIMGLLALSCQCPGGVEDAHMRHLGLTTHQPTWERVLPQQEDTIIQQEPNQ

SEQ ID NO: 943512 - protein, 189 aa, Homo sapiens
MGLLGIPQGRVGLAQLEVGLDVVVVLVEDGRAVVQHLVVLLDHQLALAVVEQRRDLLVQLDPFRGPRLFLHLVLEAGGIVVLGSLLHMRLAVEPVALLVDKWHCLCLLFVCYGPWVLLVRSKTLHLQHLHVEEEGLGVLLQGVQVSMAQGAVFTHLFYNAAVPLALQGVLAHRDVAETFGHQRVQDHML

SEQ ID NO: 943513 - protein, 212 aa, Homo sapiens
MVWAFVGTLPWEGGMRWLEKCSWRVFFCPQGHGIFYSFFVPKGQSGGQGLFAKELSWGKRQGELPAGPKGEQGLDPREQPRVLFSNRMKQGGRLWSELFYGFLHYWLFRMVLMKSFLYGKPHIFQLGEQQRIYLYFKGTCSPEERFDLDARILLLQSTGQLQVGCLEAAGLQFTTMRTPLPGSTSSGGGATDVCPGSPLIAAGSARAPAFGC

SEQ ID NO: 943514 - protein, 194 aa, Homo sapiens
MRRTQRSLWCGTCLRRAAAAAEPPACVPSVARGWRRRWQRRYWREVALAQERVSFMLLRAAVEHTIVVESLVLQPGGCHNYTLPVLEKGEFSVPGVQVHANYGALAEPRREAGLVALVVEEARFGEAPAVLIPAQQAAERVGVFVQVHIRRPDAHHHVGAVDGRGHLDLPEVLALPQPLGAPDGRRAAPVLHVG

SEQ ID NO: 943515 - protein, 222 aa, Homo sapiens
MGCAGGTVLERAEQARGERERQSRPGHGGEELRSLNFGPRGKEEASWSSVDGYGEGNVLVSMGERMPAGTSEVTGQAEPPTLTERSLRALGLSGNVTAKIYIYIYINHSWEGRGKAWGGIRGSGVASRSQLCLPETPRGWCPSVTRSRSCPLAAGYPRSSEDSPWIFREQLGIPRKEPIISGYCQPTQIHQRPLHTGHVLSFPEVHSLEDVSCVNAIALSCL

SEQ ID NO: 943516 - protein, 114 aa, Homo sapiens
MGRGPQLARLPTNMEAPLISQLRRGLLCGEPTEEALGEAEHMKGPRDLRIDVCDANELAEGDDGPVAAEAVTFGLCLHLDMRTFKSYMKYHGILYGLHIVLYNANGELLCSVLF

SEQ ID NO: 943517 - protein, 218 aa, Homo sapiens
CDGVKLHPPPDGYDVGVREGGEVGEGGIGHNFVHHGLGHHLAKGPGLGPLQDLCGALQGCRQRGWLLQDVADVVEPHVALLIPTEHNPLIRAGAEREVGQLGGRALQLRQDHHCHRGLAAPAPPPLPPAPQADGAQAAPLGGHDVLIHKCQLIHSPPDASEPSKKKNSYFTQPPFLGVVQPAVPAAAAEIAAGQQAGVRAGGDRAEAQGDRGGVQCEL

SEQ ID NO: 943518 - protein, 186 aa, Homo sapiens
SRLPARMMLQELSGHKVLLGGQFLKTHRATWVTYHQEKKEPQNQRDNSDLSFLRKLFFLLYDGIITFLLNVGAIVTDSAILPPVSRCEEELQTSSSRSHSSFLSGNSCPCPSPPPSPAAVFSLRKAGCFPAMADSRLSTPRHNGDQQPLATSPLGQRPGLQAHAVSLPANDHSGGRLCAVRVVTVN

SEQ ID NO: 943519 - protein, 104 aa, Homo sapiens
VPQDVGVQQVSGREGPLAKGANISVQRVEVVLVVVQGIEHLEAAGHLAGKTRAPWGFSGTWATCMSTSSEVEVALHLPILEELVAPAGSARGRAKKRKGAAPAG

SEQ ID NO: 943520 - protein, 91 aa, Homo sapiens
PFTDVSFHRPPGPTSHYHPICLPQQSAGTLGPLEDAGGGQLGIRGVAELGDQPLALSREELLPKRGDIDSLAALSLPRPAFRPRPLTWAYR

SEQ ID NO: 943521 - protein, 192 aa, Homo sapiens
MATRGTSSARERGQSRAEAPPRALLAPPPPPAPHPSPATQLFSSSTPPGTTPPAQPSDPPPRPQRHRQAQAQRTPSPPPLPTPFHNTRLRPPTPRSPGALIPTLPAPPAPRSVMDAAFVCSFVMKINVRSRKLSRCWSCSGVQPRVPATSSMSIMVTPPCTKPCRVQCEGPTRWIKLDWLSLKVYGSGLRTG

SEQ ID NO: 943522 - protein, 256 aa, Homo sapiens
MPNTQPGCKGGPRNCSRGKLGTGAPRRRILRRHTHRASHRISSKGLVKKSLSPTPERKRGGEKEEGKRLEETENKAQLFQAHAPSQGRRIPEGTQDRRRGGRKAAFPGGSKFWAGGQSCCGGGGGGKGEAPEPPSFTESTILPPTCMFNTPILTQQPPITEYCCRRRTPPPQNHLPTVHRHPAPPPATPTHTHPLPHNDRTQKTLYFGTVFVTRMLTKGPGEYPGKGPPTPKTKDPRFSFPWREPDRGTGERVEMG

SEQ ID NO: 943523 - protein, 95 aa, Homo sapiens
LSDKYIQTHYSERDLDGDKRPHCNRGITQTSGMVLRRPTLCGKQGLWGRPLRLRMAGPERYRNRRSVLVWRKQEVTLITSFAQMIEFEIPPGLME

SEQ ID NO: 943524 - protein, 137 aa, Homo sapiens
VFWGWVWAVFDTNTSFTDLIFSTVCFFLLVGVDATAMRAGVLAVWWAGAWRRGGSLGALFGCDPFRTASVPRIGVPWPFPLCVWVCVLAVSLLGVWVSGCFFLLLQVVAFFIICAASSFIFTLNTHQFPKFDILVIV

SEQ ID NO: 943525 - protein, 203 aa, Homo sapiens
MPSTQTLLSPFSCLRVQIVLGGSVGTCTRMVFSVDVVYKAPTEYWIPVLEKAVAHIKGPDKLEAAVAVGEDVQQALVVTSPVLGFLVGHAEQVGFQLQTLQDAVGSAVHHHQAVVLAAWNDVPVIRQQGQHGSGVYSLVLQGGWAGSRVVDGQLLVIGASKQDVRQVEEAQHGELDFISPNCCPSDAMSQSFTVLSQEPEHTR

SEQ ID NO: 943526 - protein, 176 aa, Homo sapiens
MRCSSGICCWGIIVEEVVVVDVNEEGSWVSDDEPHHTAVLKYVEMEKEEKEGGQWDVSNDAGERPEENIPPPQDKKVIVEEGPGQEKKYFGNKIDDAKLKNGLFVFVAQFVRGVPVLQEVGRLGVEKVKVEIKVEKMHELSKGIKAGVEEPVEEDEPDEVIGDASFRRRSMMRELS

SEQ ID NO: 943527 - protein, 135 aa, Homo sapiens
MAASPDFKNFGPSSSFFPERRINLFLQLKLACVSRVARGAGAYLAWMVRDNLLSEASCFHWWVIFAVPSVATTNILERDILDIEAHIVPKKSFTQSFMVHFERIYFRCNVDWSKGDHHTGFEHTSIHSANRHSDK

SEQ ID NO: 943528 - protein, 94 aa, Homo sapiens
ASGVSFCSLGSRPSGLWHARTSGPWSGGRAWRGRCPGGPPAGKLLPKNENLEEKKDEKVKESRKTITLLPPKQKEKVLEKDEKEPFFFFFFFFY

SEQ ID NO: 943529 - protein, 185 aa, Homo sapiens
YINPCVPGFLAGGLGFIEKFTDLFDMLFLNAVLPVDFSKQVGRGQLLLWVPECGLGANLPQVVQCLLTDVDSFRLGTVFVLFHFLWGIQHGPVSHHSVQKVKRAVRGCDVLSASDDTVASVGCQDDVGVRLQGAVQVGEALNVQHVDLINKQHSRDQLSNALVMYLFTTLLISPRSLSVISVFFG

SEQ ID NO: 943530 - protein, 280 aa, Homo sapiens
FLWWFCHFNFKPVLDVIGVFGIILVRDKGGGQGFGAKEACPGHPVRVGVRVLRYVVVKEDVGSLVVHPPAKQIGGHQAPPLEIFGLLKECVGLLLGHAPVDGDGREVLLHEELGQGHAALHCLDEDYHLVKLQHIQEIKELAVLLTVFEFDVVLLQAVQRELVSSSTNTSMGSCMNFLHTGRMSLLRVALNIMHCFSCGVRRKISCTSRRMSSCSSILSDSSSKKYFTFFEAEAPIPHERQDAARGPTTTWGQFFFNTSSSFLMERHRRHRNLTLGMYWK

SEQ ID NO: 943531 - protein, 253 aa, Homo sapiens
DKKILQYPSGKGVGWGVLIVHFLAGSPRDRPSGRKPPPEEGKENDSGNRPGGGGEKSKKQTPPPQMGKRDRELEDEKGGVGGVAKNKNKGPGRTGVLEGLVGGLVLDKGGGNGLVPGENGGRVGGLWERREERIRGLGGGAEYVWGGTRKGDTGTLRGEGTEREQKAGAQGVAPERWWGQGGAVERGESRDGGAGRRREELGGAQGHGMELGWGASQLHDVLPPPAKPITKTGAPKVVGRGKQKRVPLPQRGA

SEQ ID NO: 943532 - protein, 148 aa, Homo sapiens
GGLASSSGLLVLCFVDPPRNSLSHITDGKAAQRRIVWEALNTHGLAGGRITNGSLTRLQEFGAIFQLFTRTAINLFLQLSQPACHVSRVEIRYGGRAGAYLAWVVQDTHLSSEASCFHSGVIFAVTKKVATTNILDRDILDIEAHIEK

SEQ ID NO: 943533 - protein, 112 aa, Homo sapiens
MGQLALLWEGLIEAGLAIGLVILLPDIALRQLCQAESTHKVLRMELVPHGTDTTASDGLPTPMAERSPAVMVMELTEWTSIQFKEGASRKTGEAVPTNKALWGARQCPWAER

SEQ ID NO: 943534 - protein, 138 aa, Homo sapiens
PDSRDGAAIVGSKKGDTGEGFLPQLLQWLELSNVEFAALDGVCDFFGEAFVCVPQGPAVLFIVLPDVWQYHSVFLLFGVVSLFFFHHKGSFGQVSEGVLGLGLSSQRLLTFIPLLLRSRGSSLFLFLPLSLGLLLLFP

SEQ ID NO: 943535 - protein, 165 aa, Homo sapiens
MKAPGFCCSASCTTFFFCSWQREHVVVDEPLQGRESERVAQGSLLEPCQGMQTHRARCACPGLFQLFVRHIRATAGRIQQDVVDLMVAWIRGGDRQEVLLSQYTARDASPGQQCGHGCQPLGIQVKGKDLPLVLQKSSQVTGLIAWGGTGIDDMGAWRGVSSMAG

SEQ ID NO: 943536 - protein, 122 aa, Homo sapiens
APVSEGQSYSRTLGAWVLGGGRAQGPQAVPGERAPVSQGHSYSRTLGAWVLRGGRALVLQAVPGGWCSGISGSLLQKASGGPGFCRGRAVVPRTPLEDRALAALSVLTVQEGGKSRVMLCGI

SEQ ID NO: 943537 - protein, 80 aa, Homo sapiens
MFLAGPCADQSHRKWATFGAPSPPSDKTKEGGGRMVVMQDVSILARWGQAAGEQLGVAKKRQSGPCRGVQLHFVQDGLLD

SEQ ID NO: 943538 - protein, 259 aa, Homo sapiens
METASNSKKVTAQGVLGKEIGEERGLGGGGWGLEPWEGSKEEEVAVASVWGDLSELSPGGLVACTDEGVLGTQTHQATVSVFNKWVLTLATKDQATGTKGELKDMCRVLNKYQGEQLTSIQGQNEQQVLQSSADIRYKLQGQFLFEGLFQFREASMRCVHLPGANFYSQLTHAANATHLLSPFEKHLRWTMEGPDSSYSCLLIHICWKVDSEARMEPPIHTEYLRSGGAMILIFMVLGARAVISFCILSAMPGYMGGAP

SEQ ID NO: 943539 - protein, 194 aa, Homo sapiens
GGPASTVWIYLYTREGGGRGSGGKLENKIVTMSKLGGRCRGGCEGPTKPQGTGEGGGLGGQEEPPEQKRRPELGAFVLVGVWGEEGRWPGPRGWAGSSGPGLRWGRGWGGGAGRRGGLGSGVGFGRVRACQQGDGGVIGEVPTSEMWVPSPSSNSSGRSLLPVSKEPGPSRFSGCAVEFTSCFPESGLLFSALG

SEQ ID NO: 943540 - protein, 129 aa, Homo sapiens
HLRLPHFPRQTRGTLQAEGKQLPGAALQGRWGGGEGGGAAWRWGGGPGGRGSGGLGTPNPHLLVTGGHTPFFRGAMQTLDNLTGAGVSRGGLGGGEGMGSGPWGWWGGAGGASPLVGGVAGLGPCVLKL

SEQ ID NO: 943541 - protein, 294 aa, Homo sapiens
PRLRASWFLETCPATANTGKREGGIRKTGGGKGGPPRLEQQEEGGGEGPGRPGGPPPPEACLLEEREDLPPPPALRKRLLAGAPPAPPPPGGETGPLPPGPPQPPRSRARSRGKKPLPNPPNKKAQEGAATRGRPAKSPLVPDSARSLLSSSQAESTRGFTLTAASAPRATGRFTTKGVSTAATPEKPPATKLMPTEVWAFGLSPLSQLFTSPELDQYRAEKGTSRRAVGPQPSHSERHHPGATAVRTQAPSSRYDTSRACSFVRISTRGLITVTVPRRPARHQPWVRRGQRAG

SEQ ID NO: 943542 - protein, 85 aa, Homo sapiens
AGLANLGVFGECGFSCDSGVKVGERFALRLALLSHSSRGPCWPWVRGRWARGAPRVCGFGAWGAPLPSVLCVPMTPEIINRNLHY

SEQ ID NO: 943543 - protein, 143 aa, Homo sapiens
VIAQGGKQPRVSRGPVHGIDAVLVLLVGGDGVVLEGLLALLFRKEVLLATEEIAAEEEAEGSDEMDTMLEKDDSAVTAAREEQLVKRVVVADVPHPVGVLLQGLHGFGDISGVPELHLTVVSAAGQVVLLIGIKIKVPHQLSV

SEQ ID NO: 943544 - protein, 145 aa, Homo sapiens
MERLATRRTAAQPCGTFSWEYTSYTPGGRTGPQWTHQPRRREPAQNRIGESQTEFWRAATESSPQEWICVLEPREGHSAGLKRKIRPEHASADTGRPGRGRGMAGPGGAGKRRENIESTGGDTVGGDGGNGKRSGRRTRVGDLGK

SEQ ID NO: 943545 - protein, 117 aa, Homo sapiens
PASNPQHQQTLQRHAALYQEARGLGPYNIHIFLEKRVKRSIYEKEEGCRLKQRLNSQGHVGNTSRHSAATTVHTLTQARPAGFRASRLHSGRYPFPPNPQNPKQGITKKDTGKPNDS

SEQ ID NO: 943546 - protein, 130 aa, Homo sapiens
RPSPFPEGAWGGNLPPSTWLDLGFGKAAHTISWAFPRRQAGFCGEAEELGHCNSERPGEPLCYLSQEEGETKAQSLKKDILSRPPIPKPWPLGQSRQNQESQKQKAPSMLVHGIAGRCGKLPPPTPGLGY

SEQ ID NO: 943547 - protein, 148 aa, Homo sapiens
MASNDAHDGDGGLGRWLPSQGEGLWQPLVLHMARVSLLFSRRHHHSCPLLEGSISCWPGLHKLGVLSLVLAIPLPGQCDLRRVEAQGPAPQGGLMVRDGMVGLCVFGCSRAAGLLPVLQVSAEHSTHVPPGRLSTARLTGRFHLRWVI

SEQ ID NO: 943548 - protein, 104 aa, Homo sapiens
GGLGGLASSGGLLVHCFGGPHSNCVSLFTDSKAAQRRVVWGALNTHGIAGGRFNNGGIPRLQDFEAFFRLFTREEVNLFLQLSKLACDVSCVAIQYRGIAGAYF

SEQ ID NO: 943549 - protein, 247 aa, Homo sapiens
DIDTLHVLLKLGDLLLQQVCTHLVEIHQKMNLYFRIKYPTLTSLAAPQTSPSSWIERTQASSSAMSVSSSQGLKSSRKEELATSAGFLDFFSGYCCSSSSWSCAASLSSSSLLLPNRSMSSSSSSSAGVGGFLAGGSIWRMAVLCWVCGVVVSGRRVLFQHVQLGFQLGDDLLELFHATQIVVLHFQTGNPDDELTMVSLVPLEAPGPELPARDFWMFSLALAMSRRITLAPFSWGEAPATGPFICS

SEQ ID NO: 943550 - protein, 67 aa, Homo sapiens
TQAGPGRSCLLSQTGKREPDLLIQPPPASHAKAIPKIPGSDTASPLDPSWGCSSAGGAPKLAPYNVE

SEQ ID NO: 943551 - protein, 262 aa, Homo sapiens
MLPLAVGPSCPFASGTEAFAGAELFKGACERQLSSEETSRCQDEDELHGAGFGGSLRPGGGLGMAWAPGSDCSLPLFAVGGPRVDLPPGVEGLAGPDPEARRDAHDQRHKVLNHGGREVRAHGGVGGGGFGGWLWGGGVASSCCFEYPVVFPVVPAWVFVEVAGDDDGGWYSVQKLSDANVHHDLLQLLGLGAIVLHDGADAEDRHKAGQQKGRADKQVPFEGRHTKPLQRFHVVKPHEAHSAQHIAVHLAQRRAGDGLDGG

SEQ ID NO: 943552 - protein, 300 aa, Homo sapiens
ENITGTLGKDMITKRKPSNQKALPSVSQADPEIRGAGQAAGPKGKGELVFLSFFLTLSFNSIHTTLPIILLTGSHIFKGLSSLAFLHPLTQVPENKGLLGIHQVKLLVQAGPGLRKGRGGALQAHSPQDLGQDSTRHHGGGRGGGGKLVAWGGGIQKEGGGAGFAGGNGGVDIFGNQATRVQKAAGEEFTKGGVTFHHLVGWLKASIGFLCYRKLFMVGFLSRDDRGICGLLEVDFGVGHQVGLEFCQVNIQDSIKSQGSSDGGHNLANKEVKVSVGWALDIEVSTTDVIDGLIVYHEGT

SEQ ID NO: 943553 - protein, 199 aa, Homo sapiens
MDGLPPPTSHAPYPPPPLPPPPPPLPNLPPDNPSSTVGRCYWVAWFVGGEGVCVWSGVLCDFFAFFWVDGVGVLLGLLFGWSGGVVEGVGCGGVVFVGGGGGGAGGGSVWGPPGISASWSIGCWAIVSSTIMGPPCACYRRRVALFIGRVVRGLLVIISKIIVISTSIISSSIVVITTSVAPTLVAISRSWSEISTATT

SEQ ID NO: 943554 - protein, 292 aa, Homo sapiens
HYWAGKTEEPLYAEGISSSRYTSGRCRSTNTGSKTWSVTRPCRRISSTRSSSFSSLVASMNSKYLKIITKMQEIYIKALFHHLKSLPLHGHLIIETKEFHKIDEKKLYGDLAGDWGQWSGDLGGCLTNRGSAALKKKMQHQALGLAQETDDVAWPGETEGCWRPTLDLLPCQKHPHPLKMLLARQPQQYPGIPLLLQLCVFLSLFYPAGSLCSCSLHFTHTHTFFFHLFLCLFNSIEYGLYFIFSKETTAGPEEAQSKGIDLLCLSCQTLGMVSQGYSSAAQAHCSVSCDRQ

SEQ ID NO: 943555 - protein, 101 aa, Homo sapiens
MGGLDSSYSCVRIHICWKVDSEARMEPPIHTEYLGSGGAMILIFIVLGARAVISFCILSAMPGYMVVPPESPVLAVQVFAAVHVTLHDGVEGSFVDAEDSM

SEQ ID NO: 943556 - protein, 214 aa, Homo sapiens
MPLKQREPGAGGSREWSMELYILKGDERRGEKKKKGEEEEGGWCLVLRLGQAWGSGKFETVPPGHLVPPPPVLSQCERQRSGMIEVEGLVGGLVGLAGCRDWQGATCGIAWGWGWLCSERGGHCGGLDVNHPGVHDLTLDLHHLLIVPRGPTACQGLIGGHGRHHQGHLGPGGLVVADGWEQQVVPSERDNIKCVFPSVNCIQECWLRTVWVAI

SEQ ID NO: 943557 - protein, 147 aa, Homo sapiens
MPRRAQTLLEPQGARHSPAKRKKEKAARPGGGGREKTGANGAGRGERDRGVLGQDEALVDAQSHVSKSRGLSSKPCSGRPCLRALPPRMVRGAPTPISLGLWAQVTPGGSSGQRWRAWALPPSPVESRAGAWCHAPRAPGLTWTPAY

SEQ ID NO: 943558 - protein, 309 aa, Homo sapiens
PNILCVLDIRSLSSHQPPTLFLASTLNATSLIFYFLTVSYSSSSAEFSHIVHTDFFFLVVAFSSSAFFPPPFFFPSGYILPHPFAPPFFSYFAAFPDFLLPTIATYLFFIPFFLLLHPEDLLTPFLSLKYFFLYSSPSPLRSFFYSFFSFLGALVFIFSSLSFPPGLSPSGLCLCLYSPRSLFASVPPLSPGGVSSVFFFVHSSFFPFVDTLSRTRYAWCFFVVFRILFGECGESQLEGGRVLLEESAEVQSVVRGLRSQIKGLEDGGHRGGRQGCGVRGVLWRQGRRHTLFSHQDLAEDDGEQQKEKP

SEQ ID NO: 943559 - protein, 250 aa, Homo sapiens
KGILRANITSGVPGQHDLHLDAQHNLYEQEVEDSSINVVVKRVSAVGNQAIHKLHGFSPLSSEFPRNHNLAAFGPTFHDEPQHIAGPPHSQLSKEFVTQRLCVGNGTKTSSGHLFSIKLERKRGISCYHHEAVQLTVENVGFAKKVLFSTPSLRNPGPHAAQEMALIVAQHKFNIVIFCATSSSVAQDISSSNVAYGGQKIGHHHHIQHIISVSLNFLKHFYHLHTMQVLALPPWLLWPCKYTNGDSESI

SEQ ID NO: 943560 - protein, 295 aa, Homo sapiens
PFGLFEGTRQTWKWNFVVSTRGSPQLGSATGQHMALLPPPESLEEELVAGSLQDVTLMTLRFTDPLFTHNPCKHENGLVTPSTPQDKMRVRDVWLGFEAAQELPGFLLHEKLVPCAPTCYRLLGTVFFWHVSVLVASLLLATAAFSGLACKKPWLSKLLSSLIPDRVRLEEFEGAVVGKDRYLGSVDIISFIILIHNVKIQRLPDFLDGAPRSPGFLFCFSGLMSSSMMSSMPASERSTSFKSSSRCGVCGRGFRGSVLLQGVLERGWRVGSVVHGVLLIWGYNAACFWCRVSCP

SEQ ID NO: 943561 - protein, 179 aa, Homo sapiens
GEWIGGGGGGEKLTQKRERREVWGWGEKPAREGEEGDSGGGGGQGGATGGEGSSPQNTKLGGLTGAVLGLGAGEEMGDVEGLRSVVGFLLDPTPWVPAQDEFADFVVERDEETVGEGTEPPAGLERVHAQGHVHAGAVGQEGSQGRLLKKPEDQDLVLQALLEDRVPPGLADDQIGPVD

SEQ ID NO: 943562 - protein, 280 aa, Homo sapiens
MEDCQRLIQLQHPWPPPHPGVKARGSALEQATGVAVETPVVTMTHDLPRSLAGKGKAQACAGPQAWQPPAPLPGMGDTLTGSGSLHLPKNARAMIIMATLQAVLSDHVQSGSVPPTRGTSFSRGGLAKVEQIPCCRKMFKNPTDGIFKKRRNLPVAWRQRDSEHGSKHSWTDSCMKKYIMVSGNKPPPRVGCLEMDPLSQKPEKPEGRDGGVNGRCVGVRCHFREVPWVSGDALLQARPQSPEACAAAGCAAPEGSRQRPGLALRITVHLSQLSDHRLPP

SEQ ID NO: 943563 - protein, 225 aa, Homo sapiens
MSSFFRFSRLTNVISLQNPSNHLCCQGYLLLFANEGFYEMLLLHIICALVQMVDAKGGVHLLHLFGSGFGHSLVGFYATVFPGGHGVDLQCFGKRSHGILFFGGALIRLLANCQGTGYLSSPSSIHHTIIADEVPDDTQSIVKGSFRLLNDHLISSSNKNGYSSGVLTLLDDQHFILSCPNEISCTRPAKPSFSAVSSENLGTIRPPVAMASAQFQVSYPANAAS

SEQ ID NO: 943564 - protein, 187 aa, Homo sapiens
KAKKPQAGPEGRVDGTAGDGFIAFLRLYFIQIKLVMVVFGGFFKWWFRAGGMDSSTPIMYIGRKLNIIWIHKSHMVSFPEEEEGGGVCALPKARALLILHVNELFIIGANTENPNAKVGGRAPEFGFLREKLEGAQAVDVFVGGELVALAVQVSKLPVGAKVKRNLFSRFLMDSSMSFSDRSASSNL

SEQ ID NO: 943565 - protein, 201 aa, Homo sapiens
GPWSPRRRPSSLIMATPPMTYTMSRGPARCFYASLVLVASDRSVCTDSGLGAGRVCGGGYEGPQDPVPAVSSTASSITSLMTGVSNGTAEKVGSMRLGSSRLEVPEPPGLVDSSSQLLQVYGLSCCPPVTLACWIQLGQVLLTHTIPKRDVEQQDPDLVVGGHAQFQQHRNDSASLESFYVLPPLASGAHGAGSCSDTYTA

SEQ ID NO: 943566 - protein, 154 aa, Homo sapiens
GLVNFGIKAAQQAWGKGGGRKQPGSVWASLWLWGPEIQIIISQPLQRLGYLVGVGRVITTETFWGGRAEHYDRGCNASLCGQQNVSQLLPSLVSRVSQPLALVLLFWLEHRRTLGPHSSSPASVSWHQPPSRRDRLSQCGARCGPGCTEQEAGN

SEQ ID NO: 943567 - protein, 194 aa, Homo sapiens
MATPPMTYTMSRGAARASMPALFFCQSPKRALTAAWELAVGGSDTKGHRFLSSRSSTASSIYILDDRGPAGQLKVGSMGSLGSSWLEVPEAPGLVKVPPSCSRLRMRLLCACTLACWILRFFSLPFRRRCATGPGFFCRRAPRSSSTGTISFMESLIFSPSASEPMARSCSTVHSFSTEPLKCFIQSSARCRCV

SEQ ID NO: 943568 - protein, 237 aa, Homo sapiens
QAFLPPRPPKRAEITGLSCCMAIILLKAATEEKSTARNHRILKGGVTFEPVASDARAAGHMFTMAQVTLTAGPTSSVGHRAGLQVKREEPGTMPLVSSGVAAKTWGSRGEEGGLRAQREGKRRCDRIAEEALELPKAFNAAESRAARLPTRRSLHESRVGQGPPLSSVVRAGNPRQELALPPWRKFGVRPGTMVTRPVEGGNSRSQLSSSGPATSSPSNKRTMGATCGTPPRRGRRV

SEQ ID NO: 943569 - protein, 34 aa, Homo sapiens
MGRKALGIYHQFHGRGAVVTCDHGCLVPPAGPTS

SEQ ID NO: 943570 - protein, 192 aa, Homo sapiens
MAATEYGSRPYDSKFRTTVTFLLDSSLCQGDVNWTDSPYSSQWALVEEGSLDRQAEFFQTPGQKTVPWKLQECMLFIFVSDAVTSAGLTSPPLFVVWVPPVIFLGVVNELVRNITDLTLPFLEKASWLRKDMLAVGRRGVLYLEGDRAVPSPPPEESGLAGRARVCPPMSSSGVSRPPPPCSAHLCSAPSPV

SEQ ID NO: 943571 - protein, 246 aa, Homo sapiens
GRKVTRSMGAESVSKYEGLGTEEQVRAHSPSQDSVAPSLEKGKSILGAQFQEHRGQRLEMAESPYLRRHQNRQQQLCGKLDELVSSGKWEGALGWPLGDGSNTWLGGTHENTQMFPSRGGQSPKPLSLQAFLRKKRHSEKKEFKEPPGKGCQNIVLKAQLRRTRHQGTTCGGKARAASKHKCQGHKRMQDRPRLIGVGLSTARTASANTSLTPSCCRAEHSRKRTVGICLASTWPCCGVMGAGPAP

SEQ ID NO: 943572 - protein, 192 aa, Homo sapiens
WGGGGGVWVLLCPASHPISPQIINSHPWEAAELRSLPTALVAYTPTGELVQLAQNPGAAFHGGKLVTKIWVGGGGVWGGKRKGNLPPFLLIVVLALGPLGGGGVLASSSSSESSLLLLFFLLLFSPEGLSSLDTNSLLLVLSLSCLGGDLVGEPLGGVDFFSIFSFTFFFFFDLSLLEDSPRPPSYSFMAFS

SEQ ID NO: 943573 - protein, 261 aa, Homo sapiens
GGGGGEGGGGGRGGGGDGEGGAEAPGGAPARGRRQRARPSREEGGRCPPGGGERGGAGGERAWDPRIQGWGTGGGGRAREGKGRRGWGRGGAEGEERGGGEEEAKNKGGGGPEKRAGGEERRGGRGGGTGEGEAKDRKKRGGSGEGVSDSGGKRREEGREGLGEGECGERGQGKGEIERGEGPGEEGGPRVDKLVEKILHCSCQACGKEPSHEGLSVYVQGEDGPGSQPGTHPPPPARPHPGGQTPEPEEALGPPHRGRRG

SEQ ID NO: 943574 - protein, 101 aa, Homo sapiens
GVSSPETDRRRYSPPLQGLRAENGFESRMISKNMQRGEGKGKRCIPLRRGGWNGSEGAGRTSTRRLPFPWCVRKQSKLGDSNELHLLSRTHGSSPVDVTEQ

SEQ ID NO: 943575 - protein, 321 aa, Homo sapiens
AQRPGPGSHESPPDALRTPSLAGWATTGWGQTMTRGKTAAQPPCQSQALCQSLPPPVPGAKAPGRRGRGPDWAVAVPGLRGPAARARGPRPAAPCSGGGRPAWGPGPGSASAWRWPPRDRRVSGCRFCDPCPPCCSGHPPACRACGACPWGTPRSAGPRRAGRRSQLPEGRSCRHVGSWRGREPEDLLAEPRILLGGVCVRLRVQGLVHLGEDDLAQVEEAPVLACRDSMSFSRSSRGTALPVRECRDSRSSGSCSHTQFSSICDGASTKSRSTWVPLNMAELRLGAELVHHVAKLMEVGLSSSCCSSEGASAVGLVKWAT

SEQ ID NO: 943576 - protein, 38 aa, Homo sapiens
MNSQGGGEQATKERCETRRRPTTNEKRDSSGKVANRSP

SEQ ID NO: 943577 - protein, 175 aa, Homo sapiens
MLFSASVNSIWWMPSPVYQWRKAFLLLLAVKCSEMRLKSSWMAVVLQMKVNAILRPGGGISETAVLKFLGIHSTKKLVFFFCTLSICSSTSFMDIRPRKTAATVRYRPEAEEKKKKHVLGIEDLLGEFRHCESSLLLASTAGERGKARHKEMETWEGDHVDCQLAEVSIELARET

SEQ ID NO: 943578 - protein, 313 aa, Homo sapiens
AGGPTAKQAAVTPPVNPRGSHNSLHSQHCGERLLGRAPRKVHVAADRGAPPALRLGRCGAGGEETAGTATLAAVTGDQTLHKSALRDVHDCDPCSGVHKPCFLTKTAFLFSFNKKIQQILSNIYVPLVKEGGGQAKVSYTSRTTNTMYIFFNITWQVKIDNMIHIEMSSPLAATAVATKIGLFPELERVKGLSSIPLRTGSMDAGTCYPSWYKKSSRESAPFLVSTNTKVSEFLSVEIGRSSRNDRLSDSSTQTTFREMFSEVEPTLPTAKKIYSSKKSRASICISLGKVALNIIVWRTPFGGIVSCSTILRI

SEQ ID NO: 943579 - protein, 150 aa, Homo sapiens
YFCRHCRSSRASRCTTSPAASRGGRSRRSRCDTPQAKDQARPTDEVSKKIGMEDHAPPPKRLPFLLCGCRNGLPPSHSRVRRILSSIFMGFRPTEDVVPNSIVAPPWTTPGAAGGGGGTGPGGCRRRAPGHVPKRQHEAKPVMCEIHGGE

SEQ ID NO: 943580 - protein, 46 aa, Homo sapiens
MATAAAGTAIAPLAFLVLQSIGPRRHRGQSFCLQNFLPSWVQNLKP

SEQ ID NO: 943581 - protein, 112 aa, Homo sapiens
GGARLQQVRTLHPRGRSSGNQYFRCRGKRLLPEDRSGGLEGLGSSESRLKKSLPVRRICSSSFFYFFMYENTFSRLASRFLFRVDLPGVCFRLIRESFGVTGSSSKSNSLGM

SEQ ID NO: 943582 - protein, 166 aa, Homo sapiens
MLARALLLCAVLALSHTANPFCSHPCENRGVCVSVGFDQYECDSARTGFSGENCSTPEFFTRIKFFVKPTPNTVHFILSHFKGFLNVVNDIAFLGNAIMSYVLTSRLHLIDSPPTFNADFGFKSWEAFSDLSYFSGALAAVPDDCPTPLGVKGKKQLPDSNEIVEK

SEQ ID NO: 943583 - protein, 102 aa, Homo sapiens
MRVMCNTNHILLVHCQKSLQFASYCTETVEHKVLPYTVDPFTKGKGAANKVPTFSFSRAGAFCQSLLCHQGVHNNVMSILCKCCFVNWGGLATKFLQGFPRF

SEQ ID NO: 943584 - protein, 114 aa, Homo sapiens
QPAYEAPLQICTRCFKQRHHLMEICTSEQHLRDQPLALQCKYFSFHIIRETVQFTNHSFLIRDSVAVKFFFSFKTFQYFLIPKIRPPCGCGILGVGTLGGEAVFRMRWVGSYFV

SEQ ID NO: 943585 - protein, 121 aa, Homo sapiens
PPGWHHGLDPKWAWMLWITSFSPSTVFGDFGRKGRERSINVRSEGVLGQLRGADSGPHGLRGLLSVVLIPPRGFWLASGQTLFFSETLSSFPRAEPTKASFSKSKIGFGFLVAAVSAEKID

SEQ ID NO: 943586 - protein, 276 aa, Homo sapiens
LPTPRVPFPAPESARVSAATNLCPHSFWVVTCSPPSLLSRLERWVGGEGAAGEARPPLTSLFSQGFLLLAWFPFPTSHKSPGCHFLHPGSLLPASSAPPFSCGFSTIFYKGFSSFVVGYLLPTPPTPAGAPGQRRPAAWRRVVAGEVGGLGEGLSAVIALVRPLAIVEVVMLQKRGGAAEALAAHGAPVGPLARVGALVLDESGGAIEGLAAVGAAVGAAWQVGAGVDGQHRALAKALAALRALEGLLPGVAAGMGDKGRPLGEALAADATAEGPL

SEQ ID NO: 943587 - protein, 192 aa, Homo sapiens
RGVIRQREWGDAVGQGGAHPDPCAGSCGEFSEVSFFSGEQPLTTTAAEVSGSALPVVPRGIRRGGFCTKEAKALDFSGRRKSTIYKKILKMHSPSYELHCHSLPGTEFEEKAGFSETPLPSGQEKGAPFRHPRVFIWKDDFFGVVPPQLPQVEGRPSCCAAECELACHSGQQRLSGRLLASVHVLAGVEIGT

SEQ ID NO: 943588 - protein, 165 aa, Homo sapiens
SKTLKALSVKVGVGRGGVGFHPFFTLPVGFVGGSPAGGLAPGGWGGGGAGGGGGGGFPGGSAGGVGVSGGAVPPWGFPGGMGSGNEAFLCSLQPIPSQVEAGKAEVTGRVCGKEKRVFWVPVVRENPLPQLLDEASMISSFTFCNSFFTSSEAPVSPSVGPSNDW

SEQ ID NO: 943589 - protein, 111 aa, Homo sapiens
MGGGDNPCKWNAKMPKAPAFLIPKGVYIISVITVCGSGGGSKKKKKEKKTELAKKNKKEERHITGGGGVGGDPQAPRRAPNPPPGEGGPGGGGGGAAGRPRGGGGGAPAPP

SEQ ID NO: 943590 - protein, 44 aa, Homo sapiens
LGWALVFQRMGGYGEALSYTAKARAAEVPPGGAPGGPGSWASPA

SEQ ID NO: 943591 - protein, 112 aa, Homo sapiens
SLFPGMISFLWGRAQDSRAVFFFHTGLEVLILHKGLWGACFFREFLGWAANSTLFLPLGLWFLFVWGHIYMCNRPKGTPVGPSSGTWGLDLDCPWLPNWGLRDICNSQPVFC

SEQ ID NO: 943592 - protein, 99 aa, Homo sapiens
MTDLTNILKKKQQRKKSSTKVSQPHSAPQLLHTLCSQPLLEEEGGDAKKDFIFLVENANGIVDSSEDLELAFGGLLEQKICVTEDGETCFVAAGAFLLC

SEQ ID NO: 943593 - protein, 121 aa, Homo sapiens
THSKDVILSFHFGRCDWLSNVSREPSFQCPSFDPPQVEKALHGPLHSIIHGQYWLVAHGIFGFVAAVVVECASQYDPHGCEGGLQLDDRNLHHHQQGYLEGQVVGHPVGDVVFGGFIIEAC

SEQ ID NO: 943594 - protein, 174 aa, Homo sapiens
GGARGVRCNLRLVGPRDSCAWASKVAGITISHHTKPFSVSFVETGFCYVGHTGLNLLASSNPPASATRGVSGVGGRPQPRPFINILNALGGEGQLGNLSTPAGQGRGLAWGQFKKSLGNVVETPSLLKIQKSARYGGRVPGFQVNEEAEAGESLEPKKWRLKRAKTGTLHSSLG

SEQ ID NO: 943595 - protein, 181 aa, Homo sapiens
GGPGGEGQPGATGHQAQGGAGEEGGEPRDSGGGGAPPAGGGHEEEEEGAATGAEHGAKGRAGTAEEQGPEGRERDGKPTGRSAPLFKKEKQKGTQKFYGGNRRRSQSKQEIANRYQKPAKERREKGVEEKRYRKGQGSLRRKQVKWLFKHPNNSQTYWAATGWANQIRIKSGANGRAGTAQ

SEQ ID NO: 943596 - protein, 65 aa, Homo sapiens
MVLLSRPLLPGGGRFLLDLLYLNLLLRQVVCALLPLLTVIVLRAAAGAFLFHLLFVLFLLCHQPL

SEQ ID NO: 943597 - protein, 121 aa, Homo sapiens
CGGAGGRWEPGGSACPGPRYLVLRALAQSTVVGGDGGLLGHPVTVPGGHLFPSVGQGFLEKAAPFARAPRLFEYPSILPPSPPPKTLWGPEFHGCSKPGLLAFPRAGRGSTGSCASWAPAR

SEQ ID NO: 943598 - protein, 82 aa, Homo sapiens
MPLPPWGSAGQTPRGGMLLTQEPTKSPGQFWAGPENPTPSPPACHSWPQMPLPASDATPSLRRRWAREVFLGNSSLSKTQYL

SEQ ID NO: 943599 - protein, 173 aa, Homo sapiens
WGSIKQNSFLLYSSNSYIFKFKPNQDNNPIHRLLYSSNAKKQQSCQYRLYINTQITGFNITGTNHKFMCCSFSFLVGNLVYFEKAYGVCKGFLPMAGGPGGENEEEGGGFICKEVHFREPPTLSKLTNILRGRTLPKLLIICHCIQGTNCPDFFFFFFVGGIIVNNLKGQITY

SEQ ID NO: 943600 - protein, 176 aa, Homo sapiens
LVFFVAAGPCLHCAWLGSQISSDLWLPCDFSGSPLLLGFVSYLGSSAAAVAAAAAGAALAPLVWWFCEVLASPAVGAGASASGFSSLRGSRVWGLVVVVPKIIVASTTSKIASIITKSIIAIPTATISTTTTAATKATTTTEVSSTTEVVIPTETTSTTTTKAFQNHFDLFGWMKH

SEQ ID NO: 943601 - protein, 86 aa, Homo sapiens
VMMAPAIVGAAPQGILRAPTLNIIQPDLPSASSHFVQGLSFGVTQHAAEENGIRILPLVIANFPPGTTVVNFSPASVITAENAEGN

SEQ ID NO: 943602 - protein, 210 aa, Homo sapiens
MTKGCQAMCSSPTLHSQHIITPLLDDVCNVVLLVAYMLHGDLLQGVVGPWTPLSSILEPALLQSTRKELFSPTKAFESPAPLEVTLLASADALGIRYSQSLLAPWSLTPPGWLPSRLLPQGYLDAGLSPSPSPGLPPPVVGPPVFDAAHGSFPGPTGVMIFFPSGVSWQSILTLDGPSMFAAPPLPGPARGGVNKEFRLGTCGAPFESRA

SEQ ID NO: 943603 - protein, 196 aa, Homo sapiens
QNQIALSHEHGSNRNSFALVHAVVRSQTHTHPPIFTLSLMPSSIHIPTIAGAKFGHNPRDSSLTSVRSWKEEVINEKQLGLLFASLLFQQCRGEGKTYTRGSQPPRHQNEQPTTSSRQCFQVTSRVLNTTFQHHKTVASWKAKHNNKNTIVSPPKTPEKKGRRRTYNLIPIILTNCSMTISKTSSVKLTASDCDLI

SEQ ID NO: 943604 - protein, 61 aa, Homo sapiens
MYVVFCVGGVNVADGVLQHVDIVYIEALLEFFREGLIDLDGVQAARAERFLRSSSSYSFMA

SEQ ID NO: 943605 - protein, 244 aa, Homo sapiens
LSPLWLILNIIFKNIHKAGFPVFKIIVETNRLKRNIKVQKMVFLLWGWWGGLRYVTAAVYTSPDAARACWDQLSLRLKLLVHRLSWLANTNPFDCDSQVIFQKADVVLGLWGQVLPPPGACGVCFPPRQGFIFNFDLLKHLLVSWEIGNPFPIQLYETPILTSPSTSRMSSFVRARAVKTLKRNTYFRIIRSSQPQRLFLPVVTPTLVAAGLQQASNLVDLLGGEGPDAHTCGIGFHHAIHVTY

SEQ ID NO: 943606 - protein, 164 aa, Homo sapiens
MVSFFFVIHLFSQLYSPLVTYVSFPNDALNEDFLLIDGDQGSKHEWCELDEQNKVGWAISFKDLMWQQPLKVLWTFARSLELLSGLFRRFSPHQGLCLGQEVGQEDLVMQTLPYGVLGLDRDEEVTGYHLGAFVDELVKSMLAIGPWLPHTMGPVWWSTRVFFL

SEQ ID NO: 943607 - protein, 30 aa, Homo sapiens
MELGEKWLEEVKMNGRIGRQWEVEGEKKMG

SEQ ID NO: 943608 - protein, 139 aa, Homo sapiens
MGAGTFDDLQAKASGNISVQFPGIAPRGKSVESDLIIFYRFISTVHFNIHLFCISSSRQDVCHQCFSQFPAYLLYSLFLFLDVFICDNKSFAEGRCVKPNSRVLCHSSGDLPCDWRRACVQSLATADKRVSSLLPGPTP

SEQ ID NO: 943609 - protein, 241 aa, Homo sapiens
ATYLNFDSYLCLFNTPCSFPLLVLFCSGDCALVVHAVYQFVGELGCGSDPCSGGLSLPFSVSPLLKPGKHSDSSAPRPLGPLPLQAKEAPPKEGPLQSQSPPDGASRQGLRLSEPGKTPLGSFVPGGTSGMLRDYSLYHGRLNPKESGEHFHSGGLEPVCLWLKRHQSPTRAGLGQGAPAPAAVALGADLAPGGDVVLVLICEVVDLVCQLLHRARPEAAAKAPEALEVVHALAVGLTRMR

SEQ ID NO: 943610 - protein, 144 aa, Homo sapiens
MATEDETQLLPHCLPAQEGGQRGGETAPGRPEPQSSPTGSRPAEKEGKEEAGPSPPAVGKQLEEGPPQKDPPPHQHSCPGTGSPQQQGDPGAMATFMTEKQLSGGRRHDFLGRISWGRGLGGPLGQTLRSLEGAQSGASECGPE

SEQ ID NO: 943611 - protein, 38 aa, Homo sapiens
MEGGGLPNLAPLGHFHVVSTVKHSGATGTTPKLETALT

SEQ ID NO: 943612 - protein, 100 aa, Homo sapiens
MAALSPGYEGRGWSPGGVRLGLLLGGKIPRVCPFMPHTIMRHRFKLHLHNSVHVSPTQNLGHFAKHIQEVKYEQVRFWEHKFFCGSVSFQAVIYDILPLG

SEQ ID NO: 943613 - protein, 151 aa, Homo sapiens
MGDFITPYSPGLSPPLLQVSNQEFLFQDALLAQECMISLVWPLAQSTCFHNNDSSLITDVTPRCGGGLTLCASPTLFPLGVVLRTPAFVGRTHEAGVEAACCRQATAHFLLIVPHPKKSSQHQKRSYLQLKFAVFLRGREMSHRKYLQRRD

SEQ ID NO: 943614 - protein, 240 aa, Homo sapiens
GVVKVSGVSRYLLLPLLVLADIHYSPAGYTNLETTSLVNYQGAARITSAFGVSGAHSSSTKGPGGDHLDVLDFVIAWGLGISLTAAFLIPILVLLPCLFLLLRPRGFDILCGQLFLLLLASGSWGPQSSCSLGAGGADGPGSLALFRLILGLDRGGVVVLFFWSCFFFPGVVVGVGWDYFISRSRFSPPTLTLIECSLSSTVKQCAAVSTKYSDTTAPIQLSCPFEGRMTEILACHGCLW

SEQ ID NO: 943615 - protein, 52 aa, Homo sapiens
MGDIAFVGGIPGVVLGLRFPPEMSMGGFECQSGVWAFAFESAGGPRLNRPWF

SEQ ID NO: 943616 - protein, 273 aa, Homo sapiens
MGGHLGPPLCLVPFFLGLLSGGVTPPPWSLARPPGSCSLGGVGFLGGSFRLLPGGQALGFVCPSGFSPFPVRARSCGSSGSWGPLGAQGPGAVGGAGCGAFPCPGPRGFGAGGSWPRSPFFFVVFSFRCYDGCALRGSAIRSCPVGRWCGRAICDNGAGYCSNPGIPIGTRKVGSQYRLEDSVTYHCSRGLTLRGSQRRTCQEGGSWSGPGPSCQDSFMYDTPPEVAGAFLSSLTETIEGVDAGGGLGPGGPLEREIVLGPSGSLDIFLVLDG

SEQ ID NO: 943617 - protein, 33 aa, Homo sapiens
TKTAQSQRKNPNTTQNIEGESRPGTRRGPPPRA

SEQ ID NO: 943618 - protein, 76 aa, Homo sapiens
MDVHMGLEALPRGKVEVSGHLIDFQEAIHLAAFILLLLHLLAEASRRHCSIVSGFLKAQPLRRYASRTSSQVSQHL

SEQ ID NO: 943619 - protein, 219 aa, Homo sapiens
LFIFYKDNLLKSQRERQFFTSRLLIKPSGSGNSFRDVTGGLGGGEGGFDKMGEDVLLSFLSWGLKIKNLGLKNILSHTYLFQWVLSFSILGGGRWLVVGAGGCWVPGFGVGWVALVIHGGVVDSGLGLELLLLVLNAGARALISFTGELKMLRNANSPSQKFCVALSPYSAVVVLAHHPVSWPVVQPLHLLQLPRDTFTRQLPRPLTHGGNTSGHFFFL

SEQ ID NO: 943620 - protein, 105 aa, Homo sapiens
MPPLVHGVIGALILKAYSPLLLVCTLEISPELAGRAGHWSVPWLQESLPVQKYFLLALVRLGGEAQVEEEAAEASLGLLKDDVTELHLVSGRKWMSTLVPNESLL

SEQ ID NO: 943621 - protein, 252 aa, Homo sapiens
SFGVVPCSHLLPLLHWLGSPGLGAQKELFTMHRKKEDNRIRILIEKGVAERQRSLFVVDGEREKKKVVKLHHKLPKAKCEGSALQCCGVIKKNWGLAATGKKKKENAKEKKEIGKLKIKQDDPFETSSEQPETFATAKNNEIHKILGNTFGICVLQDFEALTPNLLARTVETVEGGGLVVILLRTMNSLKQLYTVTMDVHSRYRTEAHQDVVGRFNERFILSLASSKKCLVMDDQLTSCPSPPPLHHRRPAS

SEQ ID NO: 943622 - protein, 111 aa, Homo sapiens
MVILHHEESDVLRGGDLRLQLPTQGYPLLCQLDGTLHCHLFIPARYFSDDVEVHFLCFLVSSRPSGVAVPIPLGGTVPPGKCYLRDRLGEAGEQEQLSQAVWTPARKPCVC

SEQ ID NO: 943623 - protein, 170 aa, Homo sapiens
RGKAPSGPLPVVLSGSRDVCIGLSFSLANLLFLGTSRCKAPPPTLPAAPPAPLSPRLAPLALLSRARQPPSPPPPPGAGQSLPCPPPSAGPSQPRPRPPPPTISCPQSPPWRPNPALVRKATPGAPGLPGGGGPGCPYHVPPLMCYPPPSRQTFPKDSVPSHTFSPYPCP

SEQ ID NO: 943624 - protein, 185 aa, Homo sapiens
SYLRLSGVKGSKTIARICFKFLYFNSVKMSSVSIPIFLPISPASLHCSTAILSPSPCSVNSCPLFSCNLFLLLFMNSSCTNCKGGGLGKEEGKEEEAPLSSLLSRASEKEGEAAALFSESGGAICFFSSVSDCELCSRRRTVFSTFQDVLSFLWCAQLWVSPYVSAVVLEKNPPGQTGNLLISPS

SEQ ID NO: 943625 - protein, 48 aa, Homo sapiens
MVGPGLVFTLCSLSAYLGFITFLVALFLRGLSLFHWLFSFSRLSSRRS

SEQ ID NO: 943626 - protein, 38 aa, Homo sapiens
MTTTKGLAQLRTCPPTFPAGAPLPKSAWEVLNEGTFAQ

SEQ ID NO: 943627 - protein, 142 aa, Homo sapiens
MEGSFFLVIHNYIWNSASPFEHHFVRIDMNWAKGLDVWSCFNNSFQVDVVYTKEFLSVATIMGVTSKEHHTLMGPDDCPALSVVPGQAVGGVRGGGGVAITTFSWFVSDTVSPSFIQFSCSWLSPPLNWTDWGSESPWLSIL

SEQ ID NO: 943628 - protein, 180 aa, Homo sapiens
MWACIRGIQHQRGGGRVTAHAGMSQAWLRGGRSQQARMASRACRGDAGNGWSVGEEDAGGGVFEGWTGLGVYNSNEINKKIEEEKEQGQTPLAHKAQPGSCGRQGSTQNRSIQVGGSGVPDVPREAAGGWDTPEAHVYSLGGQWHWAWQGPIGRTLPALLRGGEVGMADGSPVAGGGEGL

SEQ ID NO: 943629 - protein, 57 aa, Homo sapiens
MIVAVLLLVKCAALLQLRVEHPTLGLLKNQVDPPPVIKIVVETQDVGMAILQVGLDF

SEQ ID NO: 943630 - protein, 239 aa, Homo sapiens
SLSSDMCWVRAISCAVDNSPIHPIHKFCCYKKGTAALPEKDPPGTRVTSKELRLFENLPRRKPLNKTWITQARKYSRMWYFKTLDTLWITELPVITQEGKQPRVNRGPVHGIDAVLVLLVGGDHVVLQGLLALLFRTVVLLVTDVILVYQVAEASDEMDTMLEKDDSAVTAAREQLVMRVVVADVPHPVGVFLQGLHGFGDISGVPELHLTVVSAAGQVVLLIWIKVKVPHQLSVGILY

SEQ ID NO: 943631 - protein, 113 aa, Homo sapiens
EVSPFPTMLLVLLFFLRCTVPSPSDADSHSESESDELVFVVLVVWLVVLVAVAVAFCKVIFVFQVCYLVVLFFYDVFPFFCLLYFPSYRLVPYHREVGAAGKIFFDGDSCVDI

SEQ ID NO: 943632 - protein, 139 aa, Homo sapiens
GNEKKRGDGGGDRFYVVFKVTSEKEDEVIVEYASGHEQEEYDAFPKYVARGALRSLFKVTDKVLLPKQVHSKRSRLAAKKPRREHSKESGVRIFTVLVGSLEPLKGKSSGPLEAPPIVGSAFVLHFMGKESILDHADEG

SEQ ID NO: 943633 - protein, 225 aa, Homo sapiens
FFLYSIPPSITPFSPPGKARGSMVWVFLFGFERPGRCRARCWSLSKYEYVSYDWKILQHPPPKHSPFSAGVWRGAGGRGARYRLAAVYCIRWVLHPASLLLLIVEEMTLGVPPDGGGSLDELPGVGVDTPALPTLPVQRHLALFEVVQAMLVTVGDVQGVEELQKAPLIRKAHGGDPLQDLEEYLVGREFWQGGGRSFLGSSRAKVMLATLAHLPVLLSDLLPEH

SEQ ID NO: 943634 - protein, 174 aa, Homo sapiens
YLFINMVYTEEMGNWTGQGGLTGDGEAPLAAPSGRAQALWRLGTPVHSSLRLSGRLCPWCSESCVPLNSGIPPGTPGPLGMLPLLLRIPKRHSVPESPPQLLEWRGNYIPQSNPDPPVDDFLLLDPFYTLSQGELGLGLGYRMAYNAGAIRAQPDGEAKATLKLVLAVIQGGPK

SEQ ID NO: 943635 - protein, 131 aa, Homo sapiens
PPIFLLAGLKAGSSFVSDARYSDKATACPHVCCGKKGKLTLEGGKLGCKLGLQAPRPGGSLLPPPELTTFKGLQGSPRFLPSCDLSLKAYRSWGDKLLKGLWVPPPQQAGWLPVLWLVMSQSPCSEKLPSK

SEQ ID NO: 943636 - protein, 152 aa, Homo sapiens
FRPKSIAGNKHTIFFNICKPVELVLWFFSDKIYFVKNLQWQNSFWLFKQLYTESPTSLYIFKYLREKPGKTFENRLILQSSMGLRGRHLKRVREGHYQSGLQNQSLLGCISTAFQKERVHFSNALASKLGGKGKGYIAALRRKQRISQDCFG

SEQ ID NO: 943637 - protein, 203 aa, Homo sapiens
GKSRFSATMSPNSSALNWGKPHFEKLDLLAARKLEPGPAQGLNHMPLVLQPGADGQDNLANVNPGHSALGPSKGTTHAWLEPVSPSTGQHLVEADDVEGVEPHPDIEAIPATTYVLIGTNSGSLQGFRGQQPNSESMWPQSGNSTAFRPRRKNANLGIRDTSAEARVWVRLVLTIPVTTGGAAAMATPGSSVAHEGKEALLRL

SEQ ID NO: 943638 - protein, 138 aa, Homo sapiens
FPSVLLHQPVRTRVLQGGSAQGHLGFPSGGLACWSDKPQSVEQMAWDSQTWQRVLLGPAWAAPFHPSSLTQHSSSLEFSVIHQLLCTPQRLLPRTSKHQKEQWPGGGQESGGQGSLQIQTIESTRWKEEKEGENLQKT

SEQ ID NO: 943639 - protein, 99 aa, Homo sapiens
RPQAQSPQLLVENMETAKINIRCRFLPVAFDLPVRMVFCLEGPQNNSPGYHLHPKRGEDGQERRRRVSERGSHQVDGEPDDLLENVSFNQLLQLLGLFQ

SEQ ID NO: 943640 - protein, 165 aa, Homo sapiens
PQRMVYYRFTHMKRRSDRTAGSAALGRTSRSPFLEPGGGFLSEMFGFQLPPLPQAPLQGPAYPRFLGAPGGRPPAPPTPPVPPLFTDKETCPRGVLHRAGQLWVVFLLRRSVACGDNKLVAMFADAVFSLNCSCTFTDKSSKKKINFFFPNNKKKMNDYNRKGKN

SEQ ID NO: 943641 - protein, 169 aa, Homo sapiens
FLPWAAPAPASPPIPGCPSGPPPGLGSLGLFLFVGELLVTKAPASFLLAPVQIAQLCVGKQFLVGLGVLVIFGRLALRLDFLVVFFFFFFFVFLLFLVVVFFGFLVASFFFFRLVLSFALLVLLSLGFVVLFALFLGLLGCLCAFFRSFFSLASRLACRSSSVLLPKLW

SEQ ID NO: 943642 - protein, 113 aa, Homo sapiens
MEGPDSSYSCLLIHICWKVDSEARMEPPIHTEYLRSGGAMILIFMVLGARAVISFCILSAMPGYMVVPPDSTVLAYRSLRMSTSHFMMELKVVSWMPQDSIPRKEGWTAPPDT

SEQ ID NO: 943643 - protein, 217 aa, Homo sapiens
MIYTEEMGKRTGQVWTDRRWGSSSRGPLGANPGPLEDEDAKGLLPEVLSPPLPLALRILRAPQFRNPSRDPRPTGHAAPATQNPEEPFSSRIPSSAAGVGGSILSNVPPRPPRKKGRSGGSGLPSVAGGGGGGGGIEKGVEGGGQEGSADGEAKTTLKLFLAVIQESPKGQCQGQGWELLLRGTHDPVAIHRAFEEEVGLGQVQLVPEEDAGVLHPC

SEQ ID NO: 943644 - protein, 194 aa, Homo sapiens
MVPVGASSFPTQFFASPRRTGRRWPAAAPPAGSQRSCLWPVQTHPCHHLFRPSSLPAAPTRWLFSPDWLSGGLDGSCQPHCAPKAWQMSEGASASRLHSGPWLKRRFSISRMTRGQFGLLWKKYFVFSKTRFWTSALLARSKSSMTFFEGFESLPQFILLPLGDDFSGQGLSKVSDLPLHILVWSSLSFTLASM

SEQ ID NO: 943645 - protein, 119 aa, Homo sapiens
LALTDKAKQRALSTGRAPNGPCSQRLPGFWAPGPRHDWWSPIWALYPTSAGGPFLGRTQEAGREFPTLILGLRRLGNKRAREKLEFETSLAAHLGCHRREKISCFLAPGPSRPTATNNV

SEQ ID NO: 943646 - protein, 270 aa, Homo sapiens
QAGGGGGGGGGGGGPGRERGGKGKEKHEGAGGGRRAPEGGGAQAGQRGRGQQRPQAPPEEGRGGSESGGRRRRGEDRPGQEEKEEEAAGKPSEGRNGGQRAERQNRPGGRRRDRKGAGEGGEGLRPPKEGPRGKEEASWSSFDGYGEGNVLVSMGERMPAGTSEVTGQAEPPTLTERSLRALGLSGNVTAKIYIYIYINHSWEGRGKAWGGIRGSGVASRSQSCLPETPRGWCPSVTRSRSCPPAAGYPEKFRGISLDFLGNSWDPREEP

SEQ ID NO: 943647 - protein, 232 aa, Homo sapiens
PLPGILLPDLTLAWRAQVSLLGPASHQATLTQDGRLRLRHIYSGGPTPSGGHVPTLQCPPCESFGAVGAAPSLLQARGVPCPLRTEGDSWGQIAALTAHSRFGRKLKFGGDPQVSYLLPLLCPVLPSMAGAMWARALFLALVVQTCSTATSSSTAKLTADQKLTRSKLPSCRLRSRASKARSSVSIWMLRSSRVRMVSMDSLMSSILKSSISSGSTASAHPSTSSSSWRLSK

SEQ ID NO: 943648 - protein, 165 aa, Homo sapiens
MAEFLSFVGTWTKLEIIILSKLLPGQTTKHRMSSPIGGNLNNENTWTQEGEHHTLGTVVVAAVGSTAFSDTPDAKGRVNGCCTPAWHMYTYVTLLLIVHMYPEDLKYKPPPPAAAPQAEGKVAKCSGVQTEGFQRAEALGVNSMNDLACPPPIRGQNWEEKSPNI

SEQ ID NO: 943649 - protein, 154 aa, Homo sapiens
CGLVGFGAGVLGRPFLFFSFLFLLRFLPSSSAFCVFCCCLRSLSSFPLSAPRRAVWLFLFFRSSPFPAPVFFAFFCFFFFFCLLFLWFFFFGAVLLFPFVLLFLPFFFFSAGAGASAFGWRFVFLVRFRHLSLWRRHFRALGLFFAFLFLALSS

SEQ ID NO: 943650 - protein, 127 aa, Homo sapiens
MGVVAVGSSLTHAKLVDSGGVDAVDPPLVEVDEENHIVPQAADPVHNGHLDDKGEQVVDECVEGLVGEHAPGKVGHKLELVVDEELGRHGDEAEVKQEAESMLSTQEYQPLCSRYRDCRGIQPRNGK

SEQ ID NO: 943651 - protein, 79 aa, Homo sapiens
EPGCLALPRRPPSVSPFCSSYAFQVLHLAEGAVGLPPALDWLGIFRANALKTAEISGCAFVQQLQYFEEAISQLLRADL

SEQ ID NO: 943652 - protein, 255 aa, Homo sapiens
ICSILFSVSSDSTCSRMSTGQAQLILSEEGLSICRRSTLDLDTLVHGQDEDGIFKELLDPAGFPPFLPGPVGDHEAVVRLAPDGPHTLGRVEHGIEGKKVILTNLELVPQVFQPRFENAALFVVGAKHGPPVVVHKSFLRSLCSGPLTAGWPRGHSLLASWYFSRVILVLVPSWVSIKSSLFLWFSRIPAHTGGHGALHVLVAGEEGHDAIRDHSGHLQQEVPIVPDQTNILQGLKFGADGHLVIATADDHREEA

SEQ ID NO: 943653 - protein, 111 aa, Homo sapiens
GTTAVENEFSVQGVDGEGVQHADVDLFFLQQFGSSQGLVGHPPDNGHLVILALQDYLGLSELELLIVVIDDGIFWAGGPDEVYTLCIGGEFHCLLCRNDITWDKKKLMWGL

SEQ ID NO: 943654 - protein, 144 aa, Homo sapiens
MKSCSPPPAPPGCPGFSCLLGGTGGLLATAGGGLAGSGAGAGAERGRADGRRDGEAALSHAIHMRNRTAGARGTKVWGRLHEFRGRRRGQRVIEGRLRWRQRQEIFGWGRQAPAACALGLEGRGGTAAGVGGPPHRRERRKAGL

SEQ ID NO: 943655 - protein, 129 aa, Homo sapiens
MRICFLHCPASHPISPQIINSHPWEAAELKGLPTALVTYTPTGEHVQMAQNPGTAFHEEKLVPKYGGGGGGCEKASAKRTFLRFYSSDPDAESSERGGVFPSSSSSESSLLFLFFLLLFSPEVLFYTIH

SEQ ID NO: 943656 - protein, 158 aa, Homo sapiens
EEQYENILMQCCPTELSVVMEMFHIFGANTESTTHMNTQNVANAIQDMDFSSNLLSISRVICDWWLLTAQCSSNASGVPTSGFLLGVFLSFGAKGLGVGCCGGGKHSEFFGHLLKYAVSSLSGGGGVGSGWSGGLSTGLDIVGGNGRVRILVIVSGIK

SEQ ID NO: 943657 - protein, 100 aa, Homo sapiens
MGLACCPQTVAPWRWGVRPAFVCRGRRDKGPQAGPLTPQKCFFSQFWGLEAPDPGVRRFFFSVSLSWAFGWPCFFVRPLLVFPLHTFVCPIFLFLGLLFW

SEQ ID NO: 943658 - protein, 269 aa, Homo sapiens
MVDMGVGWSPHLLTLCLHEHRHMQVPLQKQSEGSSSDNFLVWYNFCFSVPHKVAVSHFTSCEGHIRALGTVTACSLSVLPPFVSELFLLHITAATTAPVITAPRRTRPAMMPTMGMVGWEDSSHLRVRGLGRPSCCTWQVYLCSSPEGTTTAAHFWKVPSPAGLVSTSSVSWVWSSPSRCQVSVISAGYEAQGPAPQGGLMVRDGVVGHMCLGGVRALHVSFPFSRYLRITARTCQPGGSQLLRLKGRLPLALGDLSGMSARSKSAVSF

SEQ ID NO: 943659 - protein, 66 aa, Homo sapiens
MLGKELDVLRWGSSEKVVKYMASKPLPNIPPKNLKGVTMLMRWAIQFRTNLVGPSWLNTLGAGCYF

SEQ ID NO: 943660 - protein, 218 aa, Homo sapiens
APYDSQLSSYSSACGCCGGGRGGMESETRAKDPPETSPAPGPFPEMPKGKRLSEGGWRENLDKPAPGELNTGRKRQDRIKMCRPREDSPASYPVHLMSLLKKDIKYPPWLVALTSSFFFFSSFRSFMLLQLVLMPPVWWMDSSRVAQPPEGVDHFPGSSLDWTREEGNKARRKGCSGRAGEAYCVPEPAGREVNSPQKRSPRWGGGPLEMCGAGQDFG

SEQ ID NO: 943661 - protein, 186 aa, Homo sapiens
PRQGAGGPGGGGGARRAAGELGGGGGGGEEGDRVGSRGGGAGGGPGAGGSSQWRMWGTRVGTQRTKGLANKEENGREDEKATDDENDFEGYFTGQRNEGGESGNKQCGGSSDLHEITTVFENRIKHVGLARSSVWSRGGVECCIFAFLVVDFCPDGSAFICTFSMYYNPVEVTNKGVFFLSAYQSD

SEQ ID NO: 943662 - protein, 104 aa, Homo sapiens
MLSESKEGYGDEGKEVGGGGSDEETKELNRHARLLRIPPSYATLLQWENEVGKNEQPADCCTVDQHHAFEPHFSGVVISIFIHGKTIYNEVACPQTHRVNRISS

SEQ ID NO: 943663 - protein, 296 aa, Homo sapiens
TQKCKKNKQEPRKTREGLSLQPHQLPEKRPTAKTSMKATLEDRAQQQFLERKGGFQKGKKRTKAERKIKKKKSAKETAKKKKQEGKRSSGKKTKRKKKDGQPVFESKLKAQTKKKKCQEKKKRSKGKKKLVVETASNFESEAETQKLKKKNGDCYLLSDPGAHHVLLLVIQTGAFTLLQDTMANKKEKKDIGTGAMKQMVNLFNHKKKGGQALDDYVANTDNCSLKDLVRECERWYCAFNNWGSVEEQRQQQAELLAVIERLGREREGSFHSNDLFLDAQLLQRTGAGAARKTTSS

SEQ ID NO: 943664 - protein, 147 aa, Homo sapiens
MVFQSPWHPHATGEVPDLEEAIPGPCGHSHAIVSDAQAADAVVMPSQDTCPVGFEFISDVALKRTRTQEEEAPALGEGDRGDPADDVVMGVSHELLVSRRSNSLQVASSEPMCKCIAIWKEANGIDVRLVASEGLPAHAFSHIPEFG

SEQ ID NO: 943665 - protein, 59 aa, Homo sapiens
MAQENMKDEGLEPAVTRWRYNAGSCYQCLVTRVQAPDELAMAAKDTGAGGTTGACKGTS

SEQ ID NO: 943666 - protein, 116 aa, Homo sapiens
RKKKSSKKKSGNGRKTGNKIKKINKGRKIKEEAKKTKQKTSKKSHSVAQKINTKKKEGNNKINNVKTTKSDKGNTRTTNTKTISIYNFTQKRKRLPDKTKHGMTEQNTGKGNPEKQ

SEQ ID NO: 943667 - protein, 226 aa, Homo sapiens
MNRVCFQQKKNIQKNVGGGACVGGGGRSGRRVGGPESSVVCCAPRVQGWVLNVCYLDPSGKCVPNRPNQGVYVKGQGTSEGVSLDPKQQLTAVADVGHDLLFDLGHLLPEEAGGIDSPAFSALSVFTLSSRRAMRSNFRFRHLVAASRFSSRLRSTLMRSWSSMLMGDTGGVASRLRAYGTVCGSSLKVEAPRPKPSCAGGHREGRRVWEVADGGRRVQLPVPTAA

SEQ ID NO: 943668 - protein, 207 aa, Homo sapiens
GGLWQRVSGGSEKPGPQVQLRPLPLVAIIVEHVVVVDVHEDGYWLSDDERQPHSCVAIVALEKAAHEPGQWDLAIMPVNAQRRNIRRGTLTRYSWKKAAKTPVLAIHLLAFFPAEALALALRHHELTSREKSFKRMVFAISPSREPTGVSNQVPPLGNTLVALATCSSSACTVRAPTARRFSTWIADTAKTFGRNNQAWGGANNRDL

SEQ ID NO: 943669 - protein, 310 aa, Homo sapiens
YTIFYKKSPSSAPEFPPSPPHSASHSHPPPTTPPLPFPIPFVSNSNMATLNNHLIYNLLNKEQTPHNNITVVDVSPVGMACPISILMKDLAHELPLFDFIQDKLKGDMMDLQHALFLTPKIVSGKDYNVTTNSKLVIITAGARHPEGLLNLVHHNVNIFKFIIPNVVKYSPNCKLLIVSNPDILTYVAWKISGFPKNHVIGSGCNLDSARFRYLMGERLGVHPLSCDGWVLGEHGDSSVPVWSGMNVCWCLSEDSAPRFGTDKDKEQWKEVHKQVVESSYEVIKLKGYTSWAIGLSVADLAESIMKNLRR

SEQ ID NO: 943670 - protein, 308 aa, Homo sapiens
APAGVIEKGGKKAGQDRAKRKERKRPRGQGQDKQKKAGAKKKKPQNGKNLGGAEKTKEGAHQQQRNKEKKENPGRKKARGEEKGGRNGKGTNEGKPGSTDGAETTQREQERERGNIKKGGGRKRQGSERRPRPPGAEENRKEEERGNQAKAGSRAREGNRPSRKAGHGGPKGERPPKKRTERREGDPGTPQEAPKQSGGKEEDRKRRGNKGSQTGTEAGGARREGKRKGGRANGGTGGKAGGGRADGPGRGETAKRGPAKAKGKHRNRRGGGENAHGRGRGGDRGAPPAKRNGNRDGGGRDGRGTPGG

SEQ ID NO: 943671 - protein, 103 aa, Homo sapiens
YKHNHQVCAGRRRSVLPGGGNKSPLTTPPLTPSPPPGPTQGLDTSPKVGGGGAGRNRGRRPRWDSRKAFRRWRWDPVPPGSLWVMDSKTCWLSVETKDTVPLD

SEQ ID NO: 943672 - protein, 102 aa, Homo sapiens
MRGARYSEQLTIVRSRPRGRFKAKGRTPWCGGIRPGRGASSWNAALVLGDESMAYFLLIQKDIPNFNLAEKQAFLYLLLRTARIQDKAGIKLFSKHMPAIPV

SEQ ID NO: 943673 - protein, 151 aa, Homo sapiens
WTPHSPRALDKGNVVILLSSGLSWWDVMWLAKLGLLCLEKRKQEGVPALGTGPGAGVVGQGEGSHPGERVGQGEQGEQGWAPGPPPALQCGYRDQMQVDVACAWGPYLVVSLSGFFIDVGFLFFLVGLGLGCNARQNIKSGKTNTSHHGSE

SEQ ID NO: 943674 - protein, 260 aa, Homo sapiens
VGEATTTAPACCCGSIHSRAGVLDGFIYRHDQARSLRGCCQRIAPHHSWFPHESFKVVSNVLVVDVFSLPCTPLGMPGPQLVENVCGIKASFVTQLAWDNLQGFGISPNQQLLFSWNSHCVIPQYLGSSILMAPPPATTEIILDGPPDDHDGIMQGPLCLLHTARRQRRRIKVDVLALGQTVKKLYLSPPIWVSSNTWHRPSTSADREFTLVWIDPTEAIIVLFRSSSGTGPTKKMSLSKKYWVATSPMGSLDKTTLAPE

SEQ ID NO: 943675 - protein, 109 aa, Homo sapiens
GAWLFLLALGWGIGVRGHGLLRVGLAFNIVSSMFFMWVLSFWVLADWFFLCCGASEGASFGISWGIFKEFLPKTLYLNQSLVQWGKICMLPPSLGSWPLQPKFSVQIQS

SEQ ID NO: 943676 - protein, 165 aa, Homo sapiens
MGKVCSQVSRVKPPPRASLFPGGSATELTLRNRKRMSFVARKPEGILTGTQHPNQQHFCSWGAAGERGAACCLQILPESRVCFPTGLPLARKVTKLSWVGYKLQGRELQWPVYREELELERLLWRRRPGDRDLRRTGGLRFGERDLLLIRGGDCATEAVVADSPG

SEQ ID NO: 943677 - protein, 167 aa, Homo sapiens
MLRLKPATVPQLCLSWRAGGRPQHIPGTRACITDSCTAISSTRPWPHLPNHSARTACKGGEFTLMAFLQRLIEKKQGILSWVRNTQQHPFRPPRVGCAGCTGIPLRLGERGDPGIQSSPGSPGVWKGHSSGGGGGNSSSEPVGTPHGGPSQLEAGSGAAPVLVVPTI

SEQ ID NO: 943678 - protein, 150 aa, Homo sapiens
MPDPAEQGKQGLPQGPPSAQGLRCHAPQHTPGPRLLQHRQCQQGLGRGPQLGVWLQHHDKDRTQLGRQTGSELRGQVALAHCLPALPTVGQLHVACHFQDGEAQTEHIRCCPIGALQQLGGHVAGVSLLDLTSSCCSQLHQQYEVTQLAA

SEQ ID NO: 943679 - protein, 77 aa, Homo sapiens
TPIFQIISGFTGKKKPRAAVNVPSEVPDSAPGRAVRDDEEGRACGDDAGGNVLGRKKSRGSELGFGGMGQNYRRVEY

SEQ ID NO: 943680 - protein, 221 aa, Homo sapiens
GVFGACPRWKGLGHSNGGSKLGLQLPLILEGGGGGPSGGFGGEGGEEEEVWVWVGGGGAGAKGGPSVAFEWWEAVWGGRAGGGGGGAAVWAGGGGGGEFRREEAGVFACVFKIFDFFFFYVIFLFFVFSDFHGIRVGWGVRWPGFLASLAHQSSDSGGSWQPSSHFFHTAKQAWMTRLSGKPSTFNLSIASFSCGVTWMYFICGASSPMAPTSPSTSEMSA

SEQ ID NO: 943681 - protein, 131 aa, Homo sapiens
MQFIHNGNATIAWRRSEKRSKPTSSPSPSSRAIKTSLGEKHITIPKAEAPPDLPHPQHLGRTRWDEGDPRARVAREPRAGAILCKLQGFIGMCVHELHRTCLKAGRKLRSQPWVLVRGYDWARRGKQHIPS

SEQ ID NO: 943682 - protein, 119 aa, Homo sapiens
MGTKGHGGQAAHGFFCGRAEGGRSRLPPGSRHNPSIGSPAPEIPSPHSSWTARAGSIGRERRQYEEERVGCWAPVASMPVLKSSPGPWMPGPGSLATFLALGTDCSQGSRGWGDLSSWA

SEQ ID NO: 943683 - protein, 151 aa, Homo sapiens
MTLFCLLGVEDFPSERKIEETSVCTTPAAGLEQLLQGSPGPLRPSYVGRGVQSHTWLHPQVDTGSKLLRCSLGSFPQHRRASMHTHSTGPTGPVTLTRHALGAACCLPSTWGYKRSPKGAGVQGLLDLLAAIGVLLQDLAEVLLLLPLQDT

SEQ ID NO: 943684 - protein, 120 aa, Homo sapiens
AVENEFSVQGLDGEGVQHADVVFFFLQQFGSSQGFVQGHPSPDKGHLVIVALQDYFGLFELDVIIVVIVDGVFWGGGRDEADTLCIGGQFHCIVCSNAITWVKEVDVGIDRNIARFSRAI

SEQ ID NO: 943685 - protein, 292 aa, Homo sapiens
GRQSRFNKTNSLQTTMIHSDFGPNSAKENSLRSLFPRVILKGGGHHPLEAGGRVGGGGAVGGEEFLVVVVFVFFLQGYCLGGHRQGLVQYLVRGKSKAFLEGWGMQEGCVGITRPLLHLGCQAEFAKLEGALRFHLHWGFFSWKSAEMLTPRPPLAALRKLCFRGEGQDVPSASLNELHVVGREHAKMAIRPIATPPAFVDHLDARDEVLGVKGDLCVVGCLVVVQGTGTEPLPTEPLALNVVVNVLRASTLLLHQWGLLVEGLLLWRFLIDSLLFCLHQTWRSAGRLLLSR

SEQ ID NO: 943686 - protein, 107 aa, Homo sapiens
MSILKNQAREIIDSRGKPTEEEEHYTSKGLYRAAVPSGASTGNKKAQQHREKEKTRKKGKGSKAVEHKKKTKAPALERKKQNDTEEEKKEKQKNDKEGTEKKKKGAN

SEQ ID NO: 943687 - protein, 77 aa, Homo sapiens
MEGPDSSYSCLLIHICWKVDSEARMEPPIHTEYLRSGGAMILIFIVLGARAVISFCILSAMPGYMVVPPDSTVLAYR

SEQ ID NO: 943688 - protein, 139 aa, Homo sapiens
PKINLCRPGGMPSLSWIFALTFSMVLLGSTSRVMVLPVRIFTKICIPPLRGGPRGRVDSFWMLLLDRVRPSSSCLPAKINLCWSGGMPSLFWFFASSFSMVLLGSTSRVMVSPVRVFTKICIPPLRRSTRCRVDSLWMS

SEQ ID NO: 943689 - protein, 212 aa, Homo sapiens
MAFFHPLTHVPVNKGTLGIHQVFLVVQESSGLSNGCGVAQHAHSSVFLCQISTRYHFWRLVVYANFEASWAPIHKLDAALGFDGGNGSFDIFGNHVTTVQQAASHVFTMARVTFHHLVGWLKASLGDLCYRKLFMVGFLSRDDRGICGQREVDAGVRAQVGLEFCEVNIQGSIKSQGSSDGGHNLANKAVKVSVGWALDIEVSTTDVIDGLI

SEQ ID NO: 943690 - protein, 129 aa, Homo sapiens
MWKTASPALTWGLGPDPAWSHPAQKKGPPVPVTFSVEREWGFCSKEFLPISKRSKWCIQPLKTFQFMVSMVFFKEFEVLREAPLQWRVHLQGVSILEQVHKMVLCDVAIFGGILHGPLGQGSHGQPLLH

SEQ ID NO: 943691 - protein, 250 aa, Homo sapiens
GPIFFGGASSSSFFIRRSVFILPGPLPWKRRDGGGEPPWEWVSGPSHPRFDLNVGFVAVLLLVVLCEASVFLPQGVLVIDGHLILDAVHGWGQRLVGGLHPGHLLHCGLQQPFVLTQERGSCQPPIHDRFLVQEVVEEAEKSCCCFSSSRFTVLQPMFSSPSDSEPPLAERSSSRSKSMSSSCSSLIASQPVVGDLPKVRQNSDVALNTMAPFRSGSSSSSQPRWRDFSFFTISTTFSPLSRSCCSCCDC

SEQ ID NO: 943692 - protein, 155 aa, Homo sapiens
MGLPGTIINNGSITRLQEFRAIFQLFTRTEINLFLQLSKLACNVGGVEIQYRGIAGAYLAWMVQDNHLSGEASGFHWWVIFAVTSNVATTNILDRHILDIEAHIVPRKSFTQSFMVHFDRFYFRCNVDWSKGDHHTGFENTSFHSANRNSTNTTN

SEQ ID NO: 943693 - protein, 180 aa, Homo sapiens
PNVPVNKGTFGIHEVKLVVQASPGFSNGCGVAQHAHSSLSLGQVFTRDHSGGLVVEANFEASGGPIHKLDGTLGLDGGNGSFDIFGNHVTTVQQAASHVFTMARVTFHHLVGWLKASIGDLCNRKLFMVGFLSRNERGICGQREVDAGIGHQVGLEFCEVKIQGSIKSQGSSYGGHNLTY

SEQ ID NO: 943694 - protein, 146 aa, Homo sapiens
MVKLACSLGSTLRMRNAGLVSENRSRFTGHSFSQQRMKVPEGRGRGIRFDSVLTGVGELQPEVSVEEGRPQEQEAWCFEVDDAAQLVQGVVQRHVRELLSDDAQDPSDPLRGVEAAGVSAHSLQDTAHKIQVMDGLCHMGPPSWCG

SEQ ID NO: 943695 - protein, 219 aa, Homo sapiens
GRGGRGTRGTDQVGVGGSLCLGEAGGKGLRGPDSLWGWASAETEDQRQVPGGRAFLRLRRKNVPAQQAVPGQGQCVRGVKALPPVDVVPVRGPQDRQREAHPDVRGLRQGPRALLVSRCPAQAAGGTGIHRHREQAPVDTVTVHAFMVFLHAAATALTQAWQLGSRMAADTLLLVGFPKLLLPGEEGLRLAGEGRAGVQRPCNPVIAQVWPEAPPPLRN

SEQ ID NO: 943696 - protein, 48 aa, Homo sapiens
MQVGYSVLQLPLLAFQLGSFPVQFFLLPEQACLGCRHHGLGGRLGWFT

SEQ ID NO: 943697 - protein, 32 aa, Homo sapiens
MKASISRWMLAFSGALVSTAGVKTEGTENKRL

SEQ ID NO: 943698 - protein, 251 aa, Homo sapiens
PIFPSLFNFLSLFMLISSAAPSSQTVPFSLPFPFSFFYFIFLAVLGMEEKMLLQGLSEEGFAKKAFTIFMISSTFALFIIFLSPTLNSIFLGPIIQAATFPYLTLWMGSVSPRRDMAFAPPRHSFFLPPPSVLSRTSYLSPNPVHFSSISIYSSISSSRPMPRSRFQPPSTAAAVPAPPPPSRAMLPAVRPAPPRRARSARLLARPGLQSALASRAEEGGGLGVGPGGSSRCGAGAGQGGPRGAGAPSEKT

SEQ ID NO: 943699 - protein, 210 aa, Homo sapiens
SGNEVKPAFPWSGQNWDTPPPVSRAQGAGRPALRRQGMRLGLCLCLPSCKPSSARAASASFQVFYSVCVGGRPLAGGGGKLSSGLQSIFRNLLFQANVLRSIAWKEVRPLRLHTAMRLVSPSSSTWEEAASPRSPRKVIPPSTGGSNFPTSARKSKRSSLQGETCRVLDGQHALALLQPASLFFPFSSCDATASGPFFQQGTAFQMAGVL

SEQ ID NO: 943700 - protein, 133 aa, Homo sapiens
MFWAHQCCHRVLAAALPVEQLLHRAPPVTVEGAVQPSSLRRLRSTMRPRARRQLLQQAARYESNPPAAERSLSAQMRWWPGARHHGCATVPRRSAAAKKEGSSSEESRKKTLALDLNAIKYRSAIGSVTVWAA

SEQ ID NO: 943701 - protein, 292 aa, Homo sapiens
VVDKTPDIYKYTYRSQHHQHQNVPQPGPCQKDQESGKIEDKKGEGPSLCQVSVITCYGPHVRRRNYPFPWIFDTVVHEDELDPLEAPPFLSPACALNAKATEAKYQQEQLGECETLQGPPSSSSCLAWILGPMPGVPITLESPPFCVVALVIPLFSRMFRLRSLKLLISSTYAWATHPFSPSARRTPSSQPSLVQVLTDRMSVFSKVQLIWVQCLVCPNTLNLGAIFPLTDDLLVLLGAGGAQGWDPSLLLTFRPGPQQELVLHVLPVEELEEEHVAGDALQLQAQVPHLQL

SEQ ID NO: 943702 - protein, 59 aa, Homo sapiens
SSRVLYSNPISNAGMGSIWYLEDDHRKQNEDRSIFDLQKRREKEAGGAEQKKSRSTKKE

SEQ ID NO: 943703 - protein, 145 aa, Homo sapiens
VVALSSVKNTDQGHRKSALQGGAGSEDVWAVVPDTASSLGLGFEGSSIVQVLLKSVGLGGLQGSGIQQQHRAQAKDVTEYLIVLEMVVHARTQHFLEGSVDPVPSPAVHVEPSKPKRTISSSHSPPSTECSTARKVERWRRRSAF

SEQ ID NO: 943704 - protein, 113 aa, Homo sapiens
MNYDEEHKGAGGYNPGVGAAGYGAALRGRRLEKKERATRIELFIRYCYTDQEPSKGFLKCQESMQESAQMLEEFVTAGSVVKGKDSSLSIYKEATVNCSTCSKRQQAPVSYTA

SEQ ID NO: 943705 - protein, 107 aa, Homo sapiens
MRGGDIPGQGCGPKMGLLVNEASLLELEVEELLQGAGSGQSSLSGGLYSPQLAMTRCMSDTKSFRVNVVAASPPLSHGLQVNGEADDLVVVRGLRLLHRLHEGQALR

SEQ ID NO: 943706 - protein, 68 aa, Homo sapiens
RKVSPYSHGAPRYASCPALTLFSAPILRELALGSDPWVQIPGPPPTHCETLARVPELGSIIPASLTWG

SEQ ID NO: 943707 - protein, 136 aa, Homo sapiens
MRETQGTLKGTQKGGCILVQCQSEGGAAGAWTGPPSPARDRRVKPPGTKAQRLERRRHVPRLHGLGVGEMRGQNWHSGQDLGLYSMGRGEALGLHGAMGEPGAERDCCCAKAQSSCSLQQRQRQGLASGSWTGERG

SEQ ID NO: 943708 - protein, 167 aa, Homo sapiens
MAAAHQGSRLAPQPGASQRAIKGLGLILRCGRWGGRKNRAIFCLGLFSVLLLLRVALGKIEEEGDCGVLSGWTLYLSPGPHFEKAQSKLKFIKGIASSLCFHPTGGEAGGEMLHFFTPWGGKRKDLSRSSPDICTCAKYSFNFCPLKSVSWSLFALLLRFRFASGNS

SEQ ID NO: 943709 - protein, 267 aa, Homo sapiens
RPSGDQAREVHWGGSALLLVLITCYFSSTTMIFPPESQILMLGAAAHSQERLGLKHRALMMSPPSTVRCLASLRSHNMAWPSLPPEAQGAPSGVTVTVFSLPVWPMWLVFSLQLVRFHTLSSFSQPQVTMLELLLLGELGTQGTHSEWLSSWTVYLLTPRVFHSLFVLSLDPETICRLSEEKATLSTSLVWPTNRLVVVPVVRSQRRRVPSQDPERANWPSEEITTITNKVGVTPQSTLWNSIVGLIPGQFPHDDGLISRGGEDHVR

SEQ ID NO: 943710 - protein, 305 aa, Homo sapiens
KRRRREEEGEQRGKGRSTTPRGPGGEGGGGGGEGRAGRDPTKGTAPGPRGRAPPSDKTPQGSREPLSPDAPARAPGGGGPAQGPGSQRSPPGPQAQPSRRQNRKKAGAAPAPRRPGPAGGSSGQGRAAARGPPQEGGQQARGREEAGAREPGGALGQEGPKGTPGGATEPRARHAPALSLNDHICLQPPRTTLYPGPAQGHLRKLCLPERLSPLASVPGHLYHQGLLQGCRCLEVHWDDALPSLLPSRELNGGLGTGWGQRRAQVPCGPVQAKAAKDAHEKDAQEAPQGREKMSHAETARGGSAG

SEQ ID NO: 943711 - protein, 349 aa, Homo sapiens
GDRENKGDKKAGGDGPEGPGGEQEKGDDRTSVAAAHPEKRTGGATARATDHWGGKATAAGTPHHAAAKKQSVDTVAVDWAPARRSTGPGGPKEDGVPLAEKKTANRRQSSPEQPTETQVTRSGLRAGAANTVQERADTAWLRGDWSQTQRGSSGQGAERRSGGAALGSGRSSRRVGGRGDRGQNRAARHLCPPPPTPWASAAIEYPGGKETGQWINPVDFQEEASLQEALVEEMSWDKGEKTEPLEKTEPPEGALELGLGYRVVLGRMETDVMVEAQRRRVTRPRRRSTHRRDIGDPNEPELPQATVHLPAVLPRAWGHPSCRGNPDAGMKWNCCTRLGWHPWGRTDLA

SEQ ID NO: 943712 - protein, 86 aa, Homo sapiens
PQHRNTNRQPFLRRHFFGVESKALNEATYMEHSIGYTQLEPQPLMTRTEARLYTEAHTRRAHADPHSTLRNTPAPVVPDIRHLYSA

SEQ ID NO: 943713 - protein, 167 aa, Homo sapiens
MATKKQHVPSQGGKRNTKALLKRRGLKIKFPRVFCSTVACEFWNNVPVGKHYAQEFLGVNVGKPLKFSVAVRGEPENCLWNPVDVQAPGDERKHVCDFLYHFGCGLPRPVARLGVHVDKQGVALLPAAAHDVLKGGNELQGVKGDHAVIMVSSEEQHGRVLDVICFW

SEQ ID NO: 943714 - protein, 108 aa, Homo sapiens
MSHVALWVQVVKKAFLKSSQGVACTLPSANGPFPGIHLRGFHCFPETIHVDQCALPSAWYLIITPSMHILVLSAIYGLSRSWFQLCLVSSVMTLQGHGPYQPQSSKEP

SEQ ID NO: 943715 - protein, 193 aa, Homo sapiens
VPRSLRWHCRALFHHRGTETCRRLKTITNIFNQLSGQRQQKQPEYSNSRQEGSSSPDIHVRRLTPKPHAGILNSAALIQGTEWRQSTGGGKMFSNQVRHTGKASHPKVSTKQAWRNKQSCQEPPDILLYALPLVPRVHHVLWFSLHKAQKAADHPKPDSQGILIVGIGPQICCRIIFIFRSWLNFFILKISLS

SEQ ID NO: 943716 - protein, 44 aa, Homo sapiens
MLPTGTLKPAQAVGRHRSSTGLCQLWPSWNQPSSHLEGHAIKRV

SEQ ID NO: 943717 - protein, 171 aa, Homo sapiens
MASVQASRRQWCYLCDLPKMPWAMVWDFSEAVCRGCVNFEGADRIELLIDAARQLNRTTVLPEGRSPGPPALSTRPPKTWRRQHQGAPAAAPAGPPPAVRDRRRRVGQDRYDRATSSGRLPLPSPALEYTLGSRLANGLGREEAVAEGARRALLGSMPGLNAPWAAWQLQC

SEQ ID NO: 943718 - protein, 65 aa, Homo sapiens
MPISCESSNKYTQRLLGRHKACARLQLRRLFCACACGHCLPVWAPGQQLLGTVRPADGLMQLRPC

SEQ ID NO: 943719 - protein, 346 aa, Homo sapiens
PPPPPPPPLPPPPALRPFPSVLPAALPGSSPAPCAPGCRRPVLPRRCLPAFFSSCCGAGCARSSASLLFPWSSSPRLVAPALVLSSLPSSPWSLSSCRPRAVWRGVCGPPLAWLLPGWFLPCVLVRLSVGSVFPRRRLRCLASSAPSAPSGLGPPSWPRRLLLFLPGALAWPVWASPGGPPPRRLSLLPPRAPLSPALSSFSGPRPSGAPSSGVSPGVCRAFWVVSFAPPPSVRFLPCVFLLRCVASVFRLALSVGPVLAVPPLAGRAPLPPSLCRFSLRARLVAPLLPPAAPLPPFPAFPAAAAPRLPWCLFSSPSRLPPLWGPPAACPFWSPSCRALGLSSRRF

SEQ ID NO: 943720 - protein, 387 aa, Homo sapiens
VRSGLPGLCPGGARLSPPRAPRPLLPVCPLRPFVPPSPPAPGSPPRPVPLLPGWGVSAPSGRASLFPFPPGAPRRARLGPPLRAPRGALAAAPAAAPGGPVPPPVAPGGPGLGGAPGGLRAPPPSAVPAASPLSPPVLGLGVPGPVLASFPRRPGPPCALPLLSARPPARPAVAPSLAGFWRPPSCLPPGCVCAPAPWPALSPPPPGLPGLVVRCSAGFRRVAPRLSLRAPLPRSCGLLALPSRFCPALPLPPALSRLPPSSPPLQAPAACFRSPLLALLRRPPPLPCRPLLSSLFCGPCGPGSRARLPRPVPCGPWVSSCPSSFVASPPSPPPRARPSPRGCRGGFAWAVRLPPSCVVRVFLLPALRRSCCRRPPRGALLRSAPPG

SEQ ID NO: 943721 - protein, 118 aa, Homo sapiens
HGGGDGDGATAQGPQGEEEIDKLGVCVVNLTKCIKNLVFLYINKNQMLQDRLYIQNHGDIASVANKFQTRWGDETDEGDREGREGALRAGNVGGGGRGGEGLLDFKRRLLIYLGMSDD

SEQ ID NO: 943722 - protein, 99 aa, Homo sapiens
SLFSVEANSSNSQKNEKALKNIQKCMAENREKDVDRESAESMCLFYTNQASASVYPNPPATNRLPLERNLKDLQQEIEDKMKGFSLPHTTDTPLPVDYA

SEQ ID NO: 943723 - protein, 325 aa, Homo sapiens
SLAGRAQKRSRAWHRPLLTTCTRLPVRCRSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCILPLSPPPAPPAAPRAPSVPPPPSASFTPHPCPADGPEQCELVQSTAIPERPAHLLRLQRDRRYLRLWPRGLLPAVAGRPGLPATAAPPGPAAPAAAFSFRPRLSPPLSTLGHPTSTPTSAGLFAFATFCPTLPPETSSSYTEGAELARPENLVCAWDGPSGNAVFGTNQAHSNVNVPSFCLWLPSGWKEQSMCKQLC

SEQ ID NO: 943724 - protein, 251 aa, Homo sapiens
MTVSPESSGGVTQSHKPASPAVEMGSAPGRATDREDKTNYSPKKKPLPDSGQTQSVGKWTTTQAEGRAQPVTLGTHKTVGQGPSHVFKARNKNTGEPVGMKLYTSPVTAVPKGGCAGLCCAVGVPPKLVQQLAVGDGGSGQKVLVMEYCSSGSLLSVLESPENGFGLPEDEFLVVLRCVVAGMNHLRENGIVHRDIKPGNIMRLVGEEEAEIYKLTDFGGGRELDDDEKFVIVYGNEEYLHPDMYEREVLR

SEQ ID NO: 943725 - protein, 117 aa, Homo sapiens
GGGGYLAAAGLGRGLFGLICGLNCACVGGLEAVRAGRPKNSWTSRTVTRTQARPSGEPLAPLIWVGNFLAVAASTPSFSLSQGFLNARKFSFFFNKPGPLARRILPEENVFSEIGVK

SEQ ID NO: 943726 - protein, 313 aa, Homo sapiens
PVDSFAPFHNVNCPRGFLYFNRQGELRISVLPAYLSYDAPWPVRKIPLRCTAHCVAYHVESKVYAVATSTNTPCARIPRMTGEEKEFETIERDEGEMEEEEEGFSIKVIFLVSWEDIANGRMELEEWEDVKWMKKVFVGSEETVSGLKRLGGGWDLDDEGEEVKCRGRILIMDVIEVVPEPGQPLTKNKFKVLYEKEQKGPVTALCHCNGHLVSAIGRKIFLWSLRASELTGMAFIDTQLYIHQMISVKNFILAADVMKSISLLRYQEESKTLSLVSRDAKPLEVYSVDFMVDMPAGFSGVCRDRNSWCNLLP

SEQ ID NO: 943727 - protein, 128 aa, Homo sapiens
VCIYPIYIKESSWPNLPKRFPGGSQGGRGRKDIHLSLSPELLDKEGKLPPDPRQMFKPSPTKKALLFWPVGLPQTQEHLANTSITGRGNGGGAAPPPTPKPPPSPPHTYMPTQTDTVWLEHAVAAPGV

SEQ ID NO: 943728 - protein, 121 aa, Homo sapiens
KFVIVDCRYPYEYEGGDIKTGVNLPLEREEESLVLKSAIGGCSEAKRVIIIFHCEFSSVGGGWMWGFIREGDRAVKDYASLYHDEMYMVKGGDEEFFPQHLTFCERQGYGGMNQGGFKDEL

SEQ ID NO: 943729 - protein, 157 aa, Homo sapiens
GLTFKAASSLPVSPSLAVNMKAFSPVKSVRKTACRTTAWASPGDKTPVDEPMNLLYNMNDCNPKLKELVLNIPQNKKVNKIEMLQHVIDYILDLQIALDSHPTYGQPTSHRDPGRTKRPRHRGPPSTQISASCPYRLLNALLNKNKRQQNTVWLNKQ

SEQ ID NO: 943730 - protein, 56 aa, Homo sapiens
TTEGELQHENIVALYDVQELHNSVFLVMEYCNGGDLADYLQAKGTLSEDTIRVFLH

SEQ ID NO: 943731 - protein, 69 aa, Homo sapiens
RRQKGESAANAQVLAAPSPCSPFAFTPSKVNMSLKNEPRVNTSALQKIAADMSNIIENLDTRELHFEGE

SEQ ID NO: 943732 - protein, 31 aa, Homo sapiens
MCYLMVLRGIFFDISFVLGDGIILFLSHEKE

SEQ ID NO: 943733 - protein, 114 aa, Homo sapiens
GWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRTYLHKW

SEQ ID NO: 943734 - protein, 128 aa, Homo sapiens
HLTLPCPTPPSFCIVGIFPAVRVKTQVHPHHCLVFCLASGHFPVSALSPKSVPSLAAWHHLSPGPWHHYTLQCKQSDFPLKNYIWPGAVGYTYNPRTGGQGKRIAWGQEFETSLGNMARPHLYKKFKN

SEQ ID NO: 943735 - protein, 60 aa, Homo sapiens
RWRLIFAAAAVDFLGLESRAFFVRSAGFAPFSRLGARLGKGLEGADRRVVALGAVMLAGE

SEQ ID NO: 943736 - protein, 157 aa, Homo sapiens
DDIDSILVQCGDSIRPDPEVLGAASQLKDILRPLRTCDSRFAYRYPDCKYNDKSEGLVSSWPWGQHAWLSILPVGLLQGRKKQLFFKDEKKGTLISSGTERGVVRYHVAVSAGWDVLAKPAVGSEDLGVDAHSMSLSLSFLCSPPDSPEGERRHQME

SEQ ID NO: 943737 - protein, 66 aa, Homo sapiens
AGAQKQYLDGMKENETSGRKEGKLGYYWDGPDKREHRLKGLAYNKEEIIFETKQKKCSLKKYSLSS

SEQ ID NO: 943738 - protein, 68 aa, Homo sapiens
DSVRNSGDRRGARVLGDSDTLSSPAEPRRYRLKGSRGWGTDSSQVSVFLWLADVWHHFTGHTGQTGPR

SEQ ID NO: 943739 - protein, 63 aa, Homo sapiens
MVMFKKISFEVVFNDPEKVYGSGEKVAGRVIVEVCEVTRVKAVWILACGVAKVLWMQGSQQCK

SEQ ID NO: 943740 - protein, 67 aa, Homo sapiens
AFLGAVYMYHKYQNRKLNAPFCTIELKEDGISFSSYHDSIPNANLSGFLEDDSNEVAPNGQLTLTTP

SEQ ID NO: 943741 - protein, 41 aa, Homo sapiens
MAGGSGGQDIDTILANTVKPRLDSKWLKTDLQPIHRWALRS

SEQ ID NO: 943742 - protein, 30 aa, Homo sapiens
MGHPPLEFSDCYLDSPDFRERLKCYEQELE

SEQ ID NO: 943743 - protein, 31 aa, Homo sapiens
MAGTALKEADGLEYKTINTGILRKGFVAGPM

SEQ ID NO: 943744 - protein, 31 aa, Homo sapiens
MAFPTVLAAQRRTRRMRLAVGALLCLCRPGA

SEQ ID NO: 943745 - protein, 35 aa, Homo sapiens
PRPSTPFYELSLSTPGLLEMAAAQEADGARSAVVA

SEQ ID NO: 943746 - protein, 34 aa, Homo sapiens
AKLMLLGIARFSSLLTLRMAMVSSLQARLFPGLA

SEQ ID NO: 943747 - protein, 74 aa, Homo sapiens
FRFSEHCWPTQNISRKTRSSISTSKLGCWVGTSFKAEGASYAHARRRAPPAKQRLGDHSGCHSGPEADQPCGMA

SEQ ID NO: 943748 - protein, 29 aa, Homo sapiens
FFDFNLAREPFGNMYDADEDMQYDEDDDE

SEQ ID NO: 943749 - protein, 50 aa, Homo sapiens
CARAADPQARHAAQPGPARAGRATPALGSDGVRVTMSALTARDRVGVQDF

SEQ ID NO: 943750 - protein, 42 aa, Homo sapiens
TPPPPPPPPLPLPLPHLRELTRYSLKMAEAHQAVAFQFTVTP

SEQ ID NO: 943751 - protein, 35 aa, Homo sapiens
ATRQVPARKKRPKRLRTGNMVRSGNKAAVVLCMDV

SEQ ID NO: 943752 - protein, 46 aa, Homo sapiens
MAFVLILVLSFYELVSGQWQVTGPGKFVQALVGEDAVFSCSLFPET

SEQ ID NO: 943753 - protein, 99 aa, Homo sapiens
TAYWRDAPERSTCRCLQAHEDDGDHNEQVAVLSAVFLDMYIKRTTQETRPPKYLHYDEETSNQLPCDISPPGTYLKQHCTAKWKTVCAPCPDHYYTDSW

SEQ ID NO: 943754 - protein, 33 aa, Homo sapiens
GSARSAAAEERSVNSSTMAKNLEGYVGFANLPN

SEQ ID NO: 943755 - protein, 99 aa, Homo sapiens
YLSVCSQLSWVFLRRPGASLRMSFSLTATALTVSVASSSLVHLKAVKMGLADLAREITSALLSLSNATIINDKVSECYAKRRLYRFDGSRCYIKLVKQL

SEQ ID NO: 943756 - protein, 68 aa, Homo sapiens
MRHHLQDHFLEIDKKNRWVPRDDFIAKASPPEPGPERTSGLLGNGLAPRIYRAHLKPWKSSRIVPANL

SEQ ID NO: 943757 - protein, 98 aa, Homo sapiens
SKAKAQRTVPKQPLTPAAAEGAAAPGPRGDEGGGTAFTQPRTPETGKLRTRQERETSDPDQPEDAGSEDEPEEGGQPKEGNAHGAARPPAPAPAHRRE

SEQ ID NO: 943758 - protein, 99 aa, Homo sapiens
RGPTGHLASGGRLPQLPQGADHGSPQTGGDSLPARGGQVAATFGCRRDALGRTAARRQLPAEQGLRGSGRLPHPGLPSPAGPAHREENAYQGSTRTPDD

SEQ ID NO: 943759 - protein, 55 aa, Homo sapiens
MRSCPEEQYWDPLLGTCMSCKTICNHQSQRTCAAFCRSLSCRKEQGKFYDHLLRD

SEQ ID NO: 943760 - protein, 49 aa, Homo sapiens
MGKVKVGVNGFGRIGRLATRAAFNSGKADIAAINDPLIDLNYMAYMFHY

SEQ ID NO: 943761 - protein, 83 aa, Homo sapiens
MGYAQERPLETIDRQRKRLVETLHADSQLLLDALLTRYVLTGPEYEALDALPDAERKRARLLVLVQLTGKACLAELLHCAQST

SEQ ID NO: 943762 - protein, 67 aa, Homo sapiens
MSLIPGAEDSDFPIHNLPYGVFSTRGDPRPRIGGAIGDQILDLSIIKHLFTGPALSKHQDVFNQPTL

SEQ ID NO: 943763 - protein, 99 aa, Homo sapiens
LLETDPRLRSGSAVPLSANVSPSPASPAPSDSSPAAGTRDPRVRPTPDPARDMYTPARRRLMRDSKRLQEDPPAGVSDAPPENNIKVRNAAIFGPEGTP

SEQ ID NO: 943764 - protein, 52 aa, Homo sapiens
MAAQFDGGAALAADSRTTTGSYIANRATDQLTPIHDRIPCCRSGSAADTQAV

SEQ ID NO: 943765 - protein, 53 aa, Homo sapiens
MTDQEAKPSTEDWGDKKEGEYRKLNGTGQQRESLQREHDNTYQETQRSILPKT

SEQ ID NO: 943766 - protein, 55 aa, Homo sapiens
MSSSEEVPWISWILRGIREQKQLLSCETQDRKNYMTATNMNPYEHSMSRTLTIDK

SEQ ID NO: 943767 - protein, 99 aa, Homo sapiens
TAPFPPLSAPGGGGGLGSLTKTTARDLRGTKKEELLKQLDDLKAELPQLRVAKATGGAASKLSKIRGGRKSIARVLTGINQTQKENLRKLYKGKKHKPL

SEQ ID NO: 943768 - protein, 60 aa, Homo sapiens
MGSERTGAVPMPMLVVLALSQGILNCCLVYNVGLLEVKIFFGSLSEQFGYAVQQFINSKG

SEQ ID NO: 943769 - protein, 98 aa, Homo sapiens
SILGRKRYPSRMRFVVALVLLNVVVVGAVLVLVTKALSKKKLEYGLQETFSPTLVRVNGLEALPSCIRSRETPKDSPSKLSAEAQTPEDTFNKGCGGK

SEQ ID NO: 943770 - protein, 51 aa, Homo sapiens
MWNDIELLTNDDTGSGYLSVGSRKEHGTALYQVDLLVKISSEKASLNPKIQ

SEQ ID NO: 943771 - protein, 107 aa, Homo sapiens
MLVNDINRLFSPPLKNRGSWELNHINAIFSTLLTEEKWVLFKLFFFKIRKQKEVRRSQIWTVRCIPNGFPSKLLQNFSFLMRGMSRGIVVQKSLVKLSQAFFCRSFG

SEQ ID NO: 943772 - protein, 147 aa, Homo sapiens
KLELKIKKPTQNHTTTWKLSNLLLMNDSWVNNDIKAEIKKFFEINENKETMYQNLWDAGKAVLRRKFIALNTHIKNLERSRIDTLTSQLKELENEEQTNPRASRRQEVTKLRVELKEIRVMKNPSKKINASRSCFFFKINEIDHQRD

SEQ ID NO: 943773 - protein, 121 aa, Homo sapiens
MSHIEAMLMEEVGSHGLGQFHPLWLCRVQPPSWLLSSWAGIECLWLFQAHGCKLQVDLPFWGLEDGGPLLTAPLGSALVKPLCGSSRPTFPFCTALTEVLLEGSAPAANFYLDIQGFPYIL

SEQ ID NO: 943774 - protein, 286 aa, Homo sapiens
IKQVLRDLQRDLDSHTIIMGDFNTPLSTLDRSTRQKVNKDIQELNSALHQAYLIDIYRTLHPKSTEYTFFSAPHHTYSKTDHIVGSKALLSKCKRTEIITNCLSDHSAIKLELRIKKLTQNRSSTWKLNNLLLNDYWVYNKMKAEIKMLFETNENKDTTYQNLWDTFKAVCRGKFIALNAHKRKQERSKIDTLTSQLKELEKQEQTHSKAGRRQEITKIRAELKEIETQKTLQKINESRSWFFEKINKIDRPLARLIKEEKERRIKDAKKNGLEGDHHRSPQEIPN

SEQ ID NO: 943775 - protein, 133 aa, Homo sapiens
MPAGALLCEVLTVPQSGGTGVDPLEGAVCPLAELKLCAGRSTALFRASRECLSLLKLHPQPPLPPGVLSQGDGSFICKPLTGAAAFLSEMPCPRRNLEMQSGYSGFLWLQGSTQFELSGSFGYAVKGKLLIHA

SEQ ID NO: 943776 - protein, 79 aa, Homo sapiens
MQSMVSLVRCLTECLQATQGVAYCRVSGCRHSALYGIAEQCPRGPESAICPLLRVGDPYDGLGNVCCSCPNAGLSLASS

SEQ ID NO: 943777 - protein, 175 aa, Homo sapiens
TSTRPVRILLLGNYQEKDIPKTPSVVTIIKGQRKMNPKDGEKPEQKNENSKNQSTSSPPKECSSLLAMEQSWTENDFDELTEEASDDRYITNFSELKDEVQTHRKEAKNLEKRLDEWLTRINSIEKTLNDLMELKPWHKNYVTHAQASVAEFDQVEERVSVIQDQMNEMKQEEKF

SEQ ID NO: 943778 - protein, 110 aa, Homo sapiens
GEPHGACLSSMWRSPGYPCNVGKRRGWPHTSCNNPVFSLWSIDFSPTPWPLRHKVLLMWGCSWWLAPGPNHQVPPPGSWFTGSSKTEVPQFPTTGFSRESPAFQFCMEFA

SEQ ID NO: 943779 - protein, 244 aa, Homo sapiens
TNNRQTESQIMGELPFTIASKRIKYLGIQLTRDVKDLFKENYKPLLKEIKEDTNKWKNIPCSWVGRINIVKMAILPKVIYRFNAIPIKLPMTFFTELEKTTLKFIWNQKRARIAKSILSQKNKAGGITLPDFKLYYKATVTKTAWYWYQNRDIDQWNRTEPSEIMPHIYNYLIFDKPEKNKQWGKDSLFNKWCWENWLAICRKLKLDPFLTPYQKSIQGWIKDLNVRPKTIKTLEENLALPFRT

SEQ ID NO: 943780 - protein, 259 aa, Homo sapiens
NPRANRRQDKNKLRAELKETETQRALQKKSMNPGAVFLKKINKIDRPPARLTKKKKEDSNKHNKKDKGDTITDPTQIQTTIREYYKHLYANKLENLEGMDKFLDKYTLPRLNQEEVESLNRAITSSKIEAVINILPIKKSPSPDGFTAEFYQRYKEKLVPFIPTLFQTTEKEELLPNSCYGAIIILIPKPGIDTTRKENFRTISLMNIDAKILNKILATHIPIAPTKKDLSRPARAPVGFTPGKPTLFEKGPKAGPGIN

SEQ ID NO: 943781 - protein, 102 aa, Homo sapiens
FIKTLEENPGNTILDIGLGKDFLTQTPKAVAMKTKIDKWDLIKLKSLCIAKETINSISRQPTERVKIFRNYASDKDLISRIYKELKQINKQQTTPLKNGQRT

SEQ ID NO: 943782 - protein, 271 aa, Homo sapiens
MLVVGNIVIKPDSQTITCENCRLLTCIDSTFNWQHRILLVRAREGVWILVSMDRPWEASPSVHILTEVLKGVLNRSKRFIFTLIAVIMGLIAVTATGAVAGVALHSSAQSVNFVNDWQKNSTRLWNSQSSIGQKLANQINDLRQTVIWMGDRLMSLEHRFQLQCDWNTSDFCITPQIYNESEHHWDMVRRHLQGREDNLTLDISKLKEQIFEASKAHLNLVPGTEAIAGVADGLANLNPVLGLRPIGKYDFKSHIKSLGLVWPVVLKGDPK

SEQ ID NO: 943783 - protein, 201 aa, Homo sapiens
MNNSRRAALRAVTLTAKVCSFTPKPARPRTHQKEETPNTSEHKKEQTPDAATLRAVTLTARVHGFILEVSERPRTHQFRTHFGDHEGTFAYCQAVRQSLSSETITYCRAVRPLPIAKQIEAIKLQMVLQMEPQMSSTNNFYQDPWTDQLALPWPREFPLDTTTAKPLLPYSAGSTRAVIGQSNSSWGVLVIEGQMLQSYLT

SEQ ID NO: 943784 - protein, 248 aa, Homo sapiens
NPDMLLAVFEDAVKACTDESLAVEERIEACLMASCSRCKNPLYTNMIALHQLLERYEAAMELCKSLLESCPINCQLLEALVALYLQTNQHDKARAVWLTAFEKNPQNAEVFLSYVKFFILQNRGDNLLPFLRKFIASFFKPGFEKYNNLDLFRYLLNIPGPIDIPSRLCKGNFDDDMFNHQVPYLWLIYCLCHPLQSSIKETVEAYEAALGVAMRCDIVQKMWMDYLFANNRAGSRNKVQGIQIFYWI

SEQ ID NO: 943785 - protein, 146 aa, Homo sapiens
MNNSRRAALRAVTLTAKVCSFTPKPARPRTHQKEETPNTSEHKKEQTPDAATLRAVTLTARVHGFILEVSERPRTHQFRTHFGDHEGTFAYCQAVRQSLSSETITYCRAVRPLPIAKQIEAIKLQMVLQMEPQMSSTNNFYRGPLD

SEQ ID NO: 943786 - protein, 166 aa, Homo sapiens
MNNSRRAALRAVTLTAKVCSFTPKPARPRTHQKEETPNTSEHKEQTPDAATLRAVTLTARVHGFILEVSERPRTHQFRTHFGDHEGTFAYCQAVRQSLSSETITYCRVKTIAYRQANRGHQATDGLTNGTPNSTNNFYRGTLELNHFPGPKKFPSETYTAKAPFFA

SEQ ID NO: 943787 - protein, 176 aa, Homo sapiens
SLGERVVTGWATLNVGRSFAYCLTTCVQPPLMSALEKSMHLGRLPSRPPLPGSGGSQSGAKMRMGPGRKRDFSPVPWSQYFESMEDVEVENETGKDTFRVYKSGSEGPVLLLLHGGHSALSWAVFTAAIIVQCIVLDLRNHGETKVKNPEDLSATMAKDVGNVVEPCLGTFLLQLC

SEQ ID NO: 943788 - protein, 134 aa, Homo sapiens
HPSPPPPPPGGGGGGGGGAGGAPPPSSLPPPPHEGGGGRPTTKKYLKGRPPPPPPPPPGGWRRPAGGGFPFFFFFFFFFFFGGGEIFFLNPPLPPPPKKKMGPATPKKKKNPPPKKKIFFFWGEKKVLFTKFFF

SEQ ID NO: 943789 - protein, 270 aa, Homo sapiens
MLLSVVSSVLPSFPAAASVFSPVPLSPGSSSFRVASGCCAPLWGLRGRAVRRVAWVVPVGVLFGVCLRVCRSLRCPGCFSCGAVFVLGVVACRAARPCPPSRAARWSGPCGCSVAVSPAPGPVCGSPRVPVPVCLVSVVSCSVLRCVVLPRVGCPSWCGPPLPSALRAGALWGPSGAPRSCVVSRLRGWVLCGVCGAAVFLCFGPPLGSRGPAGLVPGVRTTRCSPSVLLLVGLGLARCVLRLSRVGRCPRLPVGCFLLVVCLRLVVSAP

SEQ ID NO: 943790 - protein, 131 aa, Homo sapiens
MYYLCWEQLGLGPHLAGPDKLIGDGVTRKAKTPWGGRAVQGHREAEVLTGSEKGELMRPGLPRHARGCEKGRKPRLQSGLASRKFRVEAEGFSQTATFTPMKVVMRSFLRMRNPDFMYGMSYGYTQGTMSQ

SEQ ID NO: 943791 - protein, 87 aa, Homo sapiens
TINKNNSQGPQDIINWFKIEVEQAFHSMGAKTVVPRSAADKSRAFNGNFKSGITLKHFLELKQEMEQDFTSILKTNHNSNGYEVEVA

SEQ ID NO: 943792 - protein, 226 aa, Homo sapiens
LIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYFPTLFATG

SEQ ID NO: 943793 - protein, 192 aa, Homo sapiens
ASVCERGREPPSVTHHSIGDPSNPGLGIALCFSQALEEFGESLGDAVRERHREKLQAFSQNWDQEHHASFNLGAYKVSHSLMTQKCGSAGILFSSQRLEGLLLRRVGTSKAIIVESTLAVWLELHTLPNCKPGTGGELLQLWFLLAEETCSRGQLDNLALFCMCHCWVPQPAPLKLWCRGASLIHSAELQGI

SEQ ID NO: 943794 - protein, 139 aa, Homo sapiens
SWISYRKEFKSRKVQCKSLLKATGQHGLGLWSKHFGRPRWEDHLRSGVDQPGQYGETPLPKITKISRVWWPAPVVPGTREAGWDSRLNPGGRGCSPAEDTPLHCSLGNSSETPSQKTKTKQTNKEFKTNVANTVRPCLY

SEQ ID NO: 943795 - protein, 71 aa, Homo sapiens
GDQSLEDEECSGQSSEIDNDQLRTSSKLILFNYKRAAQELNVDHFMVVRHLKQIEKVKKLNKWVPHELSEK

SEQ ID NO: 943796 - protein, 207 aa, Homo sapiens
LSWQARTGHTALRRVVSGCRPKSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPSLPGLPKNLYLGIFQFLLFDHFYIPSLPQLFFDVVK

SEQ ID NO: 943797 - protein, 166 aa, Homo sapiens
VPKYPLPASLINPSVAAHHDPIRIQLKDSSKFPSVPQYPISLTHQKGLQPIVNKLCSCSLLRPTHSPYNTPILPVKKSDGSYRLVHNLQAISQAVLPIHPIVHNPYPLLSLVATNTTLYTAIDLKDAFFTISLHPDSQNLFAFTWTDPDTLHVTTHMDCPPSGLQG

SEQ ID NO: 943798 - protein, 149 aa, Homo sapiens
TGPSELHHGHPFDLWPTPKPRNGKGSPIPVNGAGKTWLAICRLKLDPFLTPYMKINSRWIKDLNVKLKTIKILEENLGNTIQDIGMGKDFMMKTPKAIATKAKIDKWDLIKLKSFFTAKEIIIRVNRQPTEWKKIFAIYPSDKGLISRI

SEQ ID NO: 943799 - protein, 137 aa, Homo sapiens
MAAPPPPPKKKRCFPPPPRGGKRLFFKTKDFFFFFFSPQKKRKKKGGVFFLKGAPKGGGKDPPTLFGCFKKKEFFFFFFQKRWGPPPPPPLGAPKRPFFPQILSPCGKDAPSGFPNLKGGGKTFFKLSQSLICKKAR

SEQ ID NO: 943800 - protein, 31 aa, Homo sapiens
TDKSEKKLAQHAAIRKMSFKAGNETESSEKQ

SEQ ID NO: 943801 - protein, 68 aa, Homo sapiens
NRPDNGQQANTQKQARGCAGSNPFQKKISVRLQQVRRVSPLETSQLAGPGVVAHAYNPNTSGGRGGRI

SEQ ID NO: 943802 - protein, 107 aa, Homo sapiens
GLLAQKSPFPRAFPQRFKNHSTIKTHAYICLLQHLFIKTWNQPKCPSMIDGIKKIWHINTMEYYAAIKKNEFMSFAGTWMKLETIILSKLTQEQKTKHRMFSLISGS

SEQ ID NO: 943803 - protein, 251 aa, Homo sapiens
EQSWMENDFDELREEGFRRSNYSELREDIQTKGKEVENFEKNLEERITRITNTEKCLKELMELKTKARELREESRSLRSRCDQLEERVSAMEDEMNEVKREGKFREKRIKRNEQSLQEIWDYVKRPNLRLIGVPESDGENGTKLENTLQDIIQENFPNLARQANVQIQEIQRMPQRYSSRRATPRHIIVRFTKVEMKEKMLRAAREKGRVTLKGKPIRLTAGSLGQKTYKARRRIGGPNIQQSKKKESTQE

SEQ ID NO: 943804 - protein, 133 aa, Homo sapiens
MRKGKLQVTKLNLESVKCDLEKSMKAGLKIHSHLSGIQKEIKYSDSLLQMKAKEYELLAKEFNSLHISNKDGCQLKENRAKESEVPSSNGEIPPFTQRVFSNYTNDTDSDTGISSNHSQDSETTVGDVVLLST

SEQ ID NO: 943805 - protein, 170 aa, Homo sapiens
PPPPKKKVLKFFPKPKGLTTRLGLGGKKQKKKRFPTKVYPPRVWFLFPLAGFQEIPRVKNPLQEGGGKNNSFVFKEFGGGGQQTALYLRGVYKNPPFLCKKGTPKPLRGGEAKPGCCPQKGHKRGNCGQNCSWVVFEENKGPWGFSSLYPEGSLAHAEAWYFPPPGSVVE

SEQ ID NO: 943806 - protein, 31 aa, Homo sapiens
MLSMQRQALHDATQAVQALQERLSEIVLVHG

SEQ ID NO: 943807 - protein, 137 aa, Homo sapiens
LGDFEAFRKKRQNPPEKKRGIQELANPPALKRKRAKGTYSNKRTTTITCYKAVNEKKKITGRKNTHSRKDNTLPLQRIKTPKQVKALQGPPNKGKKQGPPTWGGEKKTLYGDKVVTEAKETAELKRITGQAGTIKKN

SEQ ID NO: 943808 - protein, 87 aa, Homo sapiens
MRCLKSCNTAKVCSFTPEPARPQTHQKEETQENSRTSEGINSGHTTFKNCDTRCDVCGFILEVSETKNPPILDTIALSLGNKSETPS

SEQ ID NO: 943809 - protein, 96 aa, Homo sapiens
EEVVSPPCVSPEVNELLMEAQLFQVSLEIELYQTLLAKPSLVQQIDRSSPVRPSSEKNDCCRGKRDGINLERKLKRRLEREASPVSGGNELRKCGP

SEQ ID NO: 943810 - protein, 105 aa, Homo sapiens [sequence omitted]

SEQ ID NO: 943811 - protein, 112 aa, Homo sapiens
PRFPLGVAPFPVLLAPLEAYFDLPVTHRWDGSSQAQGASSNTIVQVKHPKPKLGLTEVGSGFCPQGTCLPLPQLLWPSQLQIWSWRALARTPRLLVCLALAPPPCQIPGVWS

SEQ ID NO: 943812 - protein, 70 aa, Homo sapiens
TTYQLKEESFTFIPRSREELPDNFPKEIPGICYFLEVRTGPKPPKPSLSSSRIKKVSYNIGTMFLRETSL

SEQ ID NO: 943813 - protein, 162 aa, Homo sapiens
KAKGFGENEVQICLVIPERSYEIGQTYLRINGNLAEIKKGSEIVSCVLSKIDEEEMILRLVKFWNSDKEKIIRFRERREITYQGTRIRLTADLSLDTLDARSKWSNVFKVLLEKGFNPRILYPAKMAFDFRGKTKVFLSIEEFRDYVLHMPTLRELLGNNIP

SEQ ID NO: 943814 - protein, 234 aa, Homo sapiens
LTHQKGLQPIVNKLCSCSLLRPTHSPYNTPILPVKKSDGSYRLVHNLQAISQAVLPIHPIVHNPYPLLSLVATNTTLYTAIDLKDAFFTISLHPDSQNLFAFTWTDPDTLQSQQLTWTVLPQGFRDSPHFFGQALARNLTSLNLSPSHLQYVDDLLLCSPSLKDSQTHTTALLNFLAIKGYRVSPSKAQLSISMMTYLGIQLSPGAQAMTPARAALIENLPPPFFKSEILSFQG

SEQ ID NO: 943815 - protein, 140 aa, Homo sapiens
HTATALLNFLAIKGYRVSPSKAQLSISMMTYLGIQLSPGAQAMTPARAALIENLPPPSSKSEILSFPGLAGFFRIWISNFALLAHPLYEVAKGPPNEPLNPSHNILPASTNSKLLLSLRQLRPYLISPNLSLSILLKAEE

SEQ ID NO: 943816 - protein, 94 aa, Homo sapiens
QQGPGDQGNSKQRYVSNAVSEAIREVANKVKVPLQDFMVRDTPCGTTGLILVFRLGLRVDLGSPQLAMIREMACTTGVFQTLTFFKGFLSCSFF

SEQ ID NO: 943817 - protein, 225 aa, Homo sapiens
VNKLCSCSLLRPTHSPYNTPILPVKKSDGSYRLVHNLQAISQAVLPIHPIVHNPYPLLSLVATNTTLYTAIDLKDAFFTISLHPDSQNLFAFTWTDPDTLQSQQLTWTVLPQGFRDSPHFFGQALARNLTSLNLSPSHLQYVDDLLLCSPSLKDSQTHTATALLNFLAIKGYRVSPSKAQLSISMMTYLGIQLSPGAQAMTPARAALIENLPPPFFKSEILSFQG

SEQ ID NO: 943818 - protein, 113 aa, Homo sapiens
VPSQLKQQDKFKPRTFSVCGGIPPAPVLGFPVAMWVFKQLPTNLLGCGDQGLKIKWGPWYTFAPLLTSSPVSLGLENTGFFSQSLFLSNQDIYIKHLGSGPSTLALITEKELQ

SEQ ID NO: 943819 - protein, 262 aa, Homo sapiens
FPSVPQYPISLTHQKGLQPIVNKLCSCSLLRPTHSPYNTPILPVKKSDGSYRLVHNLQAISQAVLPIHPIVHNPYPLLSLVATNTTLYTAIDLKDAFFTISLHPDSQNLFAFTWTDPDTLQSQQLTWTVLPQGFRDSPHFFGQALARNLTSLNLSPSHLQYVDDLLLCSPSLKDSQTHTATALLNFLAIKGYRVSPSKAQLSISMMTYLGIQLSPGAQAMTSARAALIENLPPPFFKSEILFPRLAFFRIWDQLWPSKLIPL

SEQ ID NO: 943820 - protein, 191 aa, Homo sapiens
LTWTVLPQGFRDSPHFFGQALARNLTSLNLSPSHLQYVDDLLLCSPSLKDSQTHTATALLNFLAIKGYRVSPSKAQLSISMMTYLGIQLSPGAQAMTPARAALIENLPPPSSKSEILSFPGLAGFFRIWISNFALLAHPLYEVAKGPPNEPLNPSHNILPSFHKLQTALVTASAPSLPDISQPFTLYTAES

SEQ ID NO: 943821 - protein, 69 aa, Homo sapiens
TPHVFLCSRTSTFSEARGPAEERQPTPSLQERQPEARYLLAADDQFRSEQRGPCDGLCGMEHGFSPKCT

SEQ ID NO: 943822 - protein, 115 aa, Homo sapiens
MCSKLTCLQKSDPNPVIKKEKRGQVWWLMPVIPALWEAKAGGSRGLELETILANMVKPRFFTKNTENEPGHGGMYSQLFRRRQELDPGGGGCSEAQIVPHSNLVTERQSDRARLC

SEQ ID NO: 943823 - protein, 226 aa, Homo sapiens
LTSSKPDSSPVTPPTDPADDSSSFDPVDFLPPRQHHDPPPEHHDPPPYVPAPALPLSPTLSNQPTSDSETSLPPPLTRSRAQCAQQPAPLLPLREVAGVEGIVHVHVPFSFYDLLQIEERLGSFSSDPDTYIKEFKYLTQSYELTWHDLYFILSSTLLEEKERVWLAAQAYADDLHQQDPTKPVGAAADPWEEPSWEYQPTEPGQVYCSHMITCLIAGLNKAAHRL

SEQ ID NO: 943824 - protein, 149 aa, Homo sapiens
REVHPALKTGRLIPWRGGKTAKRVEISKTRPFFLAKDNSLPAREQNWMENEFDEFTEGGFRRWVITNSELKEHVLTQCKEAKNEKRLEELLTRITTLEKNINDLMELKNTARDFREAYRSINSCIDQAEERISEIEDQLNDIKCDVKIR

SEQ ID NO: 943825 - protein, 278 aa, Homo sapiens
QVRKNQATKPTVNIDADQLLGTGPNWSTINQQSVMQNEAIEQVRAICLRAWGKIQDPGTAFPINSIRQGSKEPYPDFVARLQDAAQKSITDDNARKVIVELMAYENANPECQSAIKPLKGKVPAGVDVITEYVKACDGIGGAMHKAMLMAQAMRGLTLGGQVRTFGKKCYNCGQIGHLKRSCPVLNKQNIINQAITAKNKKPSGLCPKCGKGKHWANQCHSKFDKDGQPLSGNRKKGQPQPPNKLGHFQFTGWSSRVSRTQPLKYPHRESANTIQQLS

SEQ ID NO: 943826 - protein, 40 aa, Homo sapiens
GSNIVRKLLYHKAQQSAMAVSRPFYRRPTSGHDSVLPQSL

SEQ ID NO: 943827 - protein, 136 aa, Homo sapiens
AGSPAASDSPGGSCGPIRKYSAPHPPPTRKSARFAGSYGSARSLSAPRKSSKSSTHPNARGSSPHWHLHGSAPNRYCQHKCHGVAGNPTGPASAPTAATPPASGAATAPPTADNTKTCPSRWGKIAAAETNGPAPR

SEQ ID NO: 943828 - protein, 41 aa, Homo sapiens
LSDMGSSVIEVEYIRRRYNYRLRRVMVAPIAGMTRPLALPV

SEQ ID NO: 943829 - protein, 48 aa, Homo sapiens
MGVDAFRCAFSFQRCPVTKRNAVTCFLHRTRNIKPGFEGSWCVLGHIF

SEQ ID NO: 943830 - protein, 129 aa, Homo sapiens
EHCSMEPFLIYGFLVAARELHTHPKNTKVEYVRSEISKNSNSALTINMIILKVRKNMLSQKIKSTHMLFVTHRINGQNHLIHTAGFKRSECDYNIIRCTNHDRWAELYEFVKGSLIFYNTLNTGKVLIP

SEQ ID NO: 943831 - protein, 46 aa, Homo sapiens
PYRHSQIALPGVNGNFQTETNCSSLILESSLTEIPCQCSRKIPLNK

SEQ ID NO: 943832 - protein, 101 aa, Homo sapiens
GPGFGFLCGLSFRGFPVPGGFPFVISLGSIGAWLLCCQPFLALYCLAFVSPPWVFLPVFFTFCSLLYVLLGLLLPPRVGSILVPARRRFARFSPLSFVVRR

SEQ ID NO: 943833 - protein, 99 aa, Homo sapiens
ARKSLPHSRSLWGMERRTSKLTVIKSLRAQPDWTTEALRLRSRGLVPSQLAPAYDTAKLRLLIGCGARPPGVNPEASSLKAWRLCLRRWSSSVAQAEVQ

SEQ ID NO: 943834 - protein, 120 aa, Homo sapiens
GQGAKAYLKKKSLGSFGKNLKSGKNFVAGQDLPSGGSQATRRRKKEELEGFGYDFYPGKMMCTDLGPRSRSLSYGKMFFTMNGTYQSWVWLQVPPQDTAPYSCVQHTSLASPLVVPWEAS

SEQ ID NO: 943835 - protein, 174 aa, Homo sapiens
PICLSFKRPISDSHKIPVARLKRLTSPLPRFTIAQVFNSSSDEGYFKFSPVYTKVAPVQGMLTIVIIQSGLALMTISPSLTSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 943836 - protein, 132 aa, Homo sapiens
MNCAVTRSRRGCQACHCVRILLQQDIGYQSVVSHSPRGGLLPSDSYQLINPWFQLMLTAFDRHKSFSIHSVVPAEALAWTEGHLVQSVPLLASYDCGHGDLGMTTYRQRWAPSLSISEMRVMPGVLIITMSH

SEQ ID NO: 943837 - protein, 160 aa, Homo sapiens
GGPGVWRVRWSGFRVGGRKAGRENGAVRSALWFRLVGWMSAVCGDAVEGSGSGGCLSRHWRRPSFGELEAASVHLPGCTGLPEPSSSHYYLISALHCSALGFPPVCAVAASETPPGSAAAANLFIVPSSCSAGAPVVLERQTALQSPGGQRGASVWFGAV

SEQ ID NO: 943838 - protein, 66 aa, Homo sapiens
KKPSLLSPSLKARGHDQSSWNPRPSGFNISRAKPSKYLEIRVCPPMPSNFGFLGKPKVSPCNPACS

SEQ ID NO: 943839 - protein, 51 aa, Homo sapiens
MLVRCMRIRIEAQWVFSVHVLTLEDWHVERQRKGLLVALREKVSLEWRSGH

SEQ ID NO: 943840 - protein, 101 aa, Homo sapiens
MIVLLCCVRCVLAWVVVGGVWWFRVWGCVVLCGRCVAGCGAGGRVSRVAGCLRFVFAAWGCIAVGCGGFGFALCASLSSGGRGVPMVPVDSPLLGVAKGGY

SEQ ID NO: 943841 - protein, 99 aa, Homo sapiens
MAVRVVVLCMCCVCEFLYRRWVRSLVVLSAWFALESVGRSASSVCAVLRVGVERSGVSVVARIILLRIVWCVVGEYIGVVRDRVGLCELGSAGCPFRLL

SEQ ID NO: 943842 - protein, 130 aa, Homo sapiens
NQRAKGRPLSLGTIKAGLQGQHSSVDLWQDLSLTWKLVLTQPWQISWLKREYRPCFESAFSKLLQPGTHESPCVSTSLTFMPQFIEHEATVKQTVGVPRRNSKDVFGPFRIRILTKMSRHCQEEPTTWHQ

SEQ ID NO: 943843 - protein, 132 aa, Homo sapiens
CTVSTLEICVGEAIDTCYEVDFLAQSCSAVSMMGFSIVIIQVVMMIIMGLVDNYPIIDSSTLSVIQIMLAISKHHWYSTRYQYIMWSDTGVTIHVIGVILDTQTVWTLVANPQHRTILAKAYAICRDLCRAL

SEQ ID NO: 943844 - protein, 143 aa, Homo sapiens
HSSCGASIKALMLSSNVSCMSSTKSLVANASNSLQSISAYHTLTALAQEIVYIWSHTHSELGETEWRPQLLSRHSCQYARFMLSHRLSSSTCVCRVFMMLPHTYVSAYGFCCTLKPAALCPVLSTSERSRAPALSCSVTKTLA

SEQ ID NO: 943845 - protein, 135 aa, Homo sapiens
ELLAFFAAHWMASATSVSADHILLSRPACLASWSEIRSPVRTISIARVFSQARVSLWVPPAPGMVPIKMLRLCELGVLIGIDDITRHGYLRATAKGIAIDSSDEWLLDLGEVVPVLQDRAGVSVLQTQVLHFVDI

SEQ ID NO: 943846 - protein, 126 aa, Homo sapiens
SVTPEPSIILKFLEFMFLEDSLPGRGIYSLLPLSIICTLIGTGAAVEPHMLEYQFVLQHQVSGSYQARVDLLHDRILGRALARAPASSLSLSLSLSLSLSLSLSLSLSLSISLSLSLSLSLYLSLS

SEQ ID NO: 943847 - protein, 77 aa, Homo sapiens
EPSPSHTGQSPHPLAQGVRAGSLAPAGVWGPHESRSPLCPGSVSMADTFMTLDTAGSAFEVAGGAEAGKMARRREGW

SEQ ID NO: 943848 - protein, 67 aa, Homo sapiens
GTLTIVYRAQRTTSPLMCAVSTMVSASVTTAKHEQIVVLDSPIDLYFQGPFSDVVTTNLKLRNPSYR

SEQ ID NO: 943849 - protein, 39 aa, Homo sapiens
MYPNKVKKPPVSRVLVAHARTLSTLADLDGLITKAQQLK

SEQ ID NO: 943850 - protein, 42 aa, Homo sapiens
MCETPQCNYSPRVTCDCVSDTPAAPLNTSDMEAVWNQAKPHE

SEQ ID NO: 943851 - protein, 39 aa, Homo sapiens
MPATGVRDIRWPSFDLHVRPVVSWRSAAACAQFGTSSCR

SEQ ID NO: 943852 - protein, 137 aa, Homo sapiens
PVPLGRSGVLSKGSKDVWDDIISVGTIDEYNHIVVMQTPGDLNRRFLTTIVASGFVGSEPEWMSDTSYPMGWKYCVNSPCVRDDIQMTVQHIVAQEVLVDRAPLRHLVQINLKGATVSTDTTRFLFFWCRILQPGGS

SEQ ID NO: 943853 - protein, 34 aa, Homo sapiens
MTFFPRIKTLIIAIVRLSLSILLGPFLYAFPLCT

SEQ ID NO: 943854 - protein, 164 aa, Homo sapiens
MMLIKRFTLSGAVGWIYWSEEQGVEDWGAGTGALAHSSDAGMSSWKYSACECCHRRRFPSHELLTIFSSKGCQLTSRTQAMWLVSFFTMCPLETVAHNPFASGAASVDELLASPMNGGQPPPHEGVQHSVALGHLLPPKSQFCCVAAWREASMPSRLQERRISQ

SEQ ID NO: 943855 - protein, 215 aa, Homo sapiens
IWPELLLIPTRLPFRAFNSCEHIASVCRYESFHEESHLSSETIAHLRIRPASPSRSSKLCSFDLIVSSSIEWAYVEDVSQHNISNHRVGDYINEPHSKSLEHILQGSRVSRVTLNHLAISIHSGSIFTNGIGPLGDVQCGQHQSGISRVTTCIFNMSRAGIKHTPSIFACSVPFYFVGPVTSFCQHHWVLLRSSSRVYYQLFPLISIDPGPKSCS

SEQ ID NO: 943856 - protein, 139 aa, Homo sapiens
MKTLHAGLTRNLGLMRDIFLRAKTLLRTTGSELLYALTHGPLELFSSPLRVRPNVLYPRPISKKRTGVSAICGPGPGSKRAKKPSCVNPAFTQTRSASPIPSKTFELLDLACARAGHLILNESYNLNFLSPRLEGGGRV

SEQ ID NO: 943857 - protein, 149 aa, Homo sapiens
EKTLYFPTKTLPDNVFRRSAIKVPPKSSFLYLEFPLKKNLGSLSFPSLPKIKNFWIFPKGKSLVLETPQTRGKNPKKPKRFPLPGFEALNLLRWPPLPQVEPEIESVLAKKGFFDFGPSINPPTKPKGFLFKNKKTLLKFIGILKDLEC

SEQ ID NO: 943858 - protein, 105 aa, Homo sapiens
KKNNPPPPKVSQKKKRFLLIPGGGVNKRKKKKPPFFSPPRKIFFLWGPPPPKGEKQKNNKPAPGREKKYYVVDFLPPGGGVFFLPPPPPLYKKKGRREGKNPPPL

SEQ ID NO: 943859 - protein, 140 aa, Homo sapiens
RLVRDICRMSVQVCPLLVLIRQSMCACNPEASPLAYELVFVVQQRFFQCFELCISTMRCEPTYSVNTGRKCWPNRVKNLGIFFNSNWKMFPMMGSGKGPGGRFQIMCTCLHMDSSCSKSAHTSRPSVTPRAYMVPLGPCC

SEQ ID NO: 943860 - protein, 70 aa, Homo sapiens
GQQPPSSTQLTQLTLPYEHASVGSAVRVIMARCLIVKITRLRSAQCSNLMQMYQQTNVLMRDTALSSSIG

SEQ ID NO: 943861 - protein, 98 aa, Homo sapiens
KLEVVMVLNEEYEYEDQDCIPMYIYAIGIVLSYIIFLCNSQAHVSVTLLRKYRINYISSSYMIFICDLHFSCSPKSISSIVLTELVLIISVHSSLREF

SEQ ID NO: 943862 - protein, 143 aa, Homo sapiens
FQQYVGLRLDQDLNAMCLHPIVPKAGQGSPPDVPPGRSIIKNDSPVPVRMERGEVASARELVPVVQQRFLHCLVSVHHHHALRAHVQRELRPEALGHPGVGLGNILQFQLEEVPDDGKRARAWGQIPVAVHLPPHGHQQEEGR

SEQ ID NO: 943863 - protein, 77 aa, Homo sapiens
MTSPGICGRGGSCVKPRHPDVGPKEGLVLEDLILELVIFLAAPTTVLRLSFPFLVLMFGSVLSHHVTEVLLLYLSLL

SEQ ID NO: 943864 - protein, 133 aa, Homo sapiens
VQMLNGSGVSRQGILSLVYNMLRCMCAKVRPQDTVSVCHTGYEYIDTIGAQCNISLTGSSDVSLASTQVTQCMSPYRAILCPMHRDGVSARSTGYSSPTNGINQYDSLGLAKCQKDTHQSLRLAERHLKSILL

SEQ ID NO: 943865 - protein, 131 aa, Homo sapiens
IHQQGYALSVYSSDVSTVRYDRIPDLGSHYVVMSLDPAVLSSSLSFSNIGGNSRPPGQLAFMTGSTLGQTMEYSPGPSSPSMQQSRRQYKARRSAALVPCQSHTVSHDQDQAINRRNRVSTSRLSKEASIG

SEQ ID NO: 943866 - protein, 175 aa, Homo sapiens
LGLILWETYPCRTNSSGLCWGRGQTARSWAGTLLYTVNGEDELFIPGEAPLNTHSLEPVRRRRPQTSCTCLGCRWPDHAARCAGQRPHVRFNGCPADCFDRPGSAPDMVTVMIPGRSPSSSVRWIWRGPEHEASAFPLYHMGCQGLFTLAPFQIRPMSTESLEEKSLTNFVFWVW

SEQ ID NO: 943867 - protein, 118 aa, Homo sapiens
NAKGKKRTQTSLKEEKEKWAPKTKRRSKRSKRNQAYKAVFSTNPQQKVGRDRRYRKGRPQEEKVRTMEASSRTPERIKSSMGANNQGEGTRGTILLCKQKLYEGAQEDHNPKIQQAPP

SEQ ID NO: 943868 - protein, 244 aa, Homo sapiens
PSPQALVRVICPVNPPSIGPQTMVFLQVSPQEGFVGIGPRNQLGALPPKNRFSVRDISPKHAENLSLGLHSRLPEMLKAKPPQQSINYGYGPPPLLPPPLCLVGTLLQKQLTLPASWSSAGPVWRLRTADPWHPEVQLCRTRLGSHPGHSHTYPLTDALELHMLPEHGLRLLQVEASGSEPTQEKIVTWIRQGRQHILDILPKLGQCLLLPGAQIADSAAHRGSTAGMGFGGGRRRVRHLTSTD

SEQ ID NO: 943869 - protein, 97 aa, Homo sapiens
MDTRSIIRLVVGYHSDPVQSVISSACSPGFRVSSSRLWSAPLSNPRASSSPYVCLSAHSSDVAASYVLHPSAVAVDGYALAESDIGHILVLGIKERL

SEQ ID NO: 943870 - protein, 103 aa, Homo sapiens
ETKSRPIPQAGVQWHDLGSLQPPPPGFKRFSCLSLPSSWDYRHPPPRPANFVFLVETGSHHVSQAGFELLTSGDPPTSASQSAGITGVNHRTRPVMDYYDKIF

SEQ ID NO: 943871 - protein, 120 aa, Homo sapiens
MSTEYHDSCMRSIRRCTSVRHWQLMSSGVSLIDVSWSVWSTNWDRKYTFSVCMLTSFAREFVLVRRTAHPVPVLWWAALTSLARVIEVSRSALVSPSMVLSGVNISRISRGSSRVSSMHD

SEQ ID NO: 943872 - protein, 72 aa, Homo sapiens
EVSVKSDLEGNVNPYQGVKGPELIQNKRKKWKEFQAEVKQRKEPEGGSIRPGVPGITTGHGGAIIIVVKKCK

SEQ ID NO: 943873 - protein, 168 aa, Homo sapiens
LFGCRKYADIYYKETANTNYKGGTIKKSVPAAPMINSIFLRRSECTGSNSNCMNKNDSTTSINSLKLNLKDEGPASCGEWQKGQEATYTRCRGELSGRPRRPNYLAKQTYSKASLILLDEPGKAFGEEISTSGRTTARVNNREKRRTGDATQAFLPENDQEGHRAQSA

SEQ ID NO: 943874 - protein, 169 aa, Homo sapiens
GEEKRRRKGGKERRKRGERRREKKKRKRKEEGKGKERKEKKGEGREKGEGGKEKGEKKKREGGERGRRGEREGKGEGGKKGEGKGGGKGRERERKGKRKRRGKEKEEEGERRRGRQGEGGERKEGKEGEKEKGEEEGSRERRGGKREKKGEEKKGGGRRGKGGEKSREG

SEQ ID NO: 943875 - protein, 76 aa, Homo sapiens
PNSTNVSIICSILCNVLGVLSPTVDYPVCMDCITSFIHHPAPSSLDHCIMGSDVTQPSLSLSYVLKIMQLYMVMVL

SEQ ID NO: 943876 - protein, 167 aa, Homo sapiens
KVAIRGYQKPLLDTCGNSKTTEQDVHSQCNGKAFSDGRNYNCYSFIPSLSCINLPEGSNIIAKSQLCAVRVILLWELTHLESSGKWSEPMTGFSCDRFSVLFLTQVTAAQAIFTISVKASVVAVKCGMTFLQGRNQGAENMTNGRVLFFRVSRQLDINMCNTLDRWY

SEQ ID NO: 943877 - protein, 217 aa, Homo sapiens
VSFRYTVLEKLELALNVRVAADALQVPVCSPLISIQLIEHVVAFSTSLCVYTLSLSLIHSADNIYVAQLLAVCINSTASMIISRFRVSVIAASRSYCFSIYSRPSLGMCSQLFQPPVSEAFNVRPDKYICPLIVETHIGRLHCNIHTDPIALIAGDKDSCQTVQISNGLTAEVYTSICHIEYIFLNGYLEVLRVEALSSTQFLCLLNFLLVDIHFND

SEQ ID NO: 943878 - protein, 114 aa, Homo sapiens
FFAHSMVHCPQRYGALAYTFSCDCDIIIDRGLFCSQKTGRFSVHTVSDLGAPTGQLKAHIKVQFMVVSGDRLVLRQGLHHHEGGLGTAIATKVVSLYIDQPCYARRIVTVYYPQ

SEQ ID NO: 943879 - protein, 67 aa, Homo sapiens
TCFKIIANMSSAILMHSNRPFKGLSRMVMVSFSRKACMSTLCASQSSILHSVTIDLKYLVLKSQTIQ

SEQ ID NO: 943880 - protein, 177 aa, Homo sapiens
MDGEAVSDPSLVKAFLQLIDALDEEFGQLNESILHMLHLCLPGMNDHQPRHCLGSDSLHYAGEVPVQEVVILILLAHHGYRIHSLGGHVEVLILGALVIKACLSLSLKDNVIRHDRACIAIEVLKQVNDHASSSNAISPAFSRMRMPELPKLVATVCIRVMVIQVLDTESCRLADRS

SEQ ID NO: 943881 - protein, 76 aa, Homo sapiens
GESLQSLQQCVRSAISVLSAQVKLLNLLHLGFLLVAVSGLLPCNEKMLFSIRLVSVSFTSLSNLPRTCFAYAHPVS

SEQ ID NO: 943882 - protein, 109 aa, Homo sapiens
MYEQLVHQVVVREVDLVSHNDGLASMVLGQQGLNRLQLPDQCLHIVILAGLIVGVDEGDEFPLQVLYAVNHHVYCGCLVVVLPIEPKGSTQVTQDGIVLVQGQVTVLEL

SEQ ID NO: 943883 - protein, 201 aa, Homo sapiens
MHVRLCRHHLLSGISSVSLSSKGIKHSNGRVIISVCSLMVSLRILVVGLASSAFGTGFTRRSTTVVAVQAKLASRACAEANGTEIFLQPLCSYVVCLPIIIPCCFIRVTLSVTVPLLSNLVVHTIVMARCRSITYQMTTSKASALSTAVCSLIQTFLPLISNGIMEICVGVKARVIRRLVQAFVDTVAHGTFLFRTYASLV

SEQ ID NO: 943884 - protein, 77 aa, Homo sapiens
MLQYPSVWVNSGEQRILRLTLRGMYVFTGKFDGVMEEAVLRAHERSAGCRRIRSLHQGQCRKELCTVHALCQAIAVI

SEQ ID NO: 943885 - protein, 100 aa, Homo sapiens
MGQDLVLHAISLFVGTHGDSDHMSPPFFTHSLNSNVWSHTLLIVSLKSAFIVHFNQFLAPTDLEVDVQLEPSSWSADIQTTPRSRTQLTLCKPSLPLATI

SEQ ID NO: 943886 - protein, 43 aa, Homo sapiens
MHRRDSVRSKQLGHVHGPVGDILYDDLPGGATLLENIISHFTG

SEQ ID NO: 943887 - protein, 114 aa, Homo sapiens
HKSATFINSWATSFSNSFELLSIEVRFWGINAQNVIWQFQIVNCPKSIAIVINISAHHISHGSHQSCEVRELIIVFQLAFISARFQFCTAVSHFTIGVSYVCNCAYLVTSHGMQ

SEQ ID NO: 943888 - protein, 202 aa, Homo sapiens
HISKSLLIRSPINSGPSSKGLYMDHDLKVPRFMLNELQLTSTSVDYCSDDVHMVTRSASSTVCLALTQYRVCRARIGIVELISILDMGSRDLLIHVHSDCGTMSIHQLWLYLLSTHYKWHRWQCLPVPPWHAVAIRTRCSAVGTIEDETSSSVSGIGGIDDIMVRGNDGISAYLQLGITVACNSTLSISRCTIDCHTDFMSS

SEQ ID NO: 943889 - protein, 149 aa, Homo sapiens
MCGLVSHSLLRFQAVAVISSAFEVITFLYTHIFSHVSYNCHGTLVFVRSAWSEGPTAVQTNDPAVESSCQYSAMLTTLQVVFQLDPICPIQLTDFCAMSAWRGFRIIDTAIADGVIRMCWSLVIRQPYGSLGPPVPSSVCSSPCRVQGC

SEQ ID NO: 943890 - protein, 183 aa, Homo sapiens
MADISFWKSSKLPILEGSYGAQPYSLEAQPVKQNPAPVFYKSPVSSRCFRTSDASNVQFCRPFSSSPGSVARMPLMQYQTEVPMGNDLVLHVKSWFVVSRSTRSYMTPPVFTHIVEQLRLRILPHHTENEVGVQSATSISSCQPLSGNEMCSYTHDPGVLTFRKSCNMALNSRSPSSVYQTPL

SEQ ID NO: 943891 - protein, 201 aa, Homo sapiens
EIDGYASVLRTIALDTCSVLIGRKHNPSVDVTVKFSMSRIMPRKPWIKAEVYTRVALMSIGSQYYCLYDPSTYSLCSERPLYRHPIGTLPAHFRYLPSVISLSSRLDSLSWSTFPFTVSPALREGSAGHVARHTVVVGSIQHGVEVRAGAVLSQNSLAVQSAVLLGKVHRGISSESPVAQDHSLLSEVQQQFLHGRRSHPS

SEQ ID NO: 943892 - protein, 132 aa, Homo sapiens
QTSTLTSVLLGNTRISGIGNGVLALDCQRSKCKPNKFSQSFQYVRFGRALAAMGALGVLAYSHHECCQGASFPSIPLFTWICISIAPIEVSQVVHIEHDLVPQKWSRCVVSTVNLHYMSPTVFWQIVNSSVW

SEQ ID NO: 943893 - protein, 87 aa, Homo sapiens
VHLSIPVRCNAFDIADSVPEYDVSSMASNSMSQILQLGHHCDRCVRQCVRILLCIHAKECCICHASRDADCADDAIMIIGISIVHGK

SEQ ID NO: 943894 - protein, 120 aa, Homo sapiens
MSSTVTGYLDCTVRDGLSRMMASSLVLTSKEEPAMPRVVEAHSSVPVGPHMDVSINANLMCWRPRTRVKLQHSRVADRQSQVVLERHPQLRHEELGVMVHAYNPSTFGSQGRRIASVWEY

SEQ ID NO: 943895 - protein, 67 aa, Homo sapiens
MALALKRTANEPYMPWCRAILAALRGRYRRLPGNELLLRRLPRGEAKSSLDGVSIDAIPNGLELDRL

SEQ ID NO: 943896 - protein, 168 aa, Homo sapiens
SLNVDFDAQSIVVRLASVRNGYMAPPACSNLLATLILQLGQRKRYLITWLPRSTTMHASVVQYVTGPVAEYQHGHFVYDLGEVSEVIGDHSSDVVLDPLKRAVDSSMQSRYVYQHPQRMAFHAFAREASTVLQAMVYLYLCLIFLLVRFSVRISFFIHMALIAHRFPQ

SEQ ID NO: 943897 - protein, 117 aa, Homo sapiens
MQFRGIKVSTSHGNAILVLFQECLFIVIASSAHRNIWWSQQLDQFWVVLFVLQEACHVSKILVVHSIKPLLYTIQDEGQLCIICLHRWYEVICNNSQMSQEQHMSMQTQLLHSLILQ

SEQ ID NO: 943898 - protein, 107 aa, Homo sapiens
MQCLCSTAQGMLNCISGYAKCHKERVSEPRVISVIFDVGSMSEDACILDVSEIHKFSDRCCSVQLIQLLTVVRSVMEQQLPQVTVLYGHTLIFVSASYALSDDIFRL

SEQ ID NO: 943899 - protein, 119 aa, Homo sapiens
FIADGFCSVLIQSDRMHSYVLDVQLVRVSRETHRSKRIGIWPMSENLGVTCTVSYVWISSAASLCTSVHARPNGKHHDSCQFAMEYLHPQAVYSPGAVHQDELHELSSGLVIASSQQVR

SEQ ID NO: 943900 - protein, 132 aa, Homo sapiens
FIIGTFTVVILVHVVVLFHGVIDCKGSVPFAFKADVIPLSALLHVIADMILGLFGVPIVDSEALCVVQLFNIRLHLIHELQALSEEQAIAGGQLELAAGMVSGMEEFLEAFMVLSLRNLREVEIQALKDFFV

SEQ ID NO: 943901 - protein, 115 aa, Homo sapiens
MFVNARAYTVVWLRGSALLSVISVLMPDSCPSRDLSARPARSVISQVLPSSGTDTVMSVLEIRAYLFNHAFMRAVAQRLAGYRRLTSQACYGGRSACQRHICWDSGPELSRPVPW

SEQ ID NO: 943902 - protein, 206 aa, Homo sapiens
HCLLSIGLSWLQNSTNEESAMTSTAARGEDSKAATVSKIRRAIAILVSFINSLICCREYMLCNLNFRNGSSSSDCNRDSKSVNSLLTHWGITVSIFTIFVSQANSASKDSTNSNIFTKYYCSRILSEPVLPGLRIWLESSMSHLPPVGRILTVSAGCKKQRASSAPGSRRQCPSAPAALSLSSQPAAAATTAIAAHLRDSQAMQPH

SEQ ID NO: 943903 - protein, 102 aa, Homo sapiens
MLWINQDNLLNGVCVIIIISVIIQLSQSSLVAFSSLLCQYLKASTTLYCVHAMMDRLAVSRTHRNWTHAPSAANTNPIYNVTLLGPVAQSARYTRARAAGSA

SEQ ID NO: 943904 - protein, 218 aa, Homo sapiens
EGEEERGREGRGKKKEEEKREEERERERKRGKERERKEKRGKEKGGWGRRGEREGKEERKEGKKEEEEEEGERKRGKRGKKKREEEGRREIGKGEKEGREKKREEKRREGKKGGRKRKRERREGEEEGKRRKEKEKKRKEKEEKRKKGRSKEGRKGEERRRGKEEREKEEREEKREKGEGKEEGKKRNEKMINRYQALTLSLSLSLSLSLYTCRIPAA

SEQ ID NO: 943905 - protein, 181 aa, Homo sapiens
EKREKKGEGEERRKGRGEKKKEGGKEEGERRRRGKKRKERRKEKREGREREKRRKKRGGGREKRRKEGQKRRKEKRGKKEGKREGRGERKKERGKKERRGKGEKERKKRKDRKRKERIKKRRKEEVKKEKKSGDTRAEREEEEKERGGIEKGVEGVKKVEKKREEKGERKRGEKGKGGERE

SEQ ID NO: 943906 - protein, 141 aa, Homo sapiens
VGRCSSASHVVKAHRRVKGAVRKVFEGHWCSQAHVAYRPRLVPLEIFRHYDGFRPLPQPLDFRLYLVIGSSYADSPEDLCFYQVFEAQVLTPSYYSYFLLHETTPRANAVSGPTIQGSESARVAVTQRHPLICPDTDPLMR

SEQ ID NO: 943907 - protein, 112 aa, Homo sapiens
MVTVDTRRFCLCPLSLPLRVPIRCKKSKASPWPELQCLGATCPEVPEESRSCLGALESSLHPSCQGSSKPRSNVVHRLGAAAPAAQTPHPQHRPGPGWYTRGMFLAYWAASV

SEQ ID NO: 943908 - protein, 104 aa, Homo sapiens
MVPTVISWDSRVHLVPDRCPRKSMPGRGRKLKVDRRGNDGVQAAVAAVRAALHPQRPATAAQRCPTPARGIPKRRDRPQPSCETQGQVCADSPRAAGLSEGHAK

SEQ ID NO: 943909 - protein, 139 aa, Homo sapiens
MIFGKIMPAGATGKMARTFSYVLAFTTMVNGGSQGVCLLWALSLPLRGLIRCKKSQGSPWAEAHWLCRQLHSSPARKPELSGCSGKFAATILSRFVQTKIRCSAPPRRRGFRRADTASTASYWPDWYTREMFLASGPRR

SEQ ID NO: 943910 - protein, 109 aa, Homo sapiens
ISSIAVLSMMISCPCITQNRVSSLLSAELLEFRATHTCSMDAWTHGSGFIKVTSIHENIAVSLIMLDSRLEPVLRVWEQVHWLLTVSGVHTDALHTLLSQWLDGRVSLY

SEQ ID NO: 943911 - protein, 157 aa, Homo sapiens
RRVTSHDLDIVHHDHQSAIIHCESVSVIDCELIHVRSYGHVSLYCVSSHHLLIQYVCSSSEYDHLQIMLNSPLLSILSVCAQGLRHPQASQFLDCAVGYDWHAWHVNTEPVSRMSLLQASVSSHVQNRRTVSQLASNISVHTAPAALQLGSIKRKLL

SEQ ID NO: 943912 - protein, 113 aa, Homo sapiens
MVLVAIKYWQWCSYTVQMDLRIDGPTAKSEVYPHYACELVSTSVHATISSTSHPVHEVCTQVWMVESADYIGYAFESFKKEAYGGIRRHHIGHLVGKVHQIINPVADKVKLHH

SEQ ID NO: 943913 - protein, 112 aa, Homo sapiens
MVQAEITQFALTIMAYHRKDHTGPNYANHGGLQYVLDPFQKLRDQSESRITLSCLNRSRTLSLREQKQYDEMTSSFIACTFIIITPDNILVKVQHDIVHVHYLQYLIQAHVF

SEQ ID NO: 943914 - protein, 97 aa, Homo sapiens
MASNREDDTGLSWLDMRYASRSGTRSRSPVFKHELDYPYLLSRTTTESLCDEKDKIPAFIMDRVCLHNQGTFNVLVTVLHDMVHLHYLQDLIQPNVV

SEQ ID NO: 943915 - protein, 84 aa, Homo sapiens
DKNHCVKVLQVHKVSIFNSGHFDDLQVYQSCDTRKILWHFVQTQIRLLVLSKMALVIVRGTLGLGRAEIAVISSIGAYPRSLIF

SEQ ID NO: 943916 - protein, 114 aa, Homo sapiens
PGTAGLCPEESPSCVSQGYGSPKIGYSEPAGVVSFKIYCMVPILCESILSVRERVVSAREKDVIPCGSPSRESRPFLSTRGCRLVTDIVRYIVYLASASVSRSFRHACSSGRFA

SEQ ID NO: 943917 - protein, 40 aa, Homo sapiens
MVSIRLLLRMMMHAVQVISITNQLTAIENVKQRAEPPRVV

SEQ ID NO: 943918 - protein, 136 aa, Homo sapiens
LVSMHGHHLYWGLSDCHNVESCREALLASISGVMAVQLHMLGTLSYRKELVHRPPNFLNISQAVMFRSPGQTLSLHFRIMAGSRPLRRVQHVSYHVLRFTCGASVARIAGAVDRYWSVLSLQVFGTCCHCYRTRCA

SEQ ID NO: 943919 - protein, 106 aa, Homo sapiens
MTACLVICNISAYNAYYVCYFVSFEYQKRLIEILSSNRQYSASVANVCRASHMIMAPVSVEFHNRVCDSSPILGCTVQHCMPAPAYMTLDVYPGGEFGSSERIRHE

SEQ ID NO: 943920 - protein, 154 aa, Homo sapiens
QYDGIMPAVAWVTLSQIHTCLQLERLMGIAVGGEDAYGLSIIPNEVVEAIGITKWLESRSALRSWSLALRSRCSSNRGILGLLAPSSIKRDNLLSADPSFTTLDTHTVLAVSPVSDEDMVISTGGHSHWPQLIEQSPDIYYIRRSRPLRTARHL

SEQ ID NO: 943921 - protein, 130 aa, Homo sapiens
SSMYGHLCVSSQDIEQTHTEPCQSTSAWATAMIFILTAITFDCFTGKFGDITLIVPDLSYPTYPAILKYVSNVRRQWLGFVSHSRDLGRACPASLYGVAPLEGRSNSSRRAVGRALDTAVVVSSENPAIL

SEQ ID NO: 943922 - protein, 116 aa, Homo sapiens
YSPARFNIATSCCSSGAIGYSSGYIKGRVCSSNVELTSVLSMSASFTPCRYVSLLPVSSSACAGGSCASTSIEKSSPGTTGAEFGIARAIKPSDILDHPLRSSFHHKHQVAISLVL

SEQ ID NO: 943923 - protein, 89 aa, Homo sapiens
MAVWLVEGMEKFLEAFMDLSLGIPVRLKSSALQDFIVSVSVGPQGEQCIGCSDAHWGEDHIGPVALVCQLTVEAEVERIQVSGGHVEGW

SEQ ID NO: 943924 - protein, 153 aa, Homo sapiens
ILEGCALLLAQKHHNDSWHVQHPADEGKMVCLTDERDSHQGPCSVHSVPLDDVADSLSGYGQTLGMAYGTTIVIRSGILTDAGSPSHYDEVWQDSKSESSWFGNLQSESSLVYATQSSWLLVQHSKSPSSPWIVLSLLVSALLAPSRATVVQV

SEQ ID NO: 943925 - protein, 105 aa, Homo sapiens
MEGSISSNESLKRLILRRVSSNNKQSALWSLIAGIPVPGQSGTRRSAYAWLRLDLNTQPVIEPLGPPLGPDTQLAARASEEVTVSSRECRGSGSTAVLKGQMRDP

SEQ ID NO: 943926 - protein, 70 aa, Homo sapiens
QLSISQVIPGTPNLTGSAWFPPIDLDQICRREMTSAPLSLVKGATFTVEARIKVAEQYPLSNDFFIANIS

SEQ ID NO: 943927 - protein, 139 aa, Homo sapiens
MVSRIGQVHAGEGTEDLDSKGGGQLAGDLRLCLKSLCIEAYQIKDCVMQSWVVLRSYLQTLPVYTQELCLWKSDWWSAEGVAYMLQKKIVLKGQFRSTVEMYGSSLTDSVYAIQNAPVPQHRESLNMFYGIFKHPLPRA

SEQ ID NO: 943928 - protein, 139 aa, Homo sapiens
MIILRLSANWQKDLEGAIGHLIADLCYDLGHTEYSWLGRLVASAYQSGHCFPTELAVLCQLLIVSTTCFRPVIGGSAHRVVTSHLGHLLVYSPLQHIMNGVLLYESALANAILCFVESNRSRHRLLSLAEVTVSIDDKG

SEQ ID NO: 943929 - protein, 80 aa, Homo sapiens
IGPPNDGAVLEIANPIDKCRIERRLKAKVMLDDKLKYELRMKQIVGKLSHNDVKSVEALATKNVKREMPSEMVKVDSKDS

SEQ ID NO: 943930 - protein, 97 aa, Homo sapiens
RQWFSTSGSNSGWHSLLSPSKVILSIVLPFQTHKGRCTLQRLDSYGYVIIVHALSSSSPIVNDWSVMPSDSTIASSRAKVVGTERQAALLYPSVMHS

SEQ ID NO: 943931 - protein, 84 aa, Homo sapiens
VDIFFQRSPYISSGSTWSFQEMSVGSKVVTKRFLSGYKEHRRLKGYVDRLRVSSATRSYRSSHDVASSLKVLCANTGLVFPAVG

SEQ ID NO: 943932 - protein, 186 aa, Homo sapiens
GNSIMTSERIGAQFFGIIWSSALTVSFRTLVISFSWARSSCRVWAFALAMPPANSWTDKVVTASLKVSMLQDYCANHTVAKNMCVKVLQDLIVSISDVVKVLICRSSRVVSEGSPCGTLSRRESDHWAQDDGIDSVRGTLALGRARSRGHQELLGLLQKPHLLAYSQISLSDETVQPRKLVQAEVA

SEQ ID NO: 943933 - protein, 250 aa, Homo sapiens
RNPFLRKPLTEPSINDVITCALTQGSPCMQDLIHAQSMDIVHHGVSLQHYTSLPSLGVRKGQQTLDHECSLSEYSHKAAIAECISSHGNVVTGDKQQELILHAVRCVTQQHIRTCGLTITLVAITDGGQLLQVSTHSVKSALEADGIDDRLNQPSALRYLVMCTCVLHLDFKLGYCGVCAPSSIDSYDLLISCSDLYRPQNSIRSVRVCSSQYSQSSQYTCAPTVSTAWPAVVTPICRSKLVVVLMRSPL

SEQ ID NO: 943934 - protein, 102 aa, Homo sapiens
MSWTCVMQQNERGQRSPDDSMGSQEASKLIHLCLQVPDSSDSSTAEHTYYAVDVDHQYTCIRAICSLGDTVTYAYLSAALRLMDIEDDGNNAEADAAASNDK

SEQ ID NO: 943935 - protein, 104 aa, Homo sapiens
SVATGTLKLGLGLSPFPYRRKATSGRMPSVIDRRGPSPLVYRPPSSYIYVVKGIQLLSRVGTSYCMWKLALSQHDQHRSADMLLLALYPANSILISGKLVLNRN

SEQ ID NO: 943936 - protein, 73 aa, Homo sapiens
GGGPGNLAVGKLKNGQQWANYHPTIRSAFRFPSKLLRLVVKATSNRAFKVAMLFIRPYCFNTFAVLELCNLHD

SEQ ID NO: 943937 - protein, 33 aa, Homo sapiens
MAVEYTIVRLRLRIRLLLSHLVANSAPRHEFGT

SEQ ID NO: 943938 - protein, 166 aa, Homo sapiens
GPSILILLLEVGQKADIAQILSSQKKKKMAENQKEGILPAEGWVTLSQIHTCTAERLMGIEDGGEKAKGKSTNTKGEVEAPGITKWLEKSGILGLLAPSPIKRDNLLSADPSFTYLDTLAVLAVSPATDEDMANSTGGHTTLTTASRAVSKHILHSKVAPAPHRSR

SEQ ID NO: 943939 - protein, 116 aa, Homo sapiens
MKFHSQCPGGISSRTGHTVLSVRHCHAQYRVCLSQARLPVSHVLLSDLAFSMIVAHQVLNALPFYGSLLTSSGMAHLTEPSLSATNESFGHGSKLDTVKTKSNWYRSQADVGIGAN

SEQ ID NO: 943940 - protein, 71 aa, Homo sapiens
LTKGLRCLETKSSASTEYVFFPQGVTDGHSSEILVSSALPKVTQTRIVLISHLCQLAGLNLRKASMTFKGV

SEQ ID NO: 943941 - protein, 43 aa, Homo sapiens
MIQFGADVHEHFFRLSHIPGLRDRAACTCDVLEPVNDIVRARL

SEQ ID NO: 943942 - protein, 134 aa, Homo sapiens
MRRQVHLVDPDCLPAVYETFKLLHIFVNTDCCAIFKLLATIVSGVVSGPHILITVTEHLCHLVLKQATEVVVAAEVSHGSGHILVICVQRTKRSTDITKSILDAHITWVLWGSGSLCRLRTLWYSTGFSNTYSM

SEQ ID NO: 943943 - protein, 126 aa, Homo sapiens
MVDHGSKHFKVALRYGAKNSEIRYHQSSAITGKKSLTLSRSCDCTATLPPHCNLRLLGSNDYKAAASCVAGITGAFHRSRLIDSMSVESGRHHVGQAGHGLLPQVIHLQQPSKVLGFIAWAAAVSQ

SEQ ID NO: 943944 - protein, 84 aa, Homo sapiens
KGILRACGLSQNYGYSPAKHVSELSITSKHDANMSDLQHKGVFVLCTIIDRHSVISRAFSSTYSRQSSPFTGAGLRIDQYLAIQ

SEQ ID NO: 943945 - protein, 67 aa, Homo sapiens
ESRHLNHIHATVLRLGSLLSGDGYSVRFSLHSLKSFISAIFIIFCTEVTVCTCSFSLRGYRTIFDSV

SEQ ID NO: 943946 - protein, 212 aa, Homo sapiens
MTFISTASDLYPTHYSRSWVRALLRVQRFNKLMICWFKLKSTDDAHGLDCQQLEVAQCLTEIPAKAGDTYLAWLTWYQSQSLWVSIAVISDPNDVGCSSQTAVRSACRRGMPCVLAMSSQGYNVLVADHAGLPLEVKGRIASWHYRCGIIIISARGADRRVPQLQEDHVPPVVVFRVTCSTRSVPLMLDVDRRRACRPNPWLWTGESAPGFF

SEQ ID NO: 943947 - protein, 50 aa, Homo sapiens
MLGPHLDFQYNMVHLIIRVWQLRISSLDLEQSSSVSQHQMNLFTEGDPES

SEQ ID NO: 943948 - protein, 31 aa, Homo sapiens
MPLTKRAICECKVNAPASNSYGTLGEPPTSA

SEQ ID NO: 943949 - protein, 143 aa, Homo sapiens
GKKGEREKRRGGGGKEREEGEEGREEGKGKEEVRRRRRKRGERGEDKRREEKRRKEGEREEGGYEREGEGGRKRRKGGSEEEGEGDRREGRAGERRRSRKKWKRARKVTLSHTLSKSISLSLSLSLSLSLSLSLSLSLSLSYS

SEQ ID NO: 943950 - protein, 70 aa, Homo sapiens
EENACSPKFHGVWDHKGVWCAARGLPQGELSDSSPETEQLRVSSEGVMDVIQCPVTGLALDVGWLRWLGV

SEQ ID NO: 943951 - protein, 133 aa, Homo sapiens
PLAVVVKLEPRLVKILIKKSIKFRPSKLVTPLPESIPIPIVRPKAFKDNPTWITTDMAWVFKVSNMIWVILLRLALGFKGASVNNPGFSLGTPSNSMEKVLVQIFSMLVQFVTIPCPIGVFKVKKPFLLWAPL

SEQ ID NO: 943952 - protein, 198 aa, Homo sapiens
KAILAHLNPLNVSCPGQVQNLSQDQIEVSNANILYTQPQYILIALPFPTIPPFPLTKSAIVIKGRSRWVLSLGTVGYTSKMGGRGALLFDRVVGQRHSSHPRRWVAGQRRSSLPRRGAGAEVLTSQMMGGRAEALPTSQMGWPGRGAPHFPDRAAGQRRFSHPRRWVAGQKRSSLPRRGGQAETLLTSQMVRLGRGTP

SEQ ID NO: 943953 - protein, 95 aa, Homo sapiens
ESYLPVVHICDGTFRNGGPFDEDAGPVRLGPRPCPRHPCRRHRDEDTVGAPNSYRMQARLLRACFSSSDCISFLLGQRVLNIICLTFCAIITWCL

SEQ ID NO: 943954 - protein, 214 aa, Homo sapiens
MRRAIASTVIFPLLEARYMTVHTMDRVSLLLQSVSDKKIIYRFLVLQMITDVRDYLVCLSGPFLLLLQIKCITESINTYSILTSSYLKSHTLLYTEFPETGYLITRGSTDSQFCMGGKASGNLQSWQKANGKQGTSYTVAEEEGGNGQTLLKHQILRELTHYHKDSLGKTVIIQSPPIRSLPLHVGITIQDEMRVGTQSQAILLRFSVTHNGCS

SEQ ID NO: 943955 - protein, 42 aa, Homo sapiens
MVAFRCTRLAYAFVSQVVLQARLASLLQFAFRSLIGLFSSIS

SEQ ID NO: 943956 - protein, 98 aa, Homo sapiens
ERKRAKGRNRVEESEDEDGQAEEDAEENKTKKDTDKEEIGGLREREIVEESHRNSESEGDKRRAKRRGREGKGEENKGMGPEEGARKRWQKKDDGNER

SEQ ID NO: 943957 - protein, 63 aa, Homo sapiens
MGRARLRSSPTAVLDIQVWVVTATFSTAGDINVVHAEGVTQVGMLAALRRLHSLLPYSFGFSS

SEQ ID NO: 943958 - protein, 140 aa, Homo sapiens
SLRDTYWHCNWVQSVVDPAIESGRKSSAHQRYQGIRLIQLGVHCDLMLIISTVCTKCRSSISSISERISSAQSWMPPDATDRDTQSTRVGPHSALFHQGRQALSDGHLSALCALAGLGLVHQQELMQVIGIAEEPLTQHA

SEQ ID NO: 943959 - protein, 174 aa, Homo sapiens
FSVSSISLRQGPYSVSRLDSEEKFWVSVLLRLVVNFVALAVFSMPFLDDDFFEWRAPPSGPHTARVPGHAPPLSPTAAAPVFLRLTSISWSWRRWQQVGAQAADGTSVDAEPAAVQQRLQRSRLVGRRLAAKAGATALGVDAARLALLSAHVRPKHPYKIRHNRTPPPTLPHHP

SEQ ID NO: 943960 - protein, 41 aa, Homo sapiens
MILRASERGSSLMPEMLSNGSPSVKSRASVSTAAFIVKVRV

SEQ ID NO: 943961 - protein, 157 aa, Homo sapiens
SCLELHLVLPGNLLCEERVVTTVLLRPLTKPANDLPVPPPAPNSPSTSFSTTPPTCRSACTLLSLVTDPAPRAATLSFRLALDLLVVLQGGHAWQKLLAAVQAQGLCQEFQADGAGHLLLYINQDSRSHSSYSTATPVVYAVPAAPTSHPPPHAPHP

SEQ ID NO: 943962 - protein, 79 aa, Homo sapiens
NPKRVTLGGYESTYRTRRNTYRHSKTGRTPFHQVKDNQAEQPKDHYSHSEPKNAGFDASEGYKNTRMKSDIIEHTISRT

SEQ ID NO: 943963 - protein, 209 aa, Homo sapiens
PARKKKWVEPAPKNRGEHIAFGPLAINPGPVYYSVSGAFLVRTFATPGSQCIGLQGHSIKDPEFPGLWYRSKVDSSKVEIGIMFTHATCQIADARNICRSSGAGMSCSLHVGLYQGALQVYMMVIQGIVDSRQHFLSNILAVFQVMVSIRNSLWFNNRYQSILLTDAGVARQGVGVLLHSEAGWTVVGNRQHSTPLPKVNAIFREVSGT

SEQ ID NO: 943964 - protein, 110 aa, Homo sapiens
MTDEEAHDVQLQCTIVKSVYMLHNVMQSASGSIIAATQRSTVTSNSVSDQSAVQQSQRHLGNHPYQLSDDRLSLQRLWLTSSLSPVHINKLYTIRARMLVPHHDPYSMVA

SEQ ID NO: 943965 - protein, 117 aa, Homo sapiens
AYCFVNESGMQRHHVGLVEPVPTGTERFFCLSLPSRWDYELMPPWPVHSLRVEKRQQMRVLTTIALHYRPHDTSDLFYLGYDNTGVSQTTQPILMFRMLTLYVKRTFGNVYLRQWLH

SEQ ID NO: 943966 - protein, 117 aa, Homo sapiens
QPIDITVDYNCWLASEFFKVEPALFSCLIYVLTIFVSDIMDMHRVYARLLPLCSKLAAFSVRLAIFRDYELDISCVDRTLESCVNIDASCARIYSNIILDFTVAASIISGSDDSSAL

SEQ ID NO: 943967 - protein, 196 aa, Homo sapiens
RRASTRHTQRSDEDRRGEKTLGPVSDAPHTYVDTIPQESTQIRNWKIRMRNPARVIGEYTTPGTGDISKDETIACHFIGDQRQCICNRGAHNNTGTTTTEVQAIFKEKKNERQHNASVRAPHKEKSTDGHTTRGRRITQCDREDEKRRPQLGDIKHEKDDTRSAHNPGERSPEESGEHAEHICAAALYEKNAARST

SEQ ID NO: 943968 - protein, 146 aa, Homo sapiens
VAHLFAQWAQLLFKLVQLLARDLVELCGHWLDIRLVQLKSAWQVLGKCTVWQHSVLDLCHINAHLQPQDFCLSFRVNIMLPGHRYKLFAQLSEGTGSCVSVVKKLKGQSELTKCGQSEVVRIVHDSVFEHIQVHNGQVIDQISVAL

SEQ ID NO: 943969 - protein, 138 aa, Homo sapiens
MLDSLVIDPKPQHVPSMLASYSASIPGCKLLLLNQLSSLVCTRSMNGIYSANSLVDYGTLYVQLYAGNVDVMQVITSVTVEDDLNNTLTVNDQTVLGTVLIMGVGVWIIHNSISPYCIVWRFRTDISQHQDDRRACAV

SEQ ID NO: 943970 - protein, 187 aa, Homo sapiens
MDTLTKASLLSSDTHLTSLNAISVHHLDSVSIRAFLLHSHQSSCNHPMLQVYVIDYIPNHTVGVNSHTVSALNLAAHVELSGSIDMSELCVLRSFPATTICSLTAAEHDTSISSLYRSICPVSLAASAAIGRVDPETGISPMTTSICSVYTDRYVMAAFMQPHLHLYIHVSSVYQALSEPRSASKTL

SEQ ID NO: 943971 - protein, 74 aa, Homo sapiens
DRKCQSCSQLMQYQSACIIAQFHEYWPMHLCKPSIRETHYRLQHMTQMRSVEHRQCLFRAQRRHLETLNTVISR

SEQ ID NO: 943972 - protein, 141 aa, Homo sapiens
MFVVRQWEAGKIGLRKWQHLTFFLEEGVGTQIQFVCNGKDRVLYLGLAFLSAQVVGRCHGNSYLGYGVVRHKVHSPGNHGSWDGVHGDGVHGGGVHEDGVHGGWCPWGCCPMGIMFMRMVCMGMVSVRMLFMGMMLMGMEV

SEQ ID NO: 943973 - protein, 117 aa, Homo sapiens
GRCGVKVHTQSLHRRLLSAAVIRGSSTSRPQNCKGIDSLHCTPGKAADTQCQVTKAARREAVHHCDPNVRHAVKGDNFGALRLDFLAGFWNCMGPLVKLLWRTVWRFFKKIKSKANI

SEQ ID NO: 943974 - protein, 116 aa, Homo sapiens
MHHHAQLICEFLVETWYHLAGQAGLRTPDLVIHLAWPSKVLGLQAGCTTPGRLLKQRNRPAEYADESINWNLHSNRLTIALNITGHLSGQIRPSRSIHADRLAMAYSTSWILLLLA

SEQ ID NO: 943975 - protein, 66 aa, Homo sapiens
AAEGTVNALFVGDSFSHCIATIIFDRYQNAYQQARWTITALLLLHESVVSVIGGKGPPTVEAQGIP

SEQ ID NO: 943976 - protein, 97 aa, Homo sapiens
MRVHRITRLVATSVPVSVCTLMYSRYSLRGSSSRLLTGSLSSSCTPFRSRFSFTSCRTEGRSSLSAISAAISTAAEPPPTTTMNRERWTSPPSSSLV

SEQ ID NO: 943977 - protein, 144 aa, Homo sapiens
GTSIAMYSRTVNVRCLTSPGYRDSSDSDVGVEDEASVVRVHVRSEPVLLIPLDDTEGRFPSYDMSSTRRDLRSIRSSIMAVRIVHRKSITLASVMQGTVPFAVSADKECSEAEIAPQLSLKEGVIRTVGKLLEYIGASVLETHV

SEQ ID NO: 943978 - protein, 120 aa, Homo sapiens
RRGKDKKREQDREVDHKDRKRGGSGKEEQRERKRMRREHKEKVRKKRNRENWKKRYAKKRRRERRSVRRVEEEKERNNKCRKEWKKEGRRKKRRKTEREKKRREIRKEKEDERKKRITVD

SEQ ID NO: 943979 - protein, 116 aa, Homo sapiens
MRSPQNTVSQVCSMGQDVGQEGDEPMYLMAWPNHPVNVHHAASICSKEYFISISSPCFRGEVVVSVSAYSVSEAVAVTPSIVYECSTVCFSMSIYTNSQSLRSQGQWCYRSSGCYF

SEQ ID NO: 943980 - protein, 30 aa, Homo sapiens
MCYDCPIATLLHKTICMNGRAVNGQPDCTM

SEQ ID NO: 943981 - protein, 105 aa, Homo sapiens
MSRYGSKSTGNVTNCIKCHSLSSLNAKIWIVMLELKSGHYISGHENLSVSARHALVIHSKGKGFYTLCYVIKHDQVPIVMQRKALEQGAVNRYRSFHDDKFMTLD

SEQ ID NO: 943982 - protein, 91 aa, Homo sapiens
MMVIQALVDSSQHLLSNILTVFQVMVSIRNYLWFNNRYVNSEAEWTLVGNPQHSTPLPKVNTIFLVLSTALCEAIKPLNGGFCVCSCKRST

SEQ ID NO: 943983 - protein, 71 aa, Homo sapiens
SLLTHSCKGASSSQPFSADLPVTSSCALIQSSVSSHVTSRPRSQGIGRSDEHMVCSQPRYSVYAEYTPLSL

SEQ ID NO: 943984 - protein, 131 aa, Homo sapiens
MGVQAIEKYTHSNWEKLAKTTGLQASCKSKIQQGSQILKPKMISLDFMSHIQVMLMQEMGTHGLGQPRLCGFARYSPTFHCFHRMVLTVCSFSRCIVQAVGGSTILGSGGWWPSSHCSTRQCPSGDSVWEF

SEQ ID NO: 943985 - protein, 112 aa, Homo sapiens
MLSSVMYGAAKNVSIAISYTFVSIRVLRCSRACCTSDRLNSAEAAASSMSSVRCYCLSPWMQAADVNSSHVWFLVRLDQIESKAINGMIQAHAGKLGVASGSSGYTAPTVSS

SEQ ID NO: 943986 - protein, 68 aa, Homo sapiens
PVCLVKGTKEFLKAFRYLSLGILGEVEIRALRNFIVVSALVHSKSIAKPEAMLTGEKTILVLLDWCAS

SEQ ID NO: 943987 - protein, 124 aa, Homo sapiens
MAAEQLIATPFFTTRRRSGQRLWINPRLTIKNLMHYTELHTCKFTFCLLEHIPNTYTLSLNIHICVRHRVWDRKAKTWGRTMRAHIKTSLQKRAAGITDVLYVHAFANGESQETHCRDLAIYPT

SEQ ID NO: 943988 - protein, 71 aa, Homo sapiens
NKWTRLALVHSSVLSFRSDELCRGHCLASCIARLVMDGTVGIKDICVGAINSVFVLYVALYVNKWGVMCPR

SEQ ID NO: 943989 - protein, 104 aa, Homo sapiens
MVFNSMDDIVSVEYVDYRVYKRRTRRRTSNASMVGIHLLLETLQLKDQIVAICTKCLNDASSLDEESQLTNDVDYHTDVDRRPLMYRLATLVRPVSTSLGFKMR

SEQ ID NO: 943990 - protein, 78 aa, Homo sapiens
AGTVRYYASNSHDDVKRRPVDSNKTRYRTNWVPGHASSLLAIDQLAFLLQLESYFILKRIQARVGSRMQQLLGRGSSV

SEQ ID NO: 943991 - protein, 31 aa, Homo sapiens
MNLFHVQAQQQPQTYAISVVDDERLTLTLDK

SEQ ID NO: 943992 - protein, 99 aa, Homo sapiens
MKHGLGDRGMHNDCHRMWQAVLRYWCHTIQRSAPSVQQDSDKKTTSLQVGYMFKRLWVNVTPGSHESFKIPGLCVKHVQIPQQAVVPGHCSFLHQRVMQ

SEQ ID NO: 943993 - protein, 144 aa, Homo sapiens
CSKRVLQVHMSIMKSFSINRRQAHYSISVPFDVFCCTSHRNISCHSQRSLQIWSHKSVIHDRNNVSMLMDNMCTACNVIYMWVEFVRVSIHTRLVQGVRAAASNLILDRSPIEILNANPDATGLKYLCAASMHVIQTNNSVSCL

SEQ ID NO: 943994 - protein, 86 aa, Homo sapiens
DRFGPIRYYASLSPFVEIDGQSYDIQLTIGQIGCRDPPRVVLSSSKIMSPCNWTCIVYGKEFRLELGGVCKSSVQAEAQSEREGSG

SEQ ID NO: 943995 - protein, 150 aa, Homo sapiens
KNTTVFIMPLAHPNWTLETWPHIGLSGEIHELSPIRTMPKESASKSIINLAIGTFCLQSPPELSAQVSIDRNGYEHICTDIMYLCYTARYHPLGLRSSCDVSLLVVLNGQRVCRCAWHEDTVLILHLRHVPCRCTMPVKQLMPLLKRRDH

SEQ ID NO: 943996 - protein, 142 aa, Homo sapiens
QITLFLNLTSYYSMCFAISGIKRAWLRALDSCESLGRSHIGCTQLSVNCSRIMTTTYSHGSMWDTETIISGTSLKMGNLSIGVLCPCSLDSYSTDVYLGATSIRSPCFRAYTFSPFKLLRIEILSPISSCLSIIRGVVYSAN

SEQ ID NO: 943997 - protein, 130 aa, Homo sapiens
EAPLSPTLYLGIQMMSPYAKQTLRSQARCLVHKLFVFGNLFSTWLNNFIVDPYSWVLSLNFGQKFKINFACTSAYAYIVMSDFVSPIRPIMPDNLLSMHSCMRCCSVAWFTNLGKDSSSLTWSQTELLME

SEQ ID NO: 943998 - protein, 128 aa, Homo sapiens
MVQRSLCLPEKALHSSRGYSSRGNWQAALSSSLATFGYCSYMLCSIEQTFRSMTDRMSSGNVISVHSQECLLIVMQTSAHRNNWRSIHEYQILAASSVLQEAFISLRMMICAAVIRFTKGFENRCADA

SEQ ID NO: 943999 - protein, 139 aa, Homo sapiens
QICMYVGVESGIMVYCRRSMGPSGMSRGIQPLIGQLTLVHVVRRHHLDSLCSYDSSPVSHAFIVRSGFVVNVTHQRASRACSPSSHLKIIVQIRFTDVESPYFMNAWRILWSSPVISLWALTTCQAAYVPPVSRSVVRL

SEQ ID NO: 944000 - protein, 144 aa, Homo sapiens
MSQCTVNSLTSRDRSAADTGGTGAVKVAQRTARGVDRYGYGVVEHGWWCEVPRSISDMQGFQSLSASRDAVLGTLLQHMAHEAEVAIDDGSTGLRSRTGLVQHDSISPHQVSMTSGGWSRNYVTDSEPATISQHSRWSISSQCA

SEQ ID NO: 944001 - protein, 58 aa, Homo sapiens
MFLELTGFNLSFPVGGTIPNADTSSQPPSQLPRLHAMTVHCGFRGFLQAHDFRQRPGQ

SEQ ID NO: 944002 - protein, 62 aa, Homo sapiens
MLHTGYSTLMLLKEGGEDQHLLVRHVIEPRLTGTRFSRRTMYEAVRIDNTDHSAQVHGYATQ

SEQ ID NO: 944003 - protein, 69 aa, Homo sapiens
FHSEALAQQCKAYSDIRYRSSPRSNEVTVFVVTARVIRRLVQAFEDSVGPDDNLIRNSMPLLVCQCLRI

SEQ ID NO: 944004 - protein, 130 aa, Homo sapiens
SLTNVSSSRMDSGMHSAVSLLIMLVIAVRVRHANGCKVALIYLYSTRCSFNSQSVLHHSPRISRNTVAICSNFFAEQSDAVIWRHADLNCGLKSLGQVQRQRVSGTSMRSRRLQRTHALPDSEVFSIVGP

SEQ ID NO: 944005 - protein, 133 aa, Homo sapiens
SLSAGSGPGIEGRAHQAFNGVAAVSGVVGCEFHLCMFIDERRPSAFQYDLVFTSTDVHPVTTVYLARRVSSAAFGTRIARATCYGSSCLDTASRTCDHQISSGFPGGSRTTPQTPIHVPLAIGRAVDENRSCQ

SEQ ID NO: 944006 - protein, 44 aa, Homo sapiens
MYLNSVVRAAIFQPDPRPQISRVFWEGRPTRQGHVTSSKRGAGS

SEQ ID NO: 944007 - protein, 155 aa, Homo sapiens
RYDHSCAEATVRRIMTADCRLILLRIKRYSSVRIRRNYNHEENATMTVITNNSSAKRGSSDTAQPEVELQISDNLSIMACQSIATTDMDYLHMSTRGHKQNQSYSRPLAAGTQSAINNIHEKAHTSESGKPVLESWLHWSPSVEAAEMLHIPVTP

SEQ ID NO: 944008 - protein, 104 aa, Homo sapiens
TVTITVPGVSLIGIVKPIYSSVNCYLKLISVYIMRIKYLTVVMLSRLGTYMIPRLSQIERTCSGIGSELGRRISVFSVVAIVASQPEGHSVGDSDNGNSRECYA

SEQ ID NO: 944009 - protein, 71 aa, Homo sapiens
YSQCRYSISCSFGHHTHFHGIITALYSSIISIGCETFHHVRASSRFSQFGNPRFLLNDDLRVTAYLSTVRS

SEQ ID NO: 944010 - protein, 131 aa, Homo sapiens
MRHSMSCVMCKTLVSDVVFKARVMSGSKVTYQLLHQADSEKSSAINDVMSVQRVSTHNVEPYMRSEMVKGVSQYCDACQKGKIESLDYGELTQQHLLMRVIVMCLGVALSRGFSGLMPVAGQCPPSRVGRG

SEQ ID NO: 944011 - protein, 116 aa, Homo sapiens
ANYNLLAACTHEVTLAPDIGTLPHELEAYTVYESEVMSPIVNRWRGHTWSSRIFARRWFRPVSIDTHHVFIPKHFIRAHTLMTYSLSRWIFTHVSRLYSSIVCVCVFTQQVSVDVH

SEQ ID NO: 944012 - protein, 184 aa, Homo sapiens
STLYKSSQSSCTGTKSSDDLPLRASVKLQESISELSKTISMWSTGVRHLAGAGISNVSPVVLLMNDECITQYGVITLHPGQQEETRGSHAEVWLILASYHREGGIFCTESHMLCVCLGYYTDLSEQKLGIARHIQCGVCAIPYVCARSESQLSNVCPANFIFKDAGEYFPCVILHAGLIFFLVI

SEQ ID NO: 944013 - protein, 122 aa, Homo sapiens
MESPCVNNSTNEYMPASLIVKCNMAMRHILDSGIVYVSITVLQTATNRWRQSSMHHLVEPFERAESCQHYGFRPVVSQSKGGYSFMPFNTVLNLCKVSCTRWCQSNTGAHAVRHPRYLHMPT

SEQ ID NO: 944014 - protein, 70 aa, Homo sapiens
MRKNEGRDIHYCDGNMGKPSFMPYARIIAKLMANSRFMILENGSLVIIDMTDDETPEVSHSTQYILTSSE

SEQ ID NO: 944015 - protein, 106 aa, Homo sapiens
METFVGFSMQAGLHPVIHMLKIPLSAGSITLNHKGAPEASCPESLILLDRALLSCPVGYPGNGLKVLGSRGPLFWSHMVPWREVLFFNHWSPEMCMQTTCSLQDPN

SEQ ID NO: 944016 - protein, 100 aa, Homo sapiens
GASVRLSDDLYIPSQVMCSRAGDETQSIHSRPIDVTVERELLVSFQRYETEKLALLSSTIGDDTTIYLSDISLRVSVRLRAECIKLGLLTSPALTNIRSI

SEQ ID NO: 944017 - protein, 134 aa, Homo sapiens
RILEKLVDKLSSTSISYGDFNKGSFALKVNRSFASTLSNMKTIIPPRTDKVLKRVKTNINVFLNVNSRFGSPQIGKLIPYDREDVQGKALNKDGIHGEPPAYPGGPQDAHILTGPTGKPKSMATPEVTALRRAS

SEQ ID NO: 944018 - protein, 33 aa, Homo sapiens
MRSAGRKGISHGRCDACDVVSRGVSEKRTAQLE

SEQ ID NO: 944019 - protein, 51 aa, Homo sapiens
MIISSGHRRLSLVIRGLFIRSPGLLSSFLTLSGRHAGWSSKNSMQPADQES

SEQ ID NO: 944020 - protein, 125 aa, Homo sapiens
LSLLSPRLECYGAISAHCNLHLPGSSNSPASVSRVAGIIGTCHHTWLIFVFLVETGFHHIGQAGLELLSSGDPPASASQNPGITGVSHRDWPVSLIFIQSSDLPASLSPIGLTIERTYLCPGIMM

SEQ ID NO: 944021 - protein, 110 aa, Homo sapiens
PHEQPLSVLMSIIVEQQRRTGHSPVRSKLTDCCTSPLHDSQQCSPSVRIRQQSTPPVHAPVPKGPGPEQPQRQGSALVRRAGPGAGAALSGWATYHARAVHSPLPQCQRR

SEQ ID NO: 944022 - protein, 76 aa, Homo sapiens
MRIKCRWSTNLLLKLMESSGPYTMEHDSLMGHRNSVVSHVEHAAVNGGLASERQYGRHGHIRQIGVDLDMANVAHE

SEQ ID NO: 944023 - protein, 88 aa, Homo sapiens
MKQGCERSLLARPRDTDEMSMETQPLYVQLWAQVRPQRNCIAKVKAFRRRRDWVYHGHKIGCAIGMVPVSMLFMAIMRMGMQVSEIII

SEQ ID NO: 944024 - protein, 82 aa, Homo sapiens
MLLSEVQAKDKWGRKGRYHWPWMERQASSKTLAGQGLLRLPWEQTRSPDSHLAKAESPHDVSEACPTPEGKLRLFNMRPEDQ

SEQ ID NO: 944025 - protein, 103 aa, Homo sapiens
SGGHTVHSPELSTYVCALEHEASSYNELSRVASYVQVEGQVGDAALTLILLSIQVEHLEPIIDGRNPAWPNHPAKVIRELLCQDMNGTHVTDRIPMQLCIHPS

SEQ ID NO: 944026 - protein, 76 aa, Homo sapiens
VQEVANHLHHMQQSIVAVLIMPLGHGDIVICVKGTLCHSRISLPDEQLGKGRLCISYSCCQDINGCRTKPCRNHVR

SEQ ID NO: 944027 - protein, 105 aa, Homo sapiens
MPGTVVYLHIKSARQYTPNVYKGQHSPKVTRLADHTLLSIGLLYVQFPRTLCESLTTMFLRLSTATSNYISHEVKGVAPTFGSSGIQMYIQRYELIGKRGNKWTQ

SEQ ID NO: 944028 - protein, 170 aa, Homo sapiens
VCRVFRVSERLLSFMIVVSRMVKSLFHSDLTCVHFARENLDRFYHWRFVFSFFITKIIIIIMVIIIFFIIIVIIFNQQRVLLLFCGTLHTPTGTDRSPDKLKSFTSSSSSSSDCASSSTANKCCPKICSGRDPHFNYKTTGGVISEPTRESVVCTHIFRVASVTLIAPPS

SEQ ID NO: 944029 - protein, 112 aa, Homo sapiens
MTVSQMYYYPDKNVDSALGWSFICPESLISLATRNGVVMAAIYGTTTPLLSQEAPSDCPDSSLVEEVEHQALVSTSSRHLFLLVDMGSDHNEQTWSRAQGLLVTNVRRPPEV

SEQ ID NO: 944030 - protein, 92 aa, Homo sapiens
YTLVSKAGECSLDLGPQYPTAKGHKRVSFLSLTCCWGYSHAPPSWITLHCEERGGFFLMKKLIVTSCPNVTSPTLPPKVLELTDESNRALAE

SEQ ID NO: 944031 - protein, 96 aa, Homo sapiens
ILSSSNEYEAADMALFERDEAITKASEVAQDYPSRSDEFYLCTVIMSLHVSSLAITNSQVLLGRIMLTRSRTSISPQATIVNGIGRRLCEWKGSAL

SEQ ID NO: 944032 - protein, 73 aa, Homo sapiens
ASLFSLSCVVAQVEAYYKCNNVVWIEATAISSIVSRIRIVKMISVEERLMVDSARVALPIRCMSEVAYSNVSG

SEQ ID NO: 944033 - protein, 74 aa, Homo sapiens
LRLLLAPLAFFNALACSVTMVSDHLRTKKGPRRTPNLTTDSLTRACIHINGMGKKERLLLQLIQDDPPCPDDMT

SEQ ID NO: 944034 - protein, 96 aa, Homo sapiens
MLFYDGQVTVIQLVKSLVITIVKECNSRYKMHNAAYVFGQSYVVMLAIPISPYNPPTVRLRYGTVNSKYHQLEGPQSRMMFNDSGYCLGQIIGYGW

SEQ ID NO: 944035 - protein, 112 aa, Homo sapiens
RLSNECIAISISSVLQLYAQVSVIYMQTVCTGISRAVGVHQQTVVHWCLALDIDVICSRLCDACIRRFGPGSLFLPIVGVQTASASRRVLDNADVVAVSYYGRVSFVLALLW

SEQ ID NO: 944036 - protein, 34 aa, Homo sapiens
MLEASRIASPVKGTQSVSQAMWHMQYTRGVPQGQ

SEQ ID NO: 944037 - protein, 62 aa, Homo sapiens
EYSVLQVIAALARRSPSEDAFDTRVQSMSRFALVILAGHQVSLAVVVIMTVYIGPIHHDSEI

SEQ ID NO: 944038 - protein, 46 aa, Homo sapiens
MGVLSLIVVYPKKDVHSAQGVRQAVVTSPCRIMWAYHSIAGSLVQF

SEQ ID NO: 944039 - protein, 57 aa, Homo sapiens
MRDLPIQYTGNAADTPFAVTLTEVTMVPNSTAGPDRGTWITGFSPQISSRRRNTRRP

SEQ ID NO: 944040 - protein, 145 aa, Homo sapiens
GPWLLPGGKGQYVPPVFLGVLSTSRFFQACNTYKGPMPATLAPGLFSRRAKRKHFFPHSWKLTQIKFERLEIQPMLNLKSKGEKINPLLKHKNESQGPVQFSPSSFLATLSAPHVPESPPKKIIGFKTIWAPHPKNNCCLKPPIT

SEQ ID NO: 944041 - protein, 105 aa, Homo sapiens
MVPGMLVGRKPDTTLASRPRQQTKLDAVTLDARYTHDAYLATNNLKPVVVEIYGPKDDTQTHYYAADAMNKDTGLHMNHLLGTKYMHTGLGTVHWVEHAHTLTLL

SEQ ID NO: 944042 - protein, 51 aa, Homo sapiens
MTQVDTGRALWERVRESLNHTAGYGGAIAALTDDDGTAQHPVITGAYALNS

SEQ ID NO: 944043 - protein, 77 aa, Homo sapiens
MRCRLPEAFHSMSSGQKTVFIKSDPPGHGLSNKSSLWQCLRQASNATVSDCLSSEGSQKVLTVWSTVHKYRAERVNH

SEQ ID NO: 944044 - protein, 125 aa, Homo sapiens
LELAFQHSGKTGPRAVQAGHSNSTSGDQVRLSLRPFAKPWPPASLVCLASPTRRPSIPKGFLRSTAQAKEPPFLCPNSPAKPQQAERLSCVPSKDRKIASISEHTLYSRFLHESPIPPMLMAASI

SEQ ID NO: 944045 - protein, 104 aa, Homo sapiens
CLIGSHVQRKARSDSVHTDAHAMQDQNNMVMCGSLVLCLKSIMQIPVTYRCVCEQVQICLGSYFKVHVRTAQKPYQIGAALRCDMCVWSASMVFTSPIRLSLIS

SEQ ID NO: 944046 - protein, 130 aa, Homo sapiens
MRPAMHATTSHGTQSQSRIISWVLSGISRGSAPEELLEDVLTAVPMHHGIVFILICQGVAVSLFLTGLVLELVLTVLFPHEEVYPLLSICSYGQGGDKVVYIVVLDAMGAVKDIYIVIMVQGTILYSARC

SEQ ID NO: 944047 - protein, 77 aa, Homo sapiens
RSWPSLISVAYKSLYNGSSGCYTQSLALSHRLERSRVIATHCNLHLAGSTNSTASASRVAGITGTRRHTQLIVVVLV

SEQ ID NO: 944048 - protein, 103 aa, Homo sapiens
HITSSSVIDPVLSLHVHGHPSCDVQTDIYAYVAAFTSSTVLPVSIQLNVASYSHGNPLLWIVAFMYSLHVSKVDMEADAVVEQVSTLLALKARQSISSNVRIP

SEQ ID NO: 944049 - protein, 152 aa, Homo sapiens
DKDWIINATWHIKDEVQVSYKTWAIAIMDMIKAHNRPELCEDNLRSRATQSQANYQTLPDLALGFPTTGIKRVCGDEGLINPRQQRLCGACKIQFVHNAIALLLGHIMTHEEGIFTRSSFYMRVWKSNMHLQLEAAVPGQLDQEYDTGLSTH

SEQ ID NO: 944050 - protein, 132 aa, Homo sapiens
MSGQEAHSVGLHTSLLHQGQQALTYVTESALGALTGPVLVQGQELLQIIGIAKKQHSQLAQVRVEEHLQLQSAMSKHGLHLAQVLLQETAHVLHVRAHQGLLHLQHLVQPCSRILLQQGQLFLQLRFVGPLL

SEQ ID NO: 944051 - protein, 114 aa, Homo sapiens
NSRAIEITDTGIMCREAANSDSRKAMADGIKGIHSGKPRRFRNSRAHFVIFQRAGHFCAIELHPTHAEDRQYRNRQHDDPHPAKPLQHLAIKEDGVRERIQPHQRSGSRSGQAR

SEQ ID NO: 944052 - protein, 85 aa, Homo sapiens
SAHVGLHAINGFAFPHMNEVSSPQSYCRSEPYGQAGCVNLLVQGQCKVHPLHVNHTYTDGDDSDIQALGMQPQSCFRIASLRYSI

SEQ ID NO: 944053 - protein, 229 aa, Homo sapiens
AEKSSTPVAIIASILTINTNAIGGEKSPNGFEDTFRQCAIPQLNAIDGVRMHQSFQLTVPLLKQQQERITFRPPPVDPAQPPIKAEHKSSTGKKSGQRAMLSVVNPAVVAIDTTWKNAWLIVISAETVDIMKPQYEGTNNHQRLYADKHAEIPDRANKPSDYAHLTVKSADLVTAGDQQEDSNDSGNKSAIEITDTCIMCREARNNDSRKALAVGHQSIHFGKNTTAGH

SEQ ID NO: 944054 - protein, 128 aa, Homo sapiens
LRSAARVNHLVVMILDFGMILCDVAVSNSGSSKIDALCMFKQQKSKKCQGNFVSVYHMHSVKYEGQKKPHAAVKAGKKAQLVLRRQNVSSKAPMLSTSSCALLAGGSLCFQYSLCLYQQSHVHSHPPR

SEQ ID NO: 944055 - protein, 103 aa, Homo sapiens
MQIGERDYTLHIIQASSAWEVNELSYILGNGGFHDYYEFLKKPALGEYCVTLVNDNCAVVSDADLRSRCCPTDRQFRMLNVPYTFFGQLKPFFLWDWDFSKDV

SEQ ID NO: 944056 - protein, 111 aa, Homo sapiens
HFQQDEGSAVSQYSIGVSIRCNRASPVSVDGTQRPVTLLSRLIHSPGCCKSSSYVPRLDMIVKCTALQTLSKGVHPLGLRYIVYPILYPTGQQHSSVPLRYSLPCNKPRYR

SEQ ID NO: 944057 - protein, 132 aa, Homo sapiens
SQQKDQRTLLINTPYICHLMQLTSTLVTFSDIECCMYLSVESQTPTWMYASSTRFSSLSPVANAGQLPGQQGPLGRTRLSVHKLHHPSSASVEGAHAWSKARQASRALLASANGESGNSASPVRDSFRCTSG

SEQ ID NO: 944058 - protein, 147 aa, Homo sapiens
MRCYQPKARRLASTRGFTLLGEAGALIVSLAALVYKSCKIIHNSTQLILCCPGLEIDELNKSNRLLDKAILMRKCAYICVERECIIVKLSVNRWCMDFHSCKAWSHCSPTIYGPDLVTLSITGGWYAGHKLGYDHRKNSLCTGNLLC

SEQ ID NO: 944059 - protein, 84 aa, Homo sapiens
MVLIGLSNRAHLASAGLILYQPFPHGVRLILRQSGCRFQWQRRYRQYPPGGCQCSRSVRALDCMWRYSESDSRVLGLSYELTLT

SEQ ID NO: 944060 - protein, 44 aa, Homo sapiens
MLGTAEMSSDQYVNAGLRMAQGGMRRDLRLVSVPEFVSKFAAVH

SEQ ID NO: 944061 - protein, 80 aa, Homo sapiens
MRYKTDIHGCHTVRSDVMFVYMQLIMFVGIIESCSTHPRSSHSCDKWLTILVRQCSPASVCSRRRLTFTPWFIKTSPQAH

SEQ ID NO: 944062 - protein, 85 aa, Homo sapiens
TRNIDKWQVACTAHAYTNLFRHAWFGQTIIAHDTPVNSGNIWGKIVSLGASLPLKCYRLRLELVFRTEDCGNWHTLAGSLEDCGP

SEQ ID NO: 944063 - protein, 114 aa, Homo sapiens
VFHVFKMMFQVLRYQDHQSQIVVELQLPRIGFQSLVNEIEVKGFHYGILGIKCCLPLGTQVDSIEQLKTGIGGQTVNIRLILLLVFLATQVLMSSKLASLVLLRTLGLLLYRIR

SEQ ID NO: 944064 - protein, 133 aa, Homo sapiens
SSGVDQEVKSRLHSIEYDTPTTYLPVRAMYGLSGKVSLVRPECVIDNPPRLAPLSFSTCSHWSVMHKPCSVSSQRVPLLRMHYASPYQILYCYCQMPQSPFLYTALTISYGCDATQARHQLYNRCSSPMLDHV

SEQ ID NO: 944065 - protein, 72 aa, Homo sapiens
LHQEAYFSTLVLAMRSSLPSRHSINEQALPHMIRSLKRYSDLSQSPVAASIRHEQLVQCTVSHIPYPPKMYD

SEQ ID NO: 944066 - protein, 137 aa, Homo sapiens
DLLMVGWTDRVNIAYQDELPYWADSTSFYIITQWLLLAHWKGKKFRMLGIISKEEATSFFGPKNRLLYLLRDFELVTARLEDNMVGGGGGSLPHMINENCLSTRADAKEKSNVTLFRRTGYLSKPTKGALGANSRFN

SEQ ID NO: 944067 - protein, 134 aa, Homo sapiens
MSQSEGTTIINLIIPSCGIQRISGQLETVIETAGLASSVVSQMHAQANLVLDKQQHFRFYCNHCSRVISPCQVDASYSSECSLCETINMSRETPSKAKSTFTVPSIVIVGYASDDKVRSEPSKIWVDPTMTIYQ

SEQ ID NO: 944068 - protein, 93 aa, Homo sapiens
SSVDHAARSSLISPEYDTPTIYISVRALACLSFPIEVVCADYVVDNAYSLRLLDPIILSHWHNLWISIPIIVLLQTEASRCVPFYSVSCSNRS

SEQ ID NO: 944069 - protein, 102 aa, Homo sapiens
MGTEISRYSWSAKVRLSSQSSQWGSIPQKGKLCVYKVTVHQKIVSSFCISRAHVNGRSYYSHYIIVTVCDYVITDGGSLCAAYSKVTLRALSGSVNEICPEC

SEQ ID NO: 944070 - protein, 156 aa, Homo sapiens
MNASNEYTEEYRTVLTEESVGCKYGMLPLPGIKPYRRTGKVPDGILRIKRDKRSAQLITNMAGVYTAVTVAQVQEDTCHILARTGDCRMSPLTNYAPITSYNDHYIDTAAIALSDVQVTDSTLEAYASRKTRPYTGGTLRINDDYWNKICNFVTPD

SEQ ID NO: 944071 - protein, 75 aa, Homo sapiens
IEPTRKPENEKKVPKSLSATLSLFSNSPADIILKFCENWAQESVNRLCLITMKLWGSIVFCPVKYTWYESHLQSE

SEQ ID NO: 944072 - protein, 83 aa, Homo sapiens
VRRELVSLQGSYLELSEQSLVRGRSVSSQVEDVSPGYRMRAERFSFSSPGAILRLHITCSYGQVGPEPHNVIPADVVPLAQNF

SEQ ID NO: 944073 - protein, 84 aa, Homo sapiens
MCTRVQSLTCLAEFDLSLNEQRLNHCGVHSNVHMILVHSAGLLSSPGAVELARPKVGRVHGQTENGPRQGARGRSSMQCLALRH

SEQ ID NO: 944074 - protein, 115 aa, Homo sapiens
MNVSSVTRVANEVVVSMALYDFFKVMEVAMYHVLYDQGKFGINVVSWTYVQKKDHFTRMCWTVYIHINQGSLLYVCPIEVVFAANVVENGSGLHQLRPIDLTHWHLLEHRISFIS

SEQ ID NO: 944075 - protein, 137 aa, Homo sapiens
GVTKAQRHEAQEPEMASSLDSCHSTDLQTSPRASDMPIAINMALNSTHVSRCARYSGFGAQTPVPIEAPPMTINFHSHIGRKASPVPPLYDAIQRRASSTETQQQTGIDEEFTRVNVLEEAPQVHGGDLHSCRIRHE

SEQ ID NO: 944076 - protein, 122 aa, Homo sapiens
MTSRQNGLVLVCHMRSVRCQVIDFQRYHIFRVHASYGQTCQSFECNVRDRYRPSPRVALQITDNLVIGFIPCKMHTMTTTVNVSYIFISLFIKVHSVNSMSLTHMLHLSHTTLFGTVLHYQK

SEQ ID NO: 944077 - protein, 44 aa, Homo sapiens
MIWTPVVTQVRILVTRAGVISRDKRLYMERGGHPLLCVDAVFGL

SEQ ID NO: 944078 - protein, 74 aa, Homo sapiens
NRASIHSSCSIPCTWYQDWVIITVICVLKTKVLGECFFIELKAQWLLFETEAQDWCYFHQMNQILLNPHKTDQD

SEQ ID NO: 944079 - protein, 119 aa, Homo sapiens
RNKSPIKVPLLTVRSESDGVQACKSMDLVDPCLDVGCLARVPKLWSDGSTELSVNLCMDIDLLFWWLHRQQVAIAQVDLDGTGGANHRGTTCVIYGSTKKNCGLGLVCLFVHGYEKVVK

SEQ ID NO: 944080 - protein, 150 aa, Homo sapiens
GTYVALSLATVFATCCTYFLFAFCHNWKPPEASPEAEQVLVPCLYSLENHEPVKPLFFINNPISARIAKHTGLLSRAIRAEDKRGSQAQMGDSPSSELGLLHPFCYLGRDASLALAPLQLMREPHALPRVESSLRVTRCRQMLQKTPEDN

SEQ ID NO: 944081 - protein, 31 aa, Homo sapiens
MTNGPVMTAIASGVHTTVVGPSKGIGGPMGV

SEQ ID NO: 944082 - protein, 75 aa, Homo sapiens
PLGPKFRKAGLKSTRQKCLQAFQPDIKSSTLEGGQPLGPKPGGGYGPLSEEFSKGDLVSTNHGVFPSTVKSPSSV

SEQ ID NO: 944083 - protein, 123 aa, Homo sapiens
YSNDQSMGSAPPYVSLLPFLKYGTFLQFQQQPFSNALWEIKALLACGKMPSPFHMCCAFTYMVTGGTQAFSALPTITSSKGVPFVCKKTQASPWAEAQWLCRQLHRSSERTRYLSGCSGKFAA

SEQ ID NO: 944084 - protein, 57 aa, Homo sapiens
QSRPKYAGSVTAIASHHFDRLKRSSERALWVTSVSADVSMADVDTLSLNRVFYFSLV

SEQ ID NO: 944085 - protein, 74 aa, Homo sapiens
FTGHMVTSMHSALGYNKNVEENYASIQREATQCLQTQFTPGLRRATRSEKVLDSPGFLNLWKYRPAWRMHQTEV

SEQ ID NO: 944086 - protein, 56 aa, Homo sapiens
MLAWLYSNAWGQRFSCLGLPSSGPKPAERGTPKSRWGGTPGEPRLGCLQWGGTMKE

SEQ ID NO: 944087 - protein, 137 aa, Homo sapiens
PCYNARVGSTGIGSFVTSTPAKLMPVSEIPAKGMASCSEDRWSSSRYTCSFSGPQLLPSRISRVIHQDTTSLDARSFAYGGVSLHNPFALTVNENASLSTTSFGNDTHSTICACGCEPAQTRGPHKKGLALVLMPVL

SEQ ID NO: 944088 - protein, 91 aa, Homo sapiens
MARFIKASWVASLFAALPPQTASACGLQGRSKENLSFQGFGRGQRLIALRLRVASSSLMPPDKKQMPGTAAGTVRWRAVTVAIATCSGVYL

SEQ ID NO: 944089 - protein, 86 aa, Homo sapiens
MYLYKDTTSHWLAGIGLVAQVARIFYLGVISHQLPTTGSFLFYGISSAFVTLGCKMGSGSCCTGTHSPRSAMVKMESSGIDRVMGS

SEQ ID NO: 944090 - protein, 78 aa, Homo sapiens
MSVSRQSILDINIDRMYHLSSQLCQNLVIYAMYSLDRKVSNPPRTWRTQWPNSSANNVCITVRVFRGFDTSPEGVRNE

SEQ ID NO: 944091 - protein, 142 aa, Homo sapiens
YLATCDSYSSKYWTLMKLSSHSGPLTFVSGNEYELIRYGIIGSLEGPKGASSSHPANDLGVPGLKVHQSCEQGLRGMGCIYLAVSSRLMMLITSASNRFLHGSPSQCVEDPIESFGVNSSLWKEPTVIILVLKVITSAGSYR

SEQ ID NO: 944092 - protein, 120 aa, Homo sapiens
MESYSSFHTFQSTNLFWCVQFVSQLQGASNTNYLQTLLCAKLLIPTVPMPFSVVTHWCFSVNLRTETRAGPVRSVRSAHTHSCQGLGAQGAAGNGTAHSVQNRARTLRTSRSHMFTGVRA

SEQ ID NO: 944093 - protein, 142 aa, Homo sapiens
LIFSWLLSVLKESAAATLVGYLQNTLVALAFLLGQFAKEVAHAFQSHIFACRNKSPEKGGVEGLQVQIAEPVHACFHVVWNNSDDIWEFMVGCARRSYPQKRCWQVPEAGDGREDGPERSQAERISERGQSLKESPRMCCVH

SEQ ID NO: 944094 - protein, 167 aa, Homo sapiens
QHADTSISKMSCMQHTVMLKNLVWYAGLTWSQQRGHGCAPQVWARRWLLCTCHRYSSSLYSRQLQHLLHLGMGVHIILDLRGLRVVLPFPPAELLLALAQLLAPGLSVCLSPSHVGREQLSAWGAQKGVAPVSSHVGKVDLLEVPAPLHGSSVSGHGSATLPAALHP

SEQ ID NO: 944095 - protein, 54 aa, Homo sapiens
MLPSDAALMLINFIMLDNTVLPVLLPVFTSTNMIQCDLQMGTPQSYGPKSPEPV

SEQ ID NO: 944096 - protein, 58 aa, Homo sapiens
MAAEFLGQENGILIIVGVAHIGLHAHKLQSVSSQTPFRQRVLVTLISACVAPSHSNSV

SEQ ID NO: 944097 - protein, 126 aa, Homo sapiens
MHFALNGLVQVDMTLLKRVQVRPPSEYGQVWRHQRIVWGCLSYQGQRQVPPNPECPSQAYAHIPPKILNYTQTAHCISITSDTSTLHLGGNTRQRSPITSFNTLQRCDHKESTSDSSQSISCRIPT

SEQ ID NO: 944098 - protein, 69 aa, Homo sapiens
GLVDVSIDYAWLSHLQFIPYPQESRAQPRPYTVGVDPWATPSGLTADAEAVDYSHAFSLSFYSVENVAW

SEQ ID NO: 944099 - protein, 71 aa, Homo sapiens
QLVDRLGVGTNLQIAFILIVLWPVGQPFPIGVDIASKVGPEKWGPKDGEELIPVVSITVLGFMYDEKLGRY

SEQ ID NO: 944100 - protein, 105 aa, Homo sapiens
GKEGRKKEGGEKGEEEEEKREGGGQKEEGRGREREGERKEREEGREREREEGKRERERKGKKGGKGERESRSHYDWLNSLSLYIYYYYYYYYYYYYIYIYIYNTC

SEQ ID NO: 944101 - protein, 90 aa, Homo sapiens
ALVEEHALPFDSIKCLQVDEDSSGALDYREIPGHHSQSDIQESLAVHVRATRGIPCCVIRMQGSASQLSCQQSSIKVHAGTSGSMHELSY

SEQ ID NO: 944102 - protein, 107 aa, Homo sapiens
MKRGPDVYTDSYSKFQNPSSNLNHFLKNKHRQTPNMELVPGAGHKGSTPRVAVLGGRWVWPGKWGQSAGPTRCLRSLGRVDRPGGLYQQCNKYANPSTERPSADPTG

SEQ ID NO: 944103 - protein, 59 aa, Homo sapiens
LCQASGYTPNVLYRSIVIVIGHSHCSSHCRIHLGSLLEHHTMVATTDDSRPHVLAHSTQ

SEQ ID NO: 944104 - protein, 116 aa, Homo sapiens
VVQPLLHVVQRKLAKMVAYWGIGTDTNTHILNQILQHFLGFNLSWGFSNKSSNLWRNEPQAAWLQKPMCQPMKTRHFQAEGMIKHLTQTNQDIVVPAFKSMWDGCTKRVTNWRTEA

SEQ ID NO: 944105 - protein, 115 aa, Homo sapiens
MVREEVASARVLVLVVQQRFLHRLVAVHHHHALRAHVQRALRHEALGLSCEGLANILQFRLEEVHDDGIAGECLWADSNCCAPASTWTSAGGRPPTPAGPGDSERTHGAAEALSC

SEQ ID NO: 944106 - protein, 32 aa, Homo sapiens
MSSAAQTSAPSSYCLCSSSLLLLKYVSRAEFL

SEQ ID NO: 944107 - protein, 73 aa, Homo sapiens
MTTPRTDGHMFPWIVDQVRVTLNSIISLSKGLTQYSSTVPSTATTESCSTAAQQARTDLSHAVLTRISARAEF

SEQ ID NO: 944108 - protein, 163 aa, Homo sapiens
HTYRALRSVPGHQDSLGECDIIISIHSYHTSTDDVYVTLRCTSGRLHDIASIATSDDLAMTELVCAEGHDYCRQIAEYEYTYPGSTDSIVLSGGSPRHRTSWICQRSGLYVVHVDSCTHLTISFCAQYVVVLTLVAYRVLHIAMCNLAGLRSAVICDIRDILA

SEQ ID NO: 944109 - protein, 80 aa, Homo sapiens
SRCDRCIMRIIVMTALWAVSLDSCRTVPISTGIMIACSAYLLVIIIQILDMSSYGNSPGSRCLRCPGGYGIFIPQLGVAE

SEQ ID NO: 944110 - protein, 142 aa, Homo sapiens
VGIIRVYDMKFVQADCVISGHKVIGSRSDHTDLARSVSYVACKYSAADDVQSSERKRHSLSCDLSVIGDSDQMPVCIIVGKFSGAIKAQHLIVLLTHILSPWFRDCTLSAVWHSMVYHKALFSLVKHTPYSACVAVVHLIDD

SEQ ID NO: 944111 - protein, 143 aa, Homo sapiens
QLYLAKGVNTVVKQKCLKNKNRLIQLQHAWAPGHPERKGSGYGLNRPQAVLERGQWLQCAHDWRWSPGLEKGEGPALCRAPWMYNTISSSQHGEHPGRIQKSPFTQKRKSHDQTWPHCKLYMSDHVQSGFVLCTQQTSSSYVD

SEQ ID NO: 944112 - protein, 36 aa, Homo sapiens
MAPDLQEYIQAKVGSLLSDRSGYSIVTPAAVSRPNR

SEQ ID NO: 944113 - protein, 71 aa, Homo sapiens
VASMCLICSSKITGLYCRFIMSIHDSCVLARSSYTVSQVPIINIMSSVMISNISRSCLRLALACMQSRSVS

SEQ ID NO: 944114 - protein, 207 aa, Homo sapiens
TNSCQTYSHGTGSSCSTLGLSVGDGFYWKTWYVLARRPSLLDRSVCMCSYVARSSSSPRSYTHGFPRRILEATLFTSSGFTFRMSVHSSCGSYLERVASICLSTSSKITGLDSRFIMSIDVSCVLARSSSSVSAVPPIKIHSYVMISTISRACLGSALACMQSRSVSSVAVVVEGRVIHPVVPVEHVEESLENMPLSGPPGEKDPPP

SEQ ID NO: 944115 - protein, 53 aa, Homo sapiens
MLMSKVSTEELPVGSGQNGLLKLVAGLAELLLRVACDAQLHPSTVRAPTPVEQ

SEQ ID NO: 944116 - protein, 51 aa, Homo sapiens
MASMIAVVGDPCIYKSVRQVSANGLDVAEALRGRHRIMDQDDTSRCCTTTD

SEQ ID NO: 944117 - protein, 120 aa, Homo sapiens
RRIHSSFSYHRQAFNVSCWCFYQSIKSFLKDRKSLRIWLHVNSDLTCFQLCFFTSFLLFYFFTFIQILIRFSLFLVCQCLPCCKNSKYRRLVWVSRRPELLQSVTQGVSDSNSGSSRRRR

SEQ ID NO: 944118 - protein, 100 aa, Homo sapiens
MVCRASRMSQVHLLGPVSSVRSGPVVFPADGLGSRQAQKALMLSGVESLVPVSRAEPKYCSRLVRVGPGPRTQAQRQHCLRGSESETRENRALCARSAPG

SEQ ID NO: 944119 - protein, 41 aa, Homo sapiens
MVHLSRACLYVLTRAPVSYSLAYISVNAVATILYKEALVHF

SEQ ID NO: 944120 - protein, 136 aa, Homo sapiens
MWVRAHPNGYVGLMTLKVSLYDTGIERYTKRPKHVSISLPVSSVCLQLSSPQPKQRAVRGQDLLLVQHHLREQHCGPYISDEAPYDDVGQGLCTLARTERLNMYSGCYNERIGLILRACHLIVVQCEVRVDAGELV

SEQ ID NO: 944121 - protein, 107 aa, Homo sapiens
EEREGERNGQIEPEDTERSEKKKVIYSTDEEKRKKGNNVEEEKACNRGQSGAARATGQRQLENKMSKREISVAQSLCLYLSISLYLSLSLSLSLYLSIYTIACRSPA

SEQ ID NO: 944122 - protein, 129 aa, Homo sapiens
SSAFISYIIHHIPRTNDIKPMIISIDADRAFDIHHHFMLTTLNNLGIDGTYLKIIRAVYDKPTVNITLNGQKLEPFPLTSRRQGCPLSPLLFNTVVEVLDRAIRQEKDIEGIQIGKEGVIVSSCRIPAA

SEQ ID NO: 944123 - protein, 119 aa, Homo sapiens
GIQLPHVLYNSSTLSLIGLSCCSTASCNSHPVGHNTYRSVVSVKTAYSIRGYSFYSLLSGSCFGWTSAIATSIDGRWGRPQAGSLFSLLVKGSMTTGTEETLLIVVDTLEVCESYEKSR

SEQ ID NO: 944124 - protein, 95 aa, Homo sapiens
GEVGSAGANGPHTHLSAEACSAQLSSSEEHLRTSFYKNLDTALLTSVSSCTEKDCSLKGEDEDDIRESFLGASATTTAASHSQGCSCDGEVGYIN

SEQ ID NO: 944125 - protein, 141 aa, Homo sapiens
VLLVLDMQVAEIGSFKKFVPNQRVRSSMPSQGQAGGLSSAGVSGVPRGPSSAVCAYSSPSYGTCGGSSHAGESSARSRGDLRRIRDAFSQVLGTFPYLAGRTLVGLRDSHSPYGPGMQSGQHTSVRKSALQGTYAHLSGAQ

SEQ ID NO: 944126 - protein, 93 aa, Homo sapiens
GVNCVGRKVLIKLTSGSTQLGVPLRVPYMMKSPHPATVFALRVTLYVNCCELLLMRISYLGAGYVDYGTHLPTEEMEALTHHEACTTPQVDWL

SEQ ID NO: 944127 - protein, 78 aa, Homo sapiens
MAPVQGGGIEYGLRVERVCVSERIRQYEPPLSISVINMHGHAFTQRGQSYTIAGRMSAAAADTMYRVYSRSSSHVSLH

SEQ ID NO: 944128 - protein, 111 aa, Homo sapiens
LLPKGYLLSVHTENLYPTELRSNFKPVCPISACFCTSPPFSLLIFKYSATGPATSESNACTYEPAPAFKAVSAYPRCMSECMRYCLQAALCSLLSFSHIAMSAIMAHVLRT

SEQ ID NO: 944129 - protein, 89 aa, Homo sapiens
YLYCTFMTLETISQNFVKSEPTGVHRQACKMHLDQPVTGKFQVGAVSQRADLQDTCALGPSFFLCSDKNLQTFKSPGPTKEKGFLLELR

SEQ ID NO: 944130 - protein, 127 aa, Homo sapiens
GLVLLQSQPFHSAEHLELNAYEFHSQREALDHEAVTQVLGARFTKPAKPELGCLEHSCWVYPFLMSSKAPCRFSEADLLPLLRFIQVMHSYARGRHPDHVLFPTARGGHNEVPHPFRVGGILCHLGH

SEQ ID NO: 944131 - protein, 43 aa, Homo sapiens
MAHSICARVFAITRAPPLPYSRAHIPLSDMVEIVLDTYRETRA

SEQ ID NO: 944132 - protein, 135 aa, Homo sapiens
MAQPTEKMKIQAHARHTHLKIVIRAEARVNHAGQDERELLTMRSVHVGRSMTCNTRENQHYRTHPIHTCAHGMVNLMLGVASSAMTSTTTGPIFKRRITLNLCATELQIQSIETTSSDVFELSSHCGITPCRQSL

SEQ ID NO: 944133 - protein, 115 aa, Homo sapiens
PVEGVVRPIPNVHRDPSELRLKHGVAQVSPGLSQDCSEIGDHRACIPQTHPHARCLVPEWKTPPPCHGSSPASHRIWWWATSCADSANSVQESFSLVQKAKGIVHASWTQMMFTP

SEQ ID NO: 944134 - protein, 67 aa, Homo sapiens
VGVVTVFTTFLTVVSVRQVVPSSECLHRDYTHGSLRILLGVRSPQSAPVLASWEWCYIEGACDLGVR

SEQ ID NO: 944135 - protein, 37 aa, Homo sapiens
MPVGVMPSHVLFPTARGGHYEVPQPLRVHGILCHLAL

SEQ ID NO: 944136 - protein, 88 aa, Homo sapiens
MGAQRYVHLVVHVNPFRMVVQFLSLQGLSCHEPKGPVNVFEMNVLEDGITAFSSFHPTALRFDNIVVSLTRSVVCAIARVPLFLQPGM

SEQ ID NO: 944137 - protein, 118 aa, Homo sapiens
RLREVTLALSFVISLSLNSHSYTFPVVPSTHYLGHVHSLVFLMSKAGYFSCRNLVTHMPEFGIVRTHHFLWSVYIFPTSLAIHYAAYTDPHSFSGKTLHSTVSDHSTRVFSDTLVLAN

SEQ ID NO: 944138 - protein, 31 aa, Homo sapiens
MSAAFSALMMCGGVHHPEDPCLRIHRDSGIA

SEQ ID NO: 944139 - protein, 109 aa, Homo sapiens
FYSVFPGLVFVSFGSVSDFFLSYPYPYYGWGAEKRASDSYTHPSQGRGSFLIKDPARPRSQEQSSPLIKKKKQHAGRVAVHPHCFKHSWNRTPDLSPVTSSLITLNKAR

SEQ ID NO: 944140 - protein, 112 aa, Homo sapiens
IGDKTSEVPHHIPYNTQVCAPDPWIVYRALQKEPVRRAVVCSSYAGRRPHCKVQFLREGAVWLMCQRPMVSMLRKRTCILVSMSSPDISSEAPQSVIPSYTCSGSMCHMHTL

SEQ ID NO: 944141 - protein, 76 aa, Homo sapiens
YVRATFAHRVAKLMAKVWAKDCVYINLQHHRAFPNEIRVNLLVPGTVQRRGNVEALPIQLELDHLRASSHPFSLDH

SEQ ID NO: 944142 - protein, 117 aa, Homo sapiens
KLWQAFQCISSGAPREPRPISWEIWAKLRSETKGTCPNSSWQMSGSGVSMGLDPCLMYCVQWKPRKARPPKNSREETQASYRSKAETSASLQDLQEVEICECTHSEHGFYTSTSESC

SEQ ID NO: 944143 - protein, 112 aa, Homo sapiens
NYISFRGLGFKTTFCNFGQWPLQLPGVADSLARSERDSHSAKMLILRPNSHHCFTPFPFIRPITDSFAAFFKFLMPQTLHPENVPIDARRLKACFNFEYRVQSCASCRTRRE

SEQ ID NO: 944144 - protein, 119 aa, Homo sapiens
MCHLVDPHLTLTAKFCYDPFLGKNPPSSCIQNVWLQTPCSDRSMAPLPCQPIYSSQGTQGTSASERRNGQTRKPLNAKYTSGLTLSSRVLYVYFSSARKYSRGTEERERGEKSTCDVSS

SEQ ID NO: 944145 - protein, 58 aa, Homo sapiens
MASSCSGSASNRSVSSSRFRSQRGGASNSEYSETTCPLYACGVMSHSARSPRVPYSYS

SEQ ID NO: 944146 - protein, 134 aa, Homo sapiens
LLGYGHAILHFSKHSGLNRVPAVNTIAPTTQQFGPFLLPRVNEPEYLLNLSFIHLRPVLVLAYQRGSRPPKTWRGQRSLHNLIIDVLVQRGPEGGTAAVAVVKAQGEVGVLRGTIHSGISHDYVGALPLVPSPT

SEQ ID NO: 944147 - protein, 111 aa, Homo sapiens
MHLGLHLWVLHATQEAYSAGWSPSETSVLGFFSSSGMRLRKKPIESRGKLGSSVRWLCSTFCGYEVLQPLQHLKGLFLCVLAVCFITEETLFIELPRRGSRDLKDSEPHAP

SEQ ID NO: 944148 - protein, 118 aa, Homo sapiens
PPVLIAYIDQDTFNLRIKMSQLSFQRRPLSSCGKSPVSLEVMWAQRVEHVAREEVRGHPQGAENAPLKLGRAQVVVYVLQDHRDQEDLKGECGTVYVVEKECLLPQKARDVVLCTALV

SEQ ID NO: 944149 - protein, 121 aa, Homo sapiens
VSSGPSNNFSDPPTVTVYPIILSPKYESLMCLCLWVRIQENPVPAVQAQFGVEVKAHSRAFERLGYRCFEGSLGSIRLFGNHKSLPPSVCRAKGYERAVVKTKTHHSFSHGQRSADSDTRA

SEQ ID NO: 944150 - protein, 128 aa, Homo sapiens
MVRAVVSLALFHFCHVLGPRVTLTVLIPHPRVFCFLEHIPCLKGIVCSRFVRLPTKLSVKPERPFLLESPGQAAAPVCVGSLRTRGRALLCRCLCSSSIFALHSYRTLLSLEHEFTAPHSALERAPHT

SEQ ID NO: 944151 - protein, 118 aa, Homo sapiens
FALSKFHTLYLCTVPQPTLQILSFGPRTIMSHTSGPTIPLRNAYSAFSVPTHLTNRLTWHVDISISFSGPMYSPCHSLNMRFFRSYNSQVSHLVPISHMSSVCTQLSVSRASSVLASC

SEQ ID NO: 944152 - protein, 130 aa, Homo sapiens
VVSGPREYDDSHIVNAVDPLAAFIALATRVKLVEVALCPLETWSQRFQESARDSEPVLCLARHIVSWLDHVVLCPEKFWAQSFMWHSLRAFVAGALSFILPQSLAHAHRIREESQSQGVHHSQCVVLSDV

SEQ ID NO: 944153 - protein, 132 aa, Homo sapiens
PLHRASSAIFLRPVKHSSLHRLWFPMPLARLHSVLTSTAKPASTSFTVKESYPGHSRECHSRSQGPHFRQSSPHGRHHITGLGHLSITLSVSWYQSDDVAEVTSDPGHIISCGLQICPNPCPSGQYPQCTFL

SEQ ID NO: 944154 - protein, 128 aa, Homo sapiens
PLVSSDTAGMSFSNGSLLCSTSPEVREKSFFGGNPESTWAPYSFRTCSYSPRTCCVAHPTVQASIHVNVYSPRRRTRRCRCGTRVSEYGKAMFLAARRARAAVCEAHSVCARSPSCAQRVRTASLPIV

SEQ ID NO: 944155 - protein, 108 aa, Homo sapiens
GAVAHLLAQWAKLLMQLVQLLARDLLQLCGHRVHVLQVELHLVLVLRLDVVQVRLHIGLRLLQILAHLVRQALCLRIQVIAKLVGHRAYLFTQLAAQGGAFTVAHIVS

SEQ ID NO: 944156 - protein, 123 aa, Homo sapiens
EWLTVCVAQSMLLPIFTQKNAHLAQVEVVRVFGSMCHIPPRVPPHDPIPGGIASLVKSLLDMTRNALLYVCISPALKYALPNVLLHLFPHVRIFDHALSLAHGPNVPEPVEKGSARLPRSPRA

SEQ ID NO: 944157 - protein, 39 aa, Homo sapiens
MRFHFLPRVLIREYRELLCASSVYLSSPAAQHISVSREC

SEQ ID NO: 944158 - protein, 124 aa, Homo sapiens
VNFHFPFFTQSVNSNFCAHTLLIESPKFAFMVHSIEFVTASAWKENVSVEELKGGKEFTTYHIQVIVKPIHKVNFLCKKPFMCASTQPEYIRCGVHSLRACENRVTVKERRTQQRVLACHIRTA

SEQ ID NO: 944159 - protein, 101 aa, Homo sapiens
RSLPFIPKFIDLCQQPDSKEKKFRAIKVRISSANFIKYFSQKCLFMVMKTSALHINLWSHQSGKVWVVIFVSQEAFISLRFLFCTTVSHFTIGLTKSRNCA

SEQ ID NO: 944160 - protein, 135 aa, Homo sapiens
VRVAPACRGTALAIPQALPDIWKAHSLNVSCKGQGPEKVPQANIVPVLLAVGVPKGKIAPVVDHSLHPHSQPVGRGLGRGTGNTLAFGTERGSAPEHSGRLSAPSPRENRYPPQSVCSLIAESHLPRTAAQSRSC

SEQ ID NO: 944161 - protein, 135 aa, Homo sapiens
SFVQGIPLHRAGTTLSKAPVPLRCKAYTQGIVLLQTRYPITQRKPDPEPNHCHLSRIVQRRDTPLKPECVARSQVYVVHSTPFWNSSCLEEILRYDQVLTSEVQRHRAAPYRAAHAALSLQRRDIALLRARGHPA

SEQ ID NO: 944162 - protein, 121 aa, Homo sapiens
EHGLSEMKAHKVLSHKDPAIVKKVQLSTTGQNVVLFFCLGPGEAQAFWPKGSENVGQYITSVGTINKSSPIVVNEPPGHLGPMPRVLAESFRKPLCDREAAVFLNNIVASGCVGSESVYMT

SEQ ID NO: 944163 - protein, 130 aa, Homo sapiens
ANRRQVVSTRKSAEFAGGICQHFWGEANSDPTLLDFIQSQVVNAPTHGADAFEIGPYSIQDLRVHVVEEKPDQPVGPRHTSLKLLDRNGLIQVPVLHLTVCRAGERDPTLGGYPAGHAHPHESPRSHPQC

SEQ ID NO: 944164 - protein, 100 aa, Homo sapiens
MGVFFPICSNPFALKYLVMSCVPLKVAKGPCSISETHFLTKKGPTGPSGNTIKFVSYWVPAPVVRTHAFCAALCSFQCCIWSLAGSRLSAIACGFLCSTV

SEQ ID NO: 944165 - protein, 72 aa, Homo sapiens
AHRIPELMAKVWHKGLLPEVPQKVGVQLQPSFNCVYINFDFTDAFLYELRCKPAVSQARVQQRGNVEAPLAS

SEQ ID NO: 944166 - protein, 117 aa, Homo sapiens
CGGNHRCKRFIIGAYTVMHLIDAHVISSGVEDSYRFLTISFESDAILTKCHSARYRRSVSGPYSVCSELPVKTFECPMLQPSYRDRPASFWPYGCIRPQSVRTYSWLRICKTVRRRL

SEQ ID NO: 944167 - protein, 106 aa, Homo sapiens
VTKKGKLVIIDWLRRLEEKLSETQRGGTIKFIGDDNRPLTKSRSYDVVIMTQLMNHLFNRRRTSRMTYWGIDLLNTKRRPHLLYIMCPIMRAKIHPSVLLKKNIAI

SEQ ID NO: 944168 - protein, 74 aa, Homo sapiens
CACYACLSGFLNSRYMIFTGVIAIIPCRNLARIVINLFSIQKSIVYPWMLAKCSFSHISGHSSDYTHTLYDRRA

SEQ ID NO: 944169 - protein, 68 aa, Homo sapiens
RSNLVTLEGIFRAKEITQAKSNTEPELQERDIAHRQIIYSLRMERPMIAWKGNGEKRLDINCERLRGA

SEQ ID NO: 944170 - protein, 95 aa, Homo sapiens
DGVSLCPPGWRGLVPSRVTPASGCRCDESFGTRHCECLGVHGLTASLDDGSFKDLVTFEYERSEPGVTSLAAAAGDTSYTTYRRLTSDRTCQVEL

SEQ ID NO: 944171 - protein, 89 aa, Homo sapiens
SCIDINSASSISSSRVPVLACDSTASRGFHRSISGSTETVPWVGGSSVASSYGQVILRALMANMLHGLTSQIVTVPWELLCISLRHRLM

SEQ ID NO: 944172 - protein, 33 aa, Homo sapiens
MGSHGCPSVLTRVARQSERGLGQPLIFHIEWVC

SEQ ID NO: 944173 - protein, 147 aa, Homo sapiens
MGEPRLQTAWVRRLLTNPKGSLDEKGHKALQMKQKAWKDDPKRALSLLKPGATKNGGPDMPLEKVNADLHHEGAWGRVQAIPTKTVIRRPKDYSVAGYMATHYGELMRYQWPELEKQMCQCVGPPCDRLGRSGFTFRGMNIRGKGPC

SEQ ID NO: 944174 - protein, 131 aa, Homo sapiens
VSPELVYSILVTIRAPSGAPGSPLGVSFLAPMSRCDVVLCTGPSFCGSQFVFHVCNGAESALAMSANMSVSAAYTFESRPREFKLETNASSVPLSVEASLPLQGDIRHGSAEFMIPCDSASDRASVCGWTV

SEQ ID NO: 944175 - protein, 117 aa, Homo sapiens
FHFESLRILIRSEYRPHSLPRPSSSYAASSACLGSSVFHKTIASVQINISDQSISLEDSLDVLISDRWIESTDEYPTSTHDVRLVLLSGQGLCRLRHRQVRSMSPSRRPPRSPALNS

SEQ ID NO: 944176 - protein, 68 aa, Homo sapiens
HCADTMISMSSTVSSSDLNYLNIHRVRGLQTHFNSRITSICKKFVTMASSYPYAICQDQLLLGQLQPV

SEQ ID NO: 944177 - protein, 84 aa, Homo sapiens
MPHSQNIDINNLNNYDTKRTKFRLSAGPEAIGGGNCDQERYGFPNKKCPPRIPGKLLSYMGRTLTPTGQDCLSRTAYLLHASER

SEQ ID NO: 944178 - protein, 50 aa, Homo sapiens
MLGVHRLHKESRVLQLVSVDITRHVDTFTACVLHLPAHQSLFSHDGRQSA

SEQ ID NO: 944179 - protein, 112 aa, Homo sapiens
SHWIRKQLWVSYLIRIVAYSQTLCSAFGNLVSYRAHGIICDIMDDNLTCRAQHVSIVIQGRSLKATPVGPACSHIWIGHWLSRQLQSAQHAREKEGLQCQDISIGSSTPAQR

SEQ ID NO: 944180 - protein, 80 aa, Homo sapiens
SSYTPESSVGSTITVQNLLGTTLAFTSLEDSHRNSNEPGRSVAELSGTNPSNSSASSALMTKKVEKSSSSSPYRMSQYPQ

SEQ ID NO: 944181 - protein, 118 aa, Homo sapiens
SLPGMRQVGSTFFALKGFSVLVLQEPLLVIVSASGLGGVNPWDSVDLILAENQGLAADIDKIVIILKLTKNRLNLFISQNCSPHSGNITKFNMGNYSIERNYMRLWDGQIPIDGGRCY

SEQ ID NO: 944182 - protein, 114 aa, Homo sapiens
EFELGCSRYLLTELSSLRIQIPQGELSPLQVNLKVPGHVNRFHSLNLSLQNGYTQSSLFPMVLVNAGEKTRPKAQFRRLLAKLVERARAYSTMYSARSSYSGAYSLATSLNSAR

SEQ ID NO: 944183 - protein, 38 aa, Homo sapiens
MPSTSSLVSCSGSIESALASSVFFSSPAAQHIAVSRVC

SEQ ID NO: 944184 - protein, 58 aa, Homo sapiens
MLCICTVLDSVIQVALHQGYKIVISDIFSSISGHNRVYISTKQTPGMNELQILKRQIK

SEQ ID NO: 944185 - protein, 71 aa, Homo sapiens
YSQGDRKGHVVTYIVGMISLSCTNSDQQARYVSRLDVYSCTLHSCIKRVDYIICCKVHCLGSRMLATSLLQ

SEQ ID NO: 944186 - protein, 115 aa, Homo sapiens
RYSVSFAFSRYLRSHSTHVPSRKALSVLGLTARFPLALGDLTRGVRGGPEAQVLVQANVTLAVVAYRVMPAKKAPVGPQFTAIHPVNNVRPGGPRGQPRPQSRATAAHNPRELCA

SEQ ID NO: 944187 - protein, 166 aa, Homo sapiens
MRNGRYWFNIKLMVSYQEYMSDQRHGSSHLTHGYFNLSMEVEMIERCCFFYTSSGRVNVADTLVGEIEPSEVEAPNLPADTVSTFTIMTRLNTLHCHRESIMRLQNTTCVCELLREAHIDLGDVLTKFFEAYGVLNARALDEDHQRPLVQFSQTLWDHPGLEAYNY

SEQ ID NO: 944188 - protein, 131 aa, Homo sapiens
LCCLGHIFVQSHPVGFFNDPLVKAGLVPPVPALLKCILQLLVTGIHTCHIEAFFHQHNEVHPSATGYVKHPLTPVLAQQPNQPSLVLAGAPPVCLQYTVATLRAASVCALWSESPSAATHRERVRYTLSNI

SEQ ID NO: 944189 - protein, 93 aa, Homo sapiens
MGHPGRQEEYLSVPNDLIPVFPMLQDSENHVSLQLVKYLFTLFDVIVLPGVGASDEHDCELLLVHELVADRGLEGATVLLHPGPHSQAALHDC

SEQ ID NO: 944190 - protein, 74 aa, Homo sapiens
LTFSICFTVIVSCSSDIQYSSSSVSASALLISITIRAMTSAYVSVGIHACALETIGYILDSILVRSLCMMAPEC

SEQ ID NO: 944191 - protein, 103 aa, Homo sapiens
KKRKREEEGKKEREKERKKIEERERRREEKGESEKKKRRRKKEKKREKRKNERGEREREERGKDKGKKRRRKKRGEREEKRRKGRKRKTEDERTKWGERGARL

SEQ ID NO: 944192 - protein, 100 aa, Homo sapiens
MLPKCAIDHFSWCLSPTVEYIFGVYSVKAILNLCPFCGLKAGIVYKIHTTANHFHSSESVVHKVVQFQKHANVLHPHGNHMNAYHTLVSIHVHTYFKIIN

SEQ ID NO: 944193 - protein, 116 aa, Homo sapiens
MPQGTLFCVQTQGHNCWRSKTYSESIKGGPDQESIPHENHNSIGGRSYDIRSISGTVEKDWGATTISRHEQTGRSHPPLPSVQKLLEPAKSGFHRLKQRPLRSTGSPSCRSSEQTN

SEQ ID NO: 944194 - protein, 76 aa, Homo sapiens
ALVRSFSYKHISLTVSLTVFVCLMICHVTHVSSYKRYLTTQKRECDSICGAQTRSVISRTQRVCYKIIVRFCANVL

SEQ ID NO: 944195 - protein, 76 aa, Homo sapiens
GRPVISTFKQISVAAFRVHFGKICHYLDNFCKLSFGILEPGTLESLLAEERLPFIPKFIELWPQAGSLYQQLATIL

SEQ ID NO: 944196 - protein, 121 aa, Homo sapiens
SSLINSGGATLIMSPWVGLPKSPLSRSCRHTFLLAPVTPSRGSFMSSFLKIMPILCAFLTQGFLLINLSRVAMATRQHSGLPVYVDPCSCGLMVSMMSLSHSSADTGYEPTERLFTRRYIS

SEQ ID NO: 944197 - protein, 110 aa, Homo sapiens
MWSQTNLRIFSIEAYKCGFTLSRGLPLVTRGPILSPILAALWPTFSGKARPSILDSIPCGPCMAQEGSIVVNEIFMSLGGRYFPLPIAEGLVRFTGDGCCAFNNCACARA

SEQ ID NO: 944198 - protein, 125 aa, Homo sapiens
LTGNRGGVAPSFHIVIYLTATIWDWPSLLKQSLLQLISCRPQHPQVWSASCLCLNEPYSPPPIMDVWDRHSGWNALFSLLVKGSMTAGTKNPLSTLSFTPWDLSRIAHNSSNNTCLMVISVWNLP

SEQ ID NO: 944199 - protein, 99 aa, Homo sapiens
CAPLYKPFTQFPRVGMRGIERMFGPHGCFGCFPVCQQVPSPDEDGNKKYWTRFLKAHISAAIVVLHAQLFLRGEALRVTLSVSRSLSISVSLSLSLSLS

SEQ ID NO: 944200 - protein, 124 aa, Homo sapiens
KEVGPESNFVLQLLARLGVGTNLQIPFFLVVLCTVGHPFPIGVSIATQSVAQKKWGPQSRRRAHRRVSPITVLVFHVLMRSLDGTETHHMEVGAPASLWFRATLTYGTLNITSAIEYRHRSLFV

SEQ ID NO: 944201 - protein, 115 aa, Homo sapiens
VFCGVLKIIIFTNSKPSQPSKNSASPKTIIFPSTFCQYTHIMPLTPRYLSVSSTTKHTLSLLPSPTTELEKITSGILLTVYLQTSSKCAQSVSTYVLYHKHILFSLIWCALVSRV

SEQ ID NO: 944202 - protein, 73 aa, Homo sapiens
YETIEDNAPRKRISEGPTAPTQGAERANTRKEAQETSNQEMQKTIQQQQGGTPTRQKRQAARASGNERNSVSL

SEQ ID NO: 944203 - protein, 111 aa, Homo sapiens
SRVRLSGLAVRAASLVHRALPIPCEACERIVNKAQHCAWGVINVNAEGIVFLRILDDEVGIPVHIVVGLVRSLEPGQLERGGSPRCDLCIFPRLVGNGPLILGVLSCGHPH

SEQ ID NO: 944204 - protein, 174 aa, Homo sapiens
RAEVRRWCGPRVRGWERVGCGGGGERGGEALGGGVGGWCRVWGGVGGGGGGWSGGRDRRRGGVAGRGRRARGGGCGLRWASRGGAGGRGRGGGGGGWVGWGGRWGVARGAGRRWVGGGGGARVEGVGRVCSGGGEPQLGGAPRLGAQKLLCCRLSCSRLGSLYSARRVLAERGG

SEQ ID NO: 944205 - protein, 88 aa, Homo sapiens
HNGCALGNEVVSTLSTSGQRMGHTGGNKFTVYVDLANYSLSVRHVSHIVHAWAPVSANHIINLFVDFILDLWVLQQNQQSISQSGAHY

SEQ ID NO: 944206 - protein, 127 aa, Homo sapiens
MGSHLPFARSPFLYPPIYDVAGRAISPTRSFLCCNTRLRAPLIEGSRAFRVSSSLEARPSFRPTSLESSTTLHSPRFPPTISRGTPRVCSSIVSSTCRQCGADGSPKVFSYFAQRSRAALHHIDALG

SEQ ID NO: 944207 - protein, 174 aa, Homo sapiens
RGIKCVCLAFLSGGPADSVFPYRDNRSSTPCRPLPLCFDMYNRISAIPQFSGQYPRSLSSKIQHLSVVPLYATLATLELTPHLLGVSIPGFGGPTPFCLVSQSSEPSALSVVTSIRSKSPCCLGSGDREIRKSRNGFTLVPLCHILVAPGSSPASSRRASVFSMGSKGVPVCPL

SEQ ID NO: 944208 - protein, 119 aa, Homo sapiens
TVCALENPLMFIPKAQYRANSLGYTGTQKLLHSREHLTRPSLGPLLAQGPPEQVLRAHTKKNVVVLPCQAQLSQSHGPGIESLFMSVRRLSNPMRIHKLFQFQSTYEVSAQFESQKSEL

SEQ ID NO: 944209 - protein, 131 aa, Homo sapiens
TFQCRHARQPWPLSFLNNSPSNDSRPVFWFQSLALLVVEHLCVVCHSAGYTRSRSSRRVKSARTARLPFRRRRSLMPGMATLMPDSMCDDWYSSCARQSINNRRSLQSYMCSLRHASVVLIDISHAKRTCL

SEQ ID NO: 944210 - protein, 194 aa, Homo sapiens
STHTRTHVYTHAGHTHISTISRYRQQRISSRTRRHTSHESTTAAPRVYISLQRARRERCCVCAHRARAHERVCVCATGRSRYRVALVSLCAHQTLCRLSHTPRDTTVRAQSLCDHARLCALFVDTECEYHTACREPIGGPFCLCDIRCARVSTRDAGEPLSEGTRRRITLLTMSLICSIVAVVADYSLRSAGSD

SEQ ID NO: 944211 - protein, 127 aa, Homo sapiens
VPYRFREKSPVCIICLQKGYNVFVTFSISLFSTPCFRKSGPLIPYFHVLSNCTLLKILTKATPPRAFEISFSQSFNPMTHPHSVCRIIAEHTPVDMTESREKEQGYRGPPPLCEKRARAVSHSPGDP

SEQ ID NO: 944212 - protein, 166 aa, Homo sapiens
MCNTRRGTRRTSPLSREYRSSGYRLHERPHTCTRHHSARVYISLSAPAERDARLCHEALPTESVCVCSGRCDIVCLVCSWHTRRCVLFSPHETPHVRAQSLCDHARLCALFVDTECISHTSCKKRRYRGRPSRVSRCDIRSLCPHESGEPLQRHRDAHLSQSSLRR

SEQ ID NO: 944213 - protein, 62 aa, Homo sapiens
MARSFPYRSGSRCPCSTNVCKLDSRPLPIDTFSLDKGIVYVSAHKWLRYDVVIRPNNTLNKL

SEQ ID NO: 944214 - protein, 69 aa, Homo sapiens
CLFKGTKKFLNAFMYLSLRILREVEIQALQYFIVSVTLGPQEDHCKACSNAHWGEEDIGAVALVSHLAV

SEQ ID NO: 944215 - protein, 53 aa, Homo sapiens
MPHYLYSPYHVYCCDSSSGSSPVAGVSTGTSAMIDGCTEYPYWPKPNSCRILQ

SEQ ID NO: 944216 - protein, 79 aa, Homo sapiens
MLGLQFLQRIMHPALELTLLPTANRLQSGLMTALGLTQLLPEMFIWKSSSSVMIRSMFSAYAHRSISSQCCIGASPRHA

SEQ ID NO: 944217 - protein, 94 aa, Homo sapiens
PLRYRHRDSVFPQVNVSGHLGLSELITSTHEALGVEVTGFTSCIYYNFASTVIGDLFPTSADFWVCRGLIFMRSASTDWSDNVEEAVCNTVSIA

SEQ ID NO: 944218 - protein, 52 aa, Homo sapiens
MLYSRLIGWLHTSLTGLMLFILIVRYGYTESDLIALELSLTLTPSDRAALGA

SEQ ID NO: 944219 - protein, 116 aa, Homo sapiens
VYAGSLMSVQMGPYKLLSSVQLAQARLRCRDDRHASSERAGSSNAKADCAHTVSLAAVQSDRMIVAASDLVASAYPVPRIILGTGHSVRCWCACPRHVCLLVSMTHTAPCDLWRAQ

SEQ ID NO: 944220 - protein, 117 aa, Homo sapiens
EFQRSHYSLYSYPYNSPMSLYCNMHLDQKYLCVITSPHNLSDHFHKTYTHSNPANGIQIPDLEIPWPLCDPFEIYIETPVVYTMPQLRKPEVVNARMHTAESSSVCSRIVFSAQGIY

SEQ ID NO: 944221 - protein, 116 aa, Homo sapiens
YRQYENDVSSFDSNLTPATNLKKHGLIKIKVEMTIVMTSNKFLNHSTQAVWSKYISLSIQHMFSFYSSYVIVHGQHVSPMNKSSLHAVTVVNLPFNSLSVIVKLIKMVVELNTLCT

SEQ ID NO: 944222 - protein, 71 aa, Homo sapiens
ISSITQTQLYVNPSKRWLFDTVSTAQTRGAQKAQKARNVCAQCVHSPSTGHLCAYLHKTSLLVTAVHIGAP

SEQ ID NO: 944223 - protein, 101 aa, Homo sapiens
DMDKFCWSRSVTLMGTEYLGLLKSLFPTVWFFFHQSYTGTPGPEATGTNTHKGTHPFGWEHSPPVQPQRGQRCQNHQNPHTQEHGLKGSEQGLQHVHEGGT

SEQ ID NO: 944224 - protein, 67 aa, Homo sapiens
MASSGVLCFELPDITARELRNAFQHVLGERDYVSTTGGHFLREEPFRGLTDARLSLWRYIAIISDSD

SEQ ID NO: 944225 - protein, 126 aa, Homo sapiens
LPAIHSVFFGTMADRRLFSAPTLRVICYNRPESPMYISFTACVFLLRCFRITRLGLRVLLLGEQCPYCKSANYAAAHQGEPIAHAPLSCDPSEPGIAFRVWYPYQVCRYAAFARCGAHALKLHLAQ

SEQ ID NO: 944226 - protein, 75 aa, Homo sapiens
MMSFSLLDTLEELFRSACPVCSSACSQVSQILLHVGFSLPGMGREPVDVVLTGRYGVRSAPYMGFIEAPRTQAFS

SEQ ID NO: 944227 - protein, 129 aa, Homo sapiens
MLHRFCDSRSHVQPFLAMRKPVTVVVILPSVFQGLHKDVLRGFGKLTVVLPILHSSTVSPESHGLSLPVLRGYLKLWRPLSDPKGLKPGTSQHVAQPVNIGQRVTPIVVLLGDNRTQTQQQRHQHRHLS

SEQ ID NO: 944228 - protein, 132 aa, Homo sapiens
AHALSLMEAMRCFHTRNQLSQEGTASPPGQNVVLLLCLGPGEAQACWPEVSEDVGHDILSVGPIDESSPIVVIDPPAHLGPMPRVLAVVFLQTSGDREPAVPHHHRGICLCGLESLGVSHTLNRWGGNIATA

SEQ ID NO: 944229 - protein, 99 aa, Homo sapiens
EKNCYRQSRYLETISIEHTVIASKKRVKLYDVFLFSMNSGVSVRCSCHVLGSRLYTEGTSESPGYIILGHDLLLPTGPHHACAHRYNSSLAEHRLLIEI

SEQ ID NO: 944230 - protein, 48 aa, Homo sapiens
MSTRMSTCGQSTAFIQRSNTRIRAFSGSSETAVMCVQISTEHSVYHKF

SEQ ID NO: 944231 - protein, 113 aa, Homo sapiens
SGCSRGHLGLANGLHTSLGDSLCSKFHEIAQEVTKVRLGLGLKLWALDLLHQVLAIVSHGLKVLRTEVSPHMAPFLSRPSSSSLQMVRSSTVAASSFMLVTVESAAYDSVSVR

SEQ ID NO: 944232 - protein, 117 aa, Homo sapiens
GSLPFAFKEDVIPLSTLLQVIVDLFLGLFGVPEVHSEGFCVVQLFNIPKNFPQLQALSEEQAIAVWSAGSVCLLLGYEEPEAFMDLSLRNLREVEIQALQDFIVSVSRGPQREHCHS

SEQ ID NO: 944233 - protein, 30 aa, Homo sapiens
MRELSSPIAYPQYRFIVGIRLSDTKSEWAC

SEQ ID NO: 944234 - protein, 91 aa, Homo sapiens
KSRSCAHRVTTKGQIELRQALVVRDLQMAAAQDSGAKASITKALKPYAHKSLADEQPRSSVHNRGSHLWNKPRYTQREGNCRSPTAEAKRR

SEQ ID NO: 944235 - protein, 107 aa, Homo sapiens
MCTEHISLQSLWVYTGSKVTQGCTGTVPTPECEALGTRGCGHSSCQVGELAGHRVCAARLKGGHTVDCNALNDHEGTSPGVSQHVDGLDHVGVQVGPVKALVSVVTR

SEQ ID NO: 944236 - protein, 47 aa, Homo sapiens
MQVYFVTSDSHMSPEPARSTYDTGRLLPCSVGGVYHERSHTSQSQYL

SEQ ID NO: 944237 - protein, 90 aa, Homo sapiens
MTVWLLLEGRYVQSIVSLSVTSKVPLKVHFNLIFSPRITSNMGICTNLQEKADMSTLEDQIAHQRVESAAAAYSCSSLLHPGISSDACTP

SEQ ID NO: 944238 - protein, 115 aa, Homo sapiens
RHLSKFQAQTVFDSAHFAVHGEGLNVYMSMVKNGACRGLVDTSGLHSNEPVLLDVNTALTMLARDFVQYMKSSKQVWCVVPSLTLVTFTGTPSFELISRECQGVLRALTGSWVFV

SEQ ID NO: 944239 - protein, 140 aa, Homo sapiens
RQLGKLQLQWEPLSAPFTVNGEDLYVYMSMVKDGAWCGLCTYSGVSFHGSSAHGSQYGQLHASPRLRSGSYRAPSRCVAMCPIRALESLSQLTLGSRLSLENARGADTFEVVMGQRIELRRSQARVVVQHSSLVVDVHDV

SEQ ID NO: 944240 - protein, 119 aa, Homo sapiens
MIGREPHCLLAGEFSMRYDSPKVPYGRGSLWLQYKLSHRCLWKFVMSPLDTNSIGSGHCMNAVNAALRSARMSRKRWLPKTLRRANDDGAPDAESYGSTEFRHVYRMDTSTLCGTAEHQ

SEQ ID NO: 944241 - protein, 206 aa, Homo sapiens
QASTRDKTVLSRALISAVVMFCLAQAMMSGSLINDFISSVHMEQGRSIILKSISPDASASCSAERRHKICTQYTEIWVGSEASINKLSFPKCWDHRSKPARPAQMKPTWCHSSLSSCGHQFSILVSAAQARERPPVSIVTGPDGAHAPPKLPDGDLSLCHNVSKIGAHRGPCRGRLPQVAFPIPGAHLLQPFQQQCLPDARGPQLV

SEQ ID NO: 944242 - protein, 126 aa, Homo sapiens
SHFAESLLRLAKYEAHGDVITFKGNSEHVGLSATRRERNSPSWYIIDAEHVSPSALENSSFLVFSGLIFDFHRPLEVYGVTQHQNSELIDGFRGNDIGDSAFLRVQGLELGSIYQLTDVVVGLIEV

SEQ ID NO: 944243 - protein, 139 aa, Homo sapiens
MLSGLPILGDTSFKFTNSSSNTQVSTVSLKCPGNHVFDKVSVSWGTNDSHIVLSGLKFPQGDTNGNPTFTLSFLFSKTQRMLEGALSHLTSLLRKFCNGSLVNATAFLDQMASSGGLARIHVSNGDNVDMSLFLPHCGS

SEQ ID NO: 944244 - protein, 210 aa, Homo sapiens
AHLRKDKPTYSKLHLEYSSVWAQRASWLTTAMCCSRRTYTSSIVLDAGPRRANNPSPHSSSERGRDTHIVTVPFWVPSMSRMALCARMGAPSHINPTRFRCTVPLRWETMPWAPGKSITAGGRFPSVHLRLPSTGVVCSSMSFPYRQRPASQNSCCQVNCPRYRHRVLHTILSCVATAGHATARHAKHLHHSTGHKAQFPQVICHAGLEY

SEQ ID NO: 944245 - protein, 69 aa, Homo sapiens
EILLNIYQHTVCSTLSEFERSPSPFLVLRVDRVHRRTSLVSEPVEETRKPLILIAVRTQGAFGNAIQPR

SEQ ID NO: 944246 - protein, 63 aa, Homo sapiens
MGPMHPPSSRMVLFLCATMSVRLVPTVARVGGGSHRSPFPSRELTSRSRFNNSVFPTPVAHSS

SEQ ID NO: 944247 - protein, 85 aa, Homo sapiens
MLFSDRVVIPWALWVYPRQIGLPGPLSVGDLSLIFQVLARSQHSVEAYAEEELGYSRVGKPFGTLCTVILISLHTSLHAVQAVRG

SEQ ID NO: 944248 - protein, 147 aa, Homo sapiens
SEQGTCLFTLYEAVCKIQRGAPMEGATQSLSVTWNPYTCSADYMPSYINSFNSSPSSDKLNALLLLCRRKFALKRMHTTQQHWPYATSSLYDKTPMFPKENLLRSASHGNQPRDRTRKARTAIMMLEPCLHTQYKQTVVYKLTRAYA

SEQ ID NO: 944249 - protein, 209 aa, Homo sapiens
MRILLAGNTLCPHFPVTWRSYRVRVHFQYLVVSLISSNNIRDIAQVYHQQHTSGQLLTALNVRHACAFLHRLCHGAHLVHVEVLFLGVLDFKGSLPLAFKQYVIPQSKNCVSVKPFVQILTFPLSTFLHVIVDLFRGLLGVPEVHSEGLCVVQLFSFLHQFIPNLQALSEEQANSGGQLQLSVCLVEGTEEFVEAFMYLSLHNLSEYET

SEQ ID NO: 944250 - protein, 129 aa, Homo sapiens
GRGEEETRKKRSEEGGEKERREKGRGEEREKREEREGREKRRERGEKGKARREERRKREEGRRSRGKERSGAAGKKGAAEEQGGRTVKQRGRQKERREEEERERNERARKGRGERRMEIRQGGEEEIKR

SEQ ID NO: 944251 - protein, 138 aa, Homo sapiens
ALSSSNDLDLRCAGCQDSDLLMHPVANPRVHAGTASQHCVGVQVFAYVHVTLHDVVQGSLAYATALHAHKGSLNSASGQRNRFIANGNDLSVSQFVALIQAGAANTRGHLGLEVQDDVAQLLLNVTHNLALDRGVKPA

SEQ ID NO: 944252 - protein, 203 aa, Homo sapiens
MATVMITLKIVPIGKSGTFLLERFYAISLMLPWVLDADITFKLSSQLDLTHYLKSSYRSCSSSCPVESMNHALVVAPYRLAVGHSKASVMDVSDLILTSLNSPLEFRSEQGYVSDQSLLYQRRVIPTQVKDPGVACSFAVWPAVNEKSGHSQFHSSQCQHRSGVYEGPKSSASLLNVVHILNSQRITDPGAMYIVHRRHSGST

SEQ ID NO: 944253 - protein, 123 aa, Homo sapiens
VFLLVLLCFPGAQTAHSRRRASVRGPRPPGDRSTPQRPTDREAPPPATTRTTASHRPSAHTRAPSTPRPRTHASPKPPRAPADHRAGHARPGTRAPWHDDNGPPRHPPRAPTPPAGPGATATE

SEQ ID NO: 944254 - protein, 152 aa, Homo sapiens
MWTKPSRLVSQGRENSACNLLYSPFRQHARQPSSLSFLVNSLSYDSPTVISFQSMLLSSESSTVSVPQLRVNRSRSSPRVKSARTGRLPLCRRLSIMPGMATLMADSMCAHSNSSCGRQSISSSRSLPSSSCSLSHAPVLLIAISDEKGAGL

SEQ ID NO: 944255 - protein, 177 aa, Homo sapiens
MYPAVCSISLPMACTPRVPRGQSLGTQIKVTPVTLSVGKARCLQHQFDFTAEYQYSQYVFSQAVSSEALRVFVTAQATLTYSDEPRSPASQYGSFRYPKYDYKYVKLSPEPDSESSSPDTPRSYVGEHHSSPERMIYQLRHWCADTQQVQLGFAHVPNPVERVLEELPSASRAACNG

SEQ ID NO: 944256 - protein, 123 aa, Homo sapiens
MIYISTELAYFYTTSSESFVRVDPNISCSALLTGFIIINAGSIVTPFLRCWMFIFSSYILYRLWQRSSWPEVIFTRNLIFLAVVSICISENDKSSKVELIEIVQGTTCAGSSLSSIYSTVLWC

SEQ ID NO: 944257 - protein, 120 aa, Homo sapiens
HRCHKLGFYAQLLLKHDPAGTLEVLLKAGARVKELLIGTMNVWAPDQVIVESPVYDVFCSLLRSQREVREAGGHCDRRQKHVGRGALCWIAPGTGHSRSYRHPLSSVLTGSVNRGSSSSN

SEQ ID NO: 944258 - protein, 138 aa, Homo sapiens
DRNKEHKREGRQDEDVRKGGKAKEKGEDRVRGVKEERRQEKERTGRKRRRTRRDVEKEGGKKAKERRRERAEKREKERGQGEKKKRREKGKDEKGRKRSATEPLALALALSLALALSLSRALTRSHTLSRTHTHTHRV

SEQ ID NO: 944259 - protein, 72 aa, Homo sapiens
IERKGIGGNNRRRREMWEVKKKRARRGEGEKKKRDDRKRREETKRKVREGKTDKMRDGKKEKREVERKEYRE

SEQ ID NO: 944260 - protein, 53 aa, Homo sapiens
MENGLAPGIGHPQQPAEGGPELSHGERRLLDPHSAAAESLQHSVRTAERLALP

SEQ ID NO: 944261 - protein, 83 aa, Homo sapiens
MQFIDIAIEPDECGLESCEWMNTIGISVLSYSMSWSFIRYSLRRRHRSSMSGNKSACMFDRSEINRARVSFNKEVRCAQSHGV

SEQ ID NO: 944262 - protein, 168 aa, Homo sapiens
RETRRIFIKLGTTQGGPMERRQGLPLQAARRHEALKDVESQGCRLRRSVIVDAHMGYADAHGCLHLFHQEGLLALHDIHHGLEPNLDAEQEGLALQADLMGLLLQLGAHIDTCYFTYCKRTRVRENIIFMRTRSRSTQAWNRFCSYWPDSESTAENQTRTNSSRGYRH

SEQ ID NO: 944263 - protein, 127 aa, Homo sapiens
MICFLPSTVSPEFTVKASEWYTFEASSKVLSTESQALAEEQSFAGVQLNLPVWLVKGTKQFLNAFMVMSPRNLLEVEIQALQVFLEVSALVRSDSIAKVVAMLTGEKKILDLLHWCDSWRYSLESIS

SEQ ID NO: 944264 - protein, 138 aa, Homo sapiens
MPRVLNKELSIRPPEIPPQMNVSSQLATEGSSDFQKYTLALNARSQSYTLTLGPTLSLSAERSGSDPCPPRSPEESGVPRHQILQILHNGPSRTGSVSPTLMVSLNTVGGEAKITVFTQVFSHVDSSAGPHICTGPTM

SEQ ID NO: 944265 - protein, 136 aa, Homo sapiens
PRDRTLLYTGLRIVPRLVTPNFLCTPYVDIDSSAHSCCRVTHSKPQKHLSVNSHTQYPPRLDVLISRISEYARPFCKCISIQTDYSMLNTSNSSQVTTYTMCPMRNVSLPQTLQVGVQYAYQKHKELDDNDQGFAL

SEQ ID NO: 944266 - protein, 135 aa, Homo sapiens
MASGNRRQVVSNRELCEFGGGICQHIWGVANSDPTLLDFIQSQVVDAHTHGADDFEIGPCSIQDLLVHVVEEKPDQPVGHRHTSLQSSLAGMGSSEYHCSTSQCPVRESATLPKAGILRVTNALMTRSGLIHSAG

SEQ ID NO: 944267 - protein, 65 aa, Homo sapiens
MMSGERSIHSLIVHIGLCILEVENLPTEHYGSVKQALTFVLMWRKEHIDSLLYRDSFNKLCPALH

SEQ ID NO: 944268 - protein, 129 aa, Homo sapiens
TTSSALGTLAFSTNMVRNMVKFMVPGPSSIMSIKVCPSGILPYISMHITQMFHVDKSISVRISHVEGLYELRNLCLVKHGYHIGCCPFRTHDGGLDLRPYARHGGCLIPTPNNRIKVALREVTNHSKER

SEQ ID NO: 944269 - protein, 54 aa, Homo sapiens
MTGQAKSKHSPGTLISALSIPHGLVGMPILFHTSHISLKLAARIPFRCPSPKTF

SEQ ID NO: 944270 - protein, 74 aa, Homo sapiens
RQSALDNATLAYVIRTLSSYHSGNACTNKGIGSTKYTCMSLSCQVCKTYSSSYSIARRIVLRLIYRVFTPRTAI

SEQ ID NO: 944271 - protein, 104 aa, Homo sapiens
MSYATTLLCTQGVPKHAFVGFLSNVLILQMMQVSAVIHFVPTGVTPVQSRHVMRSLMICHMHTVSQDRATPRAGVGLPVRHTCHRSPEKSLSLYIYTLLSRSGL

SEQ ID NO: 944272 - protein, 45 aa, Homo sapiens
MSCNIAALVLNGGSGPLAPLLLITCYVSQKVAPCVRVSTTSTNTV

SEQ ID NO: 944273 - protein, 146 aa, Homo sapiens
MGQKLARTTVKRPVKNLQSCMLHCGGTGCALHFRKDAYHVPRNVGVMIGDDRVVHEGLSLPGIDHLQSPLRHMRKRVYEDDRKSTRCSYSYTTLTQYCDPTYATYHHGRCSTSMTDASWAGDKLASSIMHKDHSHKRVYSSYTNKL

SEQ ID NO: 944274 - protein, 103 aa, Homo sapiens
VATDAVIHNHALGQQDTPYPTPIIFILKGVLQPMQYSYEGDVKFYRVSRPLLLTCKVFADIQYYTVDYTYLKETPSLVNDELGRLNNLCENRGQHKDSLFHNT

SEQ ID NO: 944275 - protein, 141 aa, Homo sapiens
QHTYGAILCNSVAHFIGVSPECEFTWEQLEQLLTAQSNPLCCLSNHRIHLMVDANTTITRVPRMASLATSNVYNVQPLSSCRLCLKVCSCRSLVSSLVRRNLEMKVSTSRDLAYHGGGPCVEGMHGACVRSRPGATGTRPR

SEQ ID NO: 944276 - protein, 139 aa, Homo sapiens
AVDLVEGLVEKDHTGDALVDESVPEEEDFSELPAVLCSVCRLDPRQPVRHGTDRFMCSQDRLSIGNNALGNFESSLLCSWVRAEYRWAMVTGSLGDKSPPIYQELWVRQQLSLSLSLSLSLSLSLYLSLSLSLSLSLSL

SEQ ID NO: 944277 - protein, 117 aa, Homo sapiens
SAESALDSHCAYTTIILPSSFNSCKSQSPSTACSFSCLTLHLATGVGSSTWQVVSRVSISISMQLCGRLLRPHLLFINMVHGVYVSPRKVLIDVVYSLQSCFLSIWIIAVRLSINQP

SEQ ID NO: 944278 - protein, 42 aa, Homo sapiens
MNNPRKDQYVPCGTLEWLNLSRLVVAAARSRDQYALVYILSM

SEQ ID NO: 944279 - protein, 33 aa, Homo sapiens
MPAVDHRITVAYLAKWFTYCRCHADIHKLRWGT

SEQ ID NO: 944280 - protein, 108 aa, Homo sapiens
CFFQRVDIKNPRPAPKNFSPQKIKAPRVFSWPFFPKGVALKGFGENLGLTPLTNFKVNPCPGISRRANLNSACKNQVWPLKKGKFSFPFSKGFPPPLYSPLPSLLALK

SEQ ID NO: 944281 - protein, 102 aa, Homo sapiens
HCSPPGREFSKKYEATSRWLLATNIPVEWGHTWVQFQAHLWPWVCYIILSLSFLFSINPPCKCVLKIRPNIYLECLAHSRSLIAALLTILGAYNSRHRMFQQ

SEQ ID NO: 944282 - protein, 65 aa, Homo sapiens
ELRNQGDCTLSSFGKLEPPFIRKVIELGTGQAAFTSSLQQSVKQLNFSKEKESRALKKMVSGNFK

SEQ ID NO: 944283 - protein, 132 aa, Homo sapiens
MIKVCGMANHLPLFILVRQNMCVLDTSLVIYSPYSPLIVKPSSRIHLSVAVESSNSSGAIIFTHKGFIWFSIIGYVGVAKQFVRTGTLIPSVMSQYPQTYNIQDINGHQYEDRGLDVPPHQRNLLGRENPNC

SEQ ID NO: 944284 - protein, 76 aa, Homo sapiens
MKSSTNLLSCPEYVVSYSLRVIPEPVLSSGTVLTFHISAWYMSPASHSLSVSTRSNRTPQAKSLTHTSSLDLMLMV

SEQ ID NO: 944285 - protein, 51 aa, Homo sapiens
MDMLGRQYLFAQPSAYISNSTSGDHLYVSAVNVPHKVSIACQSRLVVSARV

SEQ ID NO: 944286 - protein, 118 aa, Homo sapiens
MVTFTYTPYSASAQLLSVLKISSRIPGVLIQVVFVIGTASIAIAGVFLVLRHASTEGVFIQYGLHPYRALRCLRIGDCAAFIMPYALVLVSHSQHGTLHMVSKFRIGISPTARNITHT

SEQ ID NO: 944287 - protein, 72 aa, Homo sapiens
LTGVVGRDACHCEVKAWDSLPGTCKRLSLGDESGLSIARRTAPIDIMSAIVDNSLQMLSRYFGHVYTLGLNV

SEQ ID NO: 944288 - protein, 123 aa, Homo sapiens
MLACSCGSHFWYSSANTESPAQVIRYATGCQRLFLSSAPRFLNTSTTVVVVLIVYFIGVLTYERILQCVIRYLLQQLIRFVYSTLRLSHRRFAFLARMGTAFISSHSGPALLNSALICLGQSH

SEQ ID NO: 944289 - protein, 47 aa, Homo sapiens
MASMVAVDGDRSIYKSVRQVAGNGLDDGEALRGRQRRKSTDDYSRSC

SEQ ID NO: 944290 - protein, 126 aa, Homo sapiens
CIKGTSLNSINMGLTWVITIQLLYKVGQYIASQLLLANYRECSHSLFFILNVTQRSISSFHAFERLINDILGMRLLAIVLSYDTCATIHFTRFHLSVYFSKAYPVSCFVLSSTLIRLIWWSAQSLV

SEQ ID NO: 944291 - protein, 117 aa, Homo sapiens
FFWKNNEHSPGIYSQPNLTQPTTVKNVLEHALIYGRPSTEIRYLEDDPLEAHIQLKARINLWIMLTKKKRKETDGHKSVTHEQILGMHKYGKKPVVVVRTQTQELTCEELSAHRVEL

SEQ ID NO: 944292 - protein, 78 aa, Homo sapiens
GAAKASALMMSGTLLVIWTLAPVRCAVLLRSRFTIAQIHVSHMDIRSILCKALIHEVKEILCSLFTFALSKREIRLLI

SEQ ID NO: 944293 - protein, 87 aa, Homo sapiens
VNYANLIRWDYFKGKSIVHAACKGATKYAEPLEQATCNILVPARTKPLLKGTHWSSLLKGGPGIRMEGGISSRDQYTPVIKTGLTVQ

SEQ ID NO: 944294 - protein, 85 aa, Homo sapiens
TSSIEDSDDQAVRYIKCMGIHWYVSGTGMRGENPPHDWMRTQLHWLPYKQLLAPDARTYQVLTELDDCGSHGHLGAQCDTPRSEV

SEQ ID NO: 944295 - protein, 86 aa, Homo sapiens
QVSHCYVGNLFANLVMYFEIGQLPVQTVQSSRSIYGRKCCDATFVSPTSCTYLPKERRKWYQVPGVAAMVMCSDIIGKLSGPALKV

SEQ ID NO: 944296 - protein, 125 aa, Homo sapiens
IGNHCASLVMRFVIGHATRSTRAVFLDNKGRKCCVATFTSLIRRMVFVKTVYNGINCRVCWHGHVYLTDFGKLWRPTLKVYSSQHAWSTWYSPVCVMHTYISLVCWVAFRVPEATQCWQDHRFNV

SEQ ID NO: 944297 - protein, 80 aa, Homo sapiens
RRVYYNKQGAVFSWGKSYVEIIGKADNNLSVIIQGWSKSGFCNTTNFMRITSRFRAYNLTLIMRVRKSRSERSSSGFLFC

SEQ ID NO: 944298 - protein, 141 aa, Homo sapiens
RVLRRVKASPSFNGGEVDDSVIVRADHLAFSVSQHALEGSPRRLIRDCLDVIIFGGYSRRRLRSTADTLAVGTRRAISVSFPYSSGMPMLHSFGSASIGRDDVLESPPAITSQFPYRPSTVFSLTVTAWTVVMSPSSIPQV

SEQ ID NO: 944299 - protein, 76 aa, Homo sapiens
LDRKKGILIFKHKGAFLKVQLPLIHTNSRPSFAGGASVQEETELYEPQSVMCQVQIVHPEAARISGSSCCTYGSRG

SEQ ID NO: 944300 - protein, 112 aa, Homo sapiens
NPTPTGPKRGKRGFNRGKSGPILKIFRGINCRTNCMKLWFAPKISKNCPYYTPSHVTAKVVLFNPPGNASIFKPNGGTAYDRKTTWDVKLIQWGLNREDYLMLMQRVQGPSV

SEQ ID NO: 944301 - protein, 114 aa, Homo sapiens
MRNYWRNTYQPALSLINKRNLAKRLCHSYVLEPSVTEGITLSVIWTLRRDCIDIPIGSLPSLAKRLGHEEQTGALRQVKSNQVLTWGQFSLQRGPGSYLVMCGGVDMTLGIYMH

SEQ ID NO: 944302 - protein, 59 aa, Homo sapiens
MVPSDSWAARIAFPWATMLWAIFESSLFCSWVRSGNRWAMVPGSSREKSRPIYRKLWVR

SEQ ID NO: 944303 - protein, 79 aa, Homo sapiens
RGSTLFNYTEFIGFMGNFCVNWFPLWSSRIHQIEYVSHPPLYVFVQLCHKNSVLIQLLIGSSSGLAVLRCACRCQGIFS

SEQ ID NO: 944304 - protein, 113 aa, Homo sapiens
MYEPSRSPYLYPKRSDSTCYSQCATSYPITITQCKHSCVGKAIDIKVTCFLMLCALSDIPSTLHIPSNFISPQHGVVQACAAYCGDKRFEALKVTLLVSPPVRLLHGAPLTPE

SEQ ID NO: 944305 - protein, 133 aa, Homo sapiens
ARFWLHNELLCMEKMFFSSTDQFIQYLLQLLRIAVTRWGTELCIVLDYGLCPAGAHGVHASISTGDGDHMAALTSGKNCIGQSRCGFQHSVSPAFLVTDAARKCENSSQGENDGSSDIKPMFSLDRLQFSSVS

SEQ ID NO: 944306 - protein, 131 aa, Homo sapiens
NPVLEFFSASCMRLNKKSCEVPCGIGLQRELLVIRLSGYKVFQPCQHLKRLVLVVLQGVSSRKSTSHRVALWRLAVTCKFPSIMRHSQRHSLSLESKLVPKDNVTEYITDCAAQEHGRPDSGSASALEGVY

SEQ ID NO: 944307 - protein, 135 aa, Homo sapiens
PAKWARVVSLTGPHRGHTVPQCTSRSPAHVLVCLMSHSWLNITFSKATFRIGSLPVPLVSPQLAFSHLVPEAHHISFRRQPAQAHTLVQGHRSLQLEQHNLESLRAHTASWLLGPAVGLALHGVGSGTVCTNTSR

SEQ ID NO: 944308 - protein, 104 aa, Homo sapiens
MTKQGLSITILTRSCYICWNLPKWYPNHLTSWCEDPEDHIPAGDQLDLYQGAANNRKGDAEDATYGGLNTLYTYCPICGIICKTRWPKPFNDTRPKKNMDLKLW

SEQ ID NO: 944309 - protein, 70 aa, Homo sapiens
DKAGLECHHLDPLMRTFVGIKHIGTLTTKRVGQRPKDHIHDGDQLDRYQEAANNRKGLMLKYHLRQPEYM

SEQ ID NO: 944310 - protein, 95 aa, Homo sapiens
SYIYTGSGLVLKTTAGMSVFERARKPLKPYGEPPCPACLAGYCPGSPLCGVFDNNAAVAKGTDYHWSQDSIAGCHGRKPLGSSTTTLRKAIMAPP

SEQ ID NO: 944311 - protein, 112 aa, Homo sapiens
FVYLSAIFRETFQIRISAESSSTKYMGQHSHNTDLVLLTGPLANVLVNILNQLRRWAVIRNQLKGPGLNVGSCRPTVIIHRRLAFLKYLDDVGNPLIRYREARHVIDCSIHS

SEQ ID NO: 944312 - protein, 117 aa, Homo sapiens
MCVAPGPEVVACEYHLCMLMEWEDAKCLPVRFGVYFHLVYPFPRGKWLPGVISSLSEHMHGHINARTASDSIQTFDHQSTLWIHRACRDSLRHKSQYSETEEEQTMRSHPDELVPIP

SEQ ID NO: 944313 - protein, 115 aa, Homo sapiens
QKLLQSQICGFPEFIVFLLEEHLLKSHHPPGLGAQRCCSWEDKSVRCRAPLLNTDSAPQSEERCTYECMEVPALCGQLGTLTRPGGTCDSRSEVKSFRSHSRLDFPISQYVSSAL

SEQ ID NO: 944314 - protein, 100 aa, Homo sapiens
CREEHLFGLTYFPPRSPFPQNVYEQLSVAVLLVEGCVQKDRTSDDMVDESVHREEYFSELSSVLYSVFHPDPPQSVPHGPHPLICSQHPLSIGNNALGNL

SEQ ID NO: 944315 - protein, 136 aa, Homo sapiens
LCTKSCLVLASSFWYKYNHVSHIPPATVSITFARRFPGEVSDHRISVCSPAFHIVPTGKKAKSLHDVRSCSQEFHVKLANCIWVYYRYLCSPEPSLHITSHLQSNHKPAISNLRLPTVQALQNPLIGPWVSNTYHG

SEQ ID NO: 944316 - protein, 79 aa, Homo sapiens
ALYHQGTARIIAALSGKKESALVAKSPGVMFVNSKLVIWSQIRVNTQPKNIAFILSGLTGFRFQVKPETLPVRVYRYLC

SEQ ID NO: 944317 - protein, 43 aa, Homo sapiens
MLFMCISQFFKPMSNLTLVCISTTHTPGLSRAREKKKANKGYP

SEQ ID NO: 944318 - protein, 111 aa, Homo sapiens
PTIADLIEHETEDPGQLHRPSKSHQGAHQHQHRGPVCPQAPYQYLKCVEDAPEYAVGLIENSVLSQHMLHQPEDPCPTVKEKTREHLMPVPMSQSARYSRSRARAAFTYSA

SEQ ID NO: 944319 - protein, 224 aa, Homo sapiens
MGFKFWAIPAPALRESRCLLNIHPKHSKKPSLPQQCFAKLLSFTNQQLRSQATSHFFIFHFGKAVGIFQQRFFPGITSVSLKTESLISQDILGKSALFISSIQRFSMTASRVALVRSVTTWKRLQTQLWESLLKPSYCPCCESSFSKLLRLAHLSLCWQAKPSLHPKVLRAWQQQASFISSLQPFCKSSFIPLAKKKEFRGIKVSMSSGKFHISIFSKNVIITV

SEQ ID NO: 944320 - protein, 55 aa, Homo sapiens
MQDRIIGVHVTMKELCSKRTLGGALSVDVQIHERRAQPDGPCGPHKPQGYKGVVC

SEQ ID NO: 944321 - protein, 145 aa, Homo sapiens
MPHDTGSVAKKRISATSEFLLLFLRPFGVQELLISVIVGTGHLCELFQKKLHYMKYPKTCCFQTHESLVIGDVVMHIVDQFREYKIPLRLEFICPLPLVLHGETVSPRECLSSQCSPGPDSSKALSSAAAALSMSSGRGGGSLVP

SEQ ID NO: 944322 - protein, 92 aa, Homo sapiens
EGGSFTELKRVILVSMCAVATKWVGMSSMKNFDVNRRSTKNRDRPVSPYDLSLCEMHSVSPLYIVPNVLSAPNVYGYVIPDNCLETHSTRVK

SEQ ID NO: 944323 - protein, 118 aa, Homo sapiens
ASLIQKKETVSQKTTHCETECVRPSTHKSLFVTQHVGSQDRAGGTADHFHPPLERVLASRPKVVDVALKVQLEHVVFLNVLGLRGNGKRVPDQSQPAKGIIVLVCFVEDEFPQQVSRH

SEQ ID NO: 944324 - protein, 109 aa, Homo sapiens
MVAHGLIIVQYIQHYDFDPIDSRLFQYDIRQLFQQHGTMRYQCCVTLMSVAQALSSSSLFKSYNLWCSSGYVYFASTFLVRGVCTECVTVVAVAVRVNNARNSFSRSSE

SEQ ID NO: 944325 - protein, 45 aa, Homo sapiens
MTLGYNGRSPPCGTDIYVPQASVPIADTACGSMASLSAHSITLEW

SEQ ID NO: 944326 - protein, 56 aa, Homo sapiens
MKCSGQRAGPLCTNHAKMPAITRFHRYNGKMGKDAILYHPIYLASGGQWSSPRNTP

SEQ ID NO: 944327 - protein, 141 aa, Homo sapiens
KRGNETGSPYHSISRVHPSEPSGASGSSPVISSLAGSDHELSSGLLLYRVQCSCFKVHRIGVPERQVLLIQAPANSLRCIRALWLQSKSVRQCSLASSSCMALPVCCGTCISQLDRQDLVSGSLLWFTNVTLSAVSRRPDH

SEQ ID NO: 944328 - protein, 44 aa, Homo sapiens
MQACQTLVPLALSPGSCSQCRTALPPGRYSRLNGGPASDAQLRL

SEQ ID NO: 944329 - protein, 94 aa, Homo sapiens
KKSEKEKVKKEEKGEERCGEEEGDERKEEKGERKEEDKNGEEELGKEKEKEKRREEEEEKREEVWGRKRKGEKRKGEGEKKLFDEKGKKEEKEA

SEQ ID NO: 944330 - protein, 133 aa, Homo sapiens
MAKRKGRFTRLRSGTGCRPCLCPQGLAASGMQQAELAADSAAYTELAQCPTSSHPVPWQQTCTEATKTAPVHLEVGTMNIWPEMYVQYLDNDFETLLQALPPYICKAGEALPVGEGGLPEALQGTSLSIAPTK

SEQ ID NO: 944331 - protein, 119 aa, Homo sapiens
EPKNGSEDRPCDALMGPFWGIKHCAYCNPYTDGAENSIDHICLLYQLYCYQRAANNCMVDLEIKFTSAWIHEILPAKPGNTFEGPASLKLFIIPDAKKRLPALMETTNEGWICRPFTVA

SEQ ID NO: 944332 - protein, 129 aa, Homo sapiens
MFGLVQTHTYNGGEPVDIHQLAAINRKGPFGLYTKDRVKPCDTSGQVRDSMTAATGPIALIDHGRTIEKASPYGYVDIWVRTCYPENVRVHKSWNSMGHTQMKGTRGPVDSLDKLGMGNCGNLSIFQKD

SEQ ID NO: 944333 - protein, 116 aa, Homo sapiens
AHYTVHQVKLHSVIGVCEGVQQVGALAPVNQVTLVAKNDDAHEGGFDRLISTMYCQQIEALCPSYYMAYSSQTSYASLLHSIINSTSGDHLYVSAVNVPHKVSTACKSSLVVSARV

SEQ ID NO: 944334 - protein, 116 aa, Homo sapiens
AGYKAALTWPGLLLMMCMLSVQNIVIFAMYNVGLTVYVPMQHMESDGCGTCPEGDHNEASAIKVWLQVVVRPEQVRVLKELPVTHGSLRVSQLEGVQVDKCRARRCIWVRLGGGDC

SEQ ID NO: 944335 - protein, 100 aa, Homo sapiens
MLYTSSGLLFVITDSALGLHNFWTDQGSNDLVSHGRDPCRRLHRLSRSHHYVARTSMEAIDTERSIKWRVNKSHEIGRDYHEALRVRHRSLLMYDPSKKC

SEQ ID NO: 944336 - protein, 98 aa, Homo sapiens
MVLGCRPLNCTMYEQLVNSVWVYAAPEDTVVTTLSIGRLAVSYSQLHKTLMGALRVGIHACPGNECYVYKEPYIRQSYITWLWQRAKVDSVISMWLSS

SEQ ID NO: 944337 - protein, 131 aa, Homo sapiens
MNSGVKNLRSGSTGRRVSTMPGFGGGWSAPGSEGPVLCGGTGPAWTLQAIEAAGGSRVLAAWKPRPRPIPAQCAAPMQAAMPARVEFLQSGASASSRAAAPPVELLRVFQISAARLLPLRPRSANIPRARS

SEQ ID NO: 944338 - protein, 110 aa, Homo sapiens
MGDSWHGQICFQSTNCGIRTAIACCHRPWMLLNLRGPVISDVSKGQVAICLHIALLFCKFVKQVSLSQYGGPSSTPPRVCPFDKEAAIIPMVLHLAYMLRQFCLLHLICS

SEQ ID NO: 944339 - protein, 138 aa, Homo sapiens
INNHAGAIMKTSLGALMKVVDGPRAHKEDPHVRVCVDASGQKELAGGVEDSSAPQERLRKSAGRARVTYHAVLNQHVDHLRKVIVDHATSTDQETRGRRHSEGRAGSYSDRTAHRVWVGRPGRAWGALLQGPHRQPAS

SEQ ID NO: 944340 - protein, 106 aa, Homo sapiens
GVVLRLHEQKSSRAVWQRREEECLNIERSSAGDCQRDQPWDGQTPGEDYLLTPSAFQLPIHPAESLLHHSIKSLYSPSFKSVGPDSSWMLDKDPGTKRTGCKRLPP

SEQ ID NO: 944341 - protein, 38 aa, Homo sapiens
MDTLVDRSYSWSGDILCPMHRYFEAELDVCPRLFSKRA

SEQ ID NO: 944342 - protein, 104 aa, Homo sapiens
YACSALDSLCAVNSAKIIPTFLAMGSPPMVCLEEHGIQAIVCTLSAHAIHSIDMCTVEGHIFKEVLSRVKSRMWLIVIAAWFRHDVPLVPESDILRQVLMASSI

SEQ ID NO: 944343 - protein, 166 aa, Homo sapiens
MGQQVLFVAVPLLHYPDCRCFCHTVLKPASSGAIETDQMLHDLWKSVYGIFEYTKGTVTMINNSNIFIKYKTTTRERYIDSNYMHDLRIQSAGALTSIYTYTKGKQRTLVPYKVARPLLKTLRFIISQIISKITAYLPWIEGKSFLCDQWRNVCLSMENSELGNAT

SEQ ID NO: 944344 - protein, 91 aa, Homo sapiens
WVVISVMQEAFVSSRVLLSTAVSRFPIGFANSVHMCMICLQTGYEVICPSLQISLRHRMVQQMQLPQPRRLHGLQMYPDRDSEHRQSTASQ

SEQ ID NO: 944345 - protein, 79 aa, Homo sapiens
GARALTWLTTMTSAVMPSDSMSQNVIDREDSASEANGEAKILVRFSSLTFFPIKFSACVYMMLRAFYVAVVHALGVTQG

SEQ ID NO: 944346 - protein, 107 aa, Homo sapiens
LHRKSQHPLLKHPGATNEQWASYASHRGWCPYASSGVPLKTSMVPLSSRVVASKLQPSEQRSVTSGSGLVSPSAPFPWALVGGRGVPMPRAQHRLHNPQCTGVLTVP

SEQ ID NO: 944347 - protein, 139 aa, Homo sapiens
NPQTHPGASETPASRPPRCPCHKSLEGPCPQVGTDGHSRSRWRPGSTAPASFWGLPGTEPGSLDLLAHPWGPSCLVVQVALEDLGLPSPQDFLRAPGQLGRSTLFAGFQFPGSWTSGVFLGPQTDRPHKQEKPQRAQDP

SEQ ID NO: 944348 - protein, 101 aa, Homo sapiens
MGVECEISLAKSLNACSGLRAPVVLVFGKRLLLLLLPPPPLLLLLLSPEAQAADPPSPNIGFTSTSRPERYLKNHMELEKPTRESSTAASTAQDPPLRQRR

SEQ ID NO: 944349 - protein, 125 aa, Homo sapiens
KPLCTDITLMRLYACVNSHVAPEMVLHCEFLTADPTAVSPKPHTDKDTAVSVPENPKWNASSLIPVTIFNILTCNLLQRTASCLCPIRFPSDLSPEISSHGRAIEIHLLIISAFISVFIKLSFHF

SEQ ID NO: 944350 - protein, 125 aa, Homo sapiens
SSFSCVGVRDIRTQPLWLWVGGLGCDSCGLGRGNIWRSRRVCCRCGRVRGVLLARFVGLVCLAGPDQRFFHRGEEGSARPPLRVGLLGPLAPISYRWGWKREKSPVLCPYSHHVSHCERLSSPRA

SEQ ID NO: 944351 - protein, 81 aa, Homo sapiens
MGLASTFIEHILRLVTIPVFIDTQVGSQASQAREECFGISVLQRLDQRYTSRCTIVSAVEYNALEKQFTTHAVLICMLSVR

SEQ ID NO: 944352 - protein, 127 aa, Homo sapiens
LLYRFIDEAATGFRDNSKVLTADPSGIASYDQARLHCRFSKSGFAQPSYSYLWAGSWFPRQFVSSVRSVDRALQQMLMAAHHVFIGNICEYTVEAMAGEALGTLRLRKYLEHPGVSSLSEKLETGTR

SEQ ID NO: 944353 - protein, 120 aa, Homo sapiens
ESFIIIIWNCHLNDFLEGLLEKVLSLIAVSTHFGLFNDELNFGFVSKYLLQPRNAKSQWSSEWHTLSVSLPHKMSSGKDSNNASGTFTACLSPRASPHFSLKRFSTLCYRSVILALQASK

SEQ ID NO: 944354 - protein, 140 aa, Homo sapiens
RATVSGYSGEKRLGNLTLMPWNISVLVCKASTVVALTPGQSSSPQGQALHEGEGCRFECPVVNGTGNARQCQHEVEAHDVAILQLQHTRQKALGGPELAQGVNVLDLEEGIIITVHEALHMDRGGSVHQYGDVTHFLASG

SEQ ID NO: 944355 - protein, 137 aa, Homo sapiens
MNRLIPLVSDCHSMGMFSTIDPPPATRINSIDISFRRLVQLGSVICIHIANDDSLERLRGMFRGLHFLKVRRTVTYSLSPKIFFPHRFLSHNFGLLVHPAGEVQSGALSGVELMILLNCGDISVSVQELEHRYSARH

SEQ ID NO: 944356 - protein, 75 aa, Homo sapiens
MSAYSVPDKDDLANALLLLGLNRSHCQQPFGSARQPSAAGKGTAHALHVWPQADPFDRETHTLKADLAAISGLMA

SEQ ID NO: 944357 - protein, 117 aa, Homo sapiens
APAENPIWVSSLLTAIYLPLRYDCTQLSRLSFCKGPRKKALTLDALAEWTCPQISVFLGAAVGSLQCSAPCCSAAGYPWHLQIETFLSRAHVERTKMRWDSVTGRMGDQSPHRYVSL

SEQ ID NO: 944358 - protein, 128 aa, Homo sapiens
KKCLGPHGRSRPINESRYMLAMIQRDFIGSMTRALTVVLAIPLVHVSRRFLSTVGAAVNVGISLPECQSRLHHGPMLMRCTRQVHLLGESISGALVVQGLAVSAHGPSMNSNLLFARYREARHEFATD

SEQ ID NO: 944359 - protein, 78 aa, Homo sapiens
MAVSHCTGSLVLLWVLRLRLILQCLLSWVVCVTAVCPLLVQSGWSSLVTSLVVAAMVRRCIVRDSVRACREIERERES

SEQ ID NO: 944360 - protein, 146 aa, Homo sapiens
KKRKKKKKEGRKKKGKRKKKEKKEEKERKKKKEKKREERKKEREKEKKERKRREKKKEKEEEREREGEKRKEKERKRRKKKKRKRRKKDKKKERKKEREKRREKKEAQKKRKKRKRRGVSGSLSISLSLSLSLSLSLYLSLLSLYS

SEQ ID NO: 944361 - protein, 177 aa, Homo sapiens
VLKKKIEGLQQWEPSNLSKLIRFSKVWPCVGSSRGRAIDVIGPVRLLHSNAHCGKDNLGPTPRHACHAYLDLSVDAMVNYPSDKLLCIHLAMAGGPLRAIKSLTTIVRPMDVRNKVSVRESVRAYLGHVQIGLKQARTVAVAWQELELHAAQRTLGGRLQTNVNAQGFYPLCPPGQV

SEQ ID NO: 944362 - protein, 137 aa, Homo sapiens
MSCASLLYSIRYELVNARWELLTAYISIGSWTAPGYKAPVRNVKYMHDRTQVLIIGSVIVILGHVQEGLQQVNIVVVHQQAPGAHTTQGALTDCSVKIRLSLDHNPYTARHTRAELDRSAPYTCTGDTAAVGLRGTA

SEQ ID NO: 944363 - protein, 132 aa, Homo sapiens
WSSRVEVYICKSLKAGTVKYTPLVTEGSSEPSEQPYERAEHGHQQQSEGSPCPALLQGFKAGAGLGLLSLSSSGVVQKCGKYSGSVDSESDIPRDMLIQTLRQPEKYGHTVGKLRYRLRYKDNVAVGMVCAD

SEQ ID NO: 944364 - protein, 111 aa, Homo sapiens
RKNNDKMSSFFKLHPIVAGDLDSCEQQDLSVPPGTEINAVLLVVIPIAMVFSITKRRIGFLSWNHFFCNILPNAGLYDDHGIELSVYKRNNCPCCYHRDLNSLLVSPHLDF

SEQ ID NO: 944365 - protein, 202 aa, Homo sapiens
WNLCQLSYLFDKLIFLALQSISTFGNRKASTSSSVAYRHVCLLPLSYKHDLNNVLPMSCDTVTFASTFGLTNSFSISLHTLCAGSLSFLYASCIAMQTPFPVWVTQLLATVLPKTPCRVFTMQLHFRAASTASDVFAYTVTSQSIDFMITTVPPSQTVTTDCRLKPSGIIFCRIVGAMNPLTSVCFQPQPGNAITRSQCIRL

SEQ ID NO: 944366 - protein, 113 aa, Homo sapiens
MASFGTSLGPDLGGLLSTQKCHVTQFHFGSIPQSAESRDSSSMPSHVTAAPSTAAKGEGNPHVHQPMRNKLSVPHRRGATYYSALKRKKIRTHSTTRKRLGVVTPSGGNQPRD

SEQ ID NO: 944367 - protein, 123 aa, Homo sapiens
PQIYLLVEQFYFSQEGRCSWRNQLGKAGEKRNTHGGKIPASQRGKGAFSKITEILLMGRMKATSASQGKQESNLLPRHTLDPEFWLFRPDRHLFSSAEMLMFQVENCDPISHASLNLKSAPPV

SEQ ID NO: 944368 - protein, 203 aa, Homo sapiens
FNNKNGKGDFSKRYKGETPVFSSAGLEPARLFEPPPQGGLGAGPPPRFFFTTGLFRGHSSAFIEPKVVGTGSLALASGCSRGQVGLKHNGLNSSVGGSLCSKSHKIAQEVSQFRSTFLEEGCQLLLFLYKVRLGLGIKLWALHLPQQVLTIVSRGLKVLRNQALHTWLLCLSQKKSSLKSADATQQHSSESIFMLARAIFLQP

SEQ ID NO: 944369 - protein, 119 aa, Homo sapiens
MERGKVASARELVLVVQQRFLHRLVAVHHHHALRAHVQREHRPEALGNREGLGISSIPTEKVPDDGKLEKGLGADSKLLCTCLHMDTSRRKPAPTSRAPVTPRPTWGRWGLLPAGRILK

SEQ ID NO: 944370 - protein, 167 aa, Homo sapiens
MLFQRPGINDLRPLWSVFPLNWFSLSRLYSCKSIVHHLLSYAASPIEQSFIIISPLARRAQIPHSVNFYNMFYIFGVNMMSFKKSAVTRAFQCKQLLQVLLEELRVSVPLLLELVRGGFGHHLHPEGAKAAVRGLATAGQLVRLAFAPGAAARPGTANLGPRLVLNS

SEQ ID NO: 944371 - protein, 152 aa, Homo sapiens
ALIGVETPHQNASLGSMNLANKQYYAIPRSRVFQGPWYSGNSRRFIRVGWGARIAIITPSISVIFRAPFSGIWCLPSGIVSVIRSEEQSDVKSKEPSFSHQCKRRSMSAQPAVPLQVFIEMWYFVGFILDRHSQKMSVYLDSCLQIMQSMLT

SEQ ID NO: 944372 - protein, 90 aa, Homo sapiens
MFYILGVNMMSSKKSPVTRAFQCKQLLQVFLRKLRVTVPLLLKLYRVVLATPPTREGRKPPSGRLAPVIQLARLPLPQVPPPASARPSRG

SEQ ID NO: 944373 - protein, 73 aa, Homo sapiens
NLTCCGNSQESHKHTVHQDWATVGKTDRLSPFSIVRSAPTGTVPHIRISRETTRVSQISVVLLSASGWSNAAI

SEQ ID NO: 944374 - protein, 157 aa, Homo sapiens
VYTYEVSSLPADSSDIILVIPLSTSASNATTQFCISISRRQKWILSNEVTFPRSAEPSPGFTELCSLVSSQINVKSSDYVLPCADRKLGIKSETDVIVLDCHSHRLIDDYITLVHLTTRYVSPYSAINSMQLRLPYESVIIVVNFFAMIIQCFNVAI

SEQ ID NO: 944375 - protein, 93 aa, Homo sapiens
DAVRKCTDMRPGACEYNKVGLIKLMVRKRHSYKAWAVMVLVLMWAVRTINPWDRLGFIISRRHDVRDSSELVMTLVYCALLIRRLANGGGLIY

SEQ ID NO: 944376 - protein, 114 aa, Homo sapiens
MGTPACEYKNRFHQAMAQETSRIKAWAEIQVLESTVDTYGFFSSCIDTILGDGACKGHQYVDKTEFHTSPVDMMYETAAYWSYSRASCTSHQAHSKGWRADLLNGVAGHHELVL

SEQ ID NO: 944377 - protein, 155 aa, Homo sapiens
LAPCMLVTTVGSPSTNAQETSPISAHDCTLGLEGTARHTDSSVNVETQYLIMLGLVNDINPWIDWVAYNSERHVVETAKYRTYSRASCNSHDTQSRGWKADLLYWRTRVTQSCIWTNIIFSDNQRCTTPADFIWAAIYAFIESQCLERVHTTGRH

SEQ ID NO: 944378 - protein, 134 aa, Homo sapiens
MRQQRTGLSPRHHANLMTRIAGGGRLISCMANAGHQSCIWTTLVFSDNQRCTTPADFIRAAIYASMESQCLQRVHHTGNHYSVCTWSKHTHFACTISSSISRYCWAHLRYESIGKELTDHGYRPIEGMSGPASR

SEQ ID NO: 944379 - protein, 204 aa, Homo sapiens
SNKKIVGSLSQSPAARPHSANDLLHVLEGSAKIPTSSVHGIIQNRQLLGIVQDLNPVVCMGRINSEGPSYCGSRVPYFLLGIIKTLCHVIQRLILRDSVILMAVFSSSIGISYVFSDNQSCNSPKHDRSTAPYAFTESQCLQSAHSTVTQYIVSSLAMYSPGASTKASPMSWQNWAQLRSECKGTCPHSSCPLSGRGYTWAWIH

SEQ ID NO: 944380 - protein, 111 aa, Homo sapiens
MREPIYTGSAYASMLGALFSYHKVTWGPLGTPSVTHSHIVCSNPLGPCVVGPIEVSGFPYVGPEWKSLLFRPVPWTAVIIFALLFNLLSGVLSIAPPGKVNIVSKVFVHCS

SEQ ID NO: 944381 - protein, 108 aa, Homo sapiens
MPGVPDNPIVCFIRVGAAVVYTIQVCRVTPVNHRARLILFCAVPFIVVMISVPRAEFHSLVTSPPLHLRMKLPRKGISSCPEYPNIARKSLILLDSHSVIRSLSPRSI

SEQ ID NO: 944382 - protein, 111 aa, Homo sapiens
MSFGPRFNNPDVQAFAPPMPGVPDMPVVCFIRVGATVVCTIQVCRVSLVNPAPRVFLFCAVPSIVVMICVPSHKFLQLVISPPGHVSMKLPRKGLSRCSRIFPNMCLEECM

SEQ ID NO: 944383 - protein, 201 aa, Homo sapiens
MFFSASTPLGKREGGGLKPLVEKAVLDGTHFEHGYMGGMESWEFSILNSVNQGGFQRLNGHTGQWVYVGPKSVGRSLIAIDYKESTQQANVGNTFTGFVYSLEGALVEPTVGVSYVPHVSPAARVIFFWAVPSIVGMFCAHGREFNLWVKRVTKIVRMDLTHKAIRDCSGTPLRGQVVKMVYVPVFEIQKRRIGGRYSLGR

SEQ ID NO: 944384 - protein, 212 aa, Homo sapiens
LFFSNPNSFTRSNQPPNPTLTPQPPPPIPLNHLTHSYIHPPPHTTPPPTPSPNTPPYNTPTPPPQTTHNKYSQSPPYSTPLHPHTHTQINTSPTSPLTYPHHTTTTSLYFPTPNSPHPSNHTHHHPPHPTLLSPLPPPPHYTRLTLSPSPKPTPTPHTSTHQHPTPPPQKTKPPPQHPHLHPTYTHPPTPSSYTKQTQQTPHHHHQPHIQTN

SEQ ID NO: 944385 - protein, 236 aa, Homo sapiens
GGRRGKRGGAPRPPVGRGPKGAAGRRAPGVRALCPVGSRRGKGARESGAHLRPGGARRCAPVGGGEARAPPGLGGPPSTKARRWGPGPPPPGGRGFRFRPQRALRPVEGPEARVGNVGCSPPWAPGGGRGRPGKRPTRHAIGLGCAAQGRMGRSEQSPKGRRGARPAGGRREQGDPMPSGVGHEEGDGLRGVPRAGGPACGAAPVPNSPRGGTRSGKRLFFKRTPRPGPPPPPSCR

SEQ ID NO: 944386 - protein, 115 aa, Homo sapiens
MAKKPRFNYLKARGKRESTRGFRVEVEVKFEGKLLKSAKNLARLKKEGYLRFQQGPRVEIEGINLLQTKAILNYIASKSNLYGKALKERALMDMILEGLANLGERILLLPECPPE

SEQ ID NO: 944387 - protein, 52 aa, Homo sapiens
MVHMLCRQGEVGPQVIHLEFHHLPHDHSRTRYKNLELSDSHMWVQGCSRSAE

SEQ ID NO: 944388 - protein, 194 aa, Homo sapiens
WPGGCPPLVPRVWGLPWPRPWVSAAAELRPPSRAALGSRGRPAPRVPCLIIGVPPMVGRPNLWSHALVPRVAFSGVLGAYPFVFLSLAARWGCSLLCGGSRCVPFRFPRFGGIKRCPPVSPRFLGVKGSPPKAGADPACEGGGLWTKGRDRPGAKGAAPPLTPSFFLCLFGAGGAWPGGPGPVFSLGRGGGFFF

SEQ ID NO: 944389 - protein, 125 aa, Homo sapiens
RRGKGDYFRWRLKAGKPIKGPPLVNSTRRTLGSRRFLFSGAKPFLKTYLVRSKLVLDPVYPLEIFNVRGETIRETKMVLRPSGVIWKGMGLIWKLMVPINRFHENRKSIASFRPVWQILSILGIH

SEQ ID NO: 944390 - protein, 71 aa, Homo sapiens
HYGRKRGINWFLKGGDQSGFSNALGEYSLREYYGFAEWLTTGHYKVNMEIMAWGKMEFQIKIRTSKIQGTM

SEQ ID NO: 944391 - protein, 124 aa, Homo sapiens
MRENTTLMPGVADNTIVCISRVEAAVVCAIQVCRVTPVKQPASLIYLWAVPLIVAGKCEHGDEFHHLEKAHHKGNRKKIPRKGIFTRSHNLSLSLSRTNSLYLTLSLSLSVSLSNYIPWCGILQ

SEQ ID NO: 944392 - protein, 51 aa, Homo sapiens
CGGLVVRECDDNLKALSDSPLLSTSFLAGGGFPVSYNRGSLGVRFSLSAPR

SEQ ID NO: 944393 - protein, 68 aa, Homo sapiens
PRKFGHNGLVGDCRHRGFCHLNLDPNLRSNQYNRGAKIFQHSFLWGPPFLGLHGLLTCQANGQLRIRI

SEQ ID NO: 944394 - protein, 128 aa, Homo sapiens
MTFTRLQVCYFAALGGIFKFKSLLFVHEDSALLLGHLGASPFVPLELGGTLTCTEYELRPGKQVMIHASLTSSLLTQWWTMKNALKLKLVAPKPKLKTKSKGKYKETANAPYIHSATYKSKVRLAPKT

SEQ ID NO: 944395 - protein, 158 aa, Homo sapiens
PPKNFFWGNGNKNFCEQKNLHPPLWAGAPLQKNTGGAFFYVPQGKRALSSKGVFSHQRGFGGRAPPPCLKNPAPPPPTNSGTKFWGGNTTPPRPHLHTTGGRPGFPLGGEIAHAPSGEKEKHQGAAPKLKNKSSLREYFPSPPQNEEFLRSTKRGFSH

SEQ ID NO: 944396 - protein, 124 aa, Homo sapiens
NRILMGKKPVSKESRELKGQLLNGSQLLHVRERQPPLLYFFYDGTHSGGGPVSWPKLWHFLCHSGFQCGDFSLIGCTLHRGRCASPISRLYTFVNIFSRWFSRNKLHISCSDTEHSVFIYHFAS

SEQ ID NO: 944397 - protein, 102 aa, Homo sapiens
KRLVSDWSFSQRRQLFDKHEYPRFPPVVSNELLHTILAFFTTRHHACGGPVPFTLRLLVRPIGTDLSGVTPPRVRALCGKVFRLGLHTLFAVNMFNTSLSDL

SEQ ID NO: 944398 - protein, 163 aa, Homo sapiens
MRIACSTVVFYIVLQSRGSVCQTQTLTAVAACQSIEIVDSSVPPASLRQASRAPCLLNVHLLQVFVGGVLIAMVLHLVQVPLLWGEHWIILRDPVADGAILLLRQPHQLYTLAVPLPTAITSWPMRALLLRLKSSRGGPQNSRSSQNPPLLGALNIIPLPSRA

SEQ ID NO: 944399 - protein, 129 aa, Homo sapiens
NSAIMAGKSSACWCWLLEDAAGETQGRRGKVLTLDLEEVKGNILGYKLDHKLKPCAQASRSRWKLPPEAVTMTGELEVKTMAMKPGYTLRITGRIADGTDGLEINLGQGTDKLNLHLNLGLSESTIAVN

SEQ ID NO: 944400 - protein, 99 aa, Homo sapiens
REIRPLWPEPEFLVMEVGKTTLILKSDSEKEKAWFNKLSPFIREIFLNLSMVPYWMEGFNLVTRANWINSLINRLDYLVTKGRIRRYQILSYKGPGSDP

SEQ ID NO: 944401 - protein, 110 aa, Homo sapiens
MDRPRKMKKMNKLMQKGEKPRPLEGGKAPQPAGNLRGQANQLALNFRWAIPNRQINDGMGAYADDMEIFMEGIRELRRYLREPPLRNCMRILMGELSNHHDHHDEFCLMP

SEQ ID NO: 944402 - protein, 112 aa, Homo sapiens
DNFKLRACGLGRFFPFQPGTFAETMLGRIMGQARRHPTWIPFLELMGTGATGAPLNLWRLAWLNPKVGGTRITPKPWTKRGPKDHSRFYSGKGDTSRLKEGFPEATSDQFST

SEQ ID NO: 944403 - protein, 113 aa, Homo sapiens
MVFFEKNHPFFGFKRPKLGRNDEMWCSTLMSFLRARYVQDLLLLLLMMILIATICQYLLHARHCTKQVTPGEEIYGTDINELGITLLGSTGEGNSNHGLSELYNCYIYLEVCL

SEQ ID NO: 944404 - protein, 87 aa, Homo sapiens
WRGLSSLLPLVSGSLSALRLQLIMVNLLQIVRDHWVHVLVPMGFVIGCYLDRKSDERLNCLPETKEVIVYFKKGGICQPQVKKFTWK

SEQ ID NO: 944405 - protein, 47 aa, Homo sapiens
SVAVNQRAFNEVCNPTHIGMTMTRMILKYYDAEIVITIRLPRKTVKP

SEQ ID NO: 944406 - protein, 71 aa, Homo sapiens
QVTRNTFTIGRHGRWRQHAAIYRSMYADLIIAMTMTPDDTIIPEVDTVSRIRITQKNLSSQSTDRKGPFLL

SEQ ID NO: 944407 - protein, 247 aa, Homo sapiens
CHVASKWITCHHLLFKTVYLLKIYPCKWVKLLLTETYTECKGNLKYKLATQDPLDTWKYHRVHIKRISKGLLRKCKEKENRVNHRINLMINGRSQGIKAKFIMMVMEIKELPHMDTQTIPQLRLPKVSYEFSHLLHENFHIICICTHPIIDLAIEYGPSGFTICHRADLLSILHKLMHLFNFLAYPCRLLILRISREVHSVTLASRPGRFSRPNATRQVRPWELPWPILEPGDRVKRPHPRLQFVLY

SEQ ID NO: 944408 - protein, 134 aa, Homo sapiens
MASGGFVRAKSTDTTLELLQMSACIEDIHLYLASQTCAIAETLPSFAHLEVTPYATIALSGNCKTNLNNVIEGNLDMVKPAKLAKPLRQRRLANPKACNESGCSLTIGRLHMDLTVSMSYRASTDNCQDHEVQT

SEQ ID NO: 944409 - protein, 108 aa, Homo sapiens
ALRPGNRRSRKGRCRFLGGKVRVPTFRLIWKVLAPASQNAREKPAGGLRPVEEDDQFEKFPAENWPALNEDEDAHVWKDNGNDAIVKDDFFNKFRPDLGNLGYKRETS

SEQ ID NO: 944410 - protein, 67 aa, Homo sapiens
RKFGHYGRKDGLIFEINGLTNFTIRFRVPFLTKFWPTLVIFGLADNTHFKGGKGKSNGAFNWNSPDN

SEQ ID NO: 944411 - protein, 196 aa, Homo sapiens
MEVVCIYFYFGPQSKYSKRCTRIRTFYLTQGLAYFAQENNICQVGPSLSKPERPFALKSIPTPLSSTGLTHPPHLHFSPLPSRTTANVYRRTSVSLPLPPPPNHPPFISSPSSLAHKFSRSPSSTIITVALFPLSPVRPTTRLHKYKASSYSPTLLFLTSLSHCPLILPLFPHTSLQLHFLLPLPLSPFPSSTYSY

SEQ ID NO: 944412 - protein, 69 aa, Homo sapiens
DPGNSAIMAGKVIEKGRELVAGPVVVMVARSLNPTRGTLRANRLFWVLIKKVLLTIIILMAKVPNLGVK

SEQ ID NO: 944413 - protein, 182 aa, Homo sapiens
PFVGVFFSHKPPCLPPPPPRARARSSFFPPFPPPLSLLEAPFPFSFPPVASPPPPWRRPLPPPHLSPLPPSPPPFFSLLAPPPPPVRPVRPPSRGRLWGRPLYAAAPPPPAALAFLLPPPPAPASLPPPPLGPPPLKSLRPPSPSPPALLLPPPGPTPPPSRRPTLFSSRASPPPPPPLPLS

SEQ ID NO: 944414 - protein, 124 aa, Homo sapiens
MAGAGPQGRSPCLAAFPIVPTLKLFEEPGLLLTIGSLEGVWVRKQAREPWVWEKVRSPKFKARAKSNFERSRDQLPPLIRKAEPERVNFWSYSGKLGPQPATQGRVQTMAFQPKLAFKPPTGQS

SEQ ID NO: 944415 - protein, 103 aa, Homo sapiens
MPKGRVLAKNLDEEGFESEDCVDDDNECMGGSDAGMIKVMNQLRFLAELAYELDAHDAPESSQQAPPKDNEISTSYNACNVHSPLKLINSMVISGPCCFIMAQ

SEQ ID NO: 944416 - protein, 165 aa, Homo sapiens
GPKIVYYKRNPTKMLNNLHRDPGPGHKGPIPGNQHNGALPEKKKKPPPNLGAWGNQGHSCFLGENVVPSQSLKPYSFFAARFHPKYPLKFPRDNPGKPPHRGICSKKPPPTFSAYAAPPCDVNARASLSILLGHPNTLGIIIGQRCSSGENGFRSKIHKNTTPEL

SEQ ID NO: 944417 - protein, 109 aa, Homo sapiens
RNKKDKAGQKEARAPQGPQTKKNEHKHTNKASKTPEETRADSPTHPTHTKDQATDRPRTTRQAEQDRTRRDTHRKNTQQPKRSPQRNHKKTHTKTRRKTRTKNPKHPRK

SEQ ID NO: 944418 - protein, 132 aa, Homo sapiens
MLQFQNQRKNCLKKGHDGRPGLYRDFLKLQELSPALMGRNAGSHTKGPLHGKKKKRSQRFGTGGQTGRWGFPGENGAPPQTVGVFVLFWPPVFIEKPRWEFPEETGALKFCPGGCGKKNPPVFLAYWHPPFR

SEQ ID NO: 944419 - protein, 214 aa, Homo sapiens
RFCFFCFGCPSDWGGRKGKRTPGPTGPLGETPTEDTAPGTNKKTARKERAWTDTRATGGPGEHAGRMQTAENSVKHGAVLYANTPREEPDGQTRGNPAQRPPGTTTRTRLPRPPPRLGDGHGARAREPPRAHHKGPGASPRRTPGTRGTMGGRRPTAPTPPRRQPIRGRAAGPRTRGAHPTPRGAPIPARHPGARTPARRGPSNNPTRAAEDGR

SEQ ID NO: 944420 - protein, 70 aa, Homo sapiens
QEPYILDSGGKDDVEGLLGHLRMVARKGPVDLALIKGYRRGVIEGSNGGQSAYNVNLHVLGGRQRHGPPG

SEQ ID NO: 944421 - protein, 122 aa, Homo sapiens
GSIYNPEGLDITEETLHSRFLKGVRIVARACLQMGYPTVASVPHSIINGSKRVLALPVETDYTFQLAEKVRAFLADPSAFGAAAPVAVATTVAPAAAAAPVKVEAKEKPKEPAKDMELGLFD

SEQ ID NO: 944422 - protein, 148 aa, Homo sapiens
GTIRGFKGTTELKGKSKVEEGSDMSTVTSQLMLKVHREDDGVQGICQVEHLAVTGNLQTQRNLEVQFKPKGHIQMTNPLQGLTRKGDALELTCEAMGKPKPVMETGLKVDDERPKHAELSGPNLLIINLTKPDKGPYRCEASTIVGKA

SEQ ID NO: 944423 - protein, 70 aa, Homo sapiens
PPSSEAALDPRLPKENCDWRLPKCYEPLVNSGIAQTNAGVLRSNVNGARIFLGCKALNSYYYTRLNIRTC

SEQ ID NO: 944424 - protein, 154 aa, Homo sapiens
MAGGGSARKPNMAVPGALILRESPSMKKAGALVNAIDSGRFPRLVNWILQKLHLKAESRFREEEEEKLYAGFSLEEPDLYLGLGTISFILEQAGDHNGKPGTLQQQLEDIHLRPGKAEAFGNTWASMGQGTGEKVRQRILASLKLETGGWQLNP

SEQ ID NO: 944425 - protein, 145 aa, Homo sapiens
QDQEMEDGLAFKTFLDHLVPKLIEAGEVKNAEILRLKEQLREMENLRLEGQQLLEKNWFLQGQLDDIKGQRETRDQNHPDIQQLKNDQEESFKEGLAKGKIVEKMLKMKADLEEVQSALYTKEMDCLRMTDEVERTQTLESKAFQ

SEQ ID NO: 944426 - protein, 68 aa, Homo sapiens
GLKEEFLGIQVKEESEEKEDQGVEFKRQKEGLRPYLDEKRLDHFLSKGEGRLPSRALKGAWMIYFTGD

SEQ ID NO: 944427 - protein, 105 aa, Homo sapiens
FWPGIHLGRESVLKVGPFMNGWGLKKCGVKWEPGRTHLMARIFREMVAPFNFWPLGPLLNSGGKILFKFNKLSPIAGTGLNWGVPGDYLVKWAMGKTHQMAYIRG

SEQ ID NO: 944428 - protein, 142 aa, Homo sapiens
LEYVLIPHGIIVDRIERLAKDIMKDIGYSDIMVLCVLKGGYKFCADLVEHLKNISRNSDRFVSMKVDFIRLDLSTLAGKNVLIVEDVVGTGRTMKALLSNIEKYKPNMIKVASLLVKRTSRSDGFRPDYAGFEIPNLFVVGY

SEQ ID NO: 944429 - protein, 192 aa, Homo sapiens
PWKKGFFPPPFFPALRAQFPGPHPRGPLPEKKKKAPPPPGPGEKRGKGGSRGKMGAPPHGWGPFFFLAPGFPPKPPGIFPPGNPVKPLPGGTGQKNPPRFFGFSPPPWQIKPKPPWGFFRGPQKGGGKQGQRGVPGGNGSPPTFPPKNAPGEKRGNPAGAPKGGATPHFVGAPTPPAFTGGKLWGPRCFKNR

SEQ ID NO: 944430 - protein, 112 aa, Homo sapiens
CVGPRKFGHYGRGNGQDISLEDSRLRFNLRAHYADDWGHVAPNSRLHQMCRVRDVLDSYKVPIQDRPKLDELRASNLPPNWPFPEQGACSLDLWILYHVKYYQNCSLNPLFL

SEQ ID NO: 944431 - protein, 118 aa, Homo sapiens
HFFFFFIPLQMRRPPKKTKQKTPPAIKKEYIHSAKWSPLPKKTRNSPPRFRPLARTKKGKLAPPKTFHPKRSPAKNIRAPEKPPKHPDLLPRSHRSKLTRGGPHNTHPTKPLSHPPPL

SEQ ID NO: 944432 - protein, 101 aa, Homo sapiens
FGHKGRGLWRPGQKGFQRLPDPGSLDSKALRLFFGPEFKSRLNPKPAKAGENNPNWNHMDQGVYNHGNAEVEINILKAEKNRLARQILRINLKKENWPESD

SEQ ID NO: 944433 - protein, 66 aa, Homo sapiens
FQNDAKVGALFDESGQTKERPEVVELEFHPLMASMEHLAVDINDVAAVVYKCLTDVARATWFSQYG

SEQ ID NO: 944434 - protein, 111 aa, Homo sapiens
QKLELPLRGKSVPGLRDLTGFRIPLNKFKIVLDIDQLSRTLVSHFLRGTKPFLEAWFIYQAHCLGDELLLIKIAKALFVWHEQHLFNCKKVYKVVENANDTRYGLAPYVFA

SEQ ID NO: 944435 - protein, 176 aa, Homo sapiens
GARSSFLSLRLLSPRNLPPLSLCFFPASPNRALFFGQKKKLSPFSSPLALILPSLPLSVIVPRPPILQVPFSFFASFPSQTPAVLYLPGFSPSYSPCCGGAGAHSVLSDHFAFFAPLFLCLSPSPASLFFFAAPPTFLPTLLFPFFSPSVNPVLLLSNLVPTILFSSPPLLCSPSL

SEQ ID NO: 944436 - protein, 96 aa, Homo sapiens
LPRPYGPITGILPNFPPTCYPHQKAPHPWPHPQALVTSFPWENLVTLHIPDHIFIFSPPFFLPQFSPPYSPLNFHPVNPLLRALLRKKSPPPISSL

SEQ ID NO: 944437 - protein, 135 aa, Homo sapiens
PRCMWGRAPLATPGERAPRGCAELSHRQQHEPDPCIGRAPVECRLLREAGPTSARAVGQVRALGRWGVGPRRGSFACPGPISFPVPRARVPGAQARAQRPPELPEGPGGQSVLEPPPVLGVGALREERDGPRVNG

SEQ ID NO: 944438 - protein, 136 aa, Homo sapiens
QTRARMCVGTYVDSEGHLYTAPIIANTGNIYKPNNKGMADELSEKQVYEAHTKEIDLCNRDPEHLNDDLVKNDFEDVNAEPRRDTQVVTRFGGRFTTFTVTYWVYRLVCGLFGIPMALIWGIYFGILSFLDIWAGV

SEQ ID NO: 944439 - protein, 143 aa, Homo sapiens
MAEVHVMVLDGHGHVMGRLAAIDAKQVLLVQTVVVVHCEGINISGNFYRNKKKHLTLLSKRMSTNHSRGPYDFRTRTHIFMADCATYAVSLNQTRPGRSGPSQSAGLNVMPYDKNKQMVDPANLDVRLKTTTVCLYGAPVSRV

SEQ ID NO: 944440 - protein, 73 aa, Homo sapiens
GLSRGAAGAPKRAYHKLGKFTRKRSRMPWTQWTFAEGGGGKLKSSRARGGNFVKGRGKCSRRQLNNITQMQLA

SEQ ID NO: 944441 - protein, 133 aa, Homo sapiens
VTFIILLYLFSALNLTGVGSRDAHSIEGDYRFKELSEENVIALEQNGWAHYHKQCACEDHVPLANEVTDTARTWHADETAEERDKRLYTTLWRHYYAQMLLCVKPMVKGLTARHNTIQRDDVLLAARLTAILF

SEQ ID NO: 944442 - protein, 128 aa, Homo sapiens
AERLECLRLRNEIIVEFDELLLKPMFRAVEKIKTIGRTYMAAAGLTLALGHENQELERQHAHIGVMVEVSIDLMSELDAVYRHFFNCFRLRVGIKPWASECCSDWGPPQSDIWGNTVNVARRMGTGLG

SEQ ID NO: 944443 - protein, 78 aa, Homo sapiens
QFLDPSVLQQVDDIRQIYLSRGLTKREIVAVAKPAKFSTRYIVAWPLSKIWLYDTAGICASYNLKGPCQLKAMPHVSR

SEQ ID NO: 944444 - protein, 69 aa, Homo sapiens
MTRHADRIISLITFAVGGNICLGFTAHRIKRAEGWEEGSSTVLSDFHWTNISGSCKDKCIELRGWTYWW

SEQ ID NO: 944445 - protein, 42 aa, Homo sapiens
MLEELVQFWRYYSLVLCVTLDGCPLLHTIVYLVSVTPDSLAF

SEQ ID NO: 944446 - protein, 129 aa, Homo sapiens
MLAQEDDNDYEPYSKANHMRIEVDLTLGYDHPGQEDSYSSYYKSVIATCKSNHYDLTYQMNAGALLTILAELMAEPGAKIDYSKHNWHMMIESEVMETMYDAFTITLSMKLITRRVTSITAMLHVPNVA

SEQ ID NO: 944447 - protein, 119 aa, Homo sapiens
MKAEQSTIPMDDRKIRAPSSIVDPSASPAHLVCYRLHATLKAMSRQPPELSHSNAALHTSDQHSVVVLAQLLSRMIHVIDIPETGPIASKAKSGTCAGPVDGLFESFRYAGDTPMYLLD

SEQ ID NO: 944448 - protein, 146 aa, Homo sapiens
DTLSQIHLAPLFVNPTLDWALGTMLGEQFPELCSSPCPPVEVTIEEPGTMDMGKHMSNEYYMRYDTAEAGFSDDDEDVNSRGMKSTCRMHPVKQTDLEDSVDITPYLGQLDEYLTHIALQFQLASHTEARAKSYTKSWPRCAGRLY

SEQ ID NO: 944449 - protein, 125 aa, Homo sapiens
AWANRKKISLVVIKCGLPVMEAAYFYHRRMGFLFQKHSPYLSLVQFVFSLCVPEPVTGRADKRAVIIIDYSGVRRMDAGKPPSIHPDFSFPVGKNYSNTWQDISLKGKSFQLDFFLQFIPIPKMS

SEQ ID NO: 944450 - protein, 115 aa, Homo sapiens
HELVVCTHRRRERERASRALRRSCAFRARGGSPLTQGTKGPTWLVIYHVTKKNTHCETLLNHNFKRHRKGYLLATKAPTPLEHKSIIRVQTTPDYRPQEGFTNGITRAHKRAVPV

SEQ ID NO: 944451 - protein, 116 aa, Homo sapiens
MLSGERVGPELMHAVKEVVKGVAVPEEFQEHHLSEVHKGAINGSIPQKEYKGELGSYEMPLKRKLDFNANVIHGSDFLVYELDNNYTWEHLEPHKGVQILGHGSKGVNGVEVDTSQ

SEQ ID NO: 944452 - protein, 204 aa, Homo sapiens
TRGRERYEVNDMDSMRKIYHETYMLTTRARGERATDLHIEHEFMVTIKKKRLVNTPYVDNFYKRAGGGILATVGELLKIGNAMVYEGTKVGWLRTQMEIFYLDTLNQKHMGMKWTPDPNTEKSWDKEGEYAMAWGVCGKQTHGSRIKRRDYASHTGRAQGATRVLGGLSEKLVHETLNNKGSPRGIIWSIICDMRTVGLYHRYV

SEQ ID NO: 944453 - protein, 103 aa, Homo sapiens
MAEDIIWDIRESYYGESLCLANYPSGFHSVMFNPVEPRMLATAHSKDGVALWYIRLRDVLLRYGGNLSVRAMSVLLNSDQTQLLGLRRHLSAVLYDIQSALPV

SEQ ID NO: 944454 - protein, 95 aa, Homo sapiens
VKRLPVSTSQMYPDEVHMLGIGDGTRAMPQSEIGAFEYLLWPLTLLRIYWWNRYTTWVMHELYVSHEGYPKLKSLRPDELPVYTDAPRICMTTVI

SEQ ID NO: 944455 - protein, 145 aa, Homo sapiens
IGGGEALAIVGSANTRPPFTLTPDYRRVGRTPPIVSDIPDVTVTPARLLFFAPTRRTVPLEDMAPAADAIMSTEEELDGYDPQPLGKRSNVLPMMELLREFGNNTSTDGSIPSLRRQQTMEDELYRMTMEIISQYPPEQSTQPQD

SEQ ID NO: 944456 - protein, 81 aa, Homo sapiens
VILVYRSHLIYSVLCLEGIILSLVIIGTVITLNTHSILANSAPIAILAYAACEAAMGLALLASISNTYGLHYVHSLNLLQC

SEQ ID NO: 944457 - protein, 84 aa, Homo sapiens
MSSISCFWDLPAPLLRLAPYCQPTMTSQRRHNHFIDVDASDDSLITSSLHAFYTYLSMRFYMHRHDLTLEGVSQFLHVDREPRG

SEQ ID NO: 944458 - protein, 128 aa, Homo sapiens
PAGLSLALTECGRNRYGDSLLDSDRPPIFSPLATSGTIFLGIFCFWDLPAPLLWVGSSCQPTMSFQIRQNYFTDVEAGVNSLVNLYLEGSYTYLSLGYFDREDVALEGVSHFFLQMCPEREGYQRLLD

SEQ ID NO: 944459 - protein, 81 aa, Homo sapiens
MKLITILFLWFRLVLRLTHESQSEEIDCNDKDLFKAVDAVLEKYNSPNPSDNHVVLCRITEATKTGGSDTVYFFKDVGGGC

SEQ ID NO: 944460 - protein, 130 aa, Homo sapiens
VGPYRQHLCCSTPPTVWVHTDSTCAVRLPPLCRCILTAPVLFDSPHWVGPYRQDLCCSTTRRVGSYRQDLCPSPSCQTVRVPLGSPPGRCIPTGPVALTFPPGRCIPTGPVPLTSLSGRCIPTRVCRLAR

SEQ ID NO: 944461 - protein, 124 aa, Homo sapiens
IPRAAGFGTSSIFPDGHLRAGGVRVQTQHTETFGARSSLPLVCFSKGQFTEHFIIYQDMFLEETRHHAQVVKKVNEKIVTGQYGRLFAAVHFASRQWKVTSEDLILIGELDLACGERIRLGVLL

SEQ ID NO: 944462 - protein, 227 aa, Homo sapiens
ATAGCLAGQPLQERTHAWCERLRARLEEMDSRTRDRLDEVKEHVEAVRAKLEEHAQQILLLAEDLQARLKKLVLPLVEDMQRQWAALVEKVQAVVGTIADPVPSDNQLNAEDCSHATSRHSVTPVSSQAEEGDPVPVPADLLVVDPSVIKMHQVSRSGAIGIMKRKNSWGGPVPKLPIVRRIKYTGRRLQRRDGKPCRSQLNVLRTTPFSAGEYKEADISSSKVTCW

SEQ ID NO: 944463 - protein, 168 aa, Homo sapiens
MITQQEMAGLGFKPGSVCCHIPHSHCLGPSPRKLETVSFLPCSPGESTGTCAYVEGSSPRQAPPLSTHCEEKRAPFQAHLLTVRILLAELRSERSGLQPKGPLLLFRRCAQLGRDLGPCATPFYGPVITTPYAGARPEHPSRDPASAVQATAMGWFLGTGRAQARQGP

SEQ ID NO: 944464 - protein, 100 aa, Homo sapiens
EIESHSKLSYSAPTLRSDYSLPFVAHMYRITPCYLRTLTTDFLPEHFDTLTPMCTTEGDTCLTYEGLDRQLISFRAPATDRHAYTHRKYLPEDFCNGLEH

SEQ ID NO: 944465 - protein, 102 aa, Homo sapiens
MVAIGEVISLVKVFTECRAYWGITWVGRNGQRYQKCDYGGNLLISFGSTVRPQLVPAENCRDFRNLGPEKFSTKLGKIGFCHKCGENSPFGGPQGGGNPFFF

SEQ ID NO: 944466 - protein, 163 aa, Homo sapiens
DGKRPGKCPAPNLALPGVLCIKPSPYRWGPKKPKSLGGPPGPSGELTPVGGNAQPLPPGKGVFSGEKGVPLKPRAPKKGVGKIPPRFFWGASAPQGKGPPGPPPPLGQKTLGNPFLSFPPPPPGEGFGAPLLGPPLFLKKKGGAELFLPLGNPRKNPPGEFGP

SEQ ID NO: 944467 - protein, 188 aa, Homo sapiens
KQQWTGHSKRVDGAVTDHIQAAEAMKGTEWLDPEDPTAIAENELLGAAAAIEAASNKLDQLKPLAKPKEEDESLYSEEQILDTANSIAAATTALLKAASDVHRELVAQGKVCAIPDNALYDGHWSQGLISAVRIVAAATNNLCEADNTAVQGHASQEKLISGSQQVAASTDQILVGCKVKADQDSEAM

SEQ ID NO: 944468 - protein, 126 aa, Homo sapiens
MCSLCSLLLLLTPCLPFSPCPVPTLPALILLHFRLPSPLRSLLCLFSLSIAFPSVPVSPLSITCLTASLLLFLLRLRFSRLCIIFSLSSLPLPFSFPILSSSLPFPPLSVSLSSSLFLSPLLSAFP

SEQ ID NO: 944469 - protein, 213 aa, Homo sapiens
FPTLKTFILGPGKGGGGPPLLGVELFRAPPKSPKKANLEAFHNGQKALGEVLKRGLGLFDERAKMLGGLGVELGQFGPPVFFESLKGRGQALAQFVFLGGQILAQGFHMGAPRGPHFPAQGVKFFLQLGTFLAPPPFEEFGPQGSTFGGESSIFSWHFMEVAKVGLHLGPNPPQDLSNSPAKGLGLFYRLPQNSWVQGPLFPQLCKGKSPSPI

SEQ ID NO: 944470 - protein, 114 aa, Homo sapiens
HEVLPSPRGQRVIPRITIEMKAEAEKRNRELRMSILKEALKKMVWNKKAYNKDYEKRQSREPGTQTKRQTTLAFKPIDESNIDVPLRETAATESSNTYTIHTWIWIQMDISDID

SEQ ID NO: 944471 - protein, 134 aa, Homo sapiens
ARADLRQRVYIACLLSRAPSYCWHACAAWSLSTWLRIHSEMLPRPQTHCTMIRSTHPATRSPPTLVQSDFNLITELYTRLRQHHYHHLITEHSYCLCDALHVDQRLTLTMRLCRDRISLTAMTEAQIHAGYRSI

SEQ ID NO: 944472 - protein, 134 aa, Homo sapiens
APRTDTLSRVTSARTGSPERSSVSDGLEKAMEVPPPAPWIFLCRAESLFPRVFAVEAVTVDSEVLEERQKRLAYVTEPYDPESGWDRLRELIGKDEQYRISKDLANICETAATAGIIGWVYGGIPAIMHAQLHW

SEQ ID NO: 944473 - protein, 119 aa, Homo sapiens
AGIRPKGHSLEHQMHKLKGGDRAYVTSYMRLNLTLLTINFLSLPTDQMLSSSEQHLPKPAAMTEVEQLDWLRDPIQNVGKVSRFGCHQHSFYLIMSQMPKKAFQQDPEDQRLPMSRLRC

SEQ ID NO: 944474 - protein, 111 aa, Homo sapiens
MGDHACSFLKDFLAGDVIADDSKTASILIQRVKLLLQVHHAVQINAVLLSLWWGNLDNVMGTYPTKLTTLGSRTTSSPSDYDDPICISPDDAILDRTYLSVDPVMPCLSCG

SEQ ID NO: 944475 - protein, 100 aa, Homo sapiens
AEAMLLRMRECARSSGGYVFVQSMAAGQADKDSERDNANAHLSHRELGYSTAVTRIHRHFTTTATSHGQQVVNADGFSGFILENLTANVLKIGTNAFRLV

SEQ ID NO: 944476 - protein, 97 aa, Homo sapiens
CTGSAVGLTVVVVVPYNNACMQKLNKNSSKGYGKTDSRSHTAGHKFPVDRIPSHMKTRSSIHDRVGATVAVYSVRCLENLTAQVLKLTGNASKDLEV

SEQ ID NO: 944477 - protein, 130 aa, Homo sapiens
RRRLERRAGSGRDRVTADRRLQDMLLSNAGSSDITSATKAGWTQKPKRRGQAKEVVKAQNWRMAEPKFMHQHVTLSPDKRRHNVSLRLSFRTDNHHDAKEPVLDTDVEMARWRMTETLGIKYLRPCIFRL

SEQ ID NO: 944478 - protein, 77 aa, Homo sapiens
CTSEIGHMTCRVSLQQHGETWAFTIRDYSVQDRHFNIIAGSDHFITPAWSLLSKDHTVINGTCSGVKDCTNARLPCM

SEQ ID NO: 944479 - protein, 71 aa, Homo sapiens
QTFTECYPPSTQIFMSYTAYYASMHPRMDLYAQMTSPGLYPMNGNVCKGRQQVEHPQKRSDRTMNGDHETY

SEQ ID NO: 944480 - protein, 121 aa, Homo sapiens
ANLNFVSTPNPDPFRDNPFTQPDQSTPSAFDSLESPDHTTENTSRSSTALSNGPLNGDVDYFGQQFDQIYNRTGQQEAQAGPWPFTSSQTQPAVRTSPYCGKPCQWTVHIEWTTATCALTV

SEQ ID NO: 944481 - protein, 126 aa, Homo sapiens
MPIYSWRLILQLTGQSDLGPGSLAEESHGDTATETDTCYHDQYNSTISMIIYHLADLTSEYSVSCLTRTKGPLTYSAEGASVQPFIAIHGDQGCQLGRNTERPEPLAYGHTIGSSSASTASYVPLA

SEQ ID NO: 944482 - protein, 33 aa, Homo sapiens
MHSPMSIGTGVATLSLMTKADTHDDDGFQASPS

SEQ ID NO: 944483 - protein, 98 aa, Homo sapiens
MTTSLKHPDFVAYPMLEKPVGSLTGIVAFLGKKLAERGFDMAYAVLVQFLVLKKDEYLLDYGWTLVAATPINPGTFSDAFESSARLLVMLSEVLIARP

SEQ ID NO: 944484 - protein, 75 aa, Homo sapiens
MPKVLLPLNYPTSGYGRLSMRATTRDRHSVTTAVRHGKKSQAENDFFESNPFNINQTGVRYTRGGDPESVAGELG

SEQ ID NO: 944485 - protein, 120 aa, Homo sapiens
MTSDLSGLLLSDLRYQTRQLTCPLRRLLTIHSYVTDRGLSLLMLLCLTILVIQGSPLTSCKYNALCFYVTAIRRDDARTYAVMVEQMSSSPSSPSVATAAQARATKACVLSIDALMILSQ

SEQ ID NO: 944486 - protein, 108 aa, Homo sapiens
QSLNSGHYGRTTIPRFVSCPPDIAYESHMTQQTQLDQMPSPSFLTHVKESLSQVLAVSEDKAPTNLYEKTYLTAVDELMDLYSHSATYMSTYTGILTGQGLSVLKGQW

SEQ ID NO: 944487 - protein, 124 aa, Homo sapiens
PVLQEDSQSLLGKVDNTLSVIPRPEVTAKARHPWGERNLAFYGPPDGEAWSQAKEMRKAVPEGCLRHTRHSKNDEEVHMEEMLAAAYTWTSQDATESSLHFTPALHKTPLGAAYTLHLDCTRRH

SEQ ID NO: 944488 - protein, 76 aa, Homo sapiens
MQNYYPENVKRFGIPEFKTSLRPWCFVAAKGYSPYWANAKPEIFAYWTWQDLTEQGVATFKASTKSWTKFEECMFA

SEQ ID NO: 944489 - protein, 83 aa, Homo sapiens
LIHELYQPRDGFQLSLGSDLFTDLAVYLRDTSVSALTTLYLAYSVPTYSRASDGAMKHINDHAADHTQGLIVDLLKTLDAMRT

SEQ ID NO: 944490 - protein, 140 aa, Homo sapiens
VGGHDYGILFIEDDHAGGEHLVFGRASVDFAGQLEQRRQLTDEAIHQAVRAQESISLERCLRNRAGEAAYPGRAILRATEALSDETRIAQRATHCIRAVQSHMRLDDSIQANPYPAMRTPVPCNGCNAITLLPTSRPALC

SEQ ID NO: 944491 - protein, 100 aa, Homo sapiens
MTIEHLALALEGQCSAQALHDAMRCAASISHGKECLSSHWLHQETAHEHLPKTTYTRSGDELMVYSSICTHPMISHTCICTDQCIAVLTVDEYQYDPPSR

SEQ ID NO: 944492 - protein, 110 aa, Homo sapiens
MPLQAVNCRLLAQRAASRVAPNRRRWDQRLRPGCHPRGAVAPHSSHMLLIFLQETVHELNIFRHFEPELTIGMLVISCVTVCYLCQHAMECHHRIEERSQSVLESTMTTV

SEQ ID NO: 944493 - protein, 233 aa, Homo sapiens
GLQEFGPSLSELCTDSRATCFRHYDAGEGLSTRNTSHWLLNARADSNYCNLHTGAIYDSVIDLNYLHNICQCDATPGTFDDTCLAHNAKLGIKVNAITIVQDCDSYTIQVSDANAKYVNWATVILTTIDKAAAHVIGAQRLIISAPSADAPMFVMTSNHDTYDNSLMIISNAFCCTNCKAPLTEDIHDNSGIMEGLMITVHAMTDIQKTADGPSLHCVVMLTGLCSIMRDYLA

SEQ ID NO: 944494 - protein, 112 aa, Homo sapiens
RERDRERDRERERERERDRERERERECELVLLRLSSSPSSPVCAFLFPFLPSCTSPILLCSPGLWLCMCSYYTYHDFHFLCTRTCLHVPSLVTDSSSPYYSVLSVSVHPHLL

SEQ ID NO: 944495 - protein, 101 aa, Homo sapiens
ADLSPRDTPQGEDMLNAIRRGVKLKKTTTNHRFSPLLFLRSQEMRPWGKNWFINPKLADPFHSIIKPKNLEATRNIALLKGLDTFRLEFKPTHGTGLNLDL

SEQ ID NO: 944496 - protein, 152 aa, Homo sapiens
MYASHYTMKKPGGCATIHFYLIPGSRPNNRRRRLETITVLGALIAQDHHERRCCMLLIHVMADLTHRLNCDNPWKLQQEPTICGDTYRPTPRARNVDHAPRPRAHPRKSRLGPDAGKPRETARNGRSQPTPHPPAPLHELTRRTLRQERPGG

SEQ ID NO: 944497 - protein, 107 aa, Homo sapiens
MRERGLDFGNQGLDVDGVKVKLLMWDTAGHERFRSVTYAYYREAHALMLLYDVTNMDLLVNIAGLDDRDSLSTPEQDVRPMLVVNKGKYGNDRVVSRLAGLNLFNES

SEQ ID NO: 944498 - protein, 147 aa, Homo sapiens
SARCVEGAPVVCMSCGGDMSDGVLKEGLLFKRGHIVHNWKARWFILRQNTAVVLQAGGGSGELAPLKGRILLDGCTMSATDWNMLEDRALEERDDAFEITRAIHARQPGKVQELHRLRNSFKVSPHKTGRIVDKMDRGTPGFLKVQH

SEQ ID NO: 944499 - protein, 135 aa, Homo sapiens
GHNRVLYQAVSQSSVTLEYVKGVDNGFGPDYQLAMKAGPIRVQKMSRPIYKRVLDREFNDGILENVALGANVTGPWMCDHCVAGNAWVYINVCLERDTVQDKVRELSAEYILQCFRRNYTMDNGVATSRVQLHGP

SEQ ID NO: 944500 - protein, 99 aa, Homo sapiens
MRPDYEFLQQDLSNADQIPEQTGWNLRPVPESLGESGSPFLGPSFQVALAGIPRQTGPLAPGQQTDTPPGLPEKKRKSADFQTGDGLAAVCYERDTSQY

SEQ ID NO: 944501 - protein, 146 aa, Homo sapiens
RCYTASYNRASDSGHLSHLFSASVDETRFANREILSTTKNYQSVVSTFIRQCEVFFYTGEIVQTTNIAGYFTTSNPGTVVGTNGATSAVVSIVALVVTTTSTNWILLVSYDSEVNADTLYLYRQSRHTCVRVQEYTVCFFQMDHIG

SEQ ID NO: 944502 - protein, 87 aa, Homo sapiens
MTSRKKVLLKGINLGESGVGKTLLMNQDVNKKFSNQYKGTIGADFLTKEVKVDDRLVTDLSNPSDLGRGLLVVCLCTHMSPRVWQQD

SEQ ID NO: 944503 - protein, 82 aa, Homo sapiens
GCRIRHEHEIETSLCNTARLCLKKKERVKVKKIMFLYYCVGLTLWNFWTILWELLLCIIRFSLTVVGLMNFHLYSDAKAICI

SEQ ID NO: 944504 - protein, 40 aa, Homo sapiens
MSPEEELDRFQPETFGKRAAELAFIYVGGYTPYTSCSLSC

SEQ ID NO: 944505 - protein, 161 aa, Homo sapiens
PRAVGILHETPFCALACRTCAEYCAVPTAHTRPYVNLKDELCVFQLWRASVSQALEGPVKPGARIFFFDGKDVLRAPHTGPNKNVWHGLDPNGRTLTESYCETWRTEASSGTGQGFLLLGGKLSGAQSRELHNTLVLWIENRLMTWLQVTTAWMHIGRGPR

SEQ ID NO: 944506 - protein, 137 aa, Homo sapiens
FCGSRVGDQPDPTDHMIYLLTTLSNCHQDLIVLQHEYADVCITLIVQSITRAEQQILSVQQYGSHLVADSSLDKEHYNDAQHLRDWYRTYANSIELGSLVASGIITPIHEHGEEANVCSRYRESLCYHHRGGLTPDD

SEQ ID NO: 944507 - protein, 77 aa, Homo sapiens
MPMSVYAFTGFWSDVSTWCEVESEVMKSDYESGDHGHFEERTIPALDFQQHPGSLTLNFPLCLTLEPRGDVSDRAVL

SEQ ID NO: 944508 - protein, 121 aa, Homo sapiens
MTAGVQQMRHLGLIPGVITKHLVMLAGTTPAKELYLSDNIEDDSIEPVVLCNSSPILISCYTEQQMLRRLVDGAPRIPVLVIHSSLHTSQPCETPLVRLAAHRRLLRTYEILRATLLLMIL

SEQ ID NO: 944509 - protein, 202 aa, Homo sapiens
FNFVLFKAEKREKKVRPPILGKDPVVSIKKLAPMEFSRRPIPGKAELKQLNLRDTAIPIPSFLVKELPRAQESEDRLGLARAKKTLNRLTSNIGDKTAPGRGDVHLPPGWVKASPISDVVRYRVLCPEDLRAYADPNTGRADPPGALIVRRRSRFIQEGAIIRVEEHVCSNRKRQQQVPAHALDFYNNLLQILHCVNHKPQD

SEQ ID NO: 944510 - protein, 140 aa, Homo sapiens
EPLSSRRCTVRCLGRSLEHQGYWTAADESCYRPGITRNRRSARASTSCTADYAITILCLLTMHAEYIRSETYIRYGADEQNATVLYTHGSYGTGVIHAVGDDAICDTTGDMIFISGSSSEGYPEPAHCNTPHCLRHYLLE

SEQ ID NO: 944511 - protein, 111 aa, Homo sapiens
LLPMWSIQCLELTELLKRPHEAAKSHLLAEVAVTCTVFPQPVTSQCYPEGANEALLTPVLDPDAPSSTTLGAPGLSIAGSPPDYHVLLAASTGYQMHRTHYDLCHTFMGEV

SEQ ID NO: 944512 - protein, 68 aa, Homo sapiens
MRHIGGKVEFNIALMSKLDGINRHFFNFFGFAWAYNHGPVNAGVNGARLRMKYGKHCECGQANGPVAW

SEQ ID NO: 944513 - protein, 127 aa, Homo sapiens
WPHHHYNSCGVNDPRWDIYCHLLCVGTRVESLLLRFTPRLGHHIPLPRTAHRERMYLDCGILRWLFEGSHEAVLMIGLGQVLAAAELVDGKLTVLAINVVLHLSEVQEAHLYTMTISCGAYDARHGF

SEQ ID NO: 944514 - protein, 159 aa, Homo sapiens
YALTAVVSADSASPHQPSAARADLLTTRSGRCFSVARRVVVLRLCGASCVSRRRTLRALVGVYSPHERLYTVYSARVARARDTRVGVVALSDAQSSGHVSLSLSHTCLCERTDTLHVTHPVEGGHTAKVESLRARGPRPVCRAPLVRGTLRSGSTCCWP

SEQ ID NO: 944515 - protein, 105 aa, Homo sapiens
DIEVKTAHEALSGETFSSEQGQFSVTRKHATYAELSGPVTGCDEPGRRLLTEVKCRGLHVILQDFRCTRRRIAATRKPTMQPMMPRPVKYEEGQAAIKARADKLT

SEQ ID NO: 944516 - protein, 106 aa, Homo sapiens
LKCKTSLGIDYRKPLSLQRAAKLAEHGGMCLQAELIRVLRLWITQAQQFKDAVSYDSVTVLLNGQQSTTLTLKLLLFNQWCTDNLFTRELLTLAMSQAEIIVHVIR

SEQ ID NO: 944517 - protein, 84 aa, Homo sapiens
SADTLLQSIELPPLNSANNAQDFLRMVQVHGELNLAHNAQQRLKVALGASRKKLSENIKYRRFNSDIFHRADTYYHQIFTGHFG

SEQ ID NO: 944518 - protein, 125 aa, Homo sapiens
GPETERPVPDKSQQTQTSSPVHVSDRKPTMHTVCWRLLPELCCSPLLLDYRAISHGTTERTWLDTESIRVTGTKADVALLTVMLPDADEHTDILLMFKESSRAIDDRFGKQMIIEGFANSDCDVL

SEQ ID NO: 944519 - protein, 98 aa, Homo sapiens
MFNVGPDADTYRLTYAYFAGGDAGYAFDGFDFGDDPSDTFFTSHNGMHFSTCDNDNDQFERYCAAQDGSGWWMNTCHAGHLTGVYYQGGTYSQASLLG

SEQ ID NO: 944520 - protein, 71 aa, Homo sapiens
NFYKDISYRQDGRNMSTRGAVSCHDTLMSYTLITLSIHYALTKLFFLDRNRSKHLTQSEARHPENFLLSHM

SEQ ID NO: 944521 - protein, 200 aa, Homo sapiens
SCGGGCSASERLSPPFPGLEPESEGAAGGSEPEAVDSDTEGEDIFTGAAGGSKHQSTKITTSLLPINNGSKVGSMKNKTKSHRISLQMPQWSYTWTAHTIFETKVLVPTYEELEEDEQEDQFDLTVSITDPEKIADGLNAYAAYKGTSQASLPLLRCNRLQYNSRFSDCVERYETLCEQHSQNASLCCTAEESLICMTEW

SEQ ID NO: 944522 - protein, 33 aa, Homo sapiens
MLNFRLTTPDCIYFTLCNLAQSSRFLLITTMSS

SEQ ID NO: 944523 - protein, 127 aa, Homo sapiens
KEKPEGVELDTDEPSMGFKAHLSALTGVHTVRQKDYGERRKLYDDDVGKHQNKKWNDSTNDGVSRCSSIRTLRPVFVEYMTEEQLVSAMESPCGLANLGNTCYMNAKLNVFDVRLLDALITAVLRVC

SEQ ID NO: 944524 - protein, 111 aa, Homo sapiens
MNAKPTPMSELILVAVKLLVPQTVHAAFYNPVELHQPVYQRSYQLKFMLTYCGRITVTSLNSYYIIWHLIMDIFWLSYQDRILNVIPFFMTSFHGIGTRALLAYTLTCDSH

SEQ ID NO: 944525 - protein, 66 aa, Homo sapiens
MLAILDLRIAKLKMQLTKLDSEAMPGELDSDRDRMMLINGRMAADAMRLLAPAVYSCLELDRTRSR

SEQ ID NO: 944526 - protein, 107 aa, Homo sapiens
KGHVETFYVNAWRSIYAIHDVQGTPMFRYQVTERQHLVPLAVLDEEDNSVRYIILIGDLRPVRHSMIINCGIMTVYTQTLSRCIYLHAFSTGTSSEFSRLNLMHVVV

SEQ ID NO: 944527 - protein, 113 aa, Homo sapiens
MCNCHMHEPAPSLAGRARCRRGALNTGCCMLVTVVVDDQVTIVYYLYQQQRRMDLLTVNSDNLHMENLRMKLPKPCKPVSKKHMGLTRDEAGAVNAALPQMHMQNATKYEHDT

SEQ ID NO: 944528 - protein, 107 aa, Homo sapiens
EETASSLSLHGKGSYRLSYSKYDTYQLFSSYSSQKEDRDVVLTTTLVDDIQAMPTTYDEREYYASLAYGTHYSSSVSLGGLYELIYVSDTAIMMRIGVATRHTECLA

SEQ ID NO: 944529 - protein, 132 aa, Homo sapiens
ETHCVHGVDVEEEQNATVPDLEPLREEHAPPVIYYVPDFISIEDDEYLLRQVYNAPKPRTQLSVDSDRTGVGFLIAQGRILSGCHHGSQRYVDTVTDLNLCGGTHSYTMCYMNQHLPVEGIMSHTHSGRVRP

SEQ ID NO: 944530 - protein, 86 aa, Homo sapiens
ARGAADALQLRRGPKKSAAAKAAGPPPQLTLPTAAIDILREGRAPGLRLSRALEVARIAALPSAVAHAYTVITALWEAGWRCGIRE

SEQ ID NO: 944531 - protein, 111 aa, Homo sapiens
TLRTVTLYRVTYARTRSPERSSMSECLEKAMEVPQRHRGAVSVEHSAYFPVTLLSTLRLSTCKSLRSIRSSLHTYLSPITQSLDGTGYWSCWDATAGIIGCEHGVPAVIHA

SEQ ID NO: 944532 - protein, 114 aa, Homo sapiens
PFYCLAVANTEHQDAMDDSIMDDRMSKIYHERCLDYTEELSQVNLVPEFPVTTLNALCQPVTSGGLPIIDAEVKLPSCCDRMEIRLDYGLDGTAGIFGHDLDDLSLRTRAFGHW

SEQ ID NO: 944533 - protein, 74 aa, Homo sapiens
RIYRIQEEEAAVNQDCTTALQPGQQSETLSQNRSEKIQRTLEEIIRDSERQRLKDWWQGVMGKNYVNEPQRATE

SEQ ID NO: 944534 - protein, 55 aa, Homo sapiens
AAVSIYWNSGETADRCVEQETYMNDGYLHRDLYTNLTGSMSPYAGVMTDDVHALW

SEQ ID NO: 944535 - protein, 79 aa, Homo sapiens
VLCGPLPPSVLDRRGILPLEESGSRSPSSQETSGSLLPQSPVPTEHLYSNEMPEDSSTPEEMPPAEPPEPPQEAAAADK

SEQ ID NO: 944536 - protein, 236 aa, Homo sapiens
ESCASLLAECALSLNIVLTSSVYYPGDRSIDCQLLLPSDVIDDVTLFCHTKGTGLDLDVSFFLHSCCVCIHLYRCTCGVFVTAQLDWTGARVDTIAAGLLDMLDISDYPHDLSLNSRETVVTVTIVHLLHMTEILIIMPMLEGARFDASLYVHSDDSRDVWDHHYECIAGIHDLIMTAENRYPFLVALAVDADVDDAAAYRDDATPNDNDIIAYALGDAITVLKQVTLLVISGCFL

SEQ ID NO: 944537 - protein, 115 aa, Homo sapiens
SSWRCAEITLTIPITGAVSACTQHDIALMDAHTGAQMTSRVHMPGLALGQYMTVIQCSQTLVLKIYETFHYTLIYGKLKIQANLIACAQPESEEAADLRIAVQVVPIAISLGMWP

SEQ ID NO: 944538 - protein, 77 aa, Homo sapiens
MTNSLPRGTCTELGDAKQPWIVHGSISAKLALAIIDDNVTRKEPNGSLYDLNLTKNGEFQATLGLVTTAIARSPGAF

SEQ ID NO: 944539 - protein, 108 aa, Homo sapiens
WGRFLFPEGGQRPFMSARLGHLALPTKKKIYVLCSGEWCPFDKLEPAPPPGTFFAGSPRITPPSLFDVVNEHPGLKKMEEKGCQELSPVFRENPNPAPHKNNFLFERV

SEQ ID NO: 944540 - protein, 134 aa, Homo sapiens
GKPPAFFGLKNFPGPGPVLPKRGPMGLNRFKSGGGGEGWAPNSFQESWYLSPGTWQGKKAGGGFPDPNSKKKFNWLGEKTPKKPRGPLGGSPTNNNFFFGRGRGGGPYLGANFGRGPGIGSFPKSITRRGATPS

SEQ ID NO: 944541 - protein, 83 aa, Homo sapiens
LHPEGVLVLEPQPWTSSGKRKTLTETIYRNYYRIHLRPEQFSAYLTSPDVGLSSYELEATPHNTSKGFQRSVYLFHKARTARH

SEQ ID NO: 944542 - protein, 116 aa, Homo sapiens
MHAKARSNACTSMTCTLRHYITDDMILKTRHNNDYDAAIIELRGEILLYTQTEASQTVTLLIVKSNTECLILIHARLYNKTRENYRDLTHMLKKHYAVLCHTSEIIDKVAGLVITL

SEQ ID NO: 944543 - protein, 81 aa, Homo sapiens
VLGLLILKGLHEGRLSHVVLDQKGDQHRESARGHCALQSSCISRQDHLHLRTDRHGPFKWTACVRRGQQKKLNKLLHGVKF

SEQ ID NO: 944544 - protein, 81 aa, Homo sapiens
HKVISLKWSHTFHLPFLLNSVDVRGVEPETSSIIDDALLAHIISMCRWGRNGVDSMCIVGQYSGLQVHDAGSMQQSLWLPE

SEQ ID NO: 944545 - protein, 103 aa, Homo sapiens
MIKQHPKTRLCRVVLDAKIRITVNCCRIKAEMDESALCGHMGSDEYEHLASRTLEAARICANTYIVMKFLHWITYACAAIHITRNPDGQDVVLSQADRLQTSM

SEQ ID NO: 944546 - protein, 144 aa, Homo sapiens
QDGEMFMRTVKLYDYYPTPYPNSDAARAVNIGALAPDLMYIELTMHGGEDYIFSLLTGYCEPPTDVSLREGLYLNPYFPGQAIDMAPTIYTDVLELDHGTPSTMCQIDTDVCAFLSWASEPYTSIARMGLMMLMMMALLVPLGY

SEQ ID NO: 944547 - protein, 132 aa, Homo sapiens
MSPISGCGSPPFYVIRITNMLSCLVDNRLHTGMRCAFGNPQCTVAKVHIGQVIMSIRTKLQNKQHVIESLRKAKFQFHARHKSLISNKEVSTSSIFMNLKTWWLKIGSSHMAVWVKYINSNGPLHKWRALHS

SEQ ID NO: 944548 - protein, 142 aa, Homo sapiens
LQRRCVSCVAVSTLSEARLVSDDLRNGQGCVLYHYLGYCQPDRSVTACVPAESMNRDEHDGLLVHHPDMPEKSRFLEVVLLGAHCAGKFTVYIQILSRKEVPVMRTVILLDALLEVITEIETPVMLLDTPGIISPETQKKLL

SEQ ID NO: 944549 - protein, 117 aa, Homo sapiens
FQLMCVYCVAASDVCGDLLTFADHRNGQGCILDHSLGYLSPRLNLDVLLLVESLNRDEHDGLLVDHPDMTDNLRFLQVGLLGAPSAGRATVCPQLLGRKGIPEIRECAYYFYAKICR

SEQ ID NO: 944550 - protein, 66 aa, Homo sapiens
MQTTDRISTDNTVIRAVFSLTNALNHQDARLIRSEQLLCLPECLGGLTSGLSTVCTHLCTSSLSVL

SEQ ID NO: 944551 - protein, 61 aa, Homo sapiens
VDDYRDHCGTLSLDPEDDSCCNKAQDELITVAKALRRSYSDNAETLPMIYLRVTISMPSLV

SEQ ID NO: 944552 - protein, 147 aa, Homo sapiens
MSWSLVSDGTRSHLRTNGVTCANFSDRLRWHVDFSPPGMSRFALVYIQGSRVDIVSHPGRVSAKRVASMHVLVPWYHRPARSPTRGGTRTWGKQTPIPGGICSHWKTGRARNPLELRRSGGIHGGASLRRWEHEAVGRLGGTRLWDP

SEQ ID NO: 944553 - protein, 94 aa, Homo sapiens
APPGGGDPPGPRGPQPGGGHPALLGPPGSPKAPGFPWGPPPGGGPPGRGKRENPPKGPGGGGAGDPRGGGLGPRAPPGGGEGPVSPPKNRGRAF

SEQ ID NO: 944554 - protein, 78 aa, Homo sapiens
MNEDTVRSGTVIYGQKEYRCYHEALSELFLRIKHELRAISDYAKYLGEDLSQTREDSPSHTADIPDLQADEWGLSLAW

SEQ ID NO: 944555 - protein, 74 aa, Homo sapiens
NDYDRARSGTVVYGQEEYICCQEALSELTTAQKARIASCQSYYQSAGDDLSQAPDDSPTGIQVTYLTYRQTSRA

SEQ ID NO: 944556 - protein, 89 aa, Homo sapiens
GGPAARTRGERVSMADETDHLILLAIMAITFDVCSLPFTIFAYMNETSSRKEKWDLRALRVLSINSIIDPWVFAILRPPVLRLMRSDLC

SEQ ID NO: 944557 - protein, 178 aa, Homo sapiens
LCKCSQEKAMFSVSAKIAKPTVEKPDQIESAISQALMELEMNSDLKAQLRELNITAAKENGGAGGRKAIINFGSGAQLEAFQKIQGRVGRELDKKVSGKHGGYIAQRRILAKTTLNSRYDKRKRPRSRTLTGVRDAILEDSGFPSEIVSPRIRVQLDGSRVIKAHIDTGQQNTVDHTV

SEQ ID NO: 944558 - protein, 103 aa, Homo sapiens
DITVWVMLHRAVQGESAQGTLGARDHAELFGTTHRERGVQGLSGPFQHMQNDFSGSIVPFWPVYLVGFLSWPTLPWAVPLTHSGSARDLDSLPFHLPVHLTWP

SEQ ID NO: 944559 - protein, 156 aa, Homo sapiens
LRHSNSLWKIKSPSIKEPGKEVLEQTQCFLIKGPYRNHCAVIKKRASKETCTLGFKIINSWGKTPQYFYSLKGAYAAAVSCLGPVISPRSCKRGEMVAIHIQQSDNPASSIWVVPKSIDTTKVIIDELDSSVAHTQRASTLNSQCRKLTFPSSRHV

SEQ ID NO: 944560 - protein, 119 aa, Homo sapiens
RIPVGGELLTHDDFIGSYPRMLTINCHFNLIDPYSQVQFDHMLWPYISSWVCGYELFWAEDVYDEYDTECLQCQYYSTTMMACHKIIFFTLLCYSLGIFRWEQGTRQTLMIWSGELHLQ

SEQ ID NO: 944561 - protein, 184 aa, Homo sapiens
MRDSSMRTSLACDGTRDTLYLEATGIEHRRALIPGANGMEGDSVRYKPDEPRVKSTDKSNVCEVLTDSSGDLSAGLGYAGTTGLQGRHKCQAIMYFDPDHVPDVQPRHLWYMTCKTRSHCVRVHNMPCARYARSECFRMKENVHSYPIDGLCTKPLCVRSSTLRHNPCSCASRTSVARFCSGIA

SEQ ID NO: 944562 - protein, 138 aa, Homo sapiens
EVSFAERRDHSAAHKAVQQSSTLNRLDRSSFTIVANTGVYASLSHIPETSVYTMTEKFDPLTHMLLLANCQSVLKDSDPESICHSCPLTSSLTMSVMNSVSILRVTHASTVDAVIISLRKLCRSGYLNIGNTSSHRGA

SEQ ID NO: 944563 - protein, 85 aa, Homo sapiens
TCYLRTANTSQENKFRLITNKICKYAQCPHWAVPTLHKLTCNWTLYTALQLGEFMTDADDISENLMSYAIDIRAPCTYWVLPLRL

SEQ ID NO: 944564 - protein, 119 aa, Homo sapiens
ADIQPHMRPAFGQGEILFTPKRCQGAVVTGIRKSQTFHDTGEVDQPANIVVTVLALMPGQFMQPTEPLHLSSALRSNLLHTQVHTYSHGLLFLRSECRPPVLTQRAILHIPVSLFRSIL

SEQ ID NO: 944565 - protein, 61 aa, Homo sapiens
LTILELVLGHRSAVRNIAMLSRKSVWCHHWAGTPYKPLVMLTTELSAHYAREHYDSPPTGP

SEQ ID NO: 944566 - protein, 108 aa, Homo sapiens
RLLEQTVSASDADQQALRNQALNLSLAYSYDTPVTSMVGTIPDDQEQSQVAEKPMEGESRYRNGHSAGAAGSRMNVRPGVISSRQLGLLGPPDVPDHAAHHPFRRLAI

SEQ ID NO: 944567 - protein, 109 aa, Homo sapiens
MAHSIDGGYLFAEPIELDNPFEDPHAIHHRLSRQYATLDDYNPFETREPTPAYEPPAAGRLASPSAHSLQPSRKLSPTEPKNYGLYSTQASVAAVTAELLKQEELNRGR

SEQ ID NO: 944568 - protein, 102 aa, Homo sapiens
STANIVLAVLHVADRKMLLLHIGWSLRDTIEYRAEGFYDWMEGSITYHNTLIRVVDARAEVDMKDLRTHFKRLYGRAHDSSVKGDTSEDYGRVLLELCLGDD

SEQ ID NO: 944569 - protein, 116 aa, Homo sapiens
MTPETRRATYEQIKERTPVCSKIVGRDIGRGDKPTEPVDSWLAKIESQVNFKFAPQNPLNPLGNLTVRPKRNRSLDTWKKPCRESEKFNTHVGLQAPIKKAFKLNTHYLPIEELGR

SEQ ID NO: 944570 - protein, 101 aa, Homo sapiens
DIDQSMKSETSGSFEDALLAIEKCMRNKSAYYAEKLYKSMKGLGTDDNTLIRVMGSRAEIDMMDIRSHFKRLYGKSLYSIIKGDTSGDYRKVLLDLCGGHD

SEQ ID NO: 944571 - protein, 127 aa, Homo sapiens
PKTMIELNDNEHPGTIFLETADPELAAHGATLPKMDIHHDVDFLKMSDTIRDLLPAMCDRPCYIQDTNLILYEEVRPRLPERILDYDVYLDQAIDELLDGDILVFHNDDPDYDISELPTVQEFPEIY

SEQ ID NO: 944572 - protein, 109 aa, Homo sapiens
KIRINLDGRHRMLPLSRYMASVLACKSVILVENLDLMSGQPYFCTMYTVTLKSYKHSRSLMAQTLSSLIHVRDDLLLVSTMKANQSSVSTVRILLLDDFWQCGQYLLAP

SEQ ID NO: 944573 - protein, 103 aa, Homo sapiens
MLPGLISVQLYMQLAELMSDLCLLIDEHDHESLSVDAAYYDADRAPCEAMIDYEHHEDEDRISQIMLCYIVEQIQDYYLLDSRIRIDLIELRRGDELNDADRH

SEQ ID NO: 944574 - protein, 100 aa, Homo sapiens
QTDTAFRDEYEARKTERTSYATFQPATSTPYWPPGPIVLDSVLDESDLYSLTHSYLEVGGRIGRSNRESGVNTYRPCPGGHERNLVTNLQTSERTTRARF

SEQ ID NO: 944575 - protein, 109 aa, Homo sapiens
PARVWSLDTMGTRLLTTLLLVLLELGFEVQGTQQPHHDDMPSPTFLTQVQESISRYWESAKTAGQNLFEMTYLPAVHVKLRDLYSGTPAMSTYTGIFTDQVLSVLKGDE

SEQ ID NO: 944576 - protein, 145 aa, Homo sapiens
EREREREREREREREREREREREPLRSFAPSPAPCTCWFGPGIIGSSAHGSLGADRVSSRVIVRACSLCPRRFHSWLSGYALIPTPAPDLQASPAVAGAFFVVSLPDSWGHVVVLFFCPLDFAFVCPTEIISFSIRAEDFRRWAV

SEQ ID NO: 944577 - protein, 56 aa, Homo sapiens
MSTKHGGQSENIMNAWTGRIEGVKVHGLGGKPGRSVCGRVDGPTDEGRISDGGHRL

SEQ ID NO: 944578 - protein, 82 aa, Homo sapiens
MALRTQYRSNTNSVEMDAQPEDLTERPDSDTKSVVLSSLAEGRLQVCIHGMEEPALMQLRDVDRFQLKHTRSMMESAVQEAL

SEQ ID NO: 944579 - protein, 121 aa, Homo sapiens
GKRVQQENYKLRYQNDDLNGQILSLRLYEATVSRDELMEALKEQEEINFRLRQYMDKIMLDILDHNPSITRDQTLRHGAGCRAALGPWDQGQTLSKDARLRRASHSHFVYLVTMRYGYPCI

SEQ ID NO: 944580 - protein, 102 aa, Homo sapiens
MAEKQVPRQATEEQLIEHTPMWIILVFGSTDRADKPTETAIAGCPSENHYTNLSVPTEPCNSPRHLTASPKRHSSLCSTENSCTERLRVIIDSTRYCNRQFR

SEQ ID NO: 944581 - protein, 131 aa, Homo sapiens
GCMNSARGHTDREFHMEEKPNFSLWRGTDTYPLNGPDSRTLNRPTLCMTPGHELRELLNDHDHKLTGDLINDAGLQTRGNGPLNDLRTHVQRIQHMCCDSATNVLSSSHLDTCERTIVDVHLQVYRGLCVA

SEQ ID NO: 944582 - protein, 182 aa, Homo sapiens
MRLCTSYCCTYHYHAYGRSAVGHDLDFSPFLYPIISHKRLLACMNWGLDISYHPVIMENNMTYCLLSLLYSSMLRTHLKKTYSSCNLASLPWEVTLNAYLWRTMIEHVRMTCVVEDKYSSSTLQEHANYYRHKADMWTSKPYESTVHRLLVDTHSLTQVVVERTYLSPTSVHEWHSEYDMTC

SEQ ID NO: 944583 - protein, 133 aa, Homo sapiens
YWYTVHQIRSGCLSATKYGQNLLYLYGGILNMIYQRPELCILTCLDTYEAASGEVHLWQSFGIARTAPSTDEMISIDPEVNIAFNQAAGSSPVQLHLGSTIRLHGLSATRKWIYHMTEVSTDDALTVRLLCGW

SEQ ID NO: 944584 - protein, 237 aa, Homo sapiens
ANWKLAGKWCMIVEADEYMELSTSILPPRHNAMGAVWTDTSYHFMYRSDQWVTDAVRYFVIRPPRSVDKEPDPLYLCHHLGHPARTQCGIRTDFKEGLEPLSDPSLGGHLSFRGDPSLMTLRSLEPSENGRDGTRSQWGTAVSAEEPSTQEELLDNALRELGHTGWYRGSMTVNETKELREAPEGTVLIRDSSHSDYLLTISRYNISWTNNVPIQYLHREWGHLIDYYGNMCQDADG

SEQ ID NO: 944585 - protein, 84 aa, Homo sapiens
QGPTPIPFLDTPGVTVTFSDFQDSELIATMMRSYITRVHTELMTNGSLIFRYDPNGLSFNPISDFSDTSFPKCAGRPWKSVSEN

SEQ ID NO: 944586 - protein, 102 aa, Homo sapiens
RTVIVDTSRVQPMMLSRASMVLGRTGCQVLCTQVHVELMVYTAYASCAVYNAIRAEGDMLTIEESEREARRFSLSLADRWVSDVRYNHLYYGNGLTHSARAD

SEQ ID NO: 944587 - protein, 135 aa, Homo sapiens
HTCVTLWKDYLDGVGDTLYLWVIGAYLCRGKRAARDGGSLVASYDEDSEELEAICKLGTGFSDQELEEHHQSLKGLVLSWPRPYVRIDGAVISEHCVDPRAVWEVKCADLSLSLIYPVVRGLGDSDGHFLRVPLV

SEQ ID NO: 944588 - protein, 138 aa, Homo sapiens
MGMVSHFKHLSPPRVHHIKVSRVSKVLVMALSKGKCNSVRVELRRSQSGSFISSVEGSVKVGFVITHFDLYDNTERLDKIDSSLGLECWERALVFHGTVMNQCDPVLGPARVWGLPPEITPFCYNEIEVSLWVMRLRP

SEQ ID NO: 944589 - protein, 106 aa, Homo sapiens
RSGELAVRALEQFASVVEAKLIRTQKGIVNEQFLLQRLADGAIDLYAMVVVLSRASRSMSEGHPTGQHECSVTPGVIEDASRIREGMDALQSDPWYEELYRSFIGF

SEQ ID NO: 944590 - protein, 134 aa, Homo sapiens
SKFTSKNKAAVYKQFYDILLDFTDSKEMCINEYGSGRVLAYYPGQNVTPYGLTKMAKDAPLLLINPRGIDTLWVVMKPDTHALGCTGTWDTEVQILHTFELVQSKLTLKTYLFHCVPALYTLDTTLFKMKMLVP

SEQ ID NO: 944591 - protein, 153 aa, Homo sapiens
MSSLPYMPEPVMLQAVHLIAAAANVTNAAIGKNSDYTLRAEPSLRAQHAKTLADSAFDYTAIDPITGATLHDDVAITAHAYARDDTTTGTDLLRSIAKHGYETISIGAKQCKYKGLHDPVDAVVLHLGSSYSRDHPVLKCTRCYDYLHTRLTT

SEQ ID NO: 944592 - protein, 97 aa, Homo sapiens
RSISIGKWIADNQPRLIQCENEVGKLLIITEIPELILEDPSDANENLILQETSEIESLPADGSPGLKSALSTSRNLRINCDTGEKPVVTFKALRHEK

SEQ ID NO: 944593 - protein, 71 aa, Homo sapiens
MWPAVMESVKFDKDHDGLIGAYCGGLWLAAVAVKVHKAALCGAQDIQDKVSSILRRGQEAYERLLWNGRYY

SEQ ID NO: 944594 - protein, 66 aa, Homo sapiens
HARCHPSPEEHYLCPHTLFSTTSTATLCPIGSTLMGLSLSPFPGQGSWTQGKCLVLKRQAFGATHY

SEQ ID NO: 944595 - protein, 45 aa, Homo sapiens
MPDSLRYLHLAPEPVLRVGDAKSQGEARHSSAVEQNFNGFAVLAP

SEQ ID NO: 944596 - protein, 102 aa, Homo sapiens
LVDDTVKSQDPAYIFLKCQATYLITVELSPIAARLKLAFDSEYYDGLSVEYSTIASYDVGDYDKGYRFIEDPWTSTKLRVCHGQAFAIDKTMWKSESITGDT

SEQ ID NO: 944597 - protein, 115 aa, Homo sapiens
MHVRSEEWDIMTSEANPYDSVRVLLVCSKNLKPRRSLSSYGTDKEKNITLTLEGVKPTDEELALFLVESSEEAKKHLLQVRKCTSMAQGKAMIETETGIIPENQNVTCDGKRLEG

SEQ ID NO: 944598 - protein, 58 aa, Homo sapiens
MPLMLTVILIYDRCLLSWLSLRSCWHVKQYKLERGEALSDRAVQYVIRIQMVKRTVLS

SEQ ID NO: 944599 - protein, 33 aa, Homo sapiens
MLLMLSVLWIYDRCLLSSSYSSTTGYALSETMY

SEQ ID NO: 944600 - protein, 127 aa, Homo sapiens
VTFITVLFLYSSAYSTGVFRCYAHMIEAAHCDKDFIHDDFIVLEMSVFSLVSSAVFISKIMFKYWMNELHLRSVETNYAQLHLFVKAIVRWLTAVRFTILTVNASCHIDDDPDLSRLARPQVVVMST

SEQ ID NO: 944601 - protein, 95 aa, Homo sapiens
GVVTRTDFHDNEQTLAETYMNMPEDILTFMPRNSLALVQGIQLLLQNDGTLLFKLAAWCPSSFNFRMKGRIRLPNIDSSVPVFTNLEKEPSKHVL

SEQ ID NO: 944602 - protein, 95 aa, Homo sapiens
GCRNSERVLTHNEEWNLPYYVSIARLMPGTCHVLRRTALSALNGHKDCWTHQMILGEQSMETRDEHSHAKLLSQIRRRRPYCIAVQQQLMDTYHS

SEQ ID NO: 944603 - protein, 117 aa, Homo sapiens
GHGPVEQQMREQALDPAGSMNIYLVLDGSHSIEASSLTGATYGLVTDAPYPTICIGSEADRIKADCFTKHLNDSNSEDHKLKYGANTKKALQAVFSMTSWPDDFLMNVGRARHVIIL

SEQ ID NO: 944604 - protein, 104 aa, Homo sapiens
MRPSGHLRTSPKGSQIFLRKKGPPYCGPLPEPKGYAWGFNHINGWSLNKFRCVACESHKLFTNLPYYCTNIFRNKYRMLFSCEVDEQYVRKEFNIKTFSFRADI

SEQ ID NO: 944605 - protein, 67 aa, Homo sapiens
AREAICEGNHSFLDLFPGAAAGDDTEDTSTEFTDSIEEEAAHHSHQQVSQCQGLGLPGWTAHSPSEV

SEQ ID NO: 944606 - protein, 68 aa, Homo sapiens
VSPGWPGCSQTTDLVIRLPRPPKVAGITGVSHCARPGKKILYMKRGESKVWHSSSCNTETDLLSPPEG

SEQ ID NO: 944607 - protein, 98 aa, Homo sapiens
MCLLYLFSSGYTRGVYRRDAHSSVGAHRSTDFGEDYFIASRGMAFAQHLQLWPLEDDAYVESEVTEFAYTCDADELGGLFERPIVSWPAAVQQETLRL

SEQ ID NO: 944608 - protein, 96 aa, Homo sapiens
MADYNPECLQGNSDSVLECRMCSAAEDGPTVIDPLYNVNSCCWRRHLTVKAGSAVIACVCLCVHTVSVCEPVGEEIEIDRYDGAIRTLAVLHRMAL

SEQ ID NO: 944609 - protein, 129 aa, Homo sapiens
NQYPDTNQDAQYWKLICTLFPYTRLESDAHCADSYQLTKEALYETCAATCGITSYSLNSRNVRPRYTTYAGVSPQSLQGCMDSNKLQVMHASDSDARYVYDALYLVRVPHELFDSVTPWFTTLLVITWI

SEQ ID NO: 944610 - protein, 139 aa, Homo sapiens
MALTWVLTVLSLLPLLEAQIRLCANLGPLPITNATLDRITGKRYISYRPFAMEYMKSLQEIQASLVDSTHNKTDDTISLREYQTRQNQCSYNSRYLNVHRENGTVFRYKGGREHVAHPLILTDTKTLMSGYYLDDQICA

SEQ ID NO: 944611 - protein, 128 aa, Homo sapiens
RAQELLIHETRESHAQRHMDCGRSCLTPFCQKTQCQEGPRGGDTRSDAKMSSDNRSAKLDNYGDLSFVDISYITVLFAYSVMTKCKGNCSPPMALKDLQRFRNRPYEDLTGSRTQLVERQNLLAAEAA

SEQ ID NO: 944612 - protein, 42 aa, Homo sapiens
MTELRRHEARESPDAMRVSTALKRYSMRKRRSHTSPVTRMKT

SEQ ID NO: 944613 - protein, 61 aa, Homo sapiens
MDARICQGSDRERLPTCLPRSVCIVNCLILYDGLRGHHEIENHRRAVECMMVSTHTRAVSI

SEQ ID NO: 944614 - protein, 126 aa, Homo sapiens
QEQMPVMDDQRDLISNNEQLPMLCRRPDAPESKCSREALYTRSSILRTLLLAGQVTTVYFLYQKQGRLDTLTVTLSEPAAVEPAHEASQGYQACEQDAHGHTLLLMHALAMGALCQTPMHNATKLC

SEQ ID NO: 944615 - protein, 73 aa, Homo sapiens
HESRSYRATDIDYLVVNTLSRADIHLVELLYYVEELDSSLISSFPLLKVTHFTVFREADPHLPSCDLVSVPCD

SEQ ID NO: 944616 - protein, 168 aa, Homo sapiens
EGAARRKLLLLLMSLQVPATLHTLTHDHNMELSERAHRISSDDNLDSDWKLILRSIGNPMRNIMVCSIYQTIGGVILFLNTIYQNVCHRDLHRNMLKDMVIEEGIELDLRGAPLAATIAETTIQRLDGRLDRYSQSKTHGVNYGNGLLCWRMPIRIAYNRLSSITLTA

SEQ ID NO: 944617 - protein, 66 aa, Homo sapiens
RRKMSVDEVSDTQLMLGVVLIGSPGTEERETIRTDAHYTEEHMEAQADIVHGHSIRRTEPRVRLSQ

SEQ ID NO: 944618 - protein, 120 aa, Homo sapiens
MSYHRLLLLCLAGLTTVYEAGPTVTGESKCPLMVKDLDAVRGSPAINVSAHVFRKAVDDTCESHLPVGKGYTKSEYAPLTGRHLASAHSMSMHRCDSQADSGPRRYTIADLLSPYFYIPR

SEQ ID NO: 944619 - protein, 135 aa, Homo sapiens
MVTVQNSGVLTHTLLVLAGPWAKNPCVEPLSILFITMLHLSNPLVRLSTRSGAHRFSLTNCCVCRCQAYIALSSVVCCACHRILRVTSDVSSRAELNSVTTRIGDDCDCAVMFYGCQAGRPPYAPVYTQTSPDVS

SEQ ID NO: 944620 - protein, 71 aa, Homo sapiens
ASVGCRTEEGMVVAQGCVLCACATHNAHGSRITDALPLMIKAVAEVDEGGKFWGIAFAEYEDKLCIPPICS

SEQ ID NO: 944621 - protein, 144 aa, Homo sapiens
MRGGGVETYADSRSLYDIKAVMNICIPHTARLSDGADDRLLALLLTKGVMLADKCVEDVIQTHHSQGLSVYYGDIEDAKTHIICYSRITCLTGYLRIRARDLTDTQHSPLLNHIFFTGQWERLFVEDTEEEDFHWDQVTTVNGL

SEQ ID NO: 944622 - protein, 106 aa, Homo sapiens
MLLMPREQRRPNHASEGCATDTGDLAAHIYFMSVARRIGSMDHTVVGTTLYCIIYTVHRGISAGRARPEYRLPSCGNYSQDMTPIRIGLWGMLQDVSNQTLLKAET

SEQ ID NO: 944623 - protein, 204 aa, Homo sapiens
MEVYIMRIRVDHPLQYLPAIITPITVRNILRLLRKLTAITFIVHKMDGRQQYHASYYVSILICKTDIIKITEACLFRVNLKTQAAILTTLCRADPRHMYGEWLHYYYQMHSRRSMYHIKNGYCTGFISESQYTYALTVNAIYELQTTDMNMQTVKHQDQLHVRKMDGQLSPEHLIVGHPQYYECRDCGYESITGTHCYIMGGYW

SEQ ID NO: 944624 - protein, 131 aa, Homo sapiens
MFRLALLPEDVAHGIGVGRCPRYVRPLAPDCIVSRQLSGPDYNQRAHTATDLRGLGHPGHCRSMATVHGCDHLPPDEMTVKPTIECWTSPTRTMSGKTSIASYPIVSRGYTLLTPDVVADQFASAWALKAH

SEQ ID NO: 944625 - protein, 97 aa, Homo sapiens
QPVFIGPTGPKGLAKLSLQQVAIAQTSPCTDTVMDTVNTTLQYLSPATLKHHFLPGLSVIRQTLTHERSYFSPVPFTSTSYYSSHIIAYHTSSTCVL

SEQ ID NO: 944626 - protein, 104 aa, Homo sapiens
RESREREREREREREREREIQRETQRATEIDSSFPLLASISLYCLLLTLSLCLFMLHPFLPVFLRHLLLLVRPFLYGSCPTRFISLSDTMYSLTLASHTYVSFS

SEQ ID NO: 944627 - protein, 117 aa, Homo sapiens
ERERERERQSERERERERDIDTERARDTWIKFLIIDSSNLVTVSRSPLPLPNGVVLYLMPECRPFSHAGSDTESLITPGTPPYSTYPLSAAHLQPCASSSPIISFSPLSAYCSLLLT

SEQ ID NO: 944628 - protein, 88 aa, Homo sapiens
MDALMPLAVSNPKHDPTPLPYLCHDEPYTLDIYLSDNLGEGMSQAFTICMSNFKYMYWTMLQQLTHHSVNGCPAAGGPTGFWDHQRAR

SEQ ID NO: 944629 - protein, 103 aa, Homo sapiens
TVSTVLETYGVLAHWGAALEPASHVGDVRWIDVDGNLPTLVKPKVTAMGTPCHDRDWTLLSTYTQWPDNIRTFMPTDFLYVLQSVKQRLQDAPMLVILLAVCR

SEQ ID NO: 944630 - protein, 69 aa, Homo sapiens
ELDQSLGIGSEYFEATLCSENISSCIVYGRMTDASTIYDEQVRRSELEYSGFVNLKRLLAPAARIHVDS

SEQ ID NO: 944631 - protein, 68 aa, Homo sapiens
VCLALSAGEELYSGVAADLMGRDFTIFRSLRQRPSLRTEPHDSRWLNGERADGLVDRGRHPPTGQVPS

SEQ ID NO: 944632 - protein, 106 aa, Homo sapiens
MLEDLRDEEEGFIFHTVTEVCYLTNIGLQSLHRWSVAARPEDSKAEKPEVGYVSDRSSPKDTRNAAMEICLIVLDDEDWTLANIYPAKIMIDISCGLDACCGDLCC

SEQ ID NO: 944633 - protein, 66 aa, Homo sapiens
HSRVLCCGHRHRLCIRRLWTRCMSKPQSLMSKHIPQFCGVLVHTFMEVLKGSGDYWQAQHELYADK

SEQ ID NO: 944634 - protein, 119 aa, Homo sapiens
WNRALSRLKLNSTPDIGISVYINNLFETDLMPAAIKIYRDTNEPADTKRSHIYGSRQMILETEASDELKRCEDPRLMLMGFKPLVLLKHHYLTHSMCEHPEEHMWIVSFLVQRSADQAA

SEQ ID NO: 944635 - protein, 112 aa, Homo sapiens
RSLGVCCLIATDDDTYFSLEELDSLKYTDLLSLVKSMVLRSNLWTSKLIEALTGYINHARAGTQNHDVKPSFCITLGDETEIRNSIQQEAVRQALGHVTINKEMVRDSLRGP

SEQ ID NO: 944636 - protein, 115 aa, Homo sapiens
RKRALSRLKLRLNRDIVISVRIYNLVQKALMPAAIKLYRETNEPVPIPGPLIHVQAACFCLAIPRGLRSMGVARLYWRKRTTEELLKHHYLRPSMFAYPEEALAIGSLTLFSALL

SEQ ID NO: 944637 - protein, 80 aa, Homo sapiens
PRPTAPCYHTTLVKPFTHIHDTRKKMQTGAISIVPHGNDDRLEHKHNISRTNPYTFSILTLTRNFFARRAKAKTPRDQSS

SEQ ID NO: 944638 - protein, 125 aa, Homo sapiens
AVGPRVTELLRRLCSDSRYRARRQLCPDFCVFSCSEGSGLQNCDLANGPETGLDYATLVTFGSIFGYIAERGWSAFECVVFLVDVLAAYGAYTGFNDKRDVKVSLCTGFFLATMGVRFKRSDCVV

SEQ ID NO: 944639 - protein, 76 aa, Homo sapiens
MANTGGPLSQAQRPDLGFGSMSRGRCLWPTLAASGSKWTSTSLDPPLSDALNAVTTIPTTYASCAVLVSGELTSRL

SEQ ID NO: 944640 - protein, 124 aa, Homo sapiens
RHLLLHALGHLFAFHTLLTMTHGPLEFKMLYSVLHSMSLETLFNVVPWSSSHYSVEHPKHAITEVAILGVDEDGGYPLDLDEAVMERTPLWEQVVVYTIVPYGMPNQDTTVWVIQYDTESSVHN

SEQ ID NO: 944641 - protein, 136 aa, Homo sapiens
MVRVRSLYTPPLPGSDSVCTSPSLTIHVLEAKVRRWSSYTGCHEPHHEWSVSMYHVPKYRARPLFSVKSALRMQELLPARTKRFHSSRETGRSIALRHGAKWAWFVFSQSNMCLFTRRSRQRREGPGVDLTSPGSA

SEQ ID NO: 944642 - protein, 156 aa, Homo sapiens
TEANLIVYIASVPLGQDAYAPDIVAAACRLTARYGHARYQTPLCSYYCKAQERTASGSIMLRHILDESYETYPYSELISCQQLHGIFCMTWSDITGRRLCTQPRTEPFTDSKREMPGTGTKMTLQLPRIRPMLSENTSESHPEALHDSIQDAQTTL

SEQ ID NO: 944643 - protein, 105 aa, Homo sapiens
MNRYIKLIAHSSRSFNIRDRATELGRPLSRFALAIVRHMFDQTCPRLRISLDTYDRTCQSHILKDDSFTLTQSQLISQVNPARDELNTHSFFPQRVQTFRSPPFN

SEQ ID NO: 944644 - protein, 99 aa, Homo sapiens
YSEAVALMWVEGVCGIYQGRGDHIHEEPLSPGIDAERLLAESANPETTAPDNMQVQENLNITWTYGKWYNQCNGITWPWLYNIMDWKTVSTLVLLEGAT

SEQ ID NO: 944645 - protein, 102 aa, Homo sapiens
NYSAVGGTRISHVTAVLAFINYLDLEYGNPFMVIEPVVALYSVLSGHAHKLTHVYLHVPTIGLPTIVACTHSIMWMNAALTEAEYQNGVITAITLYPSLDID

SEQ ID NO: 944646 - protein, 135 aa, Homo sapiens
HSRLLCCGHRHRLCRRRLWTRCMIRPQSSMSEHIPQFCGGLGHTFMEVLKGSGDYWQAHDELYADKGTVETGYWFTKKPPYREGILDTRSVELKSTEHFTRESDLDGVLNAHFFCGPQNYRIEELLRLVRRVFTY

SEQ ID NO: 944647 - protein, 128 aa, Homo sapiens
AREAALHSRRAPGLFTHAHRAVSAQLEERRRDPHPRMTLQEGDCRGSQNVYLTKGTGDSDEMAPEAPQHTHIDVHIHHETVLCKILVTWWSALRPRANQARGSRLLWASWVMQRAGDLECAPRRIFLL

SEQ ID NO: 944648 - protein, 110 aa, Homo sapiens
GPSQVTAYTAYMAKANILTTHNQYLLRGCDLKILMNMHFDLKLTKWCLYRMQATSADDMTALYRGYQGPCIAQGGFNAISHGTASRMLDRFADIGPELVRARARIAMELG

SEQ ID NO: 944649 - protein, 243 aa, Homo sapiens
MGCRLYGSTIEQGYQNMESGGGDIFRICRFHTITRMTNTGSLQMYRAPTSLKAVARCLHNGLALVTHATRMGSDTDPARITASMQKKSNPVIELNMNFSNSLQKMDGDNLVFKNCRPALATVEPLPPSSGFKGSSSPGSLGELIYYYHIDNVRFFSHFGEPVSPEAFLSGATVGAQGPCVADFMCMGDREYWFTTMLSFLYSLSSHNTRDREMPLGASHRNLKTGGTRDYRRTGGETSRGSRD

SEQ ID NO: 944650 - protein, 129 aa, Homo sapiens
MVKGLSVLLLVLLLGLGLTPTTLGQDNCRYTHFLTQHYDAKPQGPDDRYCESIMRRQGLSLPCKDMNTFIHGIKRMIKAIMCMNVNPYRDNLRISQCLFQVTTCKLHGGYPWAPCQYRAHMRVQRRCGL

SEQ ID NO: 944651 - protein, 121 aa, Homo sapiens
KEWPVLEATPARALSNYAIKRPILLGELGYARVPAKPFTLCEHTVYTLFILDQALGQQVPAHDFIHIPSCVEALEDSLSPVEVDIGHARKLMWSALDGYFIQQIEAFCSILDSGQRVYSMS

SEQ ID NO: 944652 - protein, 101 aa, Homo sapiens
MSIPSLEELDSLKCSDLQNLTQSLGLRANLRATKFVKALKGYIKHEAKGNENQDERQTSGFSCDETRIQISNHEEAERQALGHVTPRRRCKTVRVDPDSQS

SEQ ID NO: 944653 - protein, 72 aa, Homo sapiens
STANRPECASNPTVTQHALAMEEELRREGSIETLSNRSSSTSGSIPRNFDGYRSSLSTNESQTLRLFPTGFP

SEQ ID NO: 944654 - protein, 83 aa, Homo sapiens
AKVMPFINCHWVIHYYELITLQTLLNALDNCICAELTIQDAVMPLVKSAHSNSVFAMISTCFQTSVWLSNVKGTARLLLTGAC

SEQ ID NO: 944655 - protein, 138 aa, Homo sapiens
RCYTAAYKLANDSCHLSLLFSASLDETRFRSSRDIVYYKRYQSVVVTFIRQCQLFFYTGEIVQTTNIEVYFLSFKPGTVVGTNGATSAVVSIVASVDTHPITNRFSRSYMPQKCADGLYLDGRFYTYLCPGSGVYCMS

SEQ ID NO: 944656 - protein, 85 aa, Homo sapiens
VPVVCLVTVCAIHRVDLPLFYRHSPRRDDTFTDGPYDAFASYLNAHLNIWCIRSAYWTGTYCLQEHAADDMHSLMAYMPKTSHLF

SEQ ID NO: 944657 - protein, 88 aa, Homo sapiens
GNPTRLWLNEECNPYVTSFSIYSDDSMAVVRRDAHTSEVAHLVTDSGEDFAALMLMACAEYLEQCSFEDHVTLVNDVTVCTCDAVDSL

SEQ ID NO: 944658 - protein, 136 aa, Homo sapiens
MVRAEDSRSGRYCSGLTDVRSSRVTCSSVSPNATGMACTDTVITPVETKVAVHRILITLTSRSVLTVNGPVRMPTKTLRITTRQTLVVKLLRLTDRYQIRIHKRVIDLYSRCEIGKHITIMQIEPEDEADVSIADA

SEQ ID NO: 944659 - protein, 217 aa, Homo sapiens
PETMLLPYLTKKLRLTGTKYGCGGGRCGACSAMISRYTLISNMIRHYPANACLMPICSLYGAAVTIVEGIGCTHTRIRPVQETIAKGHGTQRGLCTPGMVMSMYTLVSSQPEPTLDQTADATEREPVTLHWMQPIIDACKHFCKTSDCCQLAERSPTRSIRSGEYEYVPSYPAHDRILPSELRIIAYKQYGWTPVSASQTMRPGSPLPWTAEVFSLT

SEQ ID NO: 944660 - protein, 80 aa, Homo sapiens
MALLTAFSSSVAVTDKDTFELSTFLESSKAPQHDRNELAEHRGVGGGLDGPPLTRRVWGLKKALWLLDEYLEVAKPSLGF

SEQ ID NO: 944661 - protein, 49 aa, Homo sapiens
MHSLETHYAQLQLFEKPMVKWLTAAHNTNLREMNAYCNTEMTPLLRLVR

SEQ ID NO: 944662 - protein, 110 aa, Homo sapiens
MHSLYFRPIVAPPTVELNIMLSPVARNTAWRDFAGQERQEIRHGYRLGIKYLMLTTAIHMVRDPMSHCVESHIQSLHWTVLYTYADIKEEDDDYEDKDSGTTQTLVRVKS

SEQ ID NO: 944663 - protein, 103 aa, Homo sapiens
ARSDGVPILSDLCAEVHTLSDIDCNRELADYEVVTHVTATRVQAVKSYRRMAYGTSQDGYSSEHGKLCHDCEYGRSANDVTRTDQLTVQIALLAPGTARDERL

SEQ ID NO: 944664 - protein, 230 aa, Homo sapiens
PFSLNQRGPRIGPPPPHSAMPLSLESSSHLTVSAHFGRSASLLPDPFVSSLAPSHKGSPLACCDWQTKWLAQTPALSIVGYNSSVSRARWVCVGISGATIFVFVLKLRRALVPASVKWSKESQLKGCVRIQRHDAHRVLTRDQWRPSSMALTCNPSTLAVQDGQITRSQDQVATHGQPPSLLKIHKKLTGCGVGRLESQLLSRLRPKNGVKLEVVACSEPKVHLCTPAWA

SEQ ID NO: 944665 - protein, 117 aa, Homo sapiens
GCRNPDRVLTDNICHAINQDSYVINYIRWPTTIRVLSCIADALFIDSHIADRIYAYMIAKYGWIVTSQEMLSCIRESIISVTCDDSRLAKELNVSRRKLTFRMVALIDTSWNPPVVY

SEQ ID NO: 944666 - protein, 159 aa, Homo sapiens
MLYRSRTQPLHDRITRVWHRLTSGHASSDISGTWPAFGLASSLATAARASLTSAVLIPGIALMSRTVRKQCTRRKHRRLIRFLDHKSAWILNVNTGVHRPRLCLVGNVSGHSVRWKGFTQSPQMELKVHKVSHGGEGEQMRVCVSYWRDVRRELDCCCR

SEQ ID NO: 944667 - protein, 137 aa, Homo sapiens
VIKGRGCGGERIQKGEDGMSEGTFTLIEEQEEYIREDIEWAHIDYFNNAIIWDLIENNTKGILAMLDEECLRPGTVTDETVLRRNQVCATHQHDESRMSKCSRILNDTYLAQRWLRSQHYAGKVLYQGEGFDDAPWS

SEQ ID NO: 944668 - protein, 223 aa, Homo sapiens
MPRVTQGHAQRPTSSLRSSQLLDDDPKWTLVRTDLVLYDHMQQMLMYLPRTAVLLMGTQHHDALGRPRAPGKHPTSGETAASLTGEWGLVFTKEDLTEIRDMWLANDVPAAARAGAMSPMEDTAPTHSTGLGPDMTCFVQAVRCPRFSRGPIEILSDVLLIKTVHKPSTQRGTLLNMLNIWTLSYGLSLHRCCTCENLHPWELDVQHAPLLAWWAPPVGRGCL

SEQ ID NO: 944669 - protein, 111 aa, Homo sapiens
MRSLPYYNTPIMDTVDLKRLEAIQNDTRLTNFSALRTGWCLLAKTDVARTKRYYFRVDEENVDVTEGGEHQLRATEDRRATKDQCNELTNPGESCWTTREPYITSFDHSPV

SEQ ID NO: 944670 - protein, 121 aa, Homo sapiens
NTTIRDAVFLLPKGDDRLLVYAMRFNHSFLVSKVIAANVRDLNRGHRLRPAVMLVQRLLWLFIPFLRGGFKLFGLFAHVFLLGFITLDLVGVVLGVNPRNMGRQFRGSAGWIWPGSSSLVG

SEQ ID NO: 944671 - protein, 158 aa, Homo sapiens
QRLTRLTEWPTCVEGCHRGLIMPSEPTQDYERTLMFLQDTAGVLTARIESVETGLKLGLCGTLLYHLIGQETMADYLLNTLNKHQRYEYVQHYSLGSACDNVKRVLKSELLKLPKTHKVNVLTSTANMNSIYTNYAAGYRDCLKTLRRELLYIRDSCT

SEQ ID NO: 944672 - protein, 104 aa, Homo sapiens
MHRMVIVKLLPGRVSRVYLQCAVELDMIHSRMCAVAQTDGYCFIEQGTINALGEVYRTAREAELRVRELTDMDPSDLPYIELRHVDYESVGYGLMGTIELTDGT

SEQ ID NO: 944673 - protein, 82 aa, Homo sapiens
MGSDQMREAIMNHERARQMRAQARIAAKGTASDTNRDDHQTDTEDDAQDQACLRKLGRQTTSGTGERKTFTNQGTMTASHAV

SEQ ID NO: 944674 - protein, 109 aa, Homo sapiens
MAACTCSPSCSWAYGQRITQAHELRAAAIYQSVTALQYGQHDKTLTLRVLVASRWNTCNSVTNEHLALATCQAEVMVLVIRQPSIQTTTPCRSAADIGMRECIPAKILT

SEQ ID NO: 944675 - protein, 78 aa, Homo sapiens
SCAHGVNGALLLECTIHSAILVMSFTRIDYDKGVNTCLSEGRAYEGYYAIEAIKLESTAKAIDTSEALRVLDMRRLTF

SEQ ID NO: 944676 - protein, 123 aa, Homo sapiens
RAERLAHISALQPPNQLDKIFDTDLFAMGAARDLGSESGPLSSDQLSHEGGLSLSPTFVPQPSSKAHVGAETSCVCWGQASFTPDPRDYRTLHQALPIRMNPEPWSLRDFSQANPTPAPYLKL

SEQ ID NO: 944677 - protein, 181 aa, Homo sapiens
GGERRASPRADWPITGTKMKVLWAALLVTFLADAMPHEEHAMETEPEPDLLPANRVAKPTALGTGTGSILGLLVRWVHTLSEHVQEELLISQVTHELKALMDETMKELNAYTSELEEQLTPVAEETRTRLSKELHAVHARVGADMEDVFCRLVHRSEVHAMLGQSTQELRTRPWFPLLKMQ

SEQ ID NO: 944678 - protein, 103 aa, Homo sapiens
VLDICAGSLTVVQVVQMPETVSEAAAEEVRHLMTKSSLQAMLLIYADYKQATVPDISTERPALMYFTPKVTWDAWTELKGTDMEDAMKAYITKVEELVAKYRI

SEQ ID NO: 944679 - protein, 126 aa, Homo sapiens
ARVPVAMEDTAQSARIKECGLCLLDVDVTLTPARQIAEADGYDYCKISEQLPDDDEVIDTLEYVLDENGIVRDKYGRLMSKQTIQNQLLYQHRQELEHLCLNYVHLDNHAAHRHTSDELPDLMLDI

SEQ ID NO: 944680 - protein, 109 aa, Homo sapiens
ATMAVTTELLQMDLYALLCIEEKAEDKEVKKAYRHKGLFWHTRHPDNSKAAELFHQLSQGLEVLTEAATRAGYDKVRKAKKQAAERTQLDEQEDEEEEESPSTRTLERE

SEQ ID NO: 944681 - protein, 132 aa, Homo sapiens
KIPRKVVFSSGYFALKRLYKFIHTAGFSGFKILERMIILVTPQCLKKKKKLPSPENSTGLFSFYLCADVMYFPTKSTLPLVRALGDLFPYGTCDRTDPSLDRYSISRKALYYTSLGCSSGMRMTNSPRLPLI

SEQ ID NO: 944682 - protein, 111 aa, Homo sapiens
MFRARAKIVKPSGEKPDEFESGIFQALLELEMNSDLQGQLKELNITAAYGIEVGGGRKAIIIFGIRSLTEIFSRKSQCGLYANWRKSSEGSMSGFIGYRRILPKTLSRTRL

SEQ ID NO: 944683 - protein, 120 aa, Homo sapiens
TNYPLIYRPPHPIQHLRMMKLPLTPRRLPDPPNHHRTIPSHALLTIRLNRLFINRPYHSRRDLWLTHALPSRHWRLNIPNLPQRYTSHEAYITDQSSTPPGIGLIRLLATIVTAIIGFVS

SEQ ID NO: 944684 - protein, 114 aa, Homo sapiens
FAGAEDVLLGLQTTDFARQRADDCGEMLLRLVNTYGTSLENCCAAYNLMKAVPNRSTKCKPDGEDPRNILKRACYTKIDPKCQLQLLSKSEETFEMWSSYVVNITIRQGPWQDF

SEQ ID NO: 944685 - protein, 107 aa, Homo sapiens
ADLHQRVPVEGSSYEHVKGKIDTMKKFYRSIRGEDHPASYPAYPSCVKNPWDCEAAEAGTASADATFLLRWDMALDPLRPSVLNGWPHGTQGLEEKPSCAPDVSACL

SEQ ID NO: 944686 - protein, 135 aa, Homo sapiens
KRTGPDAGRETVLLCCKMYRTKVGLKDRQQLYKLIIIQLLYDGYISIGNGLMNEIKPQYVCAPSEQLLHLIKLGEIVNTNPYVPWQGMENDDTRVQYAIGRSDTVAPCTGIDLELDAYVQTMCAEASEYETCYVT

SEQ ID NO: 944687 - protein, 59 aa, Homo sapiens
MREPAEENRSNRRIQASEAYETLMDASVVASTREDELSGPEGDPSTPEEASTNAEGLGP

SEQ ID NO: 944688 - protein, 102 aa, Homo sapiens
MPLTLALQLSLGSNYYARVRLSSIKVLGVIPHLKRMEHHHEGCDILSPVPPAVDARVQVDNDVDEGRGTLSLIFVAVIIVLRRNTVFAFDHGKVMRFQKAVC

SEQ ID NO: 944689 - protein, 158 aa, Homo sapiens
MPTVLSRQFIKEKLILSHVDIQLKYLDLGLPNRDQTDDQDTIDSALVTQNDSVADKCATISPDEVRERQFKLLNMWIGPNGTIRNILRETVFREPIICQYITRLVPGWTKPITIGRHAHGDQCKDTDFVADRAGTLRRSSLRCRGDKNGCPLARGVAG

SEQ ID NO: 944690 - protein, 92 aa, Homo sapiens
GDYVFLQAALCVPRRDENDYLTSHRTVAHEHSEMYTQSMAFCWNLIGAVRYTTFEYPNTIRNTCNTGLYLNGAESAKRTEEGHTYVCNTSGL

SEQ ID NO: 944691 - protein, 113 aa, Homo sapiens
LDRGQVHGCEKRTWACLIEAYERESDQSCELKIRHGVDRQGKYPEECSTLRIMCITERRTERDTHAEREEEPITVTAELVRSDETACTHWQLSGTTIWKWLTSEHCKLLRVCF

SEQ ID NO: 944692 - protein, 120 aa, Homo sapiens
GFRIVHKFEGSRRLTPMLEEVLLWVVNQCDKLHCCLILRNYSQAWRLMPVISASRVAGITGTCHHAQLIFVFLVETGFHHVGQAGLELLTSSYPPALASRVGIIGVSHPPSPHVNYFNVS

SEQ ID NO: 944693 - protein, 130 aa, Homo sapiens
PATIYRWKVVPQGMLNSQTFVGKVIQLVRDQFPDCYIIHYVDDILCAAASRDRRIECFARLQEVVGLTGLAIAPDKIHTTPYHYLGMRVQEKTVKPQKEEIRKESLKTLNDFQKLLGDVNWIRPTLGIPT

SEQ ID NO: 944694 - protein, 170 aa, Homo sapiens
MGLCHQETTGSGHVWHRAAVPSGPLPMEVLCQPEHWSGPRDLFSGLGYHFQAMNLGAVSDEQGSTSPVTCTFPLLAAHSVRMEITTEVIQDLICSECQMCRLLNAPRDSHHIRQQLLLETYTHCEGALCHCLCVPCAQVSVCEPVGEEIEIDKIDGFAIHSTLEFDRDSL

SEQ ID NO: 944695 - protein, 188 aa, Homo sapiens
AGIGTRLTVNREPPLPEGVFICILMVDALCTTEPVSLLECGIMEEREMSRFTEADDTIEDLACYHLSSKLLAESCVVYDQMHIQPCAKAIYLFSASSTTASHVFVILGTNGVTYAANSFPEIEDALNPHKYQMLMATVDVMFVSEGQTLPDPIVGLNDTPSFIMADILDLHTGQCIDSTTLTWTCFSG

SEQ ID NO: 944696 - protein, 97 aa, Homo sapiens
RHLVKMNHLLITTQSATEMNDIREPQLWEQWSNLPATLFSIEASILDVVFETAYRRYYCSCAVVTVLLIRNDYSHLCVHPRDNSRTQKVVIYVQRQV

SEQ ID NO: 944697 - protein, 124 aa, Homo sapiens
MNMQDGFLITLLLLLLRLAKTYETTLEKCCAVLDPHYSYAKVFDEFKPLAEEPQNSIKQNRELLEQLGEYKFQNALLARYTKKVPQVSTTTLVEVSRNLGRAANVGNILKPRCTRQRQCDTVPA

SEQ ID NO: 944698 - protein, 168 aa, Homo sapiens
HEVFLCSDMHIYSIAGRDPQACAPCQDFSSSVWVPHSGPIFPMSPAGAGRHPSLLAVGPSWAGIGSPAEWGVVGQSPRSWAPATGTQGPRTPSGPPHRHTVGCWPYARRRAPTSCLVCVCVWFSRNDSNCCLDIEIYCDCECTRLDPVSYLHQFGKNAGLRLSHLNRM

SEQ ID NO: 944699 - protein, 38 aa, Homo sapiens
MEPNALLTFEDSNTNGFYCYTGVHVEGADSVKGTEGGL

SEQ ID NO: 944700 - protein, 200 aa, Homo sapiens
GCRILHEGSWSQNGAVLCSYSPEPPTSAGSPYPIVCQPMTGAHDQRHPGHTSLGSGFISHWAFETRSTISRITRYKQPSFTLPPTRHRTRSFLESARPEQDQCVYNTTYLNVHRDGTIYRYLGCQEHFAQLVILRDTKTYMLAFDVNDEKNCGLSVYADKPQTSNGNCERVTALDCERIFQVRCRVHRLEGRGPYLDTFG

SEQ ID NO: 944701 - protein, 81 aa, Homo sapiens
MCHRSTERHLWITPMYMLVIRRHTVSLYVRSQYVLTELYTTRTDITGNCKTEPSRATYSCELACHHIFNVLRSLTGLQAVH

SEQ ID NO: 944702 - protein, 126 aa, Homo sapiens
SDVEDATMHVNAARFINHSCEPNCFSRVIHVEGQHIGIFALRRILRGEELTYDYQFPIEDASNKLSCNCGAKRCRGSLTEAAAVHHEPLHLLVSSLSSWPYPGGFLDPSRAYYPHTLCVKVDVGCV

SEQ ID NO: 944703 - protein, 111 aa, Homo sapiens
RARTHILPWFILEGRDWLDQRARGLLPWSMPFNTGLILANELDRCNGNDCVGITRLTVALRHHVSVIAIMLRSAVLANREKELYQCDWRLRIEDTLLCIAKSLGFLIGEDY

SEQ ID NO: 944704 - protein, 85 aa, Homo sapiens
GAKRMAELWLWPRGKQHKRGWVVLEETGMVKTGLPMERGKERQKRGEKREKGKRAEKGENRRGLQQKAKGIKCGFLLKAGAHRLN

SEQ ID NO: 944705 - protein, 109 aa, Homo sapiens
MKVLGEKHLDLLYPTILRHVGAGIAESIGEGVSTVKPADKVITLFLQCGECSSCLNSEGNCIQFKQSETQLMSDGPSLFTCKRTSIYHFGNTSTFCEYTVITGNLTCHD

SEQ ID NO: 944706 - protein, 85 aa, Homo sapiens
QAGGEAHAQAQAQAEAQARAKAYYASQKAELLQHQHELQLLQPPPHFQSTGAAPNGGGGGDGHAVTIHHSGWLMTTTIVYGPMSS

SEQ ID NO: 944707 - protein, 119 aa, Homo sapiens
MKLPTDASPIYPACCFLLIPFYLSPDSVECIIFFTYVPQLHVRIFLPLPQLPNLVHSSINQLQLTLDYAGHAAQPRTTSVHDESVIEYYDHESLIDLMPLLLDYSTTISSARLALTTDG

SEQ ID NO: 944708 - protein, 66 aa, Homo sapiens
HEVPSPRVSPASEYSQSPWLLRHPHPSHPAAGPCLCGEQPALCPCPGLPNYRPVTPAQLVGLLVRV

SEQ ID NO: 944709 - protein, 108 aa, Homo sapiens
HEVVFAYGKQQQTNTKCQSPGCAIGLSVHVLVNTACSGTNTKTFEERLLVTFCDLRNPRPVRKAEIHIAVHDARNSTESSSHCGADLLSLSVHAILFCTVTLVQEVLV

SEQ ID NO: 944710 - protein, 67 aa, Homo sapiens
GACMDTLASVYEVVLLFIFVYALHGNDRLCHRRKPEESRIIVGAEPELAKVTDILSDSRLIEKARQV

SEQ ID NO: 944711 - protein, 107 aa, Homo sapiens
MTTACTLQMRQNYHQNSKGAHKPRRANCELYSFYGYLCIGYYFDREEGALKNFGTNSFHQSQEEEEQAEKPVKLWNQRGGPIFLQEIKKPDCEDSESGLNAMECAFL

SEQ ID NO: 944712 - protein, 123 aa, Homo sapiens
DTQCNTRAPVPPAEDGIYEEHSLNEQESIQGAVPVSDDEQVDVEPPEGEEKVETAEVEDRTEEPMETEPKGAADVEIVRDKAALDLTPIVLADKGQNIDIVQRHEAMLQNGETPKDLNDEQND

SEQ ID NO: 944713 - protein, 116 aa, Homo sapiens
MGSSLPRWAGLDLTFLILKENTICKLQMCFHDNRYDMSQKRYEYEDQNVLFPSALEIPVHNYRFELTLIGISCCSNCKDLSGAEATTSSGLFSCRKVHHVGSIWSHYTLFAAIPPP

SEQ ID NO: 944714 - protein, 129 aa, Homo sapiens
LSTLFCPKEDDLKGFNGDGVSTYKRHFGVVFEEKMPSTDTIFVMNSMVLIFKQWCRVALLTINGSIPRSQYGEIGNGPYSSCGAFTWMQYMTLSKRNASQHLPHIIFHDRCQSSSTSTFGCCVITQLGI

SEQ ID NO: 944715 - protein, 83 aa, Homo sapiens
MLFSHRTYFGVVETIYVRSYACMFAFAIATSHSTGLHSPYLHVEPVYDVMSYNPEVLYPDDVWTASPDITVMRYFSTTDYDRE

SEQ ID NO: 944716 - protein, 104 aa, Homo sapiens
MIMPEEILTCMPPNFLSLHCQLPQLEELRDDGKASTDEPRLACACLHEDGGALRRMSSSSPETEIMQQLRLLNVQVSDRLYHESTRDAAMENCLCAHDWEDLAT

SEQ ID NO: 944717 - protein, 114 aa, Homo sapiens
MGISACLTSRTLCLYITYAFSARQWYCTVIISSSGTFLFGGSSHISSSVPVCDAGACNGSPQAPCIRVVYLVVLWSSRQMLSLPGSCWTGSTASFRVRLDPLLGSLFVQSKNLI

SEQ ID NO: 944718 - protein, 112 aa, Homo sapiens
LEVLALKLGKQLSFGTRSLSLSGRETAMSGFLGTVGCALGGPSRRKMLQTINYSLVLSLQVLLLFYDLFVNYFSELLLFNIIIMVLMCLNTLIFQAGLDNLLYHKFRYHHTD

SEQ ID NO: 944719 - protein, 54 aa, Homo sapiens
MDALHVIEILTGTWEGYTKPDVTAYRTTTTGSHGLGEFFDCGPCWDEFLRFSGL

SEQ ID NO: 944720 - protein, 80 aa, Homo sapiens
PTAVMKKEVLLMGNSRSWKTTMMSILFDDYIVRDTRRLSASIDAEHSRVRLLGNLVLYLCHCGGLETVLDNYFASHRYGV

SEQ ID NO: 944721 - protein, 96 aa, Homo sapiens
MCRHWKLQDPKDNVCIYSLYLLLSYDQYPLLRSNEASGYAHVDYISTGLFHGELPSSDYYGNYVLLDWAYNERHNVEQANGIQSHRQDHQDTFVPL

SEQ ID NO: 944722 - protein, 87 aa, Homo sapiens
QTTSGRDKRVPVPLGDKSRPGAIPRCTPEILGSSPIQPSGFKKSRLSIPKKSYPPGGVKKQFKHLVLLIASKKRWGKVPKGSRHSEF

SEQ ID NO: 944723 - protein, 42 aa, Homo sapiens
MSGYWMFTRAYTNWMSVACILLIMHVSSDTYSAVHDPHSTQV

SEQ ID NO: 944724 - protein, 100 aa, Homo sapiens
DGLASTGRSLCETQLVLYADAQELKRSVGKLPSHRESLQIVQAQVHTLFSQDQCQGRRMTAKDLLDRLSSIDNLKASLSQVVADLKMLRTARDSLCAYSV

SEQ ID NO: 944725 - protein, 152 aa, Homo sapiens
EFGTRESLACSRSSLCNTTLVLYADAQELNRRCGKLPSHRESLQIVQTQRHTLVTRTNARAGCLTARTFSQTFFSDALKASRSHVVADLNMLRTAVDSLCAYYCKIYATENSLDSDTGLLDDLTNDPHMFAGAVAEITQIGLNELSVHCAEL

SEQ ID NO: 944726 - protein, 120 aa, Homo sapiens
MRRRTELETVSARRCGGTGGSSLIGSSMGSSGGGSIDSFSEHLITRKPRTALALPSALPEGGRLFMDHTGPDYQPDVSVQRRVEEWNKLHNYYVHNDNLNMQSLEIIIKESYAAPRRSCG

SEQ ID NO: 944727 - protein, 125 aa, Homo sapiens
MSGWESYYITEGDEEADEEHEENLEASGDYEYSGRDRLIFEVDAFNAILESHSEHELTPFDMSIQCIQSVYISEIIRSDRDLLAAVIYGTEIDIYSVSRNNIYVLHELDNPGAHEFYSSTRFVPG

SEQ ID NO: 944728 - protein, 124 aa, Homo sapiens
ITRDQKPGNRNLLWKSPRWISKLGAHLQKFSDTGENPVKLSLSVRKVAMRETNLLIESKRVHVEANPIMNVRHGGKSSTWASTLANFRGSHLESKPFQQQVTNLSFPIAISQPSRKNSQLHQEQ

SEQ ID NO: 944729 - protein, 101 aa, Homo sapiens
TNLRQMRLSDSLSPGSATAEYAELKKMELVEIYYYMIPHYACTRVMDHLRPLGRVRWYYMDMSRITKALTDTLSRDCSDMCNSDAPTHLMTCMACCETRTT

SEQ ID NO: 944730 - protein, 115 aa, Homo sapiens
GPIDRPPVLGLAPARRALPTPEPGRNSSDSSLAYTIAALQTGPVVRGSRADPEAGFAEPPTRAGPLEGAFNSRTRQANMTENFTFDPADKPKRAKASKKCTDSTPHSDMIVAVIP

SEQ ID NO: 944731 - protein, 141 aa, Homo sapiens
MVSECSICMCTSMLLLMSQLLIVTDHFIPYVYDKVCTVATFRDTYGAMAELLRHLYGLIRPEDDVMCTGLYDDAEALLHPYLDETARRHPYLDVQEHTLFDNGNQAGVTECCQAADAACLESSSMNSAMKGRLRLPVTEGR

SEQ ID NO: 944732 - protein, 62 aa, Homo sapiens
MGSLVYATTFLDITSSSCLIHYISIRLSSQGDIDDMYTVYDAFHPNERKSLLEGTMHLEYRH

SEQ ID NO: 944733 - protein, 104 aa, Homo sapiens
AQCIAVCETPALTSGGLLDKDLQKVAHSIHRAVELTLQIQSDTGVRATLKEFMERLAGDKYQTTEQALRKEVESFDSLFHMHCLPDFYRSAPTLNPPGATEEAG

SEQ ID NO: 944734 - protein, 112 aa, Homo sapiens
MLRDFDPMTHTEEPGVCTNLRSLRLLDNIELMICDHILNCIGNVTSVTSRNRVLLNSECPYCASWTRSNKMLALRISERIEHFKHHSEPISYLALVQGHDQITESMKKGSWY

SEQ ID NO: 944735 - protein, 114 aa, Homo sapiens
MLRDHEPGGHAEQTVGVHESPHHDVHGQVLKISDTDPELWRDCLDWQSGKRQTRGKLHITYSALLNKEQDLLGIVLQTYSFRTSVKSTTAISAGSGATTAVSRNINVRELTKHV

SEQ ID NO: 944736 - protein, 134 aa, Homo sapiens
PRRGSLCGRTMLDFASFAVTFLLAEMGAVLYLYPASRQAAGIPGITSTEEKDGNLPDIVNRGSLHEFLANLHDRYGPVDSFSVGRRLVDRLGTVDVLKPHINPNRDMDPYETMLKSLLTDQSGGGSVSDHMRLL

SEQ ID NO: 944737 - protein, 264 aa, Homo sapiens
PHPGLWAAFPTGVTGALWSRVARAEALLRLHLAATCAWADEVAEQWVTKEDTCLCADFANHSGRASSHNGLLDKAVSNTIASLICGRRFEIDDPRLLRLLDLSHEGLEEESGFLCEVLYAVPVLLCIPALAVKGLRCQMAFLTQLGELLTEHMMTCDTNQTPRDLSEAYLAEMEAKGNPESRFNDEPARVVADLFSAAMVTTSCTLAWGRLLMILHPDVQSRVHQEIVDIVWLVLLTTEGDQAHIIYTTGVILTCRVCDIYPWG

SEQ ID NO: 944738 - protein, 90 aa, Homo sapiens
KCDVDIRKDLYANTVLSGGPPCPCIAQDAEEITACTHNEDKSLSLASLLVIAAPPVSCHFTDVITSRVDESALITAASRRTMTYLRYTLS

SEQ ID NO: 944739 - protein, 118 aa, Homo sapiens
AAGAADPRAAFGRRRCLVRRGVVLRRLSVAVGVGCGMCSAGELLRGGDGGERDEDGDALAEREAAGTEWDPGASPRRSGQRSKESEQDVEDSQNHTGEPSGDDYLTRMYFWRTNSGQV

SEQ ID NO: 944740 - protein, 116 aa, Homo sapiens
ERFLRRQAPMLATCRDLHFYSQPEDLYSFLRELIHHCAKVTQPKAHIDPDFSQTPYALGSELDSKRRGRLLENSPVPVSDYVWTSLSLAHALVDRPICDHESSHRSLLLVLSGQRP

SEQ ID NO: 944741 - protein, 134 aa, Homo sapiens
MERLAQAGVCNTLYASLCRRVTFPVILTPYLCRPPLLEPDSRTWDSTWRIAYTHCAMVTQATADIGRPFSEGPEPWSGVCQHGPMSMTVEAYYGCECVWERQSLSGPFVFWRSICRPGLLPQMPTARILSAHRL

SEQ ID NO: 944742 - protein, 152 aa, Homo sapiens
MIPLYEMEARCVQAVSGQSQLTATYTSQVQRDYTASASQVAGTTGVCQHTQLIVVLVVETIDHVVQHAIYVCDLVSHLPEPHVLEITGMSQHARAARCLQSNRMHVAGVMESTCMLSYSWAELRGLFEPVRCRIEKSWHTTELTVTTTRSAN

SEQ ID NO: 944743 - protein, 70 aa, Homo sapiens
PPCRNSARALLSPSLLITRQLTDALVRSLLSGYAWMIHAHTSVTIQCHSIKVPYYMLAVQLDQYTFQHAL

SEQ ID NO: 944744 - protein, 112 aa, Homo sapiens
MTYKGETESDSEEYPASERDVIWVVFRAVFLCKKVATTAVVIKATSVSEGNIGSHMGQSHGQCLVWAAMGIIGPSSPLTSAKATFCPTESPRSIDQPVSAVCDRFLYENIFP

SEQ ID NO: 944745 - protein, 111 aa, Homo sapiens
MTPSARYGGKIEKTLQIDAATAMRKRELDEADLPPGEFIDDEETVDDTAYSYDTCHIDHHSHDTSAQLLTQPLILKQQHTTHGIKQGQISMLLLAHLSLELRLQSLVRVIC

SEQ ID NO: 944746 - protein, 204 aa, Homo sapiens
TSQDLMNKSCAEAVMNAAMAHEADMHYLIAVVPARTAQLCVSPAGTDMCLSMHALATGYVLTVESSCEDKVDRLTSEYLVVRHRPPYVRMYEHHSEILLAEETKGMKDDYLTDMFEDSCLRSETMTGRSEGPLTACTCDNVPSHDSELDMSRPMLDILRQKSVSVLRGDETFYGVRVAVSELHYMTAAGYDDRRLISPDDVRPS

SEQ ID NO: 944747 - protein, 56 aa, Homo sapiens
MSWRESYYRTEGDDAEEEQEENLDTSGDYRYSRRDSSILLDEAFDALLSLTSDRWL

SEQ ID NO: 944748 - protein, 68 aa, Homo sapiens
ERESYSEDDEDYLCSEQASLACGTMLLILASPTIGLMETLNIVSYALPMTAKTTRQTLMAEMNDCPGP

SEQ ID NO: 944749 - protein, 52 aa, Homo sapiens
MTRVSICMMLAMLLLTLSGTDSIECILFLVLNDTCSDETATYAVPELDVTYV

SEQ ID NO: 944750 - protein, 70 aa, Homo sapiens
SLKPDVYSYAPLRCWTSRTMVAFSEISILAGHSLTEAVGECVVMCVCLALASHGKYQCKEDTLNPLGGVS

SEQ ID NO: 944751 - protein, 137 aa, Homo sapiens
EIKLARAVEEVTLLVPAAERDDSLTKMQLMELAILNGTYRDASIRSPYLALSVAATVQAAPRIITGPAPVLPPAALRTPTPAGPTIMPLIRHIQTACMLNGTPDPTAAIVPPGPEAGRYTPYEYPYTVAPPTSILEF

SEQ ID NO: 944752 - protein, 135 aa, Homo sapiens
ELHVEYSRVPEELVGLTEACEDAVNSMWLLAIAKPSATCRYAILKKAGCAYMLGAQCKSDSGMITVAERHMPTSAMGGATPACSYRSASARTGTDRVHCLTKLLPHAPLVDLGPDTHYSTTLYDYEYTEQLDPGF

SEQ ID NO: 944753 - protein, 79 aa, Homo sapiens
MTSHSRDYSIGDSRDGFCLLHRLADDTYTARSISTIGVAYDIRTLELDGNTICILYGTQIAIADAIRSSDYSGDTGLML

SEQ ID NO: 944754 - protein, 82 aa, Homo sapiens
MLEDQDACTVSDRRRHVSGYVKADWLHARDTFCVTPSLWNSIMMAVTLRQSGYIPSARDSIYIELCNCYRHSDPTIVPSAMA

SEQ ID NO: 944755 - protein, 134 aa, Homo sapiens
RNLIDESTEEVKKLLVPAAEGEYSLKMMQLMELAILNVAYRDANIKSPALALSLAVTAHAVSRIITGPAPGLPPAVLRYSYASWPYHNAFEQTNTDRCHARNSSPNCCNSCSMARSWFESIHTYEYPYTLAPAT

SEQ ID NO: 944756 - protein, 83 aa, Homo sapiens
ELSPVLDNQTLSIMDYTGVVAANTGLTIHPDELPIGAPITRALFDETLTVLILYPLTLTIRVRTSLYALLTHTMSVGTVTEAL

SEQ ID NO: 944757 - protein, 103 aa, Homo sapiens
MAMLELDVDHSLLGLLDRSVYLMVQVVSIELERRNHCRYSACVTSKENVNLSTYGRIVEVQEHGTLTLKMCWGFRSYSIGCWYPDRGGVPHEKLPNLSDGNGR

SEQ ID NO: 944758 - protein, 83 aa, Homo sapiens
GYYTASDHGVVALGFVGAQGIPITPVGWHVYRAQEDDAKHDVYGADADCTVTFLHILDYNETSRMTYVTTLVHAPGLAAIQKE

SEQ ID NO: 944759 - protein, 73 aa, Homo sapiens
MFDTDIETAVCVHGIQSITLDYPKMEYCALRDDGRGFVTGKALPSISVRIMIRAPVYLTDAVTCVGIYPAVVA

SEQ ID NO: 944760 - protein, 136 aa, Homo sapiens
KATDFFDLKNFTGPGAVLPKRGPMGFKRFESEGGGEGWAPKSFQESWELSPGNWQGKKAGGGLLKRKSKKKFKGFGEKTPKNPRSPSGGSPTIAFFSFEKDRGGAPTRLKTLDGGWGLKASQRASQEGVAPFLKAS

SEQ ID NO: 944761 - protein, 91 aa, Homo sapiens
DGLTLTVRRLRETQLVLYGDVHEREEERGRAPQHRVITAEGALQVHTLLSQDQAYAARMACQDLLDRLSCIDNLKASLSQVEADSKMRHDC

SEQ ID NO: 944762 - protein, 124 aa, Homo sapiens
LRKSTVLVVHITFYAWPATHILPHHRWDRLPMMIDQIKSAALRYRQRMRTLCEALEDECLRLEARILSSMNCQNPEKRDPCFKDLLMDAHMAPSQMTCNCYQALVWLRMAGFQVSSDNPRGFLY

SEQ ID NO: 944763 - protein, 117 aa, Homo sapiens
MWLDALLTTHGLFKPGGPSSFKNLTLQCFAGVSTTCHVKPEHQMLIYKDDVLLYNIYYMKSTESYLIPEVLIYDSRTYKCTAIVNNTEKTTAHDQLVAEESPETLVSLDKKKAFGAT

SEQ ID NO: 944764 - protein, 137 aa, Homo sapiens
TACRRKQRMFWARISALSEMELRYTIYVNGLCQREYSPGTTRQGLFYTVFGYYMIIISYVTTNESMVDDIWGTHLVGSGQQEYERERCIIFANNRRSPARRHQRRRRDRLSDIMAVVGMMTMTIYITHIRIRQDPLA

SEQ ID NO: 944765 - protein, 141 aa, Homo sapiens
RRERERERERERERERERERESEHYTARPCQLGVGASRTLRTGPALLSERTFTSFLYWVTSVYGVSAVAICCFAHDALSDVAHCLLPVLGTYLCLLDVLGALYCVIAAIYLFLLLRFASVFRDLLRSSGLVSCLVLVCWLA

SEQ ID NO: 944766 - protein, 82 aa, Homo sapiens
MTSAPMLNSAEMAVDVSTLTALITVPASHDWCWMDRSAAASSTRARASMTLYEEADNKWRLTEYAVTLCCRGAPTRVLCLLP

SEQ ID NO: 944767 - protein, 102 aa, Homo sapiens
MLTLAVRSLASIVANLSIAKTSNSYTNDEPCIGGCTDIISQFPTAIFMCLDQDGIIYYWHWATTLATHIIVGSYVVYLCVVLIPVALLDTRDIIQCSLWAIY

SEQ ID NO: 944768 - protein, 89 aa, Homo sapiens
GCGAYRGGVRVEQWGLQACAQPGQGTGGLLEGMRFLIGAAGWDAPQFSKKKGSNIFFGGPPPPPGCFSRGGGGGAPPQKKGGKKRGFFS

SEQ ID NO: 944769 - protein, 83 aa, Homo sapiens
ARGEREREREREIDILREPYKNVVVRILSSGIIVSLLVCVENAYDYFQAVKICIACSLADPLDTTPDSTHGLVVESIHDSYMS

SEQ ID NO: 944770 - protein, 187 aa, Homo sapiens
MLSGCQADATVAPDSGLRGDMALLESLSPYLSPTGLLLVSCDLCFVRADRSTCTVNVTVTQLRANSVTVSCDVPQGNIVVGYSIFQLRHNVPVQSVIREVNTTTRCCALLSLAEDSDYTVHGMSIGLRRESPPRARLHFRTLKGSDRLPSTLSSSDITVEGLMESGHCILVESASFGRCCSCGLMLA

SEQ ID NO: 944771 - protein, 92 aa, Homo sapiens
VGMVNQIFQPSCPLRVHHIKSFGTSGIISSSSATERTIPALPVYVAGNEITLVAKGLQNTVEDKNTAFPFSSESKKELSVEVITGSNTDLKD

SEQ ID NO: 944772 - protein, 93 aa, Homo sapiens
FLRRPRLASQSKARDTKVLIEDTDDEANYLNFLKSSLTSLVFLLYNPFLDQRNLKYLSSRKQEKTHNTFSELFRIGSYGLQTSSLGFFSFLLG

SEQ ID NO: 944773 - protein, 154 aa, Homo sapiens
MAGRIYISSLAPLPSLPKTQLSTHRIRNGYRSQRGHYRGRIHISRRSFLAMWLSLFSTEDSNLGSNIYHDFRMDWLAPATCEPIQSAFFFSGDKFYRLNLRTRPVDTVDPTYPRSIPQYCLACPSTGHLRSHSPHGRALCYSLLSSPFPTPIVP

SEQ ID NO: 944774 - protein, 178 aa, Homo sapiens
GGHIMWLNIVKGSIPVGSRVLVKPSLSSYREIEEHDSYYHTLSLMQAETKCNPWITVRGKECTVQDSFKGVDAALTRHNWLDQSDSQFVLHRITEATKTVASDTIHSFMYEIKEGDCAERGEDSRELTCTDAVEALTVECTASEEKRSCTETCHNESLEMCGIPILRAQTWSPYLDTV

SEQ ID NO: 944775 - protein, 107 aa, Homo sapiens
MTSSHTHRYFVADPMGDKPVGSLAGIGEVLCNMLVGCFDNAYVVLGLFLVLIIDEDLFREWLTDTFGANAFLSLDCFLCLQIVVRRLLVMLSVMLSFPTPYSYFAAE

SEQ ID NO: 944776 - protein, 161 aa, Homo sapiens
ILQTGLTLIEDTEILYSAMYRSRANLERKAVTVPRCIRTEGTLCLSEAQDSDAHLLQDSTEPRTYRVPYSDEEVVEVPYSRRTRMSIGTKGLKVKLFDGLSRSDLTAKLCTRNRSAEEGELADSQSSHTVCGVQQIEMLYGPRTVKAPHVTFQARVLKVTD

SEQ ID NO: 944777 - protein, 100 aa, Homo sapiens
ERERERECVRLILRHCLFSLLCSSHITCLYTSIRASLIAATFDCSASPIWSSHTCLHLCTSLLTLPLHRGSLWLRLLITYIPCSTVIPMLITLVHVTPKR

SEQ ID NO: 944778 - protein, 83 aa, Homo sapiens
APVSQLLNVVVSLHWTSFSSFPPLPDDRSYKPDVSCLDGPGEAWTRDMGVISMIMHLPERNPRYLLSATGPGVLRPTLSTLIW

SEQ ID NO: 944779 - protein, 105 aa, Homo sapiens
CYFLRLRYHTRRPLHNHESLCPPVVDALELADSRTARIRHEAQTQTSKFGGVALGTPDHTHPGYGKTQYMAVVLCLCHTVTIGKGCVLLSYIARDSYSECFLGAC

SEQ ID NO: 944780 - protein, 54 aa, Homo sapiens
MSQLKQVTHHYIPYLETDYAQVPLEEPLEKWLTDEHTMNLREMLLIATQIGQPI

SEQ ID NO: 944781 - protein, 206 aa, Homo sapiens
AGYAALCTVTNMKLLAATELLLTICSLEGALVRRQAEEPCVESLDSQYLQTVTDYGKDLMEKVKSPELKAEAKTYFEKSEQLTPLIKKAGTGLVNFLSYCVELGTQSDTQRSVHAIVFQPQLVSRTPTEQSKSSCAYPLCATIDAEWSRYMRRNALLAQPTRGGVRDLNSPIVMRITMHCPSFYNVLTWRRNSEQARRSTFPQVRL

SEQ ID NO: 944782 - protein, 103 aa, Homo sapiens
MVSWQYGLLEQFATVVEAKLIHKMGIVNEQFLLQWLADGAIDLYAMVVVLSRALRSLSEGHHTVHHECYVTPGVIKAAARIREGMGLKSDPWHQELYRNFVGL

SEQ ID NO: 944783 - protein, 113 aa, Homo sapiens
MMTESKNDFIEQSTMRLNSLKLGYRHVHLTAKNGDQDSLATLCVKISLQDYGWRKPGVSRLRGLGPLSTRRDRPGVAGPSLLLRAMAHARPAPVLSFIAQGITAALYTIRPER

SEQ ID NO: 944784 - protein, 125 aa, Homo sapiens
MPRASVTQMETRQLLFIILDILETDRGSLGPRAFVKVQCWSRTRASSCRDSLSWTCTPYMVFWATWLSRHARCIHCLAATTASEKPLERPRGERLAGALTKLSVLNLCMLRLNRLGLQMDTLCLP

SEQ ID NO: 944785 - protein, 81 aa, Homo sapiens
KEAAGSSQPKLPPFGELDQAIFRKATLVGPPKKVPRVQVPPLERLTKRRKAPQQIVVNVFIEKIIPVITNCLSVDVNDLCM

SEQ ID NO: 944786 - protein, 103 aa, Homo sapiens
MCQQSDVGSCCGPRGSCSVRRECVGWCMATGATLLKLSGSQARSVSAVGVVQAFREPENAQQASMGMLGPWERPADQGELKSDRAHLMGKTTLLWLKSLMGAS

SEQ ID NO: 944787 - protein, 132 aa, Homo sapiens
MKCPPGADCLSTRLDFFGNWERTSISKLAPASRLPFRLCSHPPRKGPKAALGQWAWPARKHLTLTLQKYAKSSFMPTSPGEGVRLSGSHFYCSLRCCRRSHGHINFASVQPCAQKAKTVFTKLVCNQHSFRS

SEQ ID NO: 944788 - protein, 93 aa, Homo sapiens
MSPATTGTFLLTVYRIFFKVHFDRNVYPLAGVLFGHGLEREYFKGEFPPYPLAEISDEPITFNTNLMGYPDTELDGFDIFGHHIVMESYMGPP

SEQ ID NO: 944789 - protein, 70 aa, Homo sapiens
PDVAPWRPWGPSPSMISVRPFLIINDQDRMYRLMGLEALRSHIMASKAVANTMRSSLGPNGLDKMIVDKD

SEQ ID NO: 944790 - protein, 69 aa, Homo sapiens
GFPAGFVTMPTGEEVKSTLSMLPMMLSGMAVVPQMFGVGGLLQSTHVNHLDFHWFGVSIKHNEKWYRSD

SEQ ID NO: 944791 - protein, 123 aa, Homo sapiens
TSRNGKWRFLCPLFQTEVAPLFRKQSNMPDKYINISCNYIKIGLESADGDFKNTWFKSMYLSSLKLTGVLCHLQSSVHTSYLAKNTTSFSFFPCCRCGTYYYWKLRCPVFFSLFFLLKNGVSF

SEQ ID NO: 944792 - protein, 140 aa, Homo sapiens
SGAPGLHEFGTRGVPAVFCTMPTGEEFQRSLSMLPMMLPGMAAVPQMFGGGGHLSATHVNHLDLHCSGVSIKHNEWYGSDWTAEDKPSGPDVSEPAITTIRPVAFNPFLIPRVSSGLIYPSMFLSPGMGMGLSAMQRQTS

SEQ ID NO: 944793 - protein, 68 aa, Homo sapiens
MYAHDLRRRTLIRSCSYSLRQTEAMQRSAGPQSILVPAVPTGARKEDLWAKSTLYLGSNARALSASKS

SEQ ID NO: 944794 - protein, 115 aa, Homo sapiens
RVRRVTQAAAGTVDCKVRGVLPAPEGGPGPRVLSGGPIQLQQDDLGAAFQTWMDTSGALRPESYSYSDRLVLDQGGEIFTKENPGRVCKDLMDCEQEVDGTYWVDPLGWSSDTIG

SEQ ID NO: 944795 - protein, 121 aa, Homo sapiens
HARCDTRPQERSLWPHTLFSKHTLRGQSVIWPTPCGLSFPPFQVTGKWTQVKCVGFISASLWERHTHLGITCEFPGSVALASFSFEGQGPLTRTSHYRPKAQPPSFTQREPYWLGGLSFGV

SEQ ID NO: 944796 - protein, 88 aa, Homo sapiens
MEWPLPFGVGLLRLVLVLTHTNLGEGNSPCTHISVTKLLRPNTQGRIDGSVKGLKENGAELTPVKDINTLYKGTQAQIGLLARIGPSR

SEQ ID NO: 944797 - protein, 67 aa, Homo sapiens
RQRLLTYEDHGAPFAGHLPRGVAVTTREPTPRLQEGEWRVHGREWGGRLSGEAVPPHPPLAYLAPGI

SEQ ID NO: 944798 - protein, 68 aa, Homo sapiens
MMDYSRSEPERAVTLVLRLATTLLCSTESSWDAAITCACYAQLHNECPLFHEPEPFTKQECYVVSPDE

SEQ ID NO: 944799 - protein, 135 aa, Homo sapiens
QVLLHNQCLSTVYTWTAQAGREPKLPPQTRNLQTSAAAQVADLPTVPVSHGSSHEWPSVCGDWCLQRYWTWHCLAAVRMRHRLHQLAAIWTTFTVLLKRHHPFVANACLPCAIQAKRSEGAACLNKWILNSNAPR

SEQ ID NO: 944800 - protein, 126 aa, Homo sapiens
VRGYSFPAPVGEMRVVQKPGTSLLRSTESSWEGAITFTCLEQSQNGGQPDFYAVEPYTKKELVAVTLPDMIRTYKVMAAENIPENPLWSPYTNIDLDHAFGKYYSRSWEASEPMGLDGPGTGYIDW

SEQ ID NO: 944801 - protein, 122 aa, Homo sapiens
FYKPYKALHDTAIISGIPAAAGVDLHEKFIESARDLHMLRTDGSELFQHVPQFDIDRMKLVHPIAILHYIASKYILYGKDITERALIDMYIAGIAESGELSLLLPERTSAVDANLASISERH

SEQ ID NO: 944802 - protein, 127 aa, Homo sapiens
PKWRLSYEPPASGRGSRWLMDMTHRTNLLNDYGYAIYGKRLLDPVLPNYYADLYAAHNSNSAEASVVCIIYTHNPHKLIDGSQAICIVAESRCTRLLSCELVRFSPVGYSFIYSYRLRCHVCDDSSI

SEQ ID NO: 944803 - protein, 114 aa, Homo sapiens
RLLIMIYNPQGHCNTVPIIEGQICKAMHTVKLRKRTEPDPSGSLAGHNHIYNVHATSKAYVLMKFVNLLNHVVRMSYWIHASSKRRTRYGVYPCTQHTLLTITVVTAASGGMTL

SEQ ID NO: 944804 - protein, 137 aa, Homo sapiens
PGYTTCSYVGLDRAGSDSQMGRSSSCSAGSQRKVSNADTLVQAELALASCLLLLNQDLAVCPTCSLMEPAGGNMGDTRLWRREDEKFIQSHEPKSTRLLMELGLISGICIIVGTIIGSGINISIKNALRTMGCRALP

SEQ ID NO: 944805 - protein, 94 aa, Homo sapiens
PSLLRCIPAVIASRAEVTHSEFQKAAEEVRHLRTKPSNEEMLVIYGHCRQATVGDINTERTGMLYFTGTAWCDAWNELNGTSKEDAMKAYISTV

SEQ ID NO: 944806 - protein, 126 aa, Homo sapiens
MSILLAATGHQMHREHYYLRHTFMLVDSVRIASVEVSYSLITRTAVQTMRDAAELDSEYYIDRVGSDTSRSRLDHADMKRIRTDHISTSLAKLEHDGVPLLQTRTCTSQLHNIKLDSYCRILTDRP

SEQ ID NO: 944807 - protein, 221 aa, Homo sapiens
KIWRRDPHEFGPQSQDTKFRDFFLPKVLIRPHPPDYGDFQPLSVSPAIPPTLEAVWTLSRSLNQSKSCISADSLGQENQTHVPELPILGNVSPLGIRALGRWGRNLRSPLLPRRTWTPCLPDLRGQRCEPSIPRSCCIRRPQLLHACHLPFTWGTLGAAAAPGAFTNPPTLLMAHNFLLATRATEVYPMLGSGLRRPQFCCKPQDWESRKWVNEEGWRVVR

SEQ ID NO: 944808 - protein, 209 aa, Homo sapiens
LQEFGISYSWYPHTTQEEGIIMSDDYLWFEGISFPYYGFQIRNLKVRDEIEIRYEDVIVLTYPKLGTNWLAEILCLMHSKWDAKWIQSVPICERSPCVESEIGYTALSETESPRLFSSHLPIQLFPKSVFSSKAKVIYLMRNPRDVLESGYFSGFVKELRYYGSWFDHIHAWMPLREETNSLVLSYEELQDTGRTLERTCSFLRKKFEL

SEQ ID NO: 944809 - protein, 101 aa, Homo sapiens
DERGCNCPSYTYGVIALLTVGTALLLTETRHAQLPQTIHDVERYSAPTSLHEGEIAHEACSELSGSGGWPSTEALQHMLGEQNGTPCNSSWEYRTLWLGTE

SEQ ID NO: 944810 - protein, 122 aa, Homo sapiens
MGTKGTAIKRYSRHSLGSSKPLMLAEVKVVIAMANEERIQIMATCLWHTDTTVIDAQLESLANPGIEGHDAASHVERMSPLVTDAKHMYTVMAIYAPLWRICKKRMRTLTNAGRNMSLLEDC

SEQ ID NO: 944811 - protein, 99 aa, Homo sapiens
PWHLLDARCYMKGTVQLLHSGECDIGYGSMYITLGNIGYIEADLCDYQALIEHPYAVRQLHMVFLIARPVTQTYTLFARDDNMASKCEDDNACDCDLDE

SEQ ID NO: 944812 - protein, 116 aa, Homo sapiens
MGTRLLPALFLVLLRLAFEVQGTQQPQQDEMPSPTFLTQVKESLSSYWESAETAVQNLYEKTYLPLYDELRDLNSTSTGAMSTYTGISTDQGLSVLKGDEYQPDPPSVDGESALHT

SEQ ID NO: 944813 - protein, 117 aa, Homo sapiens
MQRRHIVAAVVAMTRGNQRELSLPEEYEQSDSVKGRRDDRLSVVARKQRDLEIMQQKQNPFGLRLCAWSQCHTRSAFPPVVLTGSRTDGIPSALSLPGPFCALFPQRASLPLCHFRG

SEQ ID NO: 944814 - protein, 118 aa, Homo sapiens
RHHEMGLAPPEFKALLLCSLISLFNMCSICVLPQTHWWILDERDPRYWPTTCGIAEFPATYQTQVDTGLQALEDILHLGGNPTSEVKPVVKAIPLTYKPEGSSPHMRDAATLFPEVRF

SEQ ID NO: 944815 - protein, 133 aa, Homo sapiens
NHGHPHGSHTRAPTAYVYATHSSHPQRKANSTAHIKGQPLPPPKKDSSYHPRHCKGPYSYPGSTGAAVGAHDACGDARSALIAKTQIRPGSSGAPENLTFKERQRLSSHGQEVSHRVKASRILTELENELYTW

SEQ ID NO: 944816 - protein, 135 aa, Homo sapiens
HGVLGSVGALRIPEGLALGYMHAMRAYCRLAGAVAAAHRSGAQVPFAKGGTPAHSPENLLLHRAKGGWGPPPAPIFGLGKPVIMGFRDPPPPKKGGVKSPPNSSSPGVGPNLVFTGCPILNRGGGPPVWAGGPFF

SEQ ID NO: 944817 - protein, 140 aa, Homo sapiens
RTWRMKWVTFIPLISLFSSAYTTGAFRPYAHMSEVAHRLKDLGEEKSIALMLIAFAQYLQKSPFEDHVNLVNEVTEFAHVLLMSQLTIVTNHFIPLDTNYAQLPLFWKPMEKWMTAVHIKNLTEMNASCNTKMTTNTCRD

SEQ ID NO: 944818 - protein, 235 aa, Homo sapiens
EREREREREREREREQRDFIDQYTDRESARVWHLSMGDTRIRTVAYSAWLLGLLGRRGCRRVLGVACDTGVGSIVAVEDVLGVTAVDGGGLMLQYALGVLWNRGHGGRVRWGRGGGAAAWRLGTMWPGHEMGALMLGSAGGAGWVTCGAGEGGGVSAGCGWGTLAASSVRGGCWAVVVGPASASVVQGGGLREGDVGRSAGRTAWVRADGEQAARVVALGSRVDGAGPGRVGVGV

SEQ ID NO: 944819 - protein, 68 aa, Homo sapiens
GCYVTSTQVVTHCKPWMCTNHRHKMYKDKYILKNSDQTLNCEGTVSTDYALNVKLAESANNILCIVKQ

SEQ ID NO: 944820 - protein, 121 aa, Homo sapiens
MEGGDGSYYTQTVFLQGEYSSSDQRFFKGIGNYLRAEILYQLEIPPFEKDQSDLEALQQHMPSPELTLSHKIRTKLQNPDLLELCHSVSKEVVQLCEAKDGSNLCFSKRLCNPVALVPLWT

SEQ ID NO: 944821 - protein, 101 aa, Homo sapiens
MQIEIRAHSHAARTFLSEQALAVYAMVLEIVPRDIEDRIKERAVMYDEVTMSDNTDFMCEQAFTLKLHMTVGGNMQCLDGSYIRWVYMRTICDELGTRCGY

SEQ ID NO: 944822 - protein, 117 aa, Homo sapiens
DDVSNGERLAVVYHTVYLYIDEDCETRALVKLMSGVQTKNLLTELEGISELETKGLSYWASFNRILQILTLMVHDYTRSSEAVGKSIYGEKFGDENVILKPSGAGILNMVRWTPHCW

SEQ ID NO: 944823 - protein, 67 aa, Homo sapiens
AVRIRHAENLMTHLVDDRGYASVPRESERGDTMSARKCDTHLRAQSTHEMWTPVLYKKTHNITHTHT

SEQ ID NO: 944824 - protein, 114 aa, Homo sapiens
VNYMIGQKWYRQGEYGQMMSCTCLVKDKENPSVTLMRHRVMMMGRHTTCETCAEVYLSAICYCHALEPGLALCQLQIPGGDPMSEGHLAVLNKILGVPVEPTLTFFAKRGSCLK

SEQ ID NO: 944825 - protein, 113 aa, Homo sapiens
MAYGTHGMTEVNRPSSYSVTDLGEPNLYCLLLIELAAMLNQRALRRIGTTRGKTVHLTGDAPDMMACPDFPPVEMWYPETMPIQMRASVDLTVKTVTCANNTRFHNSRACWYQ

SEQ ID NO: 944826 - protein, 49 aa, Homo sapiens
MTIGKHRRAIQEQKSSRIPYFHYKEHLCSLYLTTLDTRGKCICNVWPLW

SEQ ID NO: 944827 - protein, 53 aa, Homo sapiens
MRPATGADCSDILRLIKELAKYEYMEEQGILTDAEVPEHWTPGTQLGGFFLGA

SEQ ID NO: 944828 - protein, 119 aa, Homo sapiens
TIKALRNVDTADTREYTAGTEADDIIELAAEAHGPGVPHTLADGADAESLLEFNAVEMCIGLLTDVEADSGKQFVQAAEDIDDVPFGITFNSDAISEYQIIEDGAVLCKKLMNAAATVR

SEQ ID NO: 944829 - protein, 111 aa, Homo sapiens
GWRNTVRGHLIEGHRRLTICGGPNTNTEHPLTETHVDDVNAKSYCYLSLQTLLYEGEDALFIWRIRNIPEDEPITVFALVLHHDCIYFIDSRVDARQLSLISHNPTINALG

SEQ ID NO: 944830 - protein, 175 aa, Homo sapiens
MCAEQASIIITSSVVVAVAPIDVADRTTDYIAVMYTSCDTMQYFRSTWHHIRVVRILDHMHTHTTHTELWLSVLFTHMMSAAVCLIIYHDYDHKHPEPRLDIHHATRRSTLCGRSDAIVPREHWEHFSHNEGAADCETTQSASSGPSVEGSRPHDFCAHEQMTLTYTSKEDLTGL

SEQ ID NO: 944831 - protein, 63 aa, Homo sapiens
MPQSKSRKIAILGYRSVGSSLTIQFVEGQFVDSYDPTIVVDTAGQDEYSIFPQTYSIDIWLFL

SEQ ID NO: 944832 - protein, 112 aa, Homo sapiens
MASDYPRICKPAPDFKATAVVDGPSKDVKLSAFNRKFVLLCLYPFDFTFVCPTEIIAFTIRAHDLSQLRFELLGSRWTFNSPPPLGFTPPRNEGSFVPPDIPPLACMTTPLS

SEQ ID NO: 944833 - protein, 128 aa, Homo sapiens
ECTEYGGCCQTAAPSVGCTDMMSASSCSIAATEALRPAACERTSLTDLLSSGYNQALLFSTSCLCHAPADTHNAPYFKETSAVNGEFKDLCRDDLRGKYSMLVFYPLKCPLRGLHLEILVTEVDYHAP

SEQ ID NO: 944834 - protein, 143 aa, Homo sapiens
ERESRERERERESSVERVTVSESASVRSIPVFPLLFYPCALPIGVPLPCVPSLAPFPLLFLLPCSFASWAPLVSIHVSSFHVTSALLRSPVSPCCGHFLDFSILFSLLSLPYFLLMFFFFSLTVFFCFILFHALFLSPFGLPV

SEQ ID NO: 944835 - protein, 173 aa, Homo sapiens
MTASLVAAINVSPPPNLNMSSLYTYLFSVLQDAPVTGAKITIAQMHVFKSDYSIFEPIGAPAVFRPGRGPFFKTNPFYYRLRKTIQLQRILDITCLRIPTWRNSENLLKQPEGLSIHEPSSKGFKHETASLGLQTVSGAPHLDKHLNKSLKLEQNKKKLANKYPTSPNSATPP

SEQ ID NO: 944836 - protein, 135 aa, Homo sapiens
PGGVRGGPCRCARGSPLALCVSLSVAPGALRLLLPLSSVSACSSFSRCAGFSRPFVSFWPPCCLLPLCGPCSGLLVACGPLVRLVRLVVFLRLVRLSLPVSSPLFGVPVALLLLCSCRCPFLARLSPRSFFPSFG

SEQ ID NO: 944837 - protein, 140 aa, Homo sapiens
YNEAQRILHETAIMADKPKLHYCNARCRMEYTRWILAAPAVEFEERSMTSCQDLDRSQNGCIFDFQHVSRAEIEGMNLVQARATLNYSASKYSLYGKDITERAMIDMYIEGLANLGEMILLVPVCTPEDKDAARLDQRAP

SEQ ID NO: 944838 - protein, 77 aa, Homo sapiens
VTASPKRKDCCKEPQAVEDNWLEYFVTDTDLVLFVMNNVYRFGTDKIIANVHYNGKIARVYSPAGVWLYGGHDDKYH

SEQ ID NO: 944839 - protein, 145 aa, Homo sapiens
ETRSMKAFEQTYRENLRIALRYYNQSEAGSHIIQRMYGCDLWPDGRLLRGHDQTVYDGKDYIALNEDLSSWTVADTAAQITQRKWEADRVAEQLIAYLEGLCVERLRRYLQNGETLPRGPPQTHVTHQPVSDHEATLRCMALGFS

SEQ ID NO: 944840 - protein, 104 aa, Homo sapiens
HIKSRSIQRSAAAVVATRTVRTNPYVDSVVTMEDMNQYSNIEEFQRDPRYNASTNQQEDGEMVIGGLSSDTSQNDLTENLARFSEDVDCASDAASADGLELREH

SEQ ID NO: 944841 - protein, 120 aa, Homo sapiens
LRSFTMKAAVLTLAAHLLTGSQARHYWRHDEPPQSRLHRVKDLATVYVDALKDRGRDYALQFERLRLGQVTLMLLDSCYSVTTSFSKLRYSSHLRPTSSGITWAMVQSYRDDLQRWQEEW

SEQ ID NO: 944842 - protein, 133 aa, Homo sapiens
GRVSLIILLTDGDPTVEETNPRSIQSNEREAVRDRDRLFWLGYGIDVSYAFLEKLALDNGELARRIHEDSDSDLQLQDLYQEVVKPLLTAVTLECPSNAREEGTQNNFRLLCMGSEMVWLRLQDRYSDELTAT

SEQ ID NO: 944843 - protein, 132 aa, Homo sapiens
GSVSLIILLTDGDPTVVETNRRSIQNNEREAGGRYRLCCLGFGFDVRYAFLQKLSLNNGGLARRIHEDSDSDLQLQDFYQEVANPLLTALTLEYPSNAREEVTQNNLRILFKASEMMKAAAPGPWSDVLTAT

SEQ ID NO: 944844 - protein, 109 aa, Homo sapiens
SYMAAPLGGVVSGQPPGPAQGSPGLAGQASVVQAGPGASRPSSSTLVDELEACFEACCASLVSQDYVNGTAQDVRTGKHCVCVHNGLGFRCLCYLLVICFMCFSAALIL

SEQ ID NO: 944845 - protein, 110 aa, Homo sapiens
VSTMYAQAEDVYLGMGAHHCARRHPDNSDGLLLRLAKTYETTLHKCCTSVDPHECYDNVCDESKPVGEEPQNLITLTCELYEHLVEYKLHNALLDRCTPKVPQVSTSTID

SEQ ID NO: 944846 - protein, 134 aa, Homo sapiens
ERERERERERERERERERERVDTDCHLLLQSSKPSSHLLVCSRWPAVLSLPPLLSLSPQHILVPTCTFSPCAATFQPPMCTFLTCVVSLCVPGYASAALAHCLLVYSSLHALWTLSLLSVTALHVCHASAIIGS

SEQ ID NO: 944847 - protein, 208 aa, Homo sapiens
PPGRRGPSPLALLLLFLLGRRLVLAIFFHLPINSRKCLLRGDSQGPALTGAYEISDQSGGAVGLRSHLKITDSAGHILYSKEDAAKGKFAFTTEDYDMCEVCFESKGTRRIPDQLVILDMKHVVEAENFEKIALRSSNHYRYSCDAYKTFFKSIADDLAYMKKREEEMRATNLTNTRGLYFSIFLMFWFIGLDTWQVFYLRRFFKGTN

SEQ ID NO: 944848 - protein, 242 aa, Homo sapiens
RHQGGAVLLRIVELVLMLLLPTLILGIFLHLPMNSRKGLLAGDAATTLPLIGAYETYTILETLSACAATSRAQTLMAIFSNPNRMLPRGNVPLHTEDYDTFHMSQSETRNMSETRPTTVDIHDTPRGGELSRLDSTSFVSLCIERRYATPIRPLREYTRRDEIHQELRRVDACCLPDNKHICTILEDLTNVAVPCTRYLRGVLPAELLLANKLIVYQRWIFSHSVSTPRSLLSIFFRGGTRW

SEQ ID NO: 944849 - protein, 70 aa, Homo sapiens
RAQECEAVVSYDHATVLQRGQQSKSLSLQSPKEADSDRGVANGDIAFELDRMFFCSQVICMASNFTVVFY

SEQ ID NO: 944850 - protein, 116 aa, Homo sapiens
AHQRCRGPFPLAQLLLFLLGPTLVLGIFFHLPINSSKRLREEIHKDLLLTDAYEISNQPGGCWRRRRHLKITDSDRHILYSTEDAYTGRSASTTDDYDICEVCVESTGTGRRPYQR

SEQ ID NO: 944851 - protein, 112 aa, Homo sapiens
LQALIDTRELLCYEPDGRPTFTTCTAEHTQRHKPSEETYDLAMDRLSKGGRVWLSTDRAGRLTMGIPPPCTTIREPDLQERSVLQDSTELFTIHRHLTVETPMPVAPTVHGV

SEQ ID NO: 944852 - protein, 92 aa, Homo sapiens
ESRASSVNCTNEDYICYTLLNTLKTILAALGEQLIYTRGAYIESASDSYATYEGCRVPKTHDVLLLLDELCAGEATCSAAFRGSCAANKYHT

SEQ ID NO: 944853 - protein, 183 aa, Homo sapiens
SEVPWTAETYKLYVITTASTSDSEQTLIRLYSLWYHIQTHLLTYTSSLLKINLNTDLRINCTISITHSHTLIYNLITFTLLFMSIYQRVHNSTSTVLSTSPSITYYNAYMYYQNLLPLHSIFTYTLLLLISITALLHHPRITSFTSFYYHIHLSILSTFTHSLFHPTIAFTTLTPTTSHPSLP

SEQ ID NO: 944854 - protein, 198 aa, Homo sapiens
MVHYKEGWEPVSNGANKIWLVNGRILLIGNRVLSLSIRVNWEIECEEQYFNLAMSSGTGVLQDRQIYSYSVVGSRKCLCRFNSAMTPSSRFFASHKGGSSVPGTMTIRHLKASVLNSMDLVAALRVLPLALSMQASQGGIFSQACTPNGNDSGMIWSTCESRWSSMTKPAMEVIPFSRLTIGEGPQRHLGASKQAGNV

SEQ ID NO: 944855 - protein, 128 aa, Homo sapiens
DAAGRLRLGVDLATRGGATFSCGYSAERVIRRQQVVMAMSVDLGSINITWAGHTLRCWLASFRPTIAMYELSIHVHAGAVDYQCVLQWVEQQASQYVAATLVDLLTSLRSVAEPAAPSDACDHYVVFV

SEQ ID NO: 944856 - protein, 60 aa, Homo sapiens
MTCVKFLSVMCHPPFDVVSLKYLKIQSQHLLSSFPSFMEFLFQNKGSDSPTALKVKIYNY

SEQ ID NO: 944857 - protein, 100 aa, Homo sapiens
HEGAWNNCFTEEGPSSVRFTPDGKYLIVAQLNLSRLSVVAAPPVGSIECSVISTIQLADQVLPHLLEVDRKTGAVYVAEIGAKQVQKYVPLNSYVPSLGS

SEQ ID NO: 944858 - protein, 96 aa, Homo sapiens
CNRCHAGNPNGRYYWGGQFTCDMAIHGTDDGVSMDELDGVMGLNVEDEYEDHGLIATAIVHNTEILALVYVTTFLYIMLLEFYFIHYIPVILSQQT

SEQ ID NO: 944859 - protein, 109 aa, Homo sapiens
MISMRKWHCTSSICRCDIYTGCRIWRITGTQELTAEGANAHGIATLSIRHRAHDITCTLSLNEVHLLTNASHTVRCRAMSNGLNVNSCLAPDVQAHAHALDPIDRHTTV

SEQ ID NO: 944860 - protein, 105 aa, Homo sapiens
MGTSKDGKKLELSIKTQISKIRFLKKRSPLGLVCCPTLKGAKEPVWSNEWSLGVKYRKISHLERFKGTVLPPHPYRAIWVPVFYQTVSYHTVMCFHVESTFGFFL

SEQ ID NO: 944861 - protein, 37 aa, Homo sapiens
MSIAGSQVLLQFLGIFRFLTAPSLLCSCFLEVGVKST

SEQ ID NO: 944862 - protein, 108 aa, Homo sapiens
TRDDVLRLRMYASGNDLRAQGSLHCWMMYLSTVRINRRTYGVTLQGQTLLACLTLEAAIATGNCVSGSTTQHTTCGSHVHCTLLADSQIRSPPLPYGTCELYGLSDTY

SEQ ID NO: 944863 - protein, 113 aa, Homo sapiens
RRTSVLHKCAAPGGQGPKTHGQKTGRVVKLTNKPWFYELKVPNGLHSSPLAHMLYYNMGFDLTFQNPQYRQTGCKRFPVARLAVCLVRFQACQALDSKMSAHGPGCALELLTS

SEQ ID NO: 944864 - protein, 234 aa, Homo sapiens
RRGWIRQAGAAGSRMNFIPAVLSCRRLGLPGPPDVADHAAYHPFLRLSILPASAPPATSNPDPAVSRVMNMSVILPLSVQRVERLCVDPRHRQGPVNLLSHPEQGGEVTAHYEREAGFSWIEVTFKNPLVWVHTFTEHVVVTLNRISSVYNWKETLFSVMPGLKMTMDTTGLLLLRDPHTVTISLLLWDGRGEGLQLLLRDTDRFYSHAGGTLGQIYQEVLFGSPQHHMTADAH

SEQ ID NO: 944865 - protein, 80 aa, Homo sapiens
MCPRLPRVPIAPGFTLCVSTSGPICTYRALRYRNETLRGSPGPNRAGTSAAYGMLSTSCARFSLVQAGIVRISALYSMAM

SEQ ID NO: 944866 - protein, 120 aa, Homo sapiens
MAKIIARDLRGKKKEELLKQLDDLEVELSQLRVAKVTGGAASKLSEIRVVRKSIVRVLTINQTQKDNLTRYYTGEMYKPLDLLAKKTRAMRRLLYMHEENLETKKHYREERLYPLAEYTL

SEQ ID NO: 944867 - protein, 108 aa, Homo sapiens
EAVIAPRDEVVRSAGTEALPVLDRDNYRTTGSTVGLLLLPILHTDGDWSCAGLRDRGEAHRLAKRSATLTQLDKSTHEKASQVTIGDHCLQLGTARMSKSAPILKGTS

SEQ ID NO: 944868 - protein, 110 aa, Homo sapiens
MKCVTDMSLLCLFSSAYFRGVFRRDAHCSEVAHRLIALPEESFKALAMIACAQYLQQRSFEDHDPSETEVTELALYGDKLCTVATLRETYADMADCCAYQEPESVLLASQ

SEQ ID NO: 944869 - protein, 248 aa, Homo sapiens
GEPGPNPRGNRDPCHGPKKRLPAGRAQFCVRRNSGVLVNRQLPPPVLKFSTSSGIRKFQKASFLKKWRGPELLQIGCRKVAFDWAVSTPGHEWGHENIRGEWVCSEGKHLSPNQSNEELIVAVMLLYPVEAVRLLVCHPAVSDKLGTVRWDMHLSSMLLSAHLAKLVLNQLVWNQSSIRTMELKCHIQTIRRVPSIIMSLSQMFISLTGTPGYLVHLLQAIMSRQKSYPAPMLLEGMSGVAALNQPPG

SEQ ID NO: 944870 - protein, 136 aa, Homo sapiens
VAAGSPRRRPHPFPLGGTRLLATLAGLFPGSPFSPRPLRRAAGPIGRALPFLSHTFPTLRSFPFPFCDFLFFPGWALWSSATLLPRSQISGHTFGLASRATASGVSFPPLLVGVGEDIYRKEIGGLFPLRAGSGHR

SEQ ID NO: 944871 - protein, 99 aa, Homo sapiens
MSDSAGCLPLPCALFMSAYGLVLLLELCFPGAALYRVLVVPPVWASSVSSASPCELTVEASYPPERLADLDTFMRYCTRFGDLIIVISYNFAFFQSTLW

SEQ ID NO: 944872 - protein, 107 aa, Homo sapiens
RGQEEGGSPQSKASEYSASFYAYYGGEIDPENRMRHVKVRAGLVQEIRELAVSGRFAADEDRHTLNKPTRLRLTDSVNWRVSQVEQEMVDDNRCWIINMDMTLQVKR

SEQ ID NO: 944873 - protein, 95 aa, Homo sapiens
QRLTLRLLTDFYEAALRHKAQPIALRDLHVDYTLGPSYVLVRLDISLALISGITDDVSDDGVSVPSSSRPLNRQTPTAIHDSIAVTRRYGVTRVD

SEQ ID NO: 944874 - protein, 72 aa, Homo sapiens
MRSGVGPGSRERNRIRRSSLKNMGCAEIIRGYRIMDATNLHGGSLVYLYPDILKEEAFRRVCRARSDHPEAA

SEQ ID NO: 944875 - protein, 113 aa, Homo sapiens
APIGERRCCKTLCEKNEEGPGTTACCGIWTCFRERPGLWSKVCKEFSHLGKEDFTSLWLGLCTGFLTEACCAEGADPDWYDTRTLALSAKCCESDSPFPVSPRHCWVLYRGLA

SEQ ID NO: 944876 - protein, 142 aa, Homo sapiens
LCTIYRERWYRISLVEETHMRGSGSLVHHYLLRGRGATTEMKEWGSRHLDLLYPTILGHEGAGIVESIAEGARTAKPGDNSITLFLSQCGECASLLRSEGKFCIQLIQGRTQLMSDGTRRLHCRDSQYITYVIPRPSVDTQG

SEQ ID NO: 944877 - protein, 137 aa, Homo sapiens
QILYQARTTVSRAHSSCIELEDSTLTHYYGRRCSTAWDYRLTEGYADTSKANGLTCAVTWTLCCWAYSYIRICCAGTSLAISEKVRGLRYVAQYIADWTRWEMTVNTCGYHAESYLGYEAHIIIILLRDIDDVCSGL

SEQ ID NO: 944878 - protein, 108 aa, Homo sapiens
MEPFRALLLRIKPDLVDNLPNAPFFLSDPMGLKPVLSLAVIVVILCTNLEEMGFDMAYVVLCQFLVLKDEDLFREWLLDTCGAYAYALPGLLLMPSTVVRPPFLMLSW

SEQ ID NO: 944879 - protein, 137 aa, Homo sapiens
EAQRSRDTGSYDLAASLYRWQRREEAVLQRRTHYHYGGGATSRRHAYTEHKPRAVYRSESEPHGAMVGPTQGAAPAAGSGAHTDCGTDLAGTERRRAQSAGANSDASMNDADESHSSAQDTLHQLRHTGMCRQFIGA

SEQ ID NO: 944880 - protein, 119 aa, Homo sapiens
KKASWGAGLVYNNRNLLEVPKLQLLRWGLHRRFCVGVGGYCGNQQSAYVKVSRERVPHERSNPSFIIQVPAHPRRLMKEYSPIWRFMSGGFLPHDNSSSMCILCIKCLHGRIRLGTCAG

SEQ ID NO: 944881 - protein, 68 aa, Homo sapiens
MSLELELVLHNVDEYRKHTLAVNWRWPCFIDHTGPGKLAKDTAFYFRLNHAGAVDDAMRAYRDPEPRW

SEQ ID NO: 944882 - protein, 71 aa, Homo sapiens
MGLLVASSFVIPPCTMVLFTYDLACSGGFLSAWICSVCSMSVHTFILHVLSVQICVMLFVFAFAVLSLVAS

SEQ ID NO: 944883 - protein, 31 aa, Homo sapiens
MTDCRAKPANEHRQMKVYTGSEPESEDDGGR

SEQ ID NO: 944884 - protein, 86 aa, Homo sapiens
GTRSQLTVPHDLSEPQLLEETCSHDRGEALSHGPGCKVLKAAAAMAARHPPEPQLCWQTSWCEITTFCICKRSPYILKTHVTDSDY

SEQ ID NO: 944885 - protein, 192 aa, Homo sapiens
HEVYGDCDFQLGKLDGMLSAVYAANAVQTQAEDVRKECQDCPLLATLNDTSVVHSQKAALAAFNAQNNGSNSQLEEISRAQLEPLRPATYEEYTVTGTDWRCKEAHRQQVNLLEEPAGVQHSRDYSPQMSMRVHRWDQCTLINGTDSQCYPDHGLSPRDMTRHTDHSVRYRHSKLARSPGGIRLAVSGSDLL

SEQ ID NO: 944886 - protein, 83 aa, Homo sapiens
HEVDCDWYLTQERLIQICHYKGITVTAYSSLSTDGPWAKPDYPSMLEDPRIKEIAAEHRRTADQDLNDAYPEEGCIEAGTSRM

SEQ ID NO: 944887 - protein, 109 aa, Homo sapiens
KKRTQMLIPTLNSVSEITMLTAQTLMRADRGVRIWSAMNTEIASDVAVPIPSEHPDLITGHACGAPAETYIRSGTYSRTLLLPYTPGSDVSAVIDAVEDRICFHYRGPS

SEQ ID NO: 944888 - protein, 72 aa, Homo sapiens
GPHTQFEQWVMEERVDCLEQGGRGSVLQVMPFTSASELVKVSAMFSPKVDLAITDLMLPLGRQEAARAIDAL

SEQ ID NO: 944889 - protein, 73 aa, Homo sapiens
GHCPNEKCTLEGEAYRADTHVHKADYEQRIPAAEREEALTLGEENAFHLCREKPIRSYIIVDTSIELCAELDY

SEQ ID NO: 944890 - protein, 66 aa, Homo sapiens
AVLSCRAVLSDSPVFDAPFSPPDSLSDRDSYLSGSMSSSSLSGSESASLDPGRRLPIVSRLSIFDD

SEQ ID NO: 944891 - protein, 113 aa, Homo sapiens
HFEESQDVCANYTQAKDDFLSMKDMNMQEGILITVARCCSDCLDISTLEKRCAAANPDECYTEAYDEYEQLGQSKFQNAAISALHQERTTSVNSNRTGLKRPRYKGQHNDVTC

SEQ ID NO: 944892 - protein, 105 aa, Homo sapiens
DRLASTGRNLCKTQLVLYDDAEELNRSAGELPKTGESIHTVQEEVDTLLNQDQAQGARMPAKDFLDRLCCLDNLKASLSQVGVDIEMLKTAVDSLDAYSVNIETN

SEQ ID NO: 944893 - protein, 126 aa, Homo sapiens
MTGAYRVFFKNSRSYAFHYKDAGLTYTPESELTEDYTYTSYYHSTFWKTLTSDRASAVYNENPLREDELHNSPASVLYLTFRGMKTYTYYEGSTQVHISGSNPPVLFHDRRPMFMGFERLGLPEAP

SEQ ID NO: 944894 - protein, 131 aa, Homo sapiens
EQLTTGPSACLDIVAVSGRETDDDDRMDIPLDLVLCAGSGKRRRRGNLPKEAVPILRDWLNEHRYNAYPSKHEPCCAIQTHLYKLQVCNWFINARRRLLPDILRKDGKDPQLTISRRGAKISAELCRVRDG

SEQ ID NO: 944895 - protein, 111 aa, Homo sapiens
IIPAAGYFQKVAQYVHGARGVSIADEDQVGFGRVGKHIWSFQMYGEDFVPDIVTMGRWATGTRWHVWLQPKKLPKPSAGLGWNIVIRMEVQYLVLMDEAVLDIIVLDEQKA

SEQ ID NO: 944896 - protein, 105 aa, Homo sapiens
MSIDIESSDVIRLIMQYLNENRLHRALVTLQEETTETVNTVDSIESCAADINSAHWDTVLHAIQSLRIARPLIDLYEQVALELIELRVVCCQVTYETDDPMIMFY

SEQ ID NO: 944897 - protein, 124 aa, Homo sapiens
IVERSGYSDVMSEALPPAVYQYNCMLYNVTIQDVYTYVATKDNCYILHERFSKNGPTTSAIVYVQDTKQIQVDKDLQYIGRHVTSEMAAQLDVEQLVHSVHLTHNSDESSIITYDASIFTHDSR

SEQ ID NO: 944898 - protein, 97 aa, Homo sapiens
MATKAECVLKGERPEQGIFNLEQNESLGPEKVWGCIKGLTGGPPGLHAHEGRDNTARCTSAGPECKPLCSKVGHRMYWHVGDLGYETADDGVADVSL

SEQ ID NO: 944899 - protein, 151 aa, Homo sapiens
MWAQRMGVLGEEAPMFPNQTPGLRETDDLEERRFHHLAQERCHTCIGRLQYERSMLPTGTRAGREPNIDRSRLSKSAPYTGCLGNLPYDVAEESIQEFFRGLNISAGRLPREPSNPERVELGYAEFEDLDSLFNGLSVNEESLGYTSSSGL

SEQ ID NO: 944900 - protein, 78 aa, Homo sapiens
GSLWCVYTRGTQIVPVLVFVIVGLGLKGQLTQQWLEDEMILHVLTHSGVCILLVILIVRDYRRSESVRGDTCQLDMRA

SEQ ID NO: 944901 - protein, 213 aa, Homo sapiens
THPWARFVHCVKGFGNLDFRGGLRGVGPGPIIAQGSFVGLPIINSFRSSDWAGAAILSGGPVGQGNFDRNVSLMVKITPHVRFQKWIPHGGADHQRKVGPPGRHNFAPGPQYGLWHGWSLDFTRPSLMSPGYESWTFRGPHQLNQKKWQSQGLPGTGEEVSSQLVMSARAGTEALYSRTYRPAGYEKSMVWARQSAAAMSPASGICTPPGLSV

SEQ ID NO: 944902 - protein, 108 aa, Homo sapiens
QKRCLRQGTWSCARGVKEALPLLAETTPDHGRHRRLLLLTILMLLLTTGAVHGWATEDRPRTREEDCHLYAAGHEYSREAYPVSVADHSLRPKQSQYMQDRVLLRRNS

SEQ ID NO: 944903 - protein, 132 aa, Homo sapiens
CLPQQTCDSGPVSRFEMMVKGSGFQAVELLTTAPAGELPEPSAQNAMLEENRAHLSTCPDHQTRTPHSMHREQLACIYKTGSCLTSTLISRVAVIRQEALFGILPVSSMSDMRTQLAISKQGNWLFNVPSSC

SEQ ID NO: 944904 - protein, 35 aa, Homo sapiens
MTRYTEYDMTMYRRTVQLMRKLTERLTKRPDDHVC

SEQ ID NO: 944905 - protein, 141 aa, Homo sapiens
GAAARCSSSSGRGGRLWSGAGGGSAGSTPPPRIPTERRTSMMRTSAWDRDRQDWRTYTLQESQPYGVLGDAQNAQCHPALMYLACACPPTLMDLHYCTVSLLGFIRTGLIELIIACHTSHHSNCTLHIHSLCTYHKCISYL

SEQ ID NO: 944906 - protein, 68 aa, Homo sapiens
GFMVRVKRLGLLRLQIRLAQCDIHMTLTLRIDVSGGDRDSISCHASKTIGHSVACCLHENQTATKLMT

SEQ ID NO: 944907 - protein, 102 aa, Homo sapiens
MSSRLMLRETLLNSAGWNDTCDRCIYFVALSEMTMNLCRCYKRNAGFYHKHAVSVTFKVCPLTNPLSVKIHASRLWEITCYTECLRCELRQCACALCSRTYV

SEQ ID NO: 944908 - protein, 186 aa, Homo sapiens
MGGPELAQHEELTLLFHGTLQLGQALNGEYRTTEGRLTWLRNSLGLYGRTIELLGQEVRRGRDAAQELRASLLETQMDEDMLQLQAEATADVLWDSGHAQNVLRDNVHRLEDHLKSDCLSPCYRAIEDLAHDDKQSHILWALTGHEQLEKREIVEQEDRLRQIQEDYTQRRIQAEYACMELMTSCC

SEQ ID NO: 944909 - protein, 43 aa, Homo sapiens
MLRLINTTSAQLLIAYIGYPTVSPPGECLFHRESGRSPVRVVT

SEQ ID NO: 944910 - protein, 73 aa, Homo sapiens
RVAKMNYHSRAYYIMDNRYTFWLMEYLEITLPGEPMLRPGKPESYLTTDKRAHSPMLLNIVKIYLSRGLTYRA

SEQ ID NO: 944911 - protein, 166 aa, Homo sapiens
SLHTGLLRETRQSVRLDTRRLQYEYSFKGPYLMQSDSTVPFRAYTWNAIERADQVCVARIDNKPERLIRGKYSGLWNWEVEVTFGVTGRCLIGGQGLGFGMRDAYDYDAEGSGVSSTGILMIGHNGQSDCDHENYGTGQAWARCHRDYRANTILCERRIPIARHWL

SEQ ID NO: 944912 - protein, 117 aa, Homo sapiens
GRAYVPIAQVKDVCVVTDQISVFVTMFQRNDRNSCDETFLRDLPIMFDVLIHDPSHLLNYSTINYKWSLGDNTGLFAFTNHTENHTYVLNGTLRLPHCGYSTRTLSATVTTTQTFDP

SEQ ID NO: 944913 - protein, 105 aa, Homo sapiens
SLRYVLAPTVVHSIIVYDKWLAIDVLVPLHIECPCRMKHYVPGTYHYYGRCMNLATDSQDSTYSLSTRVDAQAAILMRLADCGSISTFESLAVMQRRIRHRHTDC

SEQ ID NO: 944914 - protein, 120 aa, Homo sapiens
DVGGKRSSKRDAESGFLGLLPTSVDPALRRCMARPKKKKRSWRLLAHEPLMLEVDQVLEDVRLQERSSGGLLPEAPNECLFLVDTGFKERPLLGDLILENTFKVPARDVLVHHVPSAEAE

SEQ ID NO: 944915 - protein, 139 aa, Homo sapiens
DDHHTLLEAQEVVTRAQLWHSLLAPDYALTAAVTATHITIMAIYMCDPDWVGDTPNRRTYADDLNECIPKVMHAEVTMTMEWTLLWPYEIHCKKASVDDDLEHHWKRHCSSARVRLTTHLSNDYGMYYSVRMHGMGSVA

SEQ ID NO: 944916 - protein, 101 aa, Homo sapiens
AVKETKRERRPHSRTVHGPPWTADAAQEFQCHGGHAFLAPLAATLVTQLKGFGILWPHCEEIRVWVGGYEEDFHFLESGVKNAGIQAPFQGGAGEQVCETI

SEQ ID NO: 944917 - protein, 99 aa, Homo sapiens
MSLECGAACGPCSVPCARARYPPRPVRREPWQLGVGAVRTLRTGPALVLVRKFTEHQWVTTVALEQWESAILHRKRWERVWYWRLPESWDVRLYSPLSR

SEQ ID NO: 944918 - protein, 66 aa, Homo sapiens
GTSIEWLPVDAMIENSRPPSHCHPSWYCSQPEMAMTYLHRLGSIGLREMAQLYGTTNATPTGDVYR

SEQ ID NO: 944919 - protein, 216 aa, Homo sapiens
MVDSVYRTRSLGVAAEGLPDQYADGEAARVWQLYIGDTRSRTVEYKAWLLGLLRQHGCQRVLDVACGTGVDSIMLVEEGFSVTSVDASDKMLKYALKEGWNRRHEGAFDEWVSEEAGGVTLDKDVPQSAEGGCDAGICLGRCAHLPDVRRDQSEHRLALNCDHILSTGWAPTGNNMYYESDLTKDVAASVVINNGPHGDAGLYGSAGGCADGCAGW

SEQ ID NO: 944920 - protein, 111 aa, Homo sapiens
DLFTREEFMQGAGRLVLYKPCVVSDQNMNMHLIHDLRIGVRSCDTETGDTVESMRESGYTALQSNISSQAACLDGVVRYPICESRIIVTLRAWSTGTVSTMILLGCDSLLR

SEQ ID NO: 944921 - protein, 60 aa, Homo sapiens
MNTRYVSQDALQRWKNAPLTIPEMRQCVNRIGETECQYIWLRNCANDAFYGLAYPWRDTV

SEQ ID NO: 944922 - protein, 104 aa, Homo sapiens
VSVSSVYEHHESTPLIGGQRTGLESPTVIDFSDITGNSFTVHWIGSLSHHYWLQDPALFRALQWETSRRTGAPLLEFHYPYQPYFRHRVCGQHRCVLMAERVPY

SEQ ID NO: 944923 - protein, 105 aa, Homo sapiens
TRCTCVCDSTIAHSVAPIFCAHVRALTFYQSRGKSLSRTHATSLKKAFCLRASLCPDWWCCDQASETLASWSPCMPNCAYMVKALKQHIFTVPGKNVGSLQPLVS

SEQ ID NO: 944924 - protein, 141 aa, Homo sapiens
SAEVIAGLLQSLGGQRPVLEADGRKAFAEDDGVHRTNTAGAHDSYCSYTSSQAVRKASLVTERHQTSWHRCMLDSRLTAVRYLVGANRVPAEQGTLGIAEQYYSRVHINNRCYDLDVGSGHPERADAIKGSLVQRLKCYVI

SEQ ID NO: 944925 - protein, 125 aa, Homo sapiens
MSQLNETDVILLEQNAPCCGHCASLYNVYEKDVKELILRATSIARTTDYADADTVLPKCLAASNYATLDMIREGMPYQYYDPCETVTHKQVQDYYEDEHELQSYLQLTVKDLSALQACSDLSYST

SEQ ID NO: 944926 - protein, 120 aa, Homo sapiens
KTSLRAAGQGLPGGGVPCDSEEIPEIQQKYPGPARSYLCGGHQPPGPKRKKLKCLAYDCYPGGPLFFTTETALTSPGSWWCPLRTQPPTPATCSTADWPSLSWGPASAVRKQGLKAVGSQ

SEQ ID NO: 944927 - protein, 199 aa, Homo sapiens
PFKVIFRSTTSEVIEWSTTTVPPQIGQRFDRTSQGALRTLCDVQGSSVAFKCIYVCHWWGKQILSRLVIDLRAPGRRMDPRIQGLLLSRVEVHSSTTDPQRITSAPVVAHSQSKGDQCPPSIHTNSSRFSRILPIAYMGATFRSTLSSPVTPILQISDNTGAWLPAHHAMSNNQVQITGGNHNLKGPLKSLQHKRHEQD

SEQ ID NO: 944928 - protein, 79 aa, Homo sapiens
DQVSNPEESLPESRESCPHYDYVGDDSPEPYLGAGSHYEASAEYPDHCRALLAYLLCRADYRHVCLTSLCLHPHSYIHF

SEQ ID NO: 944929 - protein, 142 aa, Homo sapiens
MLNCCDCCGLEDVRECLHSDADMEDEATRDSAMICFMFHLMWTGRFTCLSMCIDKTWRRIHPCVSTQTYSALVLMTYTPIILTEGQSTGTLMKTLALTTVREIQSLCATMPPMLNLVSPHGASGYSDWGAPYSLAYRIGDVA

SEQ ID NO: 944930 - protein, 129 aa, Homo sapiens
MGTFSATELTGYPQSVHELPASLSSLSKNCEIVRDCRVWSVNLSNGMRDDDHLRCRTRADIAMMSVSIMILAADALNDCCGDTLGAEATFDDTYGDEVSVHNTNLLEIMADCEDREHNYSRRTRGVTRR

SEQ ID NO: 944931 - protein, 96 aa, Homo sapiens
MELERAPLPMRILPHSYRCTNERVPFSKLSSNMMPHMTYQPGTYCEAGLMPGGYTAIELMPPGHISPLSYTLPIFFHPPLSGIQEFQELSPTRFTL

SEQ ID NO: 944932 - protein, 178 aa, Homo sapiens
MTIICTVVRVSTLSTATETLKWTRIYRTVLTGSSPAWQTTSHLSTARCEDGSLESSSPTRYWKSLAPDRSDDEHYLLDNTSRPRYSHSYLSDSDTEVILTETNTNPMGVVGSHFTLDPGVAWHLSQKRRAPVLTTRLSDCMETLRLFLHGHFKVKGKMSSPIEQVWKTIIFIIFSFFI

SEQ ID NO: 944933 - protein, 144 aa, Homo sapiens
MLCLTLWTRWTTDSGYYTEVLGVLLGMTGLRYEVQADLQLLSSNDSPAYDSQSAETTCMSHCATARNRGDKNSAFYVNAYCTTYDLQIPCWICRLKATQSINAYDVTDALRMPQSSHVVDLRTHALRYTLTWLSYLPSHDPVPA

SEQ ID NO: 944934 - protein, 132 aa, Homo sapiens
PGLQEFGSRGLTSFMFSNRRVTGRRLYIQLTMGNLNRNLIALNPDGLYHTLVLKSITRFEHNECCHYTMKSLLPCQEHLNQHYIDPKDRPFYPVLENFMNSWTDECIVRLGLNMEQSLDIQLDHSMRYSWQS

SEQ ID NO: 944935 - protein, 135 aa, Homo sapiens
TRVSVDDSRTPPVKRLEVDTSVYRKRVLDFLRSPYTAVGTGGRPHLRTSALDFFCESGDSFSKRCLCPAFPTVGYTAGFGLWFYGRGSVNPQRGRPLEPCFRPNERICLACALMPPAPVDGLWPFIRLWDVTALF

SEQ ID NO: 944936 - protein, 129 aa, Homo sapiens
KARRRDAKLQSCQEPEAPPSQHVVLMQGRANDLMKYLWAKDHTTIPIKRSDMLKDIIKEYTDVHHEIIERACYSLKKVFGIQLKEIDQNDHLYSLLSTLEPTDAGILRTTKDSPKLSLLMVLLSIIFMW

SEQ ID NO: 944937 - protein, 125 aa, Homo sapiens
VKNQARFCQFGPGPKIRGGLPPPLRGVKKSSRCYYIKSAFCVKKKAAKAARIPSAQPQGFGGPFVKRRRGGPKWRTHDCKPFRTGNRPGATICAGHEEMTCCSPIHLDSYEEQVFSVRTNMKPSE

SEQ ID NO: 944938 - protein, 137 aa, Homo sapiens
VRSAEHGAMVSMEAELNYVVSTRLDSDSAGTNRLRRRRPDGLHMTIMLTVNIDVRSLVISVGMTKVLRLQRLSHTLNHGDSYEDEHGHQSYELRAVVYRLRFESVNGISQWLLQGTSTPLIRMLVIIDDRTTGLADG

SEQ ID NO: 944939 - protein, 139 aa, Homo sapiens
HEGSSESLLGHEHGCPPGDDHGYPVLHMARYTAYVDYPIYDVLKKVGHANRPLQDEGRCVIMCQGSKKDIFKKVLYETLAGESQLDHCMHEHFNGEIVTKTIENKQDAVDYLNWTFLYRRMTHNPNYYNLQGIFHSLVG

SEQ ID NO: 944940 - protein, 118 aa, Homo sapiens
ERNDARGRESCVMMLYTRLWNDAPCDTEKDRWICEGTTGDPAQCAWSRAHWSMSDSGGWSHFLASGADWQRGFSFSYTAGESQKHSGQHRPVQTRAWALGPSWRPHTNFTYADPLFTG

SEQ ID NO: 944941 - protein, 140 aa, Homo sapiens
TSLTVRVTYMDRSPCYGYQCTSEEHDKAHHTAYLEFSPSKSLVHLEPMSNELPCGLTQTEQAHYMLNGGTLLVLKKLYFYYLIMAKGGIARTAPHGLFVKHVDMKVHAVISIHVKTDIAPGDRVLMYAALPTGDDLGDSA

SEQ ID NO: 944942 - protein, 119 aa, Homo sapiens
MEEVQVLELDGRGHLLGRLTAIEAKQVLLDRKAEVVHCEGINIIGYFYRNTMQYLAGLRKRMNTNPSRGSYHLRDTSRILRRTVRGMLMYPPPYDERKQWRFLLASERANEAYGLPIWA

SEQ ID NO: 944943 - protein, 103 aa, Homo sapiens
VVRVGSVHGRSVLNRSVRSVDVTLLKFDKLDSEKAGRCVSYSSQVEYSWILMGLRSIVDQNCLFISLGAVAQREQVCAWVLRLIHGRAELHALAFLEGLMDLT

SEQ ID NO: 944944 - protein, 257 aa, Homo sapiens
PGRGSSVHSPGSGSGSSPGHRPRPPRRDSSSSSSSISSSSSSNSHHHTFSLMGQPPRVGAGGDRYPNPAAQCSFDLTPYGTAASEDIWLTVITTTVDVELMVSFERSVLSPTGNRKKWLCVLLSTTIWGKSAFLDRQDLTTSSWAYDTDLLPGYMPFSELVFRENITPTDLNGYTELMDACINVHSLAKLIQLGGRCSRDRYGMTLQNLVPGGHGPYGFPPYVRRLDYCRTIGWASQISVRPQMHRPIVLFVPATEV

SEQ ID NO: 944945 - protein, 133 aa, Homo sapiens
MAETIKDVEDDEYKAVYISCSKESDDPMAYINSTAEGEVTFISIVFVPTFAPRGLFDEYGSIKSDYIKLYVRVFITDDFHDMMPNYLNFVKDVADSDDLPLNVSRETLQQHLLKVIRKKLVRWKNVDQHQACD

SEQ ID NO: 944946 - protein, 115 aa, Homo sapiens
AAFLRTPESMKTGTRKPTLLKISTLGNFPRVLGGPKGGPQSGKGVFFWERVVFLEKKFFGGALGAKKNPRGKMPFLPRGGFFFFQKGFFLKKSLGKKKKTPPRCFAPQKKNPAPP

SEQ ID NO: 944947 - protein, 76 aa, Homo sapiens
DSVRGSLTLSANIDICTNNSCIILDWYSLDRKNNLPNEPLVLEHRILAHYAWICHLRTLCQRGQVCLSSIQACIAR

SEQ ID NO: 944948 - protein, 111 aa, Homo sapiens
MCSSPHLNLPNLFNQGLFLLGFPVEIRLPKEFVIKGDFGQLIWPPYGLPCVCVAIYVKFRNMPRSDNFRSDLLYDLYARNAFYYSYQIGQSSRISHQVAPMLVYRTAGSLD

SEQ ID NO: 944949 - protein, 140 aa, Homo sapiens
HEVGLALTSPGNKTPPKKGAPTPGYPPISPGGGRRAQKYFWCAQKPHKRGKGGRPKKFTPQFVGGSWCGKKKKFPPPGGDILGGGGGGGFFFFISPPRLFFFFGGEKIFFFFSPAGGGGGLLTPPPSSPPPRGGGSSFFL

SEQ ID NO: 944950 - protein, 124 aa, Homo sapiens
MLRLSANILLDSIMACGLGASNLNLKPESAFECQSEVASDAMSFVLNLGKDTDNLCLDSNPCVNGHGTANTIVCNSKDRGAWGTEHEEAVFSFQAGRVAQVCIFDQANLTAKLSQGYQFRFPRL

SEQ ID NO: 944951 - protein, 230 aa, Homo sapiens
LRSRSGLSAEGPAPGQFYRIPSTPDSFMDPASALYRGPITLTQNPMVTGTLVLGVQFQGGVVIASDMLGSYGSLARLRTISRIMRVNISTMLGASGKYSDAQYQKHVIGQKVIDDELLRDGHSYRPRALHSWMTMAMYSRRSKINPMRNTMVIRRYADRQSSLGHVDMHGDIYEAPSLDTGYGAYLGQPLLREVLEKHPVLSQTYVRHLVERCMRMLHYRRAVFDQFSDL

SEQ ID NO: 944952 - protein, 114 aa, Homo sapiens
NGQKFMEYVAEHWEMHRLEKERATQERQLKNTRQRQRCCMAELLEHTSKRRGLASNTPGARKLNTITMCNATGNSSIRAIFGGTVYHFPVSRLPPSGSKPVAGFTCSGGQHTEC

SEQ ID NO: 944953 - protein, 70 aa, Homo sapiens
SRNAYIQVIELLVEEPCCIIGSLLMHICYSGTDADEWDNIQIDDIDICIRTSTAVPVDYLSYLTDFKLCS

SEQ ID NO: 944954 - protein, 120 aa, Homo sapiens
RCTCHAGLHTAACALDTCLERPVKSHNILRELNTQHMMWPRVATAGFELLALMATGHLGLPKCLEYSSLSHWERAKGKLLWNRLYLERVWAQDMLKWCVGKRTLASPREAENSHGMWHVS

SEQ ID NO: 944955 - protein, 103 aa, Homo sapiens
VRDGTRGIVTHHSIHSLGTHYAHRRLSARPLWRKGGWCAQHGPVRNGRFLEHKGGHPNLPRYGETPKVRGRALGFKAMERHFWILSLVKGVKVVLQEGGQLLR

SEQ ID NO: 944956 - protein, 39 aa, Homo sapiens
MPWLIILIVACQRIASRQSLRPDLERPPPADSSASTSDR

SEQ ID NO: 944957 - protein, 183 aa, Homo sapiens
MLTRKVELAMPHSPLLHFSLGLSARLRLIAIWGRLTSIAGLSLQRRYWTHARTLCASNHRLQNRIYSSSSSTQPSMHNRIPAQHIDHSHMWLYQSRHRQLESLMYAIPPPRDHTPILDTTIPQSRCITGSTLQQDETIYMVDHKISCERIVVDVCAWIIIDLEVIAFLVSALITTQYGTIAEY

SEQ ID NO: 944958 - protein, 102 aa, Homo sapiens
HELCSFLETASLKHIALAMRESEPCVRMDPPAVCISLCETTAVMPAGHVRTFPHTHTMPQVKGLCLTREPFHDGFLGRDRRGEVSLGAMKPGPHTLCEVSLT

SEQ ID NO: 944959 - protein, 117 aa, Homo sapiens
QGESARRARAKRRGARASEERGERRHRAAAVLTEPASEGTGMASRGGKKKSTKTFRSGKAGVIFSVGRMLRYIKGHPKYRIGVGAPVYMGAVLEYLTAENLELAGNAPRDNTGTGHP

SEQ ID NO: 944960 - protein, 138 aa, Homo sapiens
VLRVRGRRTARGGRQASSSPCRRVYGLRRLRWTPLLNVEGLRGAHLGSYCSARYAPATFCAEGSRSPLRGTALGTYRHYEDASRAEHSGTCSSGHGASCAARGASGSDRGVPGLALDAYDHVLPERLTMSEESDGCQL

SEQ ID NO: 944961 - protein, 99 aa, Homo sapiens
LSDSSKMNIRNIKLGTRSRKGPCLLSCLSVTIRPDLLALADAPVRESKANTDWKSELLGQSMTFTIASLISHMDEHEAPSQRMIIAYLTSVNVWVSANL

SEQ ID NO: 944962 - protein, 134 aa, Homo sapiens
MSVLTGTQSSRLSRSEVRSIILYEIMHRWKLAQVHVHIDSIEAVTKIASEHTAVREQAEEACIAAAEQAISVRQQDRLENAAQYRERATCDPWTQIRYTRGNDLRMSKKPKDPQPPDKEFTPYDYSQRDFMAVA

SEQ ID NO: 944963 - protein, 114 aa, Homo sapiens
TTVNSCSVATANVCVVDGWQPHDVIRTHIYMRDPICDSCTAFGHTLIDHEEGMGDELAVTVRPLLRQVYCGNCVLLHQDARITMHMLDSEEKHSSQTHYDSDLDDILVVASMGI

SEQ ID NO: 944964 - protein, 145 aa, Homo sapiens
GRVLGLAKVAPVDYLSQYGYLQKPVEGSNNFKPEDITEALRAFQEASELPVSGQLDDATRARMRQTRCGLEDPFNQKTLKYSAAAPLEKDAPDFSHLEPALHPFTPHSPGRPAISLTRLQQCGSLDLPRCTLVRLTSDSTSWPSL

SEQ ID NO: 944965 - protein, 139 aa, Homo sapiens
MRDHIIAKNVAADIAVQSSVNRDANALEGVKGTFSMGTCTVKKPYSEALERNLQTHGRSIHAERDVMDATLARTYVVTDWRVNGVGACTHMARICYKVKSGFSGLIAACDTLCAGVEEQLRPLTAACECPTLSIAAWWR

SEQ ID NO: 944966 - protein, 126 aa, Homo sapiens
MQVYLGLYWSLLWSTYFVYTWECSTPYHCLKASLCPDCCWWYHSTETLPPWSPCMPRCSYCLIALRQLIYTEPGKIVGELRNPCLYDLLLCTTVRAPFQVQHVLHGPPAVALCLTEEACSSYCFYA

SEQ ID NO: 944967 - protein, 70 aa, Homo sapiens
PAISHVHHSMNLIAGYQVLNELSPQGIAPRAHDMRLPLALTKDLYASLQLCIWKQAFASTSGLTKHFVYR

SEQ ID NO: 944968 - protein, 221 aa, Homo sapiens
LNFGYVLAPLDMQGLVTGAKRIRKAAAAVHDSMFRPGVLLSWRLAHGMHYLWGLGGEETFWALVGQRLRVCTGLRTPDRDDNWEGVAVGRAGRDARGRLEPGLGQCVQATCRHSRDDLKRGRETARMEQGDRHGTKGRGDDRDRGRMTGQGLTGRSTGKPEDDQGGRAARWRSRVHGGVGRGTENGARGHERRGLGMSGREGRKCEGGTAEQMGGAVWMGR

SEQ ID NO: 944969 - protein, 95 aa, Homo sapiens
MGQSADRLTGHSAASLLEHDEYALCTDSVTLKAQDEGLLTDVIPITEPRLETATRAHGNRPSLLELMYLLMPAFMMAYSAETDAQYSLFELMRMA

SEQ ID NO: 944970 - protein, 144 aa, Homo sapiens
AAGIRHDRDRVRERERERERERDRERVTPVIAIYFSISPFPLSSLSLVFHHVLLPPAFAFFFLTDFSLSLFLLLLSSSPLSLCLILPLFCSIPPLTLSSLLIFPSSILSASYLSPCLLLVFHFSLFCPSSFFPPFLPFSSSFFS

SEQ ID NO: 944971 - protein, 98 aa, Homo sapiens
GDLSLRRDVDFSSSEYHVCKSEECVNTGTGYSCYGSNGYYYHTQRMQCMRYDRVADEEPPCEGGRCGITVAYYHWTCESSLMLDGSKSRMRSYESTEL

SEQ ID NO: 944972 - protein, 75 aa, Homo sapiens
MKAALHCTTVGCGSCTCIEVAVGNTGLTVFSDELKVGRTINGTFYGGCSVHSVLLVTDYPNMDALRLMYRYRAFV

SEQ ID NO: 944973 - protein, 127 aa, Homo sapiens
RIQHEIARNCANQRSTFRTALEPLADWLINIVCAISTYADLIAVAVTDMIIKRDSNSDAAESYVIYRTLSTPRTLAKYDNPSYATARLASSTGPVSNYADSINLQILCVATVITTAASAHRYYHHGR

SEQ ID NO: 944974 - protein, 105 aa, Homo sapiens
MRLASTHRSLCATQLLLYEDAAEHARRAAERCTTGESLHTVQAYVHTLFSLDQAQGAHVPAHDFLDRLCCLDNLEASLSRLEVDKRMVKTVVDSLDAYSVNIETN

SEQ ID NO: 944975 - protein, 90 aa, Homo sapiens
IHRPAIIGTLARPHSNSARTVRSMTRRAAERCNTSESVHTVHAYVDTLCSLDQTQGRHVPAHDFLDRTCCLDDMEALLSRLGLDIENGLN

SEQ ID NO: 944976 - protein, 66 aa, Homo sapiens
MTTTVACYVRQSRAPHGHKYVRLKPGMDDEPPSQVLGGAGHAKVGPHSRLSSVSYCCRPYGDSVAP

SEQ ID NO: 944977 - protein, 75 aa, Homo sapiens
RNERCRVCGMHNLDSIITFAEASKKMILLTAVTCGLYAYRRITDKRRAEPYYWPSIADDYDKTKLGTASKKKYAM

SEQ ID NO: 944978 - protein, 131 aa, Homo sapiens
HTAMAPKPQPWVQTEGPEKNKGRPAGREEDPFRSTAEALKAIPAEKRIIREDPTCPLNSDPGTQAYEDYNCTLNQTNIENNHGKLYMIQLLQDSNRFFTCWNRWGRVGEVLQSINRLTRLEDAKKDSEDFR

SEQ ID NO: 944979 - protein, 153 aa, Homo sapiens
MLLGKVSLAYRAAVQSRPTRRFEELGLMMSTVSLSKLSSSHDLTQIIRVDLVWPSSGGAHGQLCACPEFSSSTVSQSEYLIYQQSQCRLRYLLQVLLWVPALSHGVVQGETVIFNHQAHLWYRYIAPFFQESNPLLLAIVPMLYKIPVFMPPN

SEQ ID NO: 944980 - protein, 71 aa, Homo sapiens
GRSCQHEEEPERDQNLRYALTQMIQTGERAKLPVPWKYSKCCKSTFTLYSFRTKAMHSILLLRTYCSVIFL

SEQ ID NO: 944981 - protein, 67 aa, Homo sapiens
GRPGQDVKEHEREHNRRYALTPMIQYRRVGLAYNTVDKYSNMVLKSTDHSSSSFWTKAMHSNFLLRT

SEQ ID NO: 944982 - protein, 54 aa, Homo sapiens
TEDWTLYGSHNGYTLIDNMSLYTFTVPVRHGHYRHPRFHVLTGAELTYSIPTHL

SEQ ID NO: 944983 - protein, 115 aa, Homo sapiens
MLTAYIRALVLLDDGAPEMDTVMPGHGMRRAEVHVTDAGLNGTDLVQGHRDEGIRAEARLDDATEDTYDVVVLPRGDLCAQNASESAAAKEILTEHDKRQALELASAQATALLAL

SEQ ID NO: 944984 - protein, 140 aa, Homo sapiens
SLRPDGDSQAPGRFWAVSAPQVGRRCPFTSDSGCLRRPTLILSSIDPAQPDLVAPAFSRIMPDLAQIAFRLYRHLCHRSYITSAFFGPLSVRCRLLNRRPGDQGWLFTVKALEALHFALPGVQRLALNAFLRLRPLDQLS

SEQ ID NO: 944985 - protein, 67 aa, Homo sapiens
PAGSDRHLIPAKSMVYDSQRLLIFSRMDLCRLLVMKTADAYAWPPGGLTLEAWMPVVDPQSGFFTPI

SEQ ID NO: 944986 - protein, 78 aa, Homo sapiens
MSCQIRQNHSTSVEAGDNRLVNLYQLSCYTYLSVGSYFNRDDVAVQGVRHYLRELAEEKREGEERILDALTSERVALY

SEQ ID NO: 944987 - protein, 83 aa, Homo sapiens
LYDCCYSSVRSVHIPGLCPKLETALPLYRSLEPFERSCRPYSCLLTCLEPIAWLSPRCQPMHFEIAPDHSTGLEGLRHTLVIL

SEQ ID NO: 944988 - protein, 68 aa, Homo sapiens
IPQLNFLLSATVNEQIVRQSTELVCTAYGEVHAIVMNPINEYKDPENIFTDRRIMCRRFFPDYLISLS

SEQ ID NO: 944989 - protein, 76 aa, Homo sapiens
DPTCRLYSKCESERADRITMYRTSLQRLWRSACKPDEYSECIRWFRGHSSTIGSACADDHCVTSDVIVLAMTSLYK

SEQ ID NO: 944990 - protein, 80 aa, Homo sapiens
IDHLRHIVSDEVVAVSSSVYTGLNQTTYDSGFDHYTDSHYADGDAEELIDRSGYVLTLCLCVCKWTCLDVIHLYVATTME

SEQ ID NO: 944991 - protein, 80 aa, Homo sapiens
SKVELTHKPPAVEIWTNSGCSLEHLWGGETRAKPAAGNPKRFAFCRGKTRLLRPEDPGRGKALSAYRWQSPQRGPHPEAD

SEQ ID NO: 944992 - protein, 109 aa, Homo sapiens
AQSIGLRLLGPGDRAGMTPVVEHASSPHTQRVPRPAPCEWGISEHWTEAPRASDNCGTHIGLRSHSVIYCLAGGGGLGGLADQTLVIPGLPIPCATDHTVPGCLSDLHA

SEQ ID NO: 944993 - protein, 113 aa, Homo sapiens
MSPVLSSHLSPSSSFLAFPASYIARSSSALSFIHSLPLSPSLFSPLHFPAALSFVSSSLAIVSLHLPASSHFHLCPCSSLPLPLPAFLLDSSPPLSLTSYSLPSCSLFSLRLL

SEQ ID NO: 944994 - protein, 80 aa, Homo sapiens
MRKVSLDAWWKQTKRKNNGKRCPGRDAESSLHSDLTRHHWQSALYTWTAHDTTDSSLHSTIGLDETPLTAGYTRTSRRRA

SEQ ID NO: 944995 - protein, 119 aa, Homo sapiens
KTSLRAAVQGLPGGGVPCDSAVIPEIQHILDRHDPTSVVVTSHQAPGEQTKLKCLDYDFYPGADGLHNGGTYQSWTVETVTSKDTVLYSCHVQNISLTQPLMVPWKASYEAWVGGCGIS

SEQ ID NO: 944996 - protein, 110 aa, Homo sapiens
DASIEVKQAFAELESFLMDREVALLAEMDKVKAEAMEILLSRQQQLVELRADIKHFVSERKYDEDLGRVARFTCDVETLKSIDSFGPVSYIQEQVFDQIPMELKYIWGLE

SEQ ID NO: 944997 - protein, 93 aa, Homo sapiens
MCSCYWLSVYPVTNGLCGWTMPWLELFWCWLVPAPVKPVVGGGSVLTRGAPGIQDASKGLWLSALMKDNAFASTLCCVLCSGLPEPCFGPLDA

SEQ ID NO: 944998 - protein, 90 aa, Homo sapiens
MWSSPDTCIEMVKVKRYISTEDPMEALDPVDTIVLHMTCTQWKPRECSQQMSVSNWHRTWTGCAWHLQYQNGTDTHRDCQRRVITVTEPE

SEQ ID NO: 944999 - protein, 125 aa, Homo sapiens
EAHRSTVNRKSTESVEGERSICGFISSVPRFPEVTTHIGERILAVQVPWHKDRIILKSGPTHLYAEQLSRTAFTCARSTNKRSWLYRILPSGSHKPFESIDQGHVTYNWDEVDPDPNQLRWPFES

SEQ ID NO: 945000 - protein, 149 aa, Homo sapiens
APAERRQTERLHPLARRQSAPGDRPETTGRRVPGPTLRPPPALSGPGASRVCRHRALRFGRRGNHERRQDGPRPRRLRGPPRPLGDGRASATTVKGRAGARTSRRRAVRRALSLVLDSCGCCRVCAKQLGELCTEREPWNRTGLFCDLA

SEQ ID NO: 945001 - protein, 134 aa, Homo sapiens
MFPLISCQGRGGDERLWRDLSFVPLGGARVLSPAHECARPRHAGQYNHILGTPTNSVLSLSLSTPLQTDRETDHRYRDEDTCLYQEIVEFMTLLCFGDSFTAGRASQPRACWRIHDQGGPRYSPCLLVPRGLAV

SEQ ID NO: 945002 - protein, 232 aa, Homo sapiens
DRETASEELDNKSVAEIMNSIPPPPPTALTTEAGAPRLMITHIVDQNLISYAGEKYWDRYISAFPVLSGPHGRGESNVIDTMLSVSGYRAQLIRSKKLSVLIHTSDEHTDIHSCTREGHLLQIIDNEKDDYEVIPNTEIYVIQSDLQRNTPVYHIRGRRKTFKDVVNLVRSHGIDLDHTRYLILQGEVEQLAVMRPKGQTEHYEGMLEYLEHIIACGRNEPILSLVESRNIK

SEQ ID NO: 945003 - protein, 144 aa, Homo sapiens
RASTQDSSVIEDTEITRQRTCVCSSANLRRKRVHTAPVIRAEGTLGLVWAPDLDATPVPGLYRDTGISDAHLQMKRWWRNLRADRHRCPWAPHGLKVNLFAGLRPLVLKGKLCPRNLSTEEGELAESESSHNEFAVQRTGCKVP

SEQ ID NO: 945004 - protein, 152 aa, Homo sapiens
ASGPRRQRQCLAVARGGRTLRAAGRNISACCFGAAVSASERDTASSRWRSPFLIVSTDWPLVLVLDRSRLTPPSGAFRWADCRPLSTAYHRSSRNECFHLFRDEPDYDASLSQEKFVSIAIKDLITSFLSLIGLASPLELTPAFNLTTWLIP

SEQ ID NO: 945005 - protein, 58 aa, Homo sapiens
MTLYGVTFLEVRTLQRSQSRYNANSALSCDLFFCKRFEEEVPSQRVERYHYVGAGLIA

SEQ ID NO: 945006 - protein, 70 aa, Homo sapiens
VIPTNDFMRIRGTAMGYCTKLNYFLLIYTTSHIDDHSHLKLLISNDSPNYINVTAMITDPNNDSLSSNTY

SEQ ID NO: 945007 - protein, 34 aa, Homo sapiens
MHLSYNGPHLKVRSYCFLVLWVALACMGAYLDDI

SEQ ID NO: 945008 - protein, 114 aa, Homo sapiens
MIARARDHYTWMHRINIGSGRSLVVIHQHYEGRRHRLDYEIEIEPTVILCLEQIKCLPGDIEYTDLAFEWNRPAHWTALRRETFDGTHDSIPVNVNNNYERRLINAPATCRTAK

SEQ ID NO: 945009 - protein, 114 aa, Homo sapiens
PGPGGAKGDKTPGGPKPGDGPGLSTPGGHPKPTHIGGDEPRGGRQHHPTYQQQHHQGPSAGEPGGRIEEKISDSEGFKANLPLLRRPGELTHSDVGCMLGIYLLISRRMFGFGF

SEQ ID NO: 945010 - protein, 193 aa, Homo sapiens
ILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISAFNHANGLTLVSRAHQLVMEGYTLGHDRNVVTIFSAPNYWYRCGNQAAIMELDDTFIPSLILPRLLVVSLMLHGAPQTTS

SEQ ID NO: 945011 - protein, 105 aa, Homo sapiens
PRAVGFGTRGERARLECLFMFFELESHSVAQAGVQRCDLGSMETLPPGFKFKRFYWLSQASSWGYTRLTHHAQVIFGFLVEMEFHHVGQAALKLLTTRFGLPDEL

SEQ ID NO: 945012 - protein, 193 aa, Homo sapiens
MVRHSLQHLQDGNEHVVAEATTTERYQAQEERVSRPHRHTTHAKTAADQGVTHRYEQTMRDNARRHTEHNTGTTDRTGTHDHKDSAQLQCTRTVTQPETKRHKSRRAQERHTTAHEWRIYCIEAPHSQALQKRKGGGGMANHKLKGGQISKKWERGSLKEREMDLERGQTLLKRGWKNNHRAQGSKWTQGEGI

SEQ ID NO: 945013 - protein, 149 aa, Homo sapiens
VNFPVPRCRNSGEGSPRFFWRKGSQPFLCLKPAFPLGPPPFVHPILLPRPFEPSTHPSALDSTLLRSGSVFQPFSFPTKRSPRDPRAVVNSANSLGKPHPQITPSISEREDRGSNKVLILLKPKFLGPTFTNFCSFCAPYKVAKVFHFL

SEQ ID NO: 945014 - protein, 96 aa, Homo sapiens
DFFTEYWFAVLMSGLYQQMVDSAYVDVLLLIIIDCITGPESCNYIMVILTLAHDGYRLTVAYIPLPQAILAFYGFQHCATTSTHCSGSDTIPATYT

SEQ ID NO: 945015 - protein, 108 aa, Homo sapiens
GRGGVPPSLCLGGSCGGGVGVGLARGCHRCVALGSGGGGLAAVGFVGRWWLGRGLGWRVCVCGVPWSFLGSEFVGSGGEFLAGVVCWPRGLEWKSRELVCWVGSGGGV

SEQ ID NO: 945016 - protein, 49 aa, Homo sapiens
MRYLRHRLSALSYTFSASVMDDTRLRIPADADANIFRGPPQSMIRQIQA

SEQ ID NO: 945017 - protein, 75 aa, Homo sapiens
ERKPVLECPEREVFIEHITLSDEERESYKSVMKAEPLLEEVLMEGLCCDNMHKCRVFWLDSGKFVWHTYTFTGRL

SEQ ID NO: 945018 - protein, 145 aa, Homo sapiens
MSRHVLSTAVSSVKALSLKMVVTYEIWQCCSNCTHTPVSTCYMASSYNTIVNRHKHQNHLADQRTFKYLLKYVGLKRHATSKFVLHNRTYFRPGMLAHSCTHISYIGQCGLIALAQKFQTTLDHVSHSLFLHCKIKLHKGGGEHL

SEQ ID NO: 945019 - protein, 109 aa, Homo sapiens
RRCGAAATCAHMQWMCVRDCSRFLSKRNKQTYRTEPNNLEGRNFFRFNGLIHTKSVGVEPQTTAFYVRTTIKNGRATLRRIRHMIRKNKCRPDLCMGDIRKGRAILCRR

SEQ ID NO: 945020 - protein, 134 aa, Homo sapiens
AREEREREIDTAAFCVVGHTLCCQTSCCLVPCVPVCGSPRRGCPQDRYTPHMIRITPTSNKSTPNLAEFGSRLYRQVAHTANTANISFSPESIGSGFAMLSLGTKGDTHKEIPEGPNFNLTEIPEALHEGSQLP

SEQ ID NO: 945021 - protein, 151 aa, Homo sapiens
MEHYYEDLGVHGHALTEDIRHIQNVKLKCCPDTYEVLSDAKKRDMYDTYGNEGSHGGGGGLSYYSSAIVGVCQLSKPQGELWEQCELRDPLAFEYTDDSTEALFETQMRTRVIENLRTVSELCAEQLSACFRTPVPVHRVRVCFIGYTTVT

SEQ ID NO: 945022 - protein, 89 aa, Homo sapiens
PALALDTDLALLMRSGLWVTPWACLRTWLMTSLDPATLSDPHMVLTMLNLMPLVKSALGHYEVIAMLCLLSTDVLDYALILTEERDLCN

SEQ ID NO: 945023 - protein, 107 aa, Homo sapiens
ERERERERERERERERESDRVLEPPGSGLSSAMVPSRSSFLRDCMCPCLLLAFSVSSHEVLLCHTLIIGCSITYCRCSVSSLCVLDAFRSLDLVESPCLLPLLGLSL

SEQ ID NO: 945024 - protein, 112 aa, Homo sapiens
LWNYKSRILNLLTDEEVNIDLPTQSIVPRTFELKPGMVLILGAIGRIDFLQGQSAWFTDLASNILTVHITYLDRADALYQKHAGYTILQILMGTDGLGASEASADMKVACAC

SEQ ID NO: 945025 - protein, 83 aa, Homo sapiens
TLGSSLGMAQKTFLEGGETGGLPKPLKPSGGFSQPPRVSKRAPRFPKRPPNWEKFFFGKKGATNGGQKAGPPPPLFVGGPPPF

SEQ ID NO: 945026 - protein, 88 aa, Homo sapiens
DGGRLSVCSVCSGGRDGQTRCCPVVRLTHYRTLGGSEPPPDGARSRLSARTSEWDIIFVESQLYMTLRQSQLTVQTTQLMLPAFQHAT

SEQ ID NO: 945027 - protein, 92 aa, Homo sapiens
MVDSMDKTSSSISPIILLQFLHMAIATGAETGEQGQDLQQDANECCIQMMPVLQQKYGALEDESVKETRLLICIGCDTFYSESGEEEVTIGV

SEQ ID NO: 945028 - protein, 94 aa, Homo sapiens
ACALRALEELASRPFLTADLRDMLDCVDITSFSITPILLLWFLHRAVPQDAEIGAHCQLIEYDANDRSIQMMRALDHKLAAIQADICELDRVLI

SEQ ID NO: 945029 - protein, 239 aa, Homo sapiens
RSSHSLSESSYGQTTRSPISPELHSAPLTHVARDSSRHLASEDTSSATPELALDEQSVQPWERRTFPLAHSPQAECEDQLDAQERAARCTRRTSGSTTGRETEAAPTSPAMDPLKSRHMVAAATAERPTTDERKTDIYTDSLTIGVKAPDISAYDIQTSYAWTFSQFLVNLRNIDPTLVVIILGIMLVLYLNPCGLVTHLSFSRWPEVQDETLLAWALHILCTVESLDLLILDDPYFTL

SEQ ID NO: 945030 - protein, 93 aa, Homo sapiens
MKAVLDCTTARCGSCTFIGVAAGSNGLTVFPEELVIWTYYQWNILWRTGVDSIPKLVTDYQNKKSNLDALVTHTLPFDTISEAFDLMNQGLSD

SEQ ID NO: 945031 - protein, 40 aa, Homo sapiens
MNHNQYYQSVLIINTHNGYSDPYDMRTGESHMTPIPYLNL

SEQ ID NO: 945032 - protein, 63 aa, Homo sapiens
PNRAEPPEVALRALAPRYVHAVMGSALTALTWSLADLSGRTASVDRTCVDSVRDQTPGSLTPM

SEQ ID NO: 945033 - protein, 112 aa, Homo sapiens
MRPEAGSSMRAFREPPHVRGRIETERELSVNNRAVAIYGLGRGLTSSSDQSQSSYCLNIANGIILGTPYSWGTQDPSFLEVKIGDKGQILIGLKGHWNIVTGFPLYGKHKTR

SEQ ID NO: 945034 - protein, 50 aa, Homo sapiens
MCPVRHGHITRGTPCERCGTRPRVEALRHGKRRECVAPLCGDIGGLNCVG

SEQ ID NO: 945035 - protein, 86 aa, Homo sapiens
SNPRGLTVHVSCDAVTVELELTGVSTCHELVNAERVYGLSFTVKWRQAVTHENYKRVDKAELVLMSIAGREPTSTPARGVIVVMAG

SEQ ID NO: 945036 - protein, 88 aa, Homo sapiens
RENIHIDVIGPQYEESERHRLKVGALYHQYPLYKNGGEEKKKRKSGEIIQAQLKDHTHTLNGKRTMVEQFSIGNERIPKAVKWVGRLV

SEQ ID NO: 945037 - protein, 74 aa, Homo sapiens
PSPNNVYGLSCCPAHSGPGRTTNILRQAPQAQVRPRGGLSRLSTCYYDDICRPPAQPGDCYRPSSGLAADSAGP

SEQ ID NO: 945038 - protein, 203 aa, Homo sapiens
PSVDHGASGPAGPSVPIGPPVPVGPSVKDGANGIPVPIGPPGPRGRSGETGPAVPPGNPGPPVPPGPPGPGIDMSAFAGLSPREKGPDPLQYMRADQAAAGLRQHDAQVDATLKCLNNQIESIRRPEGFRKNPVCTCRDLLCHPEWKSGDYWIDLNQGCTLDAMKVFCNMETGETCVYPNPAHVFQKNWWSHQSQAIWSNTAR

SEQ ID NO: 945039 - protein, 94 aa, Homo sapiens
MQVSSVCQRCSQALKLDTSLKILDRVTIHELTAPLLTTGHAKPGETQQDETNSWEEPFIETTGQDGVSRRFILTARMMSTGAQLDSDWGGICGG

SEQ ID NO: 945040 - protein, 145 aa, Homo sapiens
PLGGGGHGEGGPRTTCGTRGHGWQVPQGFLDAPALAGAPNCPVPRVPPDPAGEELIRWLISSPRIHDCTSPLSGAGGAAWRQGTGLRLVSTCLGQRHNRLKRWDFEAYPDGIGRRSARARLPQYAVHVSSGRTRLQDYDDGSGRL

SEQ ID NO: 945041 - protein, 103 aa, Homo sapiens
RKAKWEAQHGASGILPVAPGATGVEHSRRKPIFAQVFPSGRSVCAKCFLLLISTPKVSTLGYKVGHVSNDHSFFFGSHEGSGPHNRITSRSPPVQQVFSFGVR

SEQ ID NO: 945042 - protein, 84 aa, Homo sapiens
ATQPRHHGTCWTPEGQNCEFRALDPSGAAGRWAASESVHTRRAYVDKPWGLGKTLGRDVPEPEFFPRTGCVDDMEPLLGAWRCT

SEQ ID NO: 945043 - protein, 134 aa, Homo sapiens
VAYSFAPRHQHRGPWPTLRQLRQCFPVRTPPSVDHREKPDAPFRVYRDAQDTCAIHRNGPDRPHECHLVQVGGAHVSVLQPIVEPQIVLPVSSQFMLTFGSSRMQFYYTAVYKRCFSGLTSCDIQLFLAVRQLC

SEQ ID NO: 945044 - protein, 69 aa, Homo sapiens
EALLTLRSDRIDPVSVPCIDCPVPSLLYLAWGLVHSTCTDDIRKRHHVRQDEDSLQRLDGMMPGTFCGP

SEQ ID NO: 945045 - protein, 145 aa, Homo sapiens
MQRLIPPFREDSAKLTTLVDADAEDFIGYLEALKLLKTHLRRQALSGPTRGSDARSLCATDAVVDTRPHCELTLHELYRCVNMACRSDLHVAGKALEIRVFDAYFNGLINLRDMTDEAFNDQIHHRVYSLLHEAKTQTALVLDCL

SEQ ID NO: 945046 - protein, 59 aa, Homo sapiens
MSDSTDQTDYATRRWTTLIVLLRRQLDDNVGRDEDAAGLELDDIVYKTSYDLRYLHQIF

SEQ ID NO: 945047 - protein, 117 aa, Homo sapiens
SSCAIVYMARTVSYGASYMATQSLSPAAVIGTMDSLYLIALYHTTDRLPAILGVPWKAEQGLLVAQGRADSQAQLMLCTEVDVVTVPDLYLKQTIVRQSVYTPVVLSRTMDLTAAVA

SEQ ID NO: 945048 - protein, 234 aa, Homo sapiens
KARSLKQMSGIGRIETVDLVGSCLLYINLIRKCMLFYGCLAHLWHSYGSSVALVVASESHFLQVQRRFRAEQPWMSSSVACLSAAGSPSSISLVMSRSALSYQVQLHVTGAPFPPCPAGRGAMSRAVGSYSTEERLAGSASIRTDKRRESLQEYTPKERRGPSPVASTIVPCVSLVYIMMHGAPTAIIGPEGAQHHVNHLYVKKDGESPISGVNEIMHELRTRLPQSAAKDIKI

SEQ ID NO: 945049 - protein, 100 aa, Homo sapiens
PLEPCVTSQSPGPCCCGRSYSCCCPYAGTSTAAAICHHALSRIPSLATYSIRNENNIPTSFTRVGQRFVTLFTLYVDSQRMRDDARINALNEALLDYDKV

SEQ ID NO: 945050 - protein, 86 aa, Homo sapiens
LYCLYAREREDAVNEITEASSGIWLALCKGMMSEDDQLQYEVGVQEYEHGKAERAALMSYHPTAEVTHCTPGCQQPGTIVTVLQRS

SEQ ID NO: 945051 - protein, 97 aa, Homo sapiens
MLRLPTVFRQMRPVFMVLAPHLTLPYATDVFGAYALAFNASLCLPFTRCCGRYFGAIRNNSDYCAYLPKSSLLIRCCYCLKSIDSFDLHLPLSSLVL

SEQ ID NO: 945052 - protein, 132 aa, Homo sapiens
MWTIYAYFAVSLSSAMTPLCTLDLTLIRVMGIRSEHDMLSILTHFTRLYGSCLYSVIMGDTSGDFPEATARTLRQRCLNSRSLNDRTALITLQTSTVMFLRCYYHHVMTLTTMSNAYSCLLDCRLSVLLFIY

SEQ ID NO: 945053 - protein, 166 aa, Homo sapiens
MRQNCYMRNLSMFFPGTDCQRLIEVDHERILRTFYEKRMATVVDADALGEQWKGYVVRIRDGNYTHGLHETLGVVTCLRVQSATEQGTSLNTPRQLRTDRENQFAGSIADAHLSVHNLTIVIKDSTIITELTDTTVSSCLSSTRASRMRRLFNHLYEDDVLQYAER

SEQ ID NO: 945054 - protein, 105 aa, Homo sapiens
DGLPRTGMSTGETYLVLYADADKPYRSVGYLPSSVESLQKVPEDPYTLLSEEQAHAEQVHPQDFLDKTFFYSGTVSLSYPSGSGFLMLETDDDTFVAYSVKQESH

SEQ ID NO: 945055 - protein, 118 aa, Homo sapiens
GRVSLIILLTDGDPTVGETNPTSIHNNVREAVSGRDRLFCLGFGFDVSYAFLEKTGLDNGGLARRIHERLKTLSCSSRTSTQEVANPLVTAVTFEYPSNGVEEGTQNNFRLLFRALGG

SEQ ID NO: 945056 - protein, 109 aa, Homo sapiens
MHPGLTLRIGCETSETDTLQPCCATLIHILISSVPFNITLNKRMKQLSLQRLQMLMTELKIVSNDCAHYIGTSYAQVQVSLPMVRGVDCGAALEPERLECSERTDIPLP

SEQ ID NO: 945057 - protein, 70 aa, Homo sapiens
EGLAMTVWNLGETTIVLYADAKIRTVELASSTVPWTYSNRYDSTFTLCSFCTKPLPTKFLLLTSSTDFFL

SEQ ID NO: 945058 - protein, 114 aa, Homo sapiens
EGVAMTWWSIGESTIVLCADANDPYSRAWLTYRTVEYSNRYDFTLSDCCFCNKALHIKFLLLTYIHSLIFVASLGDLTNPVKAALDMLETNDDSIVAYIYRIPRGTFLIEPNGY

SEQ ID NO: 945059 - protein, 106 aa, Homo sapiens
MLYTCARSPNMTVYAVWLSSSMADSCTRNNMLCRATGNTAGHDMVTILAHLTRLYGYSLYSNFMGDTSGDCKQELFGLCGSSDESTYTTLKEDSEDLALYYIMFIH

SEQ ID NO: 945060 - protein, 80 aa, Homo sapiens
YSGTTDILCDRRLPISLVLGHCLYPVLFWDTSTLFFVNTLARSYVTVACMQVYMCMSEPENVQPSAREPRHTAFMDEWDH

SEQ ID NO: 945061 - protein, 55 aa, Homo sapiens
TEDRTLYGSHNGYTLLTTGVRTLSQSPCVRATPDIPDLMPYTLAWLTYAMPTHLA

SEQ ID NO: 945062 - protein, 129 aa, Homo sapiens
MASFTRPVISLVMNIDSSATPNELAPVITAFQEDLDEHCFSPGVPCQRGQHRYASSGQHTLYLLAEHGGTRPWFLVCGCSMGGSSELRVLSAQCPVLAHLLYSVCHRVTRCLKKKGCILSAGYYNSARH

SEQ ID NO: 945063 - protein, 81 aa, Homo sapiens
FVAMHILNIARFGMAATLTGTMRGIIANAEITLTDSIGYPSRLLTDHLYHVTLITAGTHYTSISYPTSSSTCYLRSPSTVY

SEQ ID NO: 945064 - protein, 119 aa, Homo sapiens
VTCISLLFLFSSAYSSGEFRRDAHRSEVAHGFKDSGVHNFTALVLICLCSVSSPDEPFEDHVTLVNEVTEFANTCVADESPALFGKPMATRLTAVQCGTLLQMCSLSHTDDSRLPRLVS

SEQ ID NO: 945065 - protein, 100 aa, Homo sapiens
MRTHLQRWHLSCIACTTDCCTCQVRATCPCSSDAHAVYHLHEHVLNRATVTHDHAMHDARMLQPGTIEICVSRTNIASAVQPSLHDAEASVHDALRSSLR

SEQ ID NO: 945066 - protein, 88 aa, Homo sapiens
MPHRSCFTAWPMDKLAQMTIEHLGLDLRLADGLAGADDRHADHHLTLTEHVPAVRVQHFRFSHESRIRIDLALALQDRVLLELGPAIA

SEQ ID NO: 945067 - protein, 79 aa, Homo sapiens
VISVLAQGSQVLESTPPPHVMRGENDHISSFIYQKAKRTFGSFLTKNLEKSSTLFLGPKLGIGGNGKLFGGQKNPQWET

SEQ ID NO: 945068 - protein, 60 aa, Homo sapiens
MQVLNTLLALLLITITCKTTTTELAYINSYIEEQLAAMTYLLSTYYVRLEYTYHELYQLL

SEQ ID NO: 945069 - protein, 122 aa, Homo sapiens
MALPWVLTDLSLLPLLEAQIRLCANLVPVPITNDIVYRITGQWVHIVSAFLTFNMTDDTIFLREYQTLSELRAVYDFSYLNGQRENGNVVRVYGGREHVAHLLFIRDTKKHEDRYYLDYEIC

SEQ ID NO: 945070 - protein, 113 aa, Homo sapiens
GTRWDVPAGLGRDSVPCMGLCAMSDSPLILKPYLWRHSTPERQAQGLGFPCEELRHHCAMVTQAKADIGPSLSQTPEGWPWVRQNGPRTLAVESSSGWEWLCVDHGLTGPFFF

SEQ ID NO: 945071 - protein, 208 aa, Homo sapiens
AGAPPPASLPTCSLISDCCASNQRDSVGVGPSEPGVGYSLVVRRFLSRSEKRNIRVVVTDFPVTADEWNSNHTIEIEMNQTLEIPCFQNSSSEISSEFTYAWSVEDNGTQETLISLTSSAIAHYLKIESSLGQTTDTCLQSKSSMMGGSSLATLESGQHRLTGLLSSALLFLEEEAPYYAAEHATLWQCLRPVSLVLAFFVGQGDEGG

SEQ ID NO: 945072 - protein, 98 aa, Homo sapiens
PPEHRCYEYYPYESQCGPERLMLNIVCIRTRYMLQSAPVLVICMYKCEGIDYRPLTNLRRSAAETLASYFEYARAMCKLTAEREQWICIRHVLEQYRD

SEQ ID NO: 945073 - protein, 87 aa, Homo sapiens
RLKIGSPPPDSAPQPVGIQTLGVGKIRWGVVKQHIPMGPGPTVGLLGLQTPDIPLKTFPCTEHALVPDNPLEIEKKKLLVTRREISL

SEQ ID NO: 945074 - protein, 74 aa, Homo sapiens
RQSRPDVETHGILEIRFWRNACDKRDFLQRVVHRQTFCTYGTKQTKTVETLAAQGDCFGTMELFLWDTFSFHRF

SEQ ID NO: 945075 - protein, 120 aa, Homo sapiens
KLHDETDRVTGPSRIPDIKDRQEMPYMDAVEHEIQRIITLAPYNLSHEATRDTILRGNLNPKGTVGVPTVDSVLYDRPRISCSRFKPEHFLNDNGKFKYSDYFKPFATGCAILQQLSASR

SEQ ID NO: 945076 - protein, 206 aa, Homo sapiens
MAVLRPSALASSELLVPNSAQRSVGCSDPNLGGFKRGACEMDHQVPLCSLPCRIGCEYDGLVCGIADGPDWVNGPEGRPSAADGGGGGEGRTEEAPRESGVKRLSLMLGPLWRHADACRHLTLSGIGGSLCMGDPCAGSQAVGASVHWRRGVTGHQTLSGPLALSGLGALEDRRPGRVLEWRTSWGWGRAACVRRAADVVELGGGG

SEQ ID NO: 945077 - protein, 133 aa, Homo sapiens
GTRRSFPTPDGRLYTAVRHLLTAPSDCPKALDTALHLASTIDDNVYAYSDSDDRVHLQVRQTYYHDSEAAINRRINLELCACYNDLAMCNYSDRDDMGSNNSALWVDSDVMGTGGRADKLMNLYNPRGGTNRT

SEQ ID NO: 945078 - protein, 69 aa, Homo sapiens
MCGKATGRDAKVNNKDSGEAVTIVKTPPTVVVGIAGYLAPLGLRTFQTVFGVHIKENARGGAIRIGHYE

SEQ ID NO: 945079 - protein, 75 aa, Homo sapiens
HEPAGNGVHDELALPDYTFFLYEELSCTGVELKYTGTARALFMLPDHRQDGGCGSHAATRDPESVERLYQANRDK

SEQ ID NO: 945080 - protein, 225 aa, Homo sapiens
HTPAVKAGGMQIVQKHSHTGDTKEEKDEDDQEWESPSPPKPTEFICGVIDQSDRGGRPAAAQVAHQKPGACMDKQSCAKNPAHPAATRVILESTSLPTWGRVCCTWGWPDRWNGEGGGGPTVLVNLRQNRGLWALPYMGLWRTRDRSSPDVVYGDAGWMSFEEHCARRGAHSRNLPRCEKGGAVGLMEQWPDGLGYDRRSNNGTVREDERGLRGPEECMLGERGQ

SEQ ID NO: 945081 - protein, 115 aa, Homo sapiens
FNVAMHILNNGRFVIAAALAGTMTGIIANAVSTLPEYISNPHRSLTDPLAIVSLITIKLSLHYKLLPYQQPDSLAYVSIQRRLNSGCMPTDPQRDVRTLFQVDHATSYPLRGASR

SEQ ID NO: 945082 - protein, 130 aa, Homo sapiens
HEEITTIPSHRESCRNANSHHHSYIEAHIKKATWLTKLMNFPGYAYTPTLWEHQTNGRGMGGRLLRMCVTCMQGSYMDSHEPEGSWVCRGRVVTLLSTPGRLMRPVGGGGGGLRGGPGGGGGSTGPEALV

SEQ ID NO: 945083 - protein, 93 aa, Homo sapiens
SSRSSELLGEAALNTVLHEDDILHSQDMFNEDGLNDSSIFNTSELAPSMNYMLQNHYTWAAFMDSVLQHFAVGATVGVKVGAPKDDFLEGADA

SEQ ID NO: 945084 - protein, 115 aa, Homo sapiens
RTCVSHDKNDNSSSDHQQRLLDHQLLNMMLIVIHDNDRIAKGLMTTDHAMTRPHQSADGPWKKQRLMSSRAMRSIIPDSTGAVEEADLGIPDLAVKLTGMSYTSSSVNESVKDLS

SEQ ID NO: 945085 - protein, 92 aa, Homo sapiens
MCSVYREFSVLTAIRSSEIHVVATEQNMNANDVSAGSKDREYYTKAWDAIDSMGPMRSDAYTSVLTFYGVSLDTLGEYTVANDYTMRYRLYW

SEQ ID NO: 945086 - protein, 125 aa, Homo sapiens
GKDWDELEEEARRTEKVVTEEEEEHSRSMSRKTKASVHSSVRGSNRGCRHSSAPIKIKRKLLLNFGPELHSSSSQPLLPFVYMGLGGHLRGPIYSGNYSATRTRANGPIQMAREEVHLQTVGGYC

SEQ ID NO: 945087 - protein, 168 aa, Homo sapiens
PTQKTKDSLDRSQSELHNDCLISKESACLMQDRICSCEINVSDAIMTFGLEPKDLMSVLNDNYGDKTEVISSLRNANSEDHESGTETNTYAVLNSVYLMTNSHTRLLYMKTMGWQEIRHAISRLTDGDNMGGSTKTAADHMREMLNINQPSHDYLDIYAIDVNMLDVD

SEQ ID NO: 945088 - protein, 222 aa, Homo sapiens
FGTKGHFDYTCEGATLSSLDVYCGALASIVTTFIIAPKLDTYTSSYLGMELTATLDARLLPVAIGRIPKPSTIKSCAKFSYYYHLLRHRYYVNFPSDNLTYITMLLQILLLDAKAHCSPKLSLTRVSRHARSCRLLQKLQIYTLGYHHHAFVHTLYPNKYPKNSMTWSPRAHYEAIFVMALPATGELSHHAQTSALLTPGLQPRVCLYPPVGAPTDPNFPDL

SEQ ID NO: 945089 - protein, 95 aa, Homo sapiens
EKACVLFFPCVSGPRGKGTPPPYQAGVPKWSRLPRPTLAAIEAHCPPYEGSNPPPCKMFGFCDTITVMAQLPVVGLNPVVRHPCRLRVPAPGEEA

SEQ ID NO: 945090 - protein, 177 aa, Homo sapiens
TRLSGVPVKRRLPISGGGARGPSGLTMAVDTAAAVLTALGGALRLAARRYMRPRVHQMRIGGDPGLMHGKTVLITGANRGLCPRHGRRATAHGSADDHGLPGPRAPRGRGGSASPRATSGRGVRPTPCRQRGGRSHNPEAGPRLAALGARLLTRNAPENSLRWMSGSITQGSSSALT

SEQ ID NO: 945091 - protein, 114 aa, Homo sapiens
SYQTIGLRLLGPVDRAVMTPRVVHARPPQTQRVPLQAPCEWAIPNNGHKPKEPCHNCGTHIGLRYRFEGPPPEWVFPGALGDQTLVCPRLEVSPGALHSGPGWLCDLRAKTWVF

SEQ ID NO: 945092 - protein, 158 aa, Homo sapiens
MSQLKIVATDFIPYLETYYAQTATLRDTYGETADCCAEHDPERNECFLHHIYDNPYLPRLARPKVDVMRAAFHDSEETLLTDAYLKLPEDVLTFMTRNSFSLLEGIKLLLQNAVKLLIKLAACGQTLMIFCMYGWLGLQTALKRGSSIGDLRMCLLPG

SEQ ID NO: 945093 - protein, 44 aa, Homo sapiens
MYIGQEKVGLLHEVPITVNCTISLKYIANTTDRFISMTLDLKRD

SEQ ID NO: 945094 - protein, 120 aa, Homo sapiens
MSQGVHRAGAGQGVAAAVQLLSTLSVLRSAVEAHVTGVLDDSLCDIDSIDNLNTYKIFHITETIARYETMLRDYKDNLKRPCPFCAEDGHCSMTGMWSPVQRVKVRLESKLRILRSTRSY

SEQ ID NO: 945095 - protein, 227 aa, Homo sapiens
VFKPCVVMPDAPPRCPAKTGRPAKYNYLLKIIQLLDDHPKCFIAGADNVVLKQMHQMRMSLHRMAVVLMSINTMMRRVIRGHLENTPALEKLLPHIRGNVGSAFTKEDLTEIRDMLLANKVPSAALAGAIAPCEVTVPGHNTGLGPEKTSFLQALGITTTISRGTIEILSDVQLIKTGDAGACESTLMIMLNISRFYLGLVSSIVYDNGSVYNPVMLDIIVGIAYAL

SEQ ID NO: 945096 - protein, 73 aa, Homo sapiens
RWYTNPGEHHLLTHALLTSTLKAHMSPIACTPRVSHYTLYKSCELDTNAAYGSTAQYFGEAPRYGDLLRFPHE

SEQ ID NO: 945097 - protein, 77 aa, Homo sapiens
EMDHAVQLTDREPERSTSDIKGSESYICISLEQLRLYTSVTDDRDYRSLDLSKCDPDYLWGHCAKMNHGVTGDQYPC

SEQ ID NO: 945098 - protein, 117 aa, Homo sapiens
SCLTGASTIMVMDTCGPRGMDFGGDQGLERGYRTVRKMSTTMMHVDNTTSRRLYDALIYYSTDEGCMLACVYLYLSYTVRQSAYIGVTFITDIGVRSDYQNAYARLGQNIVPCYRDS

SEQ ID NO: 945099 - protein, 152 aa, Homo sapiens
AGLFVRRSELHSLKVIAGECRRGVLARESPRSLQRGLLSLTVRFLLQHVSHGLLPAGACLDRGSIQSMLTHIRMHHPPTHAIVRLLMYKMGLRPDTAQLSGVSRCIFNLSCIVFFALYDLSNVCITAYAIIVSVMWLSIRKVQEPQVKANRH

SEQ ID NO: 945100 - protein, 79 aa, Homo sapiens
GCDLRLEQLYPRGMCVVTVGRDCGRRLEAVTADPNYHNPGLSICVAGLIDDLAASMSLCGLLPYNLLILYDADRTSLWT

SEQ ID NO: 945101 - protein, 103 aa, Homo sapiens
PIVADCYCHQKLLRQLIIISVSAELEQVPIFMTDTDIPMAGPGAVYNIRFPIQTSIFSPDTEERCLDVSHEAGGQLQGETISKNILSSAQSMETVIRSCLCTV

SEQ ID NO: 945102 - protein, 114 aa, Homo sapiens
MVAVTMNAGSHRPLLDELSASSPVDRLTFTLELNARHIMDNGNELFKPNRAGLTDVHDEHVAIVLIVEMQDDYCMTPEIAETRVYITCTSCYETIENDDAILNDTAGHFVVSGN

SEQ ID NO: 945103 - protein, 117 aa, Homo sapiens
VVEKSEARSTDRQACDLERRVWGLQHGCDHYHIIWSETLTLSTIHKTPFVENTKKLLRIDFLDPFFLSITGFPFLIPILESIKYLCVSKRSYQFFKKICKKDERSLEDTRTEWISFS

SEQ ID NO: 945104 - protein, 121 aa, Homo sapiens
MTEELVGHGRDNRRRQCGPTYGISITTSIRTVAPGPYEHELYWVKLKLAAIIHRCLCLRKQCRMHSLEDMTVTEIKEPLIYSFDWSIDRDTVSADALRERAHIAPQADGPIATCLLTCTLN

SEQ ID NO: 945105 - protein, 116 aa, Homo sapiens
ARGTAQNRRDQTRVRPHADFSEQTPTKEKLTIMRIAVFAFASLGITCAIPVKQADSGSSEGPILEAESSDPQNAVCSEETNDFKQETLSSECNGHDHMDDMDDEDDDDHVDRQDFI

SEQ ID NO: 945106 - protein, 131 aa, Homo sapiens
MEHYITSATAASLDDAMPAIATRLWTNAEYYAATEAWRRYGLVVRMSLPNQREGYVSRIGHVDYPGPLHVTLCTVNYSVIVGDTAGDCIDAQQYYEAQKVEITIPQRHVGAYDLATWNISNLDYMIIIEEC

SEQ ID NO: 945107 - protein, 130 aa, Homo sapiens
TSEDTVVAMCRRPARCYRYCESKPYPKCRFCRGVPDAARYRIFDLWRKKAWMNFRFVATWCQMNMNSCALKPWRLSEFVRNKYMVVIRINKMLACAGADRLQTGMPGPLGPKAAVARVHIGQVIMCIRTA

SEQ ID NO: 945108 - protein, 78 aa, Homo sapiens
VGGMLVRCVYDFEIMDSWPRQPMATLSGLRLSLLIKEDELRESIEIINTDHLGFLRVATLFSVVPGSQLETRWPGLYS

SEQ ID NO: 945109 - protein, 119 aa, Homo sapiens
MRSLSVLILMLNACLAVSADPVPTTPDIIQVHDNYNIYRIYEKWYNLDIGSTCPCLNKIMDMMTDSTLMLGEDATDAEISMTSTRCRIGVRNETGGAYETTDTDGKSLYHSHWILTMVL

SEQ ID NO: 945110 - protein, 107 aa, Homo sapiens
MAEDLIVTRSLSVMLSMLSACLAVSARPVPTTDDNIQVQATCAWLNNIMDRMTDNTLVLGEGATEAEISMTSTRWRKGVCKASGTYDTTDTDGKSHYPRSSWNISWS

SEQ ID NO: 945111 - protein, 126 aa, Homo sapiens
ADMLSDKELWALLEELERQEELLCELDSKPDTVIANGEDTTSSEEVYFFVIRMVQGYNHSEVKRIVSGTVSMNGSRSYHSDEDDDDDDDDDYHIDDHDGDNDHDALGVGESIPTLYFSHTGEPKRV

SEQ ID NO: 945112 - protein, 97 aa, Homo sapiens
RHYSQRCPAWTIWLLFCDGRGEGLRLLLRDTDRFFRHVGGTLGQFYQEVLWGSPAASDDRRRTLRVQGNDHSVTRERKLDYQEGPPGVENSCWSVEP

SEQ ID NO: 945113 - protein, 82 aa, Homo sapiens
LLVTCEIDLSVYEASMTHQDEKTLWSFNLLVRTVPITPTGAKLPHLHYKLPDEATSVLNLTYEQYMLKTSSIKANYYTQLIQ

SEQ ID NO: 945114 - protein, 229 aa, Homo sapiens
KYFDQLLPMSGHRLQKFCALLAFHYGKLCKGFYEIPYNLKRACQCISRCHTRALSMSSCAICEPLGPLLYQLCVWATIVGSLSGQLLQERAQSWDERLRTLMDEMASRILYCLDKVKHQVSDVLAYLEEQAQHIRVQAESFLDRLKIWFQPLVQNIQYQWAGLMQKVCFAVAPERSLCSVTIIDRPSLQPCDPSPSRASCLSAACIVETLSPPQRSSGVVPSLIKIHRV

SEQ ID NO: 945115 - protein, 98 aa, Homo sapiens
EDVIIEVNGVNVLHEPYEKVVDRIQSRGKNVTLLACGKKAYDYFQAKSLIVASLADPLDTLPDSKEGIEAESNHDSHMAERAHSTASHSSSNSEDTEM

SEQ ID NO: 945116 - protein, 173 aa, Homo sapiens
GGQDDGKRQQQDDHAGGEHLVLGSVSVASAGQLEQRRQLTDEVVQQAGRAQRPLSQERGLRNRVGEAACQEALASVRHRRGETSPAERSGRHTAAARSRAITARRTHSAEPRASDAHSWAVQWLGSRALVRQVGHTGGTNASNEARVYQGQVEEEVYIGLFKRSTRSTAANCR

SEQ ID NO: 945117 - protein, 156 aa, Homo sapiens
MIPVERACCCGRCAVEGPCMLNADLEDDQQGLCPWRLTGSQMEDYYQIFGLRKEYAMLLRFGPNRLNRLGHGRDALHELVAYQQMQPVMVVQASGNRSADFSLTLAGAGCRGWAQALRVCSATGLPLSGLPWRVCDQVDGAGPLEPSTQEQTSAFS

SEQ ID NO: 945118 - protein, 118 aa, Homo sapiens
MCSYVLSQELSLLGKLCHKLLAGANGHLPHSNQDVRAASRQRLTISRPVQGGALMWNCLDCWTVDAGACDSTQPVAMRAEPQGVDDVPTIYRVMLGYVESPEHDLTILAYRHRGIHPE

SEQ ID NO: 945119 - protein, 77 aa, Homo sapiens
QDSGRALNEYQGDAPYVPADIVAQLSSGGHHGSELSTSVSFPSFLLLESTTDGTTDLRRLVSIELTEMLMLWRPTKS

SEQ ID NO: 945120 - protein, 126 aa, Homo sapiens
ERGPAGMAVTDQAARKKERVLWLLDVDGTLTPARQIAVEGGSDYCQTAEQLTDGDEVIEKIDYVLAESVTVQDKHGRLLYKQTIQNHLGKELQEDLINYCLSYMALIRLPKKRDTYTELRNGMLLS

SEQ ID NO: 945121 - protein, 265 aa, Homo sapiens
MEAEDASACRPSLPDYTKAEEPIPMKSLGALLYLLNACTGGEQLALCQLLPDNIHVQENELSLRIYGKWYNLYIGCTCPWLRNIMDRMTENTLRCERALHTRNHHDQHSEEERRLKGSGLELTRKHILIEKSLYHTAKWDITMESYERHTTYDEYAIALTHILSRNHGPTITDKLYRRTLQMTVTLQDDYKLCAQSVNIPADYIFTMGRRGECVPEEHEPEPILTPRVRKAELPPDEEGSRREQLVTVFTGDTLQLGYHADPACD

SEQ ID NO: 945122 - protein, 126 aa, Homo sapiens
SLEDMLLPVNGLMVLYVDLSCFMGLKRLKLGQNGLRHLAAWTLAESLEELDLRVNRFSLAPDRDLGGPETSLRRLYVLRDPLKSCANDKLADQLDQGREDVDATHDLNWRFSCQYEVHLSHGRAEH

SEQ ID NO: 945123 - protein, 70 aa, Homo sapiens
ATQARDHGTCCTPAGQECEFRPLDPSGAAGRCAASESVHTRRAYLDSPGASAKHLDGMCLRTNFSLERVV

SEQ ID NO: 945124 - protein, 69 aa, Homo sapiens
PQSRGTMAPAERAGAKKVSFAPSILAELLAAGLLSDSVHTRRTFLDKPCGLGHLDRMVLSLNFSLSRVG

SEQ ID NO: 945125 - protein, 44 aa, Homo sapiens
MSTDPVTGRARGVGFALFKDAANDDTGYGTEQNTNWMALIVPGR

SEQ ID NO: 945126 - protein, 95 aa, Homo sapiens
FTADTHQSADIHRVNDITEDNLRVLQVNGWLMMFGDDDLKIMEQYCNMSTELAWTCCADELIMPLRQTHIDTPSGDLMHTSNFLEAYSAMADCCA

SEQ ID NO: 945127 - protein, 141 aa, Homo sapiens
MLRMKGDTTVILTNTWLDDRAERDGLAQLMCELKMHFDFLIESCQVGMVKPEPYIYKFLLDTLNASPSEDGYLDDISANLKPARDLGMVTILVQDTDTCLKELEKVTGIQLLNTPVTLPTFAIRDMSHGYLTVLTVRLHIV

SEQ ID NO: 945128 - protein, 122 aa, Homo sapiens
MRSSTEYQADELRRTKLNAESTAPVLFTGVVDARGERTVLALAGSMAGTSVDAYHLVTDRMRRTVKFLCALLRGIFNLSVDWLHQARKAAFYIPPDEYVVTDPEQEKNYGFAFDALSRALEL

SEQ ID NO: 945129 - protein, 127 aa, Homo sapiens
DGLASTGRSLGETHIVLYGDAEEPYRSVGELPSTVESLQKVHEHVYTLLSEDQAQADRVSPQDFLDRLSSLDNLEASVSQVEADLKMLKTDEDSIVAYSVKIETNENNLVSAKGLLDDLRNELDRCL

SEQ ID NO: 945130 - protein, 189 aa, Homo sapiens
AGNLRHVGEGSATVTKEETLVASIHTLGCVVTARALIQMPVTSEMSVLRLYQAPVDIISKKVATSHVHTLLILDQALADQVSPDDFLDRLFFLDDLEDLTNPVKADLEMLKTNDDSTVAYMVKQETKQDNPGIAEVLLDELTNELRMLIVTVANNDQMASTYCECRALLFKPNFYRPLQREFYQTNTKA

SEQ ID NO: 945131 - protein, 182 aa, Homo sapiens
NIKNRIDASVLLAEASLARKQRKTHTTFIPLMLNEMPQIGDLEGLDAELVTLNEDEAELRCDGTKSTIKPCQMSVARITCVRSQRPNEGIPCIDDYIYTHEQVVDYLTQYSGIEPGDLDAFYYMHLTTLKCTYWELHILIDIGVQHVGHGLQKDLPDINRMVPKDQWLDTDYLFHMPQRGNP

SEQ ID NO: 945132 - protein, 91 aa, Homo sapiens
MAVALILAYLSLTGRLSRYLWQHEELPQSPWYRAKDLVNVIEDVLTDTGMDYADHIEGVLLVLTAELYSYLTTGTVSSTFSQLRLQIDHVT

SEQ ID NO: 945133 - protein, 95 aa, Homo sapiens
PRELACRVQLLSLDSIEATESYDTCYPGIPRQLQVRPPLLLCALIALAAYLAHSRQQILYNVYANTGCTVLNTNYECDILISTRTDMYRRMIVTR

SEQ ID NO: 945134 - protein, 165 aa, Homo sapiens
MSLLMSQLIMETDHCVPFWATNDALLQLFVNAYGEVADCCANHDPERYDCLLHHKDDNPILPLLMRPEVDVMGTASHDDEETSKYYLYEAARRHPYYYAPELLFSAKRYTAAFTECCQAADEAACLLTKLDDLPDERNASSAKLYSSAPVSKHLEELSQRGQELC

SEQ ID NO: 945135 - protein, 91 aa, Homo sapiens
MAWISSKRALTTGVLLMAPGQLYVIVKGNVKLTSDVPILNSRCDLISDPITSHPNSLLHLSSPLRTTAPLYTDRACLWCYALNRLIARALC

SEQ ID NO: 945136 - protein, 59 aa, Homo sapiens
MRREHRHELLGRDLLQIGRHVSNWRSMIWYMTESSISSMIFTESVYTLHLMVESTDDTL

SEQ ID NO: 945137 - protein, 115 aa, Homo sapiens
LELDGEFRTDVAGYIRYLRPGYSVLSHYGHEDSRPDLGGDYRSVEKLYLADPMKARSILRDRHTDGNLSVSRSDEKYVLMIQPDDAEDDKKTDMFHSHVRRLMVAKAARNETMAE

SEQ ID NO: 945138 - protein, 119 aa, Homo sapiens
MYWTQISFYHLARLLDEQNHERYMSEYTEGEFDSEEFRFTVRWIYSQYTRSLILIDCLRHVGTEMVRYACSETRFYDFMNLETDVRDVLSLYRVLDSIGLDRSLDPHFREDPGPWLFPL

SEQ ID NO: 945139 - protein, 81 aa, Homo sapiens
RLVHAWFQGDVLLTSLPLVRLCMSESRARIEHDELTCMSVEMKMRPDTYYDGMFGELIATTDDVHRDDTTQQASHSCVTVP

SEQ ID NO: 945140 - protein, 109 aa, Homo sapiens
VFNLNPVKIDFRAQRKAPQAFVSSVRQGSIFGLKVLLSSIKCSLWWSTKVVGLHQNPGEGHYFSCRPRSGVKAFHITPGTYSRPSGIVYSRSLGFFVPPYVSLLIKSVL

SEQ ID NO: 945141 - protein, 255 aa, Homo sapiens
RHEGDCAISARWGPWIVSLPARRNAVHGPKGHGGGGAEPAGPTLSPSTESPESPLSRIWTYRAGSQGYKAGAEEDFAGTGNFLPAGEAAARGFCGLGLKLQELEQEDGEPFLAVMEKRLFEYLSQMEKALPTPQAQQLHDVLRWKQPGVSITSSLAWRQYEVDMGWMLPERNVTDSENLGEPMEQKPPQQQRLGLHNPLPKAKPWHTSASGTIFKDAPRTSSWPRLLAPLGRRRAQGQWGSTRGGPERPTAAVSY

SEQ ID NO: 945142 - protein, 114 aa, Homo sapiens
QHEIARNWASQRSALGSALDPLADYSPVSIYVSKTYAYLIPVALTYMIISRDVTMIADVNYARYRTMPTPRTLAKYINPCYATARLTSLAAPVVYADSIYLQILRRYTALHRMP

SEQ ID NO: 945143 - protein, 108 aa, Homo sapiens
FEAALGSYENTHICGGCTGDNSYGHEEYVGCCFCGTGNALFLNDLVSRDLNGYTYCRLSILMTYTCANFSKESTVHDHTTSITGAMTGTLSDALAISSDKWADGGLTA

SEQ ID NO: 945144 - protein, 94 aa, Homo sapiens
DENAEQFFRDQGRQTSSLQPASPDSVYNLMLQLVNNRYQGPSLIPRNPPCAPSTRRRVILSVPDHVPTGSGPPSKTYRSPMPMPLQVVTHTPYP

SEQ ID NO: 945145 - protein, 65 aa, Homo sapiens
MESYKVLDLHFVLFSQLTGMLGTSSLRTVATNSPAGIADIQRRDRLIAIGGVVLVYYERPVVLSS

SEQ ID NO: 945146 - protein, 170 aa, Homo sapiens
TPGCTNLAREQSTRDYNGHCEPSTDVRIKERGKNVKGAWEILTRLCTEFENYVADIEVDGKRVERALWDTGCQEENERLRALFYPDTGRILRRVSIYRPERLENISRWSPQGKDLCANVPINLCGNKKELQNDEHTKRELAQMKHEPVEPEKGADMARWRSWGHGVVTTA

SEQ ID NO: 945147 - protein, 186 aa, Homo sapiens
HESNQHVIITLTVNPAHTCSYGEGKKSERDLGNITPAGTVFENYVADIEVDGKPVEVALWDTGVQEENERLRALFYPDTEGILGGFSIDRPDMVRKHSRWTPQVKRFCANGAIYSGWEYKKEIRNDEHTRRELSQMKHEPRKPRKGGDMANRNGAFVYTECVTQTTNRVREVFVATRDALKLYTVE

SEQ ID NO: 945148 - protein, 63 aa, Homo sapiens
EYMRARMVTLTEREVTGDTGEYLETPGAIARAFSPRTRLLEYTYPKSARTRFYYLRGPPQRIF

SEQ ID NO: 945149 - protein, 121 aa, Homo sapiens
MATEPARETELERRATDFLATEGADTFCCSTVYVRLTCQRCRESVLDSSCKIMDCWIIHELTDSLLTTLQAEPAMNQDEETEYREKLQMVTPSQEDVVRSLMLPGGQMSTHSADSYSLNGG

SEQ ID NO: 945150 - protein, 117 aa, Homo sapiens
STDRPHLVIGTHFLSPAHVMKLLEAIPSQYSSPTTIATAMNLSEKINNDWSRCRQLFRICGESNVESLLQSGIFACRRRQLTIGGRSGAGRARILGPCTVPDLAALDVDCALNMELG

SEQ ID NO: 945151 - protein, 112 aa, Homo sapiens
GPGALHLYTLARYSEARPVDSCVGSQHSVRPRALELHTAYPIAHDVNLNLQADWTTSLPCPENGHKGFLGYDGPEALGGVYIPGRLDKGELSLHPGRLSHGTRTGVLPCPNT

SEQ ID NO: 945152 - protein, 154 aa, Homo sapiens
AVGILHERSHNLYKITPNLCEIAFRLYTPDDDTQCNSANIFFSPVSIGTGFGKVSLGNKGDTHKEILEGPNFNLTENPEAQNHERFQELLHIPKQADRQVQVSTGNGLFLNEGPKLVDKFLEEGEVDHSEDFTVNSGDTEEGQKQINAFAEGTR

SEQ ID NO: 945153 - protein, 138 aa, Homo sapiens
KSCHTALGRGFAWDILKANFTETYLSHVNLLRKQGPISARAAVPLVLDGNGLYCSCVNCVQSEADFTLNQYFGYQGAYKCLQDDAVDEAYGKHKTIFENLAKADRDQYELLCLDNTLKPVDEYKDWHLCQVPSHTVVA

SEQ ID NO: 945154 - protein, 63 aa, Homo sapiens
MWCLVTEEKAFGRTRSAHPLRVLWKHGPDEEVTLPEGDSLKGSGTRSLSRNDWFTVLVIDPLW

SEQ ID NO: 945155 - protein, 140 aa, Homo sapiens
HEAAQTAREELDNRKVEKILSRIPLLPPLRNDTHESCGSSAYDNSYCEPQLQILCWGEKSGTFPYNAFPVLSGPMAVANPKVLNLCLLWLAIEHHKNLVTREGHFPKIIGYGGDDYEGISYSFYVFTTGRGDNTSVYYMR

SEQ ID NO: 945156 - protein, 119 aa, Homo sapiens
MTTRNGLCPLRGPETLDKFLEEGKKVYHSKTFTVNFGDTEEGQKQINDYLEKGTQEDGDLVKELDRNTSFGLVKYIFFEGERERTFEVQDTEEEDFHMDQVTTVKVAIKRLSMCNIHLW

SEQ ID NO: 945157 - protein, 82 aa, Homo sapiens
RKYPKCELQLLWRAQETYEKWAANVCEHSEAKRMRLCRRHIYIAVLNHVCVVHERQEVKESPNAATESLVNRRHMLFNSGSR

SEQ ID NO: 945158 - protein, 105 aa, Homo sapiens
CRNSARGHLYSTFVEPYDRHLLSNSVAVGTLDAIGVWWNTTFFYYGRDRSPLGGAGAMLPTGGEGYRYGPESELSQAFATTPNSLYEMGRYEPEQYVDRARDSTF

SEQ ID NO: 945159 - protein, 104 aa, Homo sapiens
MCILIGENDTFGAETKKNCDLDENIEKGLLDRAFNVLLIQHRCLQIPVWRHPLSNPPELEESDTLGVRRAAQRPLKAELRISLEEGPPQEINYLTRIHYAQSGF

SEQ ID NO: 945160 - protein, 140 aa, Homo sapiens
AREREMLLSVLFDTCIMCKTMWHCVSTICVCGGTEGFIFSSGTLYLARTEGEELSHHNKKPGKNFKGHKNQVNWLWMCTERNVLVLRFHNKNARLWEVQRKQWIRTRGLSEFKARLAVCHFNKDLVGAEHRDPRHGGFLW

SEQ ID NO: 945161 - protein, 36 aa, Homo sapiens
MTYFNAITISANKYVTTTDLTFLPLLLLNRNANLWC

SEQ ID NO: 945162 - protein, 68 aa, Homo sapiens
MDTREKVSTNAISGAKAIPTERFEAEMTFRGLPRWSKGLGLYTPCQSGITCGPPQDGVRQLFIASVSV

SEQ ID NO: 945163 - protein, 30 aa, Homo sapiens
MRVSVLICLEASVRAAIAPPTLGGTSDLIG

SEQ ID NO: 945164 - protein, 123 aa, Homo sapiens
MTYSRMSFPSYHLQGRECSHLEQTVTCARMLAYITCFVSSDRIRHGSEPIYPTSEQTVILMQVLDEVTASYHQFVEHQDIAELWCSLHMLDAHLTDQGASVVYAVMPDGLWVLSPAFELASRR

SEQ ID NO: 945165 - protein, 134 aa, Homo sapiens
MLSTLQVTYCGGLELRRACRYSETVCEYDEKTYSRMSLSSYHMEERECSHWEQTVHWPPMVACLPSIVSYDRMRHSLSLSTHAIAAALCLQVLDEVIRSEHLIVAHRTLLSCGIAFTAEPHSRHGAVYMLIQIA

SEQ ID NO: 945166 - protein, 110 aa, Homo sapiens
RQLASAFRGNIRCTYMARLRVRADICHAQHSIFAVQVSLEGLCAIINIALEDILDTETGLRNRWLFFFFFNCKHISFNDFTSLVPKCSKGCLRFVCSWNFWSPKVSICRN

SEQ ID NO: 945167 - protein, 121 aa, Homo sapiens
MLWLPTDFRQMRPLSRVLAPHLTRAYAKDVKFGADARALMLQGVDLIADAVVGTMAPKGRTVIIEQSWGTSKVTKDGVTVAKSIDLKDKYTLELNLFKMVPITQMKKLCDALPMLLYWHAL

SEQ ID NO: 945168 - protein, 138 aa, Homo sapiens
SALYEKALQTLHEASEMTQIMWPAGMLTCSEDTLTVGTADHCDGFTFAGYTPRVISIGGLAPMLSDTDKKSFTDILYGTGPGYKVVDSERENVCMVDYAHTNYQAQSAEPLRHETHGAEDVRRCSGPMAHLLHGMHER

SEQ ID NO: 945169 - protein, 149 aa, Homo sapiens
MTLTRLYSLLLTLLGYQYQPGQELTTLREPLLHKAVPSCDQLRTSGCSVAMPRYTVHVRGVWMAMAVQDAQVNVDMLGTDAYRRYIKNKLCNSRYTFRGDSHFHVPRSKGMGLWSTEDRVLMAYHPVRRFVMTVMQGYCFIHLTGGFLS

SEQ ID NO: 945170 - protein, 88 aa, Homo sapiens
LEFCTRTAVCTQEKSSLCSWELYKNTLWRCSCVERRANTCGAGHGSAQAQSLNGLVHPELSPSGELCLPALEQFGTVVEGQLVTRRGL

SEQ ID NO: 945171 - protein, 91 aa, Homo sapiens
HEKRFTHRGVISRLILRSWQNQMAERILWLCELGPTGYIILFHRKNTWAKRGHGTEAIPITKYLYTVSEIISRGYKICVSYLIPVKPLRVV

SEQ ID NO: 945172 - protein, 94 aa, Homo sapiens
PLRTSRLSEYLMEDKMEVDVQYVHMSLWVYETIDDYIVRCRYSWCKSMLTNCYEHDSALTLHQADYTRSWDADAYSPYQAYALFTAVACIIWLR

SEQ ID NO: 945173 - protein, 31 aa, Homo sapiens
MRDLRRPAYSGEPSLHLLTLPYPIDMQIDSV

SEQ ID NO: 945174 - protein, 100 aa, Homo sapiens
MRRLLLKLAAVALIAGLQASAHRLRFLTCAECVNNSSKSTHLRGYIRLHFGERPFSCEEFEPRFYQSSHLAAHLDHHAPDRTFAGPDCGGLSRCPRCGVF

SEQ ID NO: 945175 - protein, 95 aa, Homo sapiens
MEKAISETGVTTVYLFTSEMYTYGAETDRDGADCTDGPTDELFGPTGELAGLSVAVTMSKLTYGGIDQLVSRTDLLLPDTKHAQLSETMRRGEDA

SEQ ID NO: 945176 - protein, 112 aa, Homo sapiens
GTRVPFFPLSYATGLLWGIFIFFLPTVHTDLILPNVDKFLCPHIGLPTIGSFIHFFSGVRFDLSEAYTRLWVLLCDLLTRGSESPESLLVQGFKFYPRPTGLASGGGTPALF

SEQ ID NO: 945177 - protein, 45 aa, Homo sapiens
MSAESMYACPHAVRALMVVIRINQMFPVLGLTGSTGMRGAFGPPA

SEQ ID NO: 945178 - protein, 128 aa, Homo sapiens
QTLIGTQSTDIPAPTELKFTQVTPTRLSAQWTHTQWSDHWISSARDPQGEDRANGRESTLVLTGHTRVYQDFMVATYEVSVYALKDTLTRRPAQGGVTTLENVRPPRRARVTDASVTTITIWWRTDWD

SEQ ID NO: 945179 - protein, 121 aa, Homo sapiens
GRVSLIILLTDGDPTVGETNPRSIQNIVREAVCGRYRLFCLGFGFYRSYAFLEKLCLDNGGLARRIHERLKTLACRFRTLPGSGNPLLTARSFEYPRNAGEEGTLNISGFSFRGFHEAGPP

SEQ ID NO: 945180 - protein, 109 aa, Homo sapiens
RAVFRILQASAAHVGSGSLVDRITDLSVQMCFLWVSNKLTLDKLDVKGKRVGMRGDFNVSYGEQPGYNNQRIKGGVPSIRADGVPMPDKDSLEPDAVELSLLCKVVCVW

SEQ ID NO: 945181 - protein, 116 aa, Homo sapiens
TQLTMRAQRMNTASELELLELVTVETRQAAYFRQRSLESTHTMALLHEEPVIALPMPGVGPSHVSGGECYSSLTEDPLVRPDYDSMVDEICRKVAGSLDGALPDPRWPSEALDSPL

SEQ ID NO: 945182 - protein, 34 aa, Homo sapiens
MDCPNRLGPYTVHTMASSILTEGPHVLTLAYTAP

SEQ ID NO: 945183 - protein, 71 aa, Homo sapiens
MVTNTIDENLPLWTVQFMMDYVSAWLYPTGYILANIVHTITLTDSAEYVLEEAYMLFMRMQQLHAANADSG

SEQ ID NO: 945184 - protein, 104 aa, Homo sapiens
EPCTSASMGEVLVLCRIAEIGGSGGGLMYGVERSAGCGENEPVEILVAEGREPPMVCREDVQGDVGVEATIGGASDGASVMVSSCRGAGFNSRGLAVLMRMLLP

SEQ ID NO: 945185 - protein, 154 aa, Homo sapiens
MDTPINCLLAPPLMFSSQQCTDGYEWDPVRQPCIDIDECDIVPDACEGGMKCVNHYGGYLCLSAERTSGATTAVVAVSSMATSVVFPGGVFVGSAAAVAGPVHTGPDNFVIRRNPADPQRIPCNPFHRIQSASRLLAKCTPRATTYTSALQGPT

SEQ ID NO: 945186 - protein, 118 aa, Homo sapiens
KEFRTNDKTVPGRIGATAGGSPRSCMLSFPSFLLVPFLFTLLFLSFFSFFPFSSFPFSPSSFPRSSIHCPRPHHFPFALHSPWFLSYSGSFPLCFLFLYSLSLSFSSLSPLTSHFSFI

SEQ ID NO: 945187 - protein, 119 aa, Homo sapiens
PRTGLADGMDTVLLICKMYITKLRLKDRQQLSKLIITQLLYDRYMSIAKGLITELKPQSECAHSEQFLHLIRLGRVGTHIHTSHGEECLAQVTTCYAADRHTMHSEAIEYACYVTSHVG

SEQ ID NO: 945188 - protein, 108 aa, Homo sapiens
MSEHGSETHYRSNTYSVEMDAQPEYLTERPDSDYRLCSTTLIGKGLYIGMSHGLEKEPDMNALRMWTDFNEAYTSKTKSQHYRSIEHAELNDDGLSVSAVHLRYCYAD

SEQ ID NO: 945189 - protein, 95 aa, Homo sapiens
PRPAPADGMATVLLISKTYITKKRLKDRQQLSKLIITQLLYDRYMRISEGPINEIKPETECAHSEQTLHIITLEESVNTNPYCPCGGMANDDTIL

SEQ ID NO: 945190 - protein, 139 aa, Homo sapiens
QTQESILQPLLPQTQESILQPLLPQTQWSILQPLLPQTQESGPQPLLPRTQESGPQPLLPQTQESRPPTPSPSDPGVQAPAPPPSDPGVRTPSPFSLRPRSPGPGPSSLRPRSPGPQPLHPQIFWNLGPGTVAHACIPA

SEQ ID NO: 945191 - protein, 70 aa, Homo sapiens
PVGERADKARRAPATYCLKMGDLIRTALHCFNGIILNCIYQRPLHRRLTTMCTDGNEVQEVRQGQRYLIR

SEQ ID NO: 945192 - protein, 233 aa, Homo sapiens
AAGIRHEERERERERERERERERERERERDRESCYRYWNCRFGLSLITMSTSHMHLVFVAVPMGAKPVRSLAGIGEVLSMKLEECGFDMAYLVLGLFLVLKKDLYLFRVWLTDTCGANAKQSWFCFLMPLRVVLRLLVMLSGKLSIPSPHSEFAARLGLLPFSLRRLLLFSYSPSSYFGVFLEFSSLTIFTFFFDFCFFMPFPVLFPLSIFLCARFPPILDWIPRPFPSPLLF

SEQ ID NO: 945193 - protein, 216 aa, Homo sapiens
PDVEHDLKHCQYDTEKGLAAGYKGLNDHHVYLAGTLLNANMATAGHACTKKYTPEQVAIDTVTAIHQTESEAVRCDMMLERWHERRGCHYEPECKQTVHCSIVLETKHVLWTEPARQCTGCKTGLAANKDATHEAVMKLANAILHAARGHDDYTGIVGLVFIQYVVTAWYTYYGPNAIAIAERLMGRLQRHTFLLFSKFHTIDFYCWKSTPVIEVR

SEQ ID NO: 945194 - protein, 56 aa, Homo sapiens
MSTINITNKCVLSLHRYDNTGTPLITPAIMTLDHTMVYLHTSRDQPPTSILPQDRP

SEQ ID NO: 945195 - protein, 76 aa, Homo sapiens
DIQNYAIEAYILRVRYIGGCCGFEPYHIMAIAEELVPERRFVPPASDMAAGEVVWTCTPHPELEQGPGTNTGRIFR

SEQ ID NO: 945196 - protein, 98 aa, Homo sapiens
RLPTRVAEAYGCEPRTPANMALRVVRERAVPALHPAREPVTRRALPAEVMADEGGRRASTAHWNSSDLGGQFTENHEWGSTEHDIATVLMSNFAQEAM

SEQ ID NO: 945197 - protein, 102 aa, Homo sapiens
MAALLLRHVGRHCLRAHFSPQLCIRNAVPLGTTAKEEMARVWNKNIGSRALAAHITIYSWSLTMAMSICHRGTGIAVSADVGPTYCDGLYGAGSHVKRRLPG

SEQ ID NO: 945198 - protein, 112 aa, Homo sapiens
QKRRSRQGTWTCAREVMEALTVLAATTTDHGRHRKAASAAATDDPAAEWSCAGLLDIGQATDSEEECHFYAAGQVHTREASKRSIDDHFLHLSNAKISKTEPYWEGTAESAG

SEQ ID NO: 945199 - protein, 65 aa, Homo sapiens
MVTAGADELIDTNVTVNMILSVKEMHDTGIDELHLNRINMETVCLTSSPECLLHAVTIYGDYDHP

SEQ ID NO: 945200 - protein, 199 aa, Homo sapiens
KTPQKEAKKSSKKRNRKHSGDDSFDEVQQCQSLMSDVMRAGQADGGERMEADRSAQWRQEKPKDEDMGEAQGRRGLELKPRRAKKLSLFMRNIAPNITRAEIISLVVPGLERVALSEPQDREEVKRRGVGELRAVIVNILEFCRKHVEEYRVRECELSAGVNMGYEQGAFETLRGMCHVLIVRIDNKLDDKLYRTSMCW

SEQ ID NO: 945201 - protein, 88 aa, Homo sapiens
GRTLYAVSVRLSCCVIIVTEWETASPEIVHYRYLNLYDKWSTGDAHITVVDIEITWLFRVCMPDCCLSIDPNLAADAIIAISEALRGK

SEQ ID NO: 945202 - protein, 66 aa, Homo sapiens
DIQRKTLWHSVLLTPRLGSECVAGLSQTLHATLAAIGSEDSRWGQMLPLDKIGASPALTCCSDSGD

SEQ ID NO: 945203 - protein, 114 aa, Homo sapiens
MLVATGTPAYCVGPCAVGIECYDAMLLNIISNMTEQLMIPETSAESYMRDSVIDGQLPGALRITCLLIIPDYTMIYGQCKTVRHHCRQPDITGGTADMSIPTHYILLTNQLYLV

SEQ ID NO: 945204 - protein, 141 aa, Homo sapiens
MTLRTHCAPYGCKYTHCATRAPSALIPMEAVMRPREEIGYLTCIDSVTQSTEAPDYLTTADADSKAAQHCQCIELTDIYAKCEHALVQTSQCLTCDYWMMRYVPDDKGIGRGDSVLVYGTTCDETATCKRSARVALLAYDS

SEQ ID NO: 945205 - protein, 68 aa, Homo sapiens
MRIAQGHGFSPSGSEDQKISLWTHVAHTFCYRKRHSSAGLWAKSNGDSLDCALTFWLALGGAPRGGAG

SEQ ID NO: 945206 - protein, 68 aa, Homo sapiens
RGVPRIRDNSCNPNSGYWDIENTALIRPCRRYSSGEIFHTGTLRRRPFILDEALGHKLSKIKIYPIPV

SEQ ID NO: 945207 - protein, 105 aa, Homo sapiens
MSTEYHMVSVVFTVEHWTVRCLQLKPLVGVVEKRVQITYAVHTEEHQACVVYNRPRFGWSLLEKQLILSYVYCCNRPKYCQCDDVLNNVGQIYNNRIDRGYLSMR

SEQ ID NO: 945208 - protein, 30 aa, Homo sapiens
MWPNPAVGFYRVGSPRSVIKRMLCRTSSPK

SEQ ID NO: 945209 - protein, 136 aa, Homo sapiens
MAATYAMRRLCMIEAVMLLIGPIRMGRRLNICTIDRHRLMHPNRSAQLQYESSAVHVQLAFHKAKPTDYSRNMVCLKTSLHFKTSSDRGYLRDAHKEKEEKVEGDPGTQATYSEMNNNKLGRGYDDETEITVEFLT

SEQ ID NO: 945210 - protein, 115 aa, Homo sapiens
MQAMLVRGASDNSTCGKSARDIAIQSGGAQQANDKNGSLSDTLSQWYPVALNVQYMYLINPSTALFVSRGGQVSARYVSACPKKLNSKCQVNDANDPFNLPKKRIILCGPLWPTS

SEQ ID NO: 945211 - protein, 76 aa, Homo sapiens
MLQALTPRSNCYSHELSCTGLGYMVSCWVSVYTFTDYYMAECNDPLAHRRCSAESLSALTTTDTDYMELTSLRSED

SEQ ID NO: 945212 - protein, 122 aa, Homo sapiens
MIETGWAFLYPDDSYHTVNYEMLTVEHEADELVAHNSEVFETFTEIHIQSAILVRDHVKVPLVNTLIYEPVLTGLNSIGLLMEVSGEDDGMALCRDHRLAVLSKCLDIWIMFLVILKTLLVS

SEQ ID NO: 945213 - protein, 94 aa, Homo sapiens
MSDHDPIMYGELGGGIVTIHQDARLDVDDSHGLTLAMVYTSTPKYSYCYIAECEVTPQTTTAMVGTIRTALKLFEQSKRCLEEHACTKPGTLVS

SEQ ID NO: 945214 - protein, 154 aa, Homo sapiens
MALQQAQKTLSMNRLYAMADVQQNNTEIFAVALCHLAELHAEQGCFAAHSEVFKHLKERFPPNSQHAQIWMLCDQYSCDRAMNDGTYHLADSLVTGITALNLIEGGYWTAVVLQAQNPMSEAHKLLHTVRGRGELAIFLPTNALPMLLQVWPLR

SEQ ID NO: 945215 - protein, 72 aa, Homo sapiens
QEFGTERDMFTGGCACMELGVQRATVFVSCVLQSSESSLDPVINTCFHGINDREKALVSPEALETQLPLSKV

SEQ ID NO: 945216 - protein, 42 aa, Homo sapiens
TIHYMQKSRLVMDPDSETDVYTHSSLTLENIALRIIRRAICA

SEQ ID NO: 945217 - protein, 133 aa, Homo sapiens
QKDCGGTDKTNQCPQAFFSCVKRRPQGVDFLKGPRKENLVTPSIRENKLEKGMDKVQLITISVLECRGQAPVTVIVGSSLAYGVLWVMTGKEPVHDIKGGKVGLKTEYLQEAQQAAAKKYNNHVRQQLAQVKT

SEQ ID NO: 945218 - protein, 122 aa, Homo sapiens
MNHFMDILLLHTLLMRYSLKLLNKHCTSTSRESFTVERDLITLSSDAHKILTPYQYVILKTKQDNQDIHKHGMEDTAHRCIVTEYQEIITSWENCENRVDIYSYVYKENAEILDAPISVDTA

SEQ ID NO: 945219 - protein, 228 aa, Homo sapiens
LQEFGTSWYVLNRDPEAGCLRMDYRQCTDERSVRDQLMGPLNAGTVPADTDVGCSAPTAYIDSARHTLDPKIAVAAQNCYKVTNGAFTVEISPGMIKDCGATWMVLGHSERRHVFVESDELIGQKVAHAMTEGLGVIVCIEEKLDEWQAGITEKVDLELTVIVDNVNDCSKVVWPMSLCGPLVLARLQHPQQAQEVHEKLRRWLKSIVIYAAAYSTRLFIGVCYWGTW

SEQ ID NO: 945220 - protein, 99 aa, Homo sapiens
MCIIFFKSEPLPVFTFKVADFWGNNNEILNGLDMEEGEGGSTWVCIENTVEGVRTYQLPVKQLDCEAREASTGGDVICYYGNRGEPEPIEFDTRVEPVI

SEQ ID NO: 945221 - protein, 81 aa, Homo sapiens
KRATPIRYIPQVNTPLLLMLAQKNRCVPFKQGMEYHRALKTRNVPVRLLLYPKSTQALSKVKVKSDSFINCVLGQRTHLGS

SEQ ID NO: 945222 - protein, 64 aa, Homo sapiens
IISNEHCSAQRDLALSLSICAIDLQNRAKPDDLPSVTQDLLETLFDQDYREGITHECGPYTVWV

SEQ ID NO: 945223 - protein, 102 aa, Homo sapiens
MLVRLTGSVEVKPLNDGSRVVTTFGEHMIIIRHEWIYSVWSRVVYTSLSLYSASVSTLRIRFYNTSRSDVKATNCWNKPKWAPCDFTKVIELWAHTKEVGVM

SEQ ID NO: 945224 - protein, 155 aa, Homo sapiens
MPEDEYTGYDKGQEIQAQTKGNPEQTPVLKPEEEAPVPEVGASKPEGRDSKAETPYSGRPQSPERRSVCTGKAFDTLTELKNGSLFGFREADSDELDEKAMRPRDPKLIRDSWGIKGPIDADFNRINCEGKTYLFGSQYSGSEDGAPGPDYPRVS

SEQ ID NO: 945225 - protein, 85 aa, Homo sapiens
TRPTKRAEDLSKYKCENVCSPMQIPRQYKIPDWFLHTQKIVKVGKSSRVQANGLDNKLRRALGVQGQHPKTIGPRARPVGVSKKK

SEQ ID NO: 945226 - protein, 47 aa, Homo sapiens
MTQYFAKKLLVEATNLTGELKVADRDGTLHDLKMCIQIGLNAPVNGR

SEQ ID NO: 945227 - protein, 126 aa, Homo sapiens
VVLTAGPGVASTGQDRWAAPLSPTFREPRVLTPLWSEEHCFTHPYPWSFRTVTLPVQVDARRCIPDHTSPLIIFTARRRADRGRIPALVQIRYRDHTFIACEMLAFACESRQYWAEQGLKAVKALV

SEQ ID NO: 945228 - protein, 91 aa, Homo sapiens
CTRLYCGRMRASVELHLVVVGTVPPDPSSLDLLLFAGPFGLLWDKTPHVSLEVIPNWLCPLLSTLGPLALRMRATNTPHINLNLNWALAIP

SEQ ID NO: 945229 - protein, 172 aa, Homo sapiens
MRTRSLFISTLCPGAVCGLMLVIPALCEAQGPGAPPCLPYVHDVSPNLQSDRTICPPCPQNVHKGSLGYTRRIRFLPTIPTLAQSDWCEAPAVLCVQYYQGPLDKAELFITYWKSVHRYTLRRATFRKYDLNLSLLLKLASAKTIRALAQRDQDRRTARCCETQGHDGHYGA

SEQ ID NO: 945230 - protein, 74 aa, Homo sapiens
GPSGLQLYAITYYSVERSVDRCLTSQHLARSTALEHYQILHYAQDVNLDNQAHLTNLTHVPTGHRRFIGYDRWI

SEQ ID NO: 945231 - protein, 119 aa, Homo sapiens
MGKKSTHWYVMTDVAHEHECICSSGTDLAGSENPLWADTGPCMTCVGGIGPDTRKGVSSTEETHSLAQPLSLHGKYRYSFSHAKLTRTRCVMRIHKNGCRFLESQYPDRLDCMYKALFC

SEQ ID NO: 945232 - protein, 202 aa, Homo sapiens
VTTSTHFPVSTESQEPRWRLYSSLSCRDTICDASSMTIRALAACKAVTLDHLHETQRSAEYALDAQAWIFHLERDVQDSLELFQTCAVLVLRELLTSSMWTDPDFLWDIITAAIDDIMKQLISATIDGEISLTYSMYIYLKQFNTAHDQRHNALNLNRLDLDLYNAAEDPLLDGDYGMVTAVHKISVEFSPARTHSDILTTH

SEQ ID NO: 945233 - protein, 95 aa, Homo sapiens
CDAEQADPPATVPRLVPSVDSPDPFAGTQPMPILQPFTEFFKKKPWSRYWPFTGPPLKIFFKSFKGKKKFPPGFFKNLGKNPRKFFLKNLGVWKL

SEQ ID NO: 945234 - protein, 71 aa, Homo sapiens
TGLNQVKPQVLLSPLNTTEVIVRVDNFFKRHPGKVSLITTLVKHSHVLSIGTVSTKVVFERFSIKEACGIC

SEQ ID NO: 945235 - protein, 71 aa, Homo sapiens
SYMRDTVVIVQLPVALQISCVLITPQWTRIYTALEDILHQGEKHKHQKSNTLIKAIQLTYNPEESSKPNMI

SEQ ID NO: 945236 - protein, 142 aa, Homo sapiens
LHESSFISHSSPQPHIQNTLAKLWGKKRKVPYKKERKRTAHISKHNGGHFRVIPKNPPRGDSKSLRRDKCEPVQVSMRDNSLICFAWYNTVVGGFPVGHRQPCDQNICVALTLWAEPGLLASFLGTHHILHRPSVFTPITVW

SEQ ID NO: 945237 - protein, 145 aa, Homo sapiens
MSPLKGREKIEEHVINLCPQVAERENVIWVCHIFAFFNDTFVHVTDLSGKETIWRVTVGMKVKADREESSPYAVMLAVQEVGHKCKELGITALYIKLRATGGMTQTPGTGAQSGLRDLVRSGMKIARIEDVTPISSVRTLRGGAP

SEQ ID NO: 945238 - protein, 143 aa, Homo sapiens
HTYSPGQSTSYTDLKSLFWTRTHSLWQTQFLYTLCQSPSASLSKVHGPLHNISNFSCAIFWIYTGNLYIAFGSDIFNPHYRIPLPKHKRQSLRSCCDTVSHTFRENNSWWNTALHDCDHRMAEMELGKRHTHILFLSGYFYSA

SEQ ID NO: 945239 - protein, 139 aa, Homo sapiens
ADILTERAYRMEKLPRSYKNICLGFKTPKEAIEGTYIDRTCPFSDTVFISGRILCGGVTKMKMQRTIVIRRDYLHYILMYDRFRSCHKNMSVHLSDCFKDVQIGDIVTLAECTTLSTTVRFNVLKVTNAAGTTKQFQKF

SEQ ID NO: 945240 - protein, 169 aa, Homo sapiens
MDRNAFGNSLERKWHSDALLTGCRLMADNVNLSGDYEAQSGYWLTPSLSPVSLSQKTMDDEMKAIGLWEDTHSLCWVTEVLTNATSHNIKCHIENPLPHYVCSTSTNYADIVGELEEVTGYQLAGEVTTITLNCPYGYDVAPGDGLTSKTARTKLDFENVSSLYDQRLP

SEQ ID NO: 945241 - protein, 39 aa, Homo sapiens
MRPDTNGYLQFVSQTLSGLGRSLLDSNLSDTPPVASMES

SEQ ID NO: 945242 - protein, 168 aa, Homo sapiens
KKLEAFLLIIWAVNVTWPNCSEGYCVSPKTRGLFIRGPRTRQGYVIFKRRVCKEIFYENIGALKNLPLTSQVRVHTPALTVFGFGSFALYAKGPCPPENLQKQNDYKVLLPFLCWPSQVQVYLTWPLNNFITDWTFAVQMFFTRGIISGSCDLQVVLSSIFLYLTFLR

SEQ ID NO: 945243 - protein, 116 aa, Homo sapiens
NLKPEVAEFYGTGLQMNQLRGRTSCHTHLGGYAGWNILKAYFTETYLSHVNLLRQSPISSRAVVPSVPMARTSASCVNCVQSVAATPLTNYFRYLRAFKSVKDGAVEVNFDALRYI

SEQ ID NO: 945244 - protein, 80 aa, Homo sapiens
NLEDDLELGKSLCLGRCLITDKSECTGLPSHVSYMEWDPTLDAVPQTLPDDLSIILVRTGYAAWYCVALYGAGRHVPNGG

SEQ ID NO: 945245 - protein, 103 aa, Homo sapiens
RSYTAIAQCGRRGVYLYSLSVPVSCAEAHNAPTRTEDWTTAYTRLGPKYRGALTWFTINTDLTPFHRRDVLKLGKAPMIKGIAGYSEEYDICIRAKSAFRGGC

SEQ ID NO: 945246 - protein, 129 aa, Homo sapiens
PQTRPLVARVGSLVQSAACACCAQRRAVCVRGADRMSKWTSKRGPRSFKGRKGRGAKGIGFLTLGWRFVQIKEKVPEFVVPDLTRFKLKPYVSYLAPESEETAPDGRAALQRRGACHMELKDRTFEPAL

SEQ ID NO: 945247 - protein, 139 aa, Homo sapiens
VRLPVGVRHAGPRALLTLRPVVSLTRTQHYPFICTGSFHTSGPLAQEDYYQILGVPLNAPPKEIKKAYYYLGKKYYPVTNKGDSGQGKVFQMAEAYKGLSDEVKRKHYHAYRSVGFDTGGSGFQHRYWGRAHCGPRGAV

SEQ ID NO: 945248 - protein, 196 aa, Homo sapiens
GGKMVLESTMVCVDNREYMRNGDILPTKLQAQKDAVNIGWHSKSPSNPENNVGLITLANDCEVLTTLTPDTGRILCKLHTVQPKGKITFWTGIRVGHMALKHRQGKNHKMRINGFVGSPMEDTEKDLWKLAKRLKKEKVNVDIINIGEEEVNTDMVTVPSGPRFGDALIRVSNMGGEGGAMLGLGPGILIWSVRCL

SEQ ID NO: 945249 - protein, 75 aa, Homo sapiens
NSWSPRTAPPLTCQLKPARVPAWRTWANAAISVHSYLSATDELEPTSHYPFMANTDVTSTSIIATSYQEASQVEY

SEQ ID NO: 945250 - protein, 83 aa, Homo sapiens
PPPAEARPPLAPEPQPAASACSLVRLNSSYLLYMARWLVILWELFWVGEVGSGTMTGPYPLTVLTRGRGTASSQAKGQSHSGG

SEQ ID NO: 945251 - protein, 97 aa, Homo sapiens
RCSSNRGAMQSRALLAVALLSLLACARASYAQDACLLSFMQGYMKHATRTGEDALSRVHESQVVQQAWGCMTGGFRSLKDYWSTGNDKFSETLELGP

SEQ ID NO: 945252 - protein, 127 aa, Homo sapiens
SESVGTEYATTGVRLTAGATGVLYAIFPELPIWCQVKGRVLGNLLKRPRGGPKNFWKNFEKAFQGGTPWENKNVPKGFPKIYKRGGGALGIFGDPPPRTNSWGDPFGAHLRVLARGAPRGFWGPSPG

SEQ ID NO: 945253 - protein, 100 aa, Homo sapiens
TRLVMLGESDLRCCEKCELTLDMRGVFEDSNYSERTTDLDVQLLCLGHIVTLFEAIMPTDFRTVSLLRAGLSMSDIETLVTIVCYHKIREKGAYSTELRS

SEQ ID NO: 945254 - protein, 70 aa, Homo sapiens
ARADSLPSPVWVFVTRQLVCVGPHSLSKANAMCKLFVCTDTKGVNRRLFCDGDTVTVETTPMKPTVEGFI

SEQ ID NO: 945255 - protein, 118 aa, Homo sapiens
MHQQNEAADTVASCIADESCGKCDKTLYSLIGDRPCTVASLSEHYAGVLAVLNTSLLEMKASCRTLMTTDTYSYGQTMSYTMCTACHDKQDTLQTIGLCERARRHPYMYAPGTLIVLL

SEQ ID NO: 945256 - protein, 165 aa, Homo sapiens
LQTAWADRARNFVHFSAQTETCEEPLTYGGLEPVLVVHQFNAIMCQSLQVVNIFIGDKGNSFRTWESEYNKCSHRCTKQNVGRCRTMRTLAHAEQFINQVALVQLVQLKLETTMAQLGPVRNHVGALVKKSLMDLISVDRLSIGEEQLRCFKAASLGVNASQFEA

SEQ ID NO: 945257 - protein, 85 aa, Homo sapiens
MTSRNNVLLDVISAEEILEFGKTLIMNYDADNILYNQVACLGSHLLTNDVMVHDMLDTMHIWDTSKTGGSSRTSVRFYRGADSAF

SEQ ID NO: 945258 - protein, 80 aa, Homo sapiens
AQSIESSTTNSQCIITAPLLSTLRISPKLCLIQEANRPSQTRCHNPGLLSTMTEGTLALSFMGLQLNAHYTIITKEIQSI

SEQ ID NO: 945259 - protein, 77 aa, Homo sapiens
MTTASTSQGRQNYHQDSEAGMNRQINLELYASYVHLYMAYYFDRDDAASKNFAKYCLDQSHDEREHAALMKLENPGG

SEQ ID NO: 945260 - protein, 108 aa, Homo sapiens
TRRTGAGGGMIVTWIDSENPDGSHILTSCLHGGFPCATAHHARVTLSSEPPSSLLTLSTIKRIPYMDYATVTDIALITTLVCTMDYVSCMAWSSDHHRIAAFTHYATY

SEQ ID NO: 945261 - protein, 85 aa, Homo sapiens
LTLMCATVGALDTCWPDVVCRHALKMGQLTGFSMIGNPVRTLQSLYAQSPRLAQEHQDTRARQDSETSRICTLKGGPMCSRASWW

SEQ ID NO: 945262 - protein, 78 aa, Homo sapiens
MRKQDSVILGSTHYRGLDCLQPYDMTAQSVHAPSYRAPETNRAFHDSEISSDAELETKLDHELSELSFRVHCSMWHTA

SEQ ID NO: 945263 - protein, 116 aa, Homo sapiens
MYSLRMKPLNSRIHVLLMSKLIMVTTHYIPSLETYNAQMWLFVKPMEGCLMDAHDPESKECFYEHIDDEPYLSTHERPYDDVMSTAIHDNRKTVQERHCMNMSEDLTFMAQNCVYS

SEQ ID NO: 945264 - protein, 145 aa, Homo sapiens
NTPFLGFSLPPKKSFFPGSQLLLVSPKKNFFSFIPPSRSPFTNPLPFFSFSHIPFPLSLFIFGSLLGKRLPLLFSSNRLSLSSISNSIAAPATLSISTVLFISFILYCHPILSKVILLFLFHHTSTLIPSLPNIQISPCFSAVLL

SEQ ID NO: 945265 - protein, 102 aa, Homo sapiens
MISSRSSMGYVRYTTVCQELQPLDSSTRRTSSMTWTTLSPCERPDIAPHSHLRHIYISSDVNRPCDIFLLDGINKTRWGDRESHEDKVDKVLEGPGAHMPLW

SEQ ID NO: 945266 - protein, 128 aa, Homo sapiens
SANANRSAVRTLCCRLSAERCVDLGYGFNKCELWASLWWPLWLANAQGKPSFHTVSDELGNYVNKRDTTWQGGHNFYNGDMSYLERRCGTLLGGPKPPQSGMCTEDPKLSGSFDAREQAQCATLESAA

SEQ ID NO: 945267 - protein, 96 aa, Homo sapiens
VWATYHRVFDKVELMLSEKLRPRCTHSASARTGFFWASIMKWGLVCAGLADMARPGEKLIHSSIWCFDGYRVYLVKILTCDYSLFRIWRYYPELKA

SEQ ID NO: 945268 - protein, 129 aa, Homo sapiens
NLSDDAPQYGNQNLSPPDTPGGGTAQTPEAGTSQPMPPGMGTRTFHQPNTPGGGTGQTPEPGTSQAMPLRKSTPYSSGGPSEDKRFSVVDMAALGGVLGALLLLALLGLAVLVHKHYGPRLVLLCGFGA

SEQ ID NO: 945269 - protein, 67 aa, Homo sapiens
RSWVTDGFICLKDYWSTDEDKSSEIWNLDPDVIANFIRGCLRPQYPKCICLYILSAPGELQYPELPL

SEQ ID NO: 945270 - protein, 208 aa, Homo sapiens
MARGIRHNQGNLIRVDICEITECASIINLTLADKHSQRKRMTYPQIYGAALTREQCYPHWCIAHDIAWCRIMDIDNMVGLHLAVMLNPLNGSVNFDIAFMLTYVRMSLYHHVNNMLKSMYENDDGFEWQQSMICNGYIVIQSGKPRMRSSKLIMVVSRIAAFLGFVPMWTSECLLEHSRDQNECKNHILDQSADGAGDVIGYPRWLSE

SEQ ID NO: 945271 - protein, 204 aa, Homo sapiens
ARENLHDATSPIIVTIITCDGRSLISNIHHLTTETLMNGDTRNYGCQADTKADGYYTFLRIPYSADWVNGQVPYQDSNLLSNVTERTLHTDYGRMSPRSCILRSLYREPGDLRHLYDDINCMTNQRSPHSYTIHITRRIAVMSLPHILLKNRCHLRIVKPNHQHRYTSGGIYGQCSDICGANHRFMPIGLLIGLQVLQYGPYLR

SEQ ID NO: 945272 - protein, 76 aa, Homo sapiens
LAQCLHWNVRKKQAHFEEEEEDVVLLFLSFLAHSLPFICFHVHLEFCYSIGTVTVHIHAGMVTTYTVLLMTPNLSE

SEQ ID NO: 945273 - protein, 240 aa, Homo sapiens
EQSVPLALHSDPVLRDTICSYSVMELCTKGLGNQEEVLKTTGINLSCVRTWEVVSNERHHVALQQSFSKLFKDIGLYPRAVSTTFGSRVNVAICLQRTSTPDATTVYVVLYSLSQSGKILPGVKVGIANSVTEPGGDSHPGEILVIKSHTASGYYTIYDIETLLADHINTTLRFGDAAQTLWALTGYLGFVRRTVLTADTGEKYDALDVVGALDALELIGYIHPLDLRLRVRITDDCDVP

SEQ ID NO: 945274 - protein, 62 aa, Homo sapiens
MCIISTAVSSCNTLAKMVVNQKPAFLWTLISPKAMLFRVPSSVAVTCEVNFGNIELLRKDPV

SEQ ID NO: 945275 - protein, 196 aa, Homo sapiens
RERERERERERERESASDRHAPLSLLVSYTKSYLSMVGSCCTSASPTVCFLKERLQLKHLSLLTTLSNRVCSQYAAYGEKKSRLSNLIKLAHNILSKCCECASEDCMAKELPEHTVKLCDNLSTKNSKFEDWCQEQTAMDVFGCTYFMPAAQLPELPNVQLATNKDWWDPRYTVMDKYTFGYADGLIFRRFPPSVL

SEQ ID NO: 945276 - protein, 138 aa, Homo sapiens
LDYLYGTAYAEERASVSLAWGYDENMALKHPNRNNTSSVEMYAQPEDLTERPDSEYRRVLLSSMAGDQDRNESGHGERTYIDALRMWTHFNEADRSKRKESALQEALVTLTERMMVLSVSVVHLSMVRYLVLTDEVYG

SEQ ID NO: 945277 - protein, 70 aa, Homo sapiens
GIRHERTPTAHDSQTGLDALCIGVSDMRSDRRLPGAHIYMSRYGTEPVISDHGQYTSEDYMTVHFCAICD

SEQ ID NO: 945278 - protein, 132 aa, Homo sapiens
SYRVTCTPHHRTGDTWGIYTTYEYTHCLCDSIEHITHSLCAKGFQARRSFYFWLCNALDVYWPVQWEYGRLNLDYSWGSKRKRLQIGATRAVPDSEDPRVFTLTGLRQRSFPPEGINNSCARGGVTVAPTGA

SEQ ID NO: 945279 - protein, 143 aa, Homo sapiens
EERERESVCLNVGCVFNYEDLTAITDMLLSYIVPTAGLTGAVRTCYISVPADNTGLGSHNTSISHACRLTTYDFADSIGILSVDNVMQSGDYVCAVESTLLFMLIISWFCFELFIHHVFHNRIVTYDYELDFVTRLFIVPSLA

SEQ ID NO: 945280 - protein, 113 aa, Homo sapiens
PELCLCLTRDYSFFTVEHVLGVQRHACYHRSDNGQGNFGARGLCPGADAGSEPKRACLRHRVQQQVKSKHLLQENEVQVLDTGDANTAIDLGQREAAVPIAHRVSMRGVLSGF

SEQ ID NO: 945281 - protein, 220 aa, Homo sapiens
TRREIERERERERERERERERESERDSERVRECECESVRVCVSLPLSDLPFLFVSCFSPSHTVPDPFFSFFYFSVAARDTLILHQPAPALHYVYGLFFSIDRSLTHPLTFFLFLPYLFVCLFNHPFLLPCLSFWFADLSFTYTLFYPSTLIFFSPPVLAPSILIPPPPFFLFLFPPPLLPDPSLSCFLSFSGFAPPPFSVFSFSSQSCRPFFLLIDFSSL

SEQ ID NO: 945282 - protein, 110 aa, Homo sapiens
RESERERERERERERERERERERERERERVRSTERESALVSVLISTHPSCCLCFTTFSYPCVVHTPVIPTFSALSVSSRSIPDPSLLLGRSLPSLLSIFPLSPHSFLHSS

SEQ ID NO: 945283 - protein, 70 aa, Homo sapiens
MRLNPTPTAWPPLQQYQEVDLPSEHRYRRLQSSRPQTRADTHDELLEGTDVSLTDTTEAQIHQGLQAHLF

SEQ ID NO: 945284 - protein, 103 aa, Homo sapiens
MLTNRLSAHRLLETHVTMGTFFLDGYCKVETLSTGTQTKAPNDSQPLMQQQEFRLLRISQLYTPDGFTPRTHMFTRHTWPMRLGLTVQAFVSLSRDADFYGGG

SEQ ID NO: 945285 - protein, 82 aa, Homo sapiens
MLTLPSGSDVLEVPSGGVTLIDNTIAEPVHGGPCYFSPQQAQMEGHTEIKMTLYEPLPIWSHSEAIRPGNTALSSSSSIYFR

SEQ ID NO: 945286 - protein, 70 aa, Homo sapiens
MRFRDWSLHETVHAPIFVYDLLSWWLKESARRLIITNSLPEGLQALKGVRSTMQEELYAAHAINYCVGLT

SEQ ID NO: 945287 - protein, 77 aa, Homo sapiens
GLLAVYTMLTIDLLYDARLLNRLQLYDQVLYFGMDRLIITKSSGRTYWTSLGHECTIVLLASVARWSLRCIDAIWSF

SEQ ID NO: 945288 - protein, 127 aa, Homo sapiens
PPGRGRTHGGDPPLQGGEGTPSLTTRTKFLAKGNLSRFLSARGQGDIFFLLGPPGRGTGGGFPLTPPRILGGGNKRLITPPPRGAPLFWGTPPKKKRGPFFPPPFFFCAPPPKKNKNPSSFPRFFSL

SEQ ID NO: 945289 - protein, 413 aa, Homo sapiens
SNHTLHTHTTKKQPKKTKRNKYEKKQKKQDENTDKKNEKNERTLEQTHGDRIGLEPPPPPPPPPLVKLREGFFCLKKEPVLRKWIGSIQHDQGGTPTVGPSVFFKKRVAHKSSGQGMPTTTSWTYTITAATRSHTRTVLEKQREREIGPPQARTGTQKVGLPGGLELSSKGHSKRHSAEERKPEEHEERERRRDSEGSKGEAQQQAERPRTRKQAAGQDGAQERRSRMDDESAERHEQSAIEETQQKRERTKRKRREGNDDHKEETGTTRGGRRGATKHRREEEDRRQERQRETTEDRLEHARAREGGGRKRPRARERPGRSKRRRERAGTEGAGRGTVKENRKREEARAHRGKEATRRWRTSERRGRTRTGRRQVRDEGENDGRPDNGGGAQQQERDRRRRHSARARAAEAG

SEQ ID NO: 945290 - protein, 121 aa, Homo sapiens
ISPESAYHPGAFRGCFRLLSPPLHDMISLNWRQQTNLELGLHTAYGRVYSMFIWDCILYLMTTATTWHHRTTVFITVDLALRLLCQFEFQQSNTSSIHSFPTQHPCNSYSVTITSGCVSFS

SEQ ID NO: 945291 - protein, 232 aa, Homo sapiens
FNKRGLPCGVGKLYERHEENLHLPGYCLLERVLLQRGFSSPWPDMVLELASFSIHGKQHLPYLPHLSLAWSFDISISTFSPAPRTIGSGRGLHGPQRNTGDFGLSLGYMVLVQAGRGSPASLMWGAVRQHLGLGLERKDVGFLFLSGERSLRQQNKFGSWSLRKLQIPLHAGREWFAGGQVLLFWLTLDMKIENFTLSLPSRQIRSFLSVCLYVTKAFRCYSSCLNNDYYFK

SEQ ID NO: 945292 - protein, 111 aa, Homo sapiens
MNAVLDCATGRCGSCTFIGVAAGSTGFTVDPEELVIGRTINGTFFGGRTSVDSIPKLVTDYQNKKFNLDALVTHTLYFDTITEAFDLMNQGACEQSSSFEDARSTFGVLSD

SEQ ID NO: 945293 - protein, 122 aa, Homo sapiens
MPVVLDERDFTVNFTDVCTGLCKCITKRRGARLAKYGAYYETKVKQELYENLVADNDIYDYTDNTHRWEYMCDGIAHYGYALKTVCDRNIVGVIHYFPYSEHTKMMEVLHCVQAASMHAVFV

SEQ ID NO: 945294 - protein, 107 aa, Homo sapiens
MDYIGYKNHEDIVIVPDDGTKLNGRLHFCAKLYRSVTNCLDSNHVLMLESNLQLENCALKITCIISNASYVLAEGVENDMTNIDISGAVMNMYEHHSMCSVHALFGA

SEQ ID NO: 945295 - protein, 172 aa, Homo sapiens
PFYTLRFETAVFSTFAAGMAVFCPCLSIWPIPQPWGPRSLSQPPTLLMPLLDYGPNSSGLGIGPPYPGIFTLGTRRRGKPSSWRTVPTNPFYPGLRAQMGYLCQTPAVCLWEKDIVPISRASAVTLLVAAEFLHSGCPPPDRTLELCLFQTSARNQHFMKISGSGHQQDLST

SEQ ID NO: 945296 - protein, 124 aa, Homo sapiens
ERERERDRESETVRERHRESETYRDRAPHTRLGIHHLGFGFLSCAWPGSLCWSCCLPRCSRPGTGGHGSGARAPSYAFCAPYYDAHLLDLGPLTKAWFLHSCDSLWFMTHKLCPTLACGDEVLC

SEQ ID NO: 945297 - protein, 133 aa, Homo sapiens
AFLCSRVQDLCSIVRRADRAHAPIMEPLRTSCCVPRCESVCVSSSERSAEDPGHASSSLTARTVLRRPHTGPRRTCGMARTPNGRKLTAERTGRQWRTEASLGTGQAFLLLGGKLSGAESRELALRLFVLCVV

SEQ ID NO: 945298 - protein, 111 aa, Homo sapiens
MCFISGGRGFRLSHITSLSYSGFSTRGDPRPRIGVAIGDQILDLSIIKHLFTWPVLFHQDGFNQPTLNSFMGLGKLAVKEARVVLQNLLSVSQARLTDDTELRVCIHLPAS

SEQ ID NO: 945299 - protein, 105 aa, Homo sapiens
MTMCQGPMSNRPKKYERDDPPGGVPVKLRDTPRVCNGAEHYLPYASQSRGKIRYEHDKMYAAHSVKFVVHTEIYLHMMNLIHDGKQHSRCINSGQQGKESLFLKC

SEQ ID NO: 945300 - protein, 117 aa, Homo sapiens
LSQRSALPLFPPLIYPTLIPPINPCFAQFSPSSYPNKMPYSTTLLVNKPYVPPAFSNNKFISHKYLSQAQGIPLQTINQNILINLVNQNPQITKNQLKAVIPDFSGLLKKFCQCHQH

SEQ ID NO: 945301 - protein, 119 aa, Homo sapiens
RAQHCQDQTRVRPGAAFSVKRRPRLTTMRIAAICFCLLGITCAIPVKQADSGSSEDSSYEQTLLAPQNAVSSEETNDFKHETLPRKTNGHDHMDDMDDEDDDDHVDSQDYIDSNDSDDV

SEQ ID NO: 945302 - protein, 84 aa, Homo sapiens
MTIKPDKRPSDLGLEEPNRIPSCSLLRINLNQDFIDLSSALNSTVASVLRAVCAGTRLAWLDYHARDLILFTDLIGRTGIYVHD

SEQ ID NO: 945303 - protein, 99 aa, Homo sapiens
GKLPSHWIFIHWEKNNLFVLSSTRDMLKKYAAANRIGPMTHFSRNLVGPEIPKNEWTKGFASTRLQEDVRMFIIGPLKLARTKSKLLACIKGLRDLIPA

SEQ ID NO: 945304 - protein, 151 aa, Homo sapiens
AIPAYPSVQKLLQDYFNGRDLNTSINPDEAVAYGAAVHAAILMGDKSENVHDLLLLDEAALTLALETAEGEMTVLSKRKCTIRTKQTHIFTTYCDNQPGVLIQVYEGERAMTNDNNLLARCELNGIPACPRGMPKIEVTLDIDADGILRHV

SEQ ID NO: 945305 - protein, 96 aa, Homo sapiens
VWATYHRVFDKVELMLCEKLRPRCTPYRRCQNRFLLGSNYEKGVGVCWIGCYGQTWRLSTGQSGVLMGTGVIWARYLLVIISKIFRIWRYYPELKG

SEQ ID NO: 945306 - protein, 65 aa, Homo sapiens
IDVDIPGASVWSAYRMPSRTPCALCEPDAYESVYSPEECSDLGPDLPRRLIRHRARGGRVQMKLV

SEQ ID NO: 945307 - protein, 133 aa, Homo sapiens
TRRKRLESFFSFKNKKSDQGGAPPGTTPPPKETIGKMGTPQRQRPTGRDQEKGTDQRTSRRKQGPQEEGARRNKRGRAGNQHARKGARGGTKGRKQRRRDDKTANNATARSGGRTNGAKESGEEGGRRDAPDG

SEQ ID NO: 945308 - protein, 185 aa, Homo sapiens
RAPGLTDDGVYCRRRAIQVCTSCLQSKPKVFSHRNTETCGYSVILVDRHKFSHLAKVIGGLSASVEATPSGLAEGWCAHRCGMAGVSSSPQAVPMSPCADQWHSKLAQISGHPFVILARILSMATRIGHREPHGAKLKNKRFHYALLRVIYEAGLAHRSTERVLRVSQHCLPVVQSIPHLCIVPT

SEQ ID NO: 945309 - protein, 130 aa, Homo sapiens
RIVCTEWVLMEEHDARVPVLEPRRVEQAPPVIYYVPDFIFKEEEECLVRQGFNGPKAKWTQLSGRKVQNWGGLPHTRGMGPERVSPRVQGFVDKECLYLFGGLPDYHVLVDQNLSGEGIMGHTPLVRVPP

SEQ ID NO: 945310 - protein, 131 aa, Homo sapiens
EVVEGVHWAIYEIITVEDVIEATPFYTDTRGQLTELILIARALEVSMGLDPGSATDVRLPIKPLMLMLTVCKTGSSLQEMGCRLKTSGESGSETHACDPSTLFAEAGSRGQVIQTPQKTGLSPIAAIAEPW

SEQ ID NO: 945311 - protein, 108 aa, Homo sapiens
MCMRRHHRTDVTHDCTMSAKCSYLCHYMDHMYRCQSKPVFTGNGIICHEDTDLDGLPNENLVCVDNETYTLSDYCANLSNLRPEDTDKDGIGDACDDDHYCYVSQSVV

SEQ ID NO: 945312 - protein, 95 aa, Homo sapiens
PAVLSSSLFLDRLLTGRHIKKEAILNLNAFNLERQQKAMKLNIYYGRTVQAMCTECMAWQDAYKEAPLEAIIKRARSICQRSEGQYVDRSSCGGL

SEQ ID NO: 945313 - protein, 113 aa, Homo sapiens
MRRVLIPLSLWLCARGVGVAELTEAQRRGLQVALEEFHKHPPAQWAFTETQVESAVDTPFPDGIFVRVEFKLQQTSWRKRDWKKPECEGRPNGRKRKWLGWITGLCGGLGRVV

SEQ ID NO: 945314 - protein, 60 aa, Homo sapiens
RSSARRLMPTRNADRHAHRTSAHSTYNQSAYHGRDANRRSLQCPTHLDVLYWLDSYSAAH

SEQ ID NO: 945315 - protein, 117 aa, Homo sapiens
RILHESTCQYRSLYYTRHKGLYVGLPEERLFGNTDLLSPSGTWQPDYTGGDCCNARSTKTHGRLYLKNKIHTLELLEERHNRFLDTGVTNKTLAAEMQELRVPLAEAQETRRTAERP

SEQ ID NO: 945316 - protein, 70 aa, Homo sapiens
MPRGQVFYRTLVCNIAILSDSVTRVRWILIAKDAFRKKHNLEPAVFKRYSCEFADVKVLDDNGNNGVAEL

SEQ ID NO: 945317 - protein, 74 aa, Homo sapiens
DTHIYTPYGTGPNNWIIMRCCYDEHDPDYTQSCRDLIHLTLTRYTGPLEIRHAQTCTPRRPLRPNGGQMRCSPN

SEQ ID NO: 945318 - protein, 74 aa, Homo sapiens
MAYCMCEVNSQVQYVTHTDLHKYDTEDARKHTLGKPLTLVTGSLHEDLTYMSATVRHTDDGPHTAPMLDKLQDE

SEQ ID NO: 945319 - protein, 148 aa, Homo sapiens
MTYSIYTETLWLNLFMKMAMTHNEECCEGHIALLVYCNVSIVTEGYEKRRGELTQREATKERGELMMPEPLNQKCRLYLRPTLMKSHRFVSHECKRTHMHRRPYLRCNEVGTAVSSSIGWQHSERGIIEYRMSELVQDYTAHTLVTSL

SEQ ID NO: 945320 - protein, 69 aa, Homo sapiens
MPFRYVGTRFFAIVSAISSTHFISIFLYSLYSLVLALSCFMVPTSCCHISSYDFFTSLFGPLVSSGLSG

SEQ ID NO: 945321 - protein, 69 aa, Homo sapiens
ERMCDSEARHGDSHDMPLELGLVEPLKFRCEAHADIGCCLAKRLVIGLMFELAAEGLSTVATVEYIGRL

SEQ ID NO: 945322 - protein, 129 aa, Homo sapiens
PPLTCDSESTLPRFVSRGILLLSDLCCLCPVSLAEDPQGEAVQKTRYIPHMIRITQTFNKITPNLCEFAFKLYRQVAHQFNRTNIFFSPVSIASGFAMVFLGTKGDTHKEILEGPDFKLTEIPEAQIRV

SEQ ID NO: 945323 - protein, 138 aa, Homo sapiens
HELRALMDETMTELKAYSELEEQLTPVAEETRSRLFKELHAAHARLGADMEDVCGRLVQYRGEVHAMLGQSTRELRVRLVYHLGKLCKRLLRDADDLHKRLVAYQAWCHEGAERGLNAIAQRSGAPGGRGACGPSCGL

SEQ ID NO: 945324 - protein, 102 aa, Homo sapiens
MVLGTKNHTFAVDCENRQDINGSGNTLKAETWDAPNLVHKAGVTYTSDMYATQDPQIRKTMEVCVLAHTWTTQAFFAVMTRNNHAHIVHAISTMNMFRVTTY

SEQ ID NO: 945325 - protein, 83 aa, Homo sapiens
PCVCFTVCLSPSSYGCIWAFIPHDRGWVTIQGYWTVDVLLCKLYVSCTALKASWTIISYECKGWSYSLLSMRSDRSPDSREFH

SEQ ID NO: 945326 - protein, 61 aa, Homo sapiens
MVAEFDSCIRDHMATERNRFIILRLTEQFANSRSDEEGVATTTHQYDTTLTSLLGMRYDCV

SEQ ID NO: 945327 - protein, 118 aa, Homo sapiens
MHDTFKSQQYAHVLGYQHDCKRSVRAQCGMFRFKSGIRRQEARSSDSIVPILKMGTTFSTRHKGTVVTLTGITSAACMYENRNVNALFSWETESLKHLHVLEALFGISINMMVLRMNT

SEQ ID NO: 945328 - protein, 123 aa, Homo sapiens
QSNTSMAVNGGHKRNGQTDATEQWTSSKESSPILCPTSERKAKTALAAQRAVTLPGRTHETPSVQMEGFLNRKHEWEAHNKRASSMFWHNVYCVINNQEMGFYRDAQTADTGITYHSEVRVVW

SEQ ID NO: 945329 - protein, 103 aa, Homo sapiens
MVGACHGVLEGHRQAEGRIGGHCPQGASGEPVPRQTYSLTPLAGSVLNHNSFNTFSCVILGCLFHVKGLRHPVIRVGPKVCASGSQSADIWLGLFFSLGFLCT

SEQ ID NO: 945330 - protein, 99 aa, Homo sapiens
AVLCIFLCTQLYIQIFFSSLTRHGYDTTTSWAHGLLFKLWVWLPGHMTRTRECPRRPWQLFLDFPGPMMVRLIPFGSSLCVPIGEKGTGTLHLTPTTPV

SEQ ID NO: 945331 - protein, 223 aa, Homo sapiens
MGTVDSDPNNELSSYNARWFLSTRDTRHELPRMDGIIPSTGTSPLVLNPPMPLPCPSNKPWALEKLVLLLALTAALAPPTGRCSKLSESPGVCASSSNPGQVILGKLISGNFGCLILKKGHGRAVEVINWQRRMKEIRRFSLTTLRLRGGPVPNSTYSETNDTALADDLQRTDWENPGYTPLNAMQHIPPFGRWRDSEQALNDALTNSCALSMANCIIVRRYL

SEQ ID NO: 945332 - protein, 71 aa, Homo sapiens
HELSLRKHVWLMRELRIVTNHFIPFLETHYAHVRLFVKPMGKWLTGVQNKNLREMKAFCDTKMTTQTFPEW

SEQ ID NO: 945333 - protein, 188 aa, Homo sapiens
PGCRIRHEHQCKSALCSYSQLQRFSKVYGPVFTVYFGMNSIEVFHGYEAVNEALIDDGELVFGRGIYPISQRITNGLGRCTYICVSFGNWSEGDGKQSPKKLVIRSYPICMDAECCITFYLGCEYLPDSAPEFYYGMISSNGQRWKEIRRFSLTTLRNFGMGKRSIEDRFQEEAHCLVRELRKTKVTI

SEQ ID NO: 945334 - protein, 79 aa, Homo sapiens
TDSICHQFRREQLEQGPPTVLLHPVPGLQPVVRPHGEGMACRLLGPSFDSYLLPELTIYDCEVNVPVLEDPRYCKEGTF

SEQ ID NO: 945335 - protein, 130 aa, Homo sapiens
MQHGGLFVLYEPKKAGSQEVGGHGASDTQKTGATCTLSDFRTSLCEPEPRCAVPSVTSGCGTHHFVHSPCVPSHKVWFPWFRQSIKQHGALGERYSAPWGKNGPLWGSNVPLCALCQREKCAIPSWRYEG

SEQ ID NO: 945336 - protein, 110 aa, Homo sapiens
LIDFKVRSQIEGRAMPQITSIIVNQLKKSIKRKHTLSNYTDQGGLMGIYKVVDLPFVLSRQLRGMLGTSSLKLWLQTRLLQLRNFSGENDLSPLEVWSWCTMKGLLATSV

SEQ ID NO: 945337 - protein, 119 aa, Homo sapiens
ALIYDMFSHPMRHELSQVNCNVSPRHMCEQNDLGGRIPSVTHVHLSEVYKQGGTGSKSPSHEWYNKGSVLDHLKMRVVYQLEIRYDTFSQSTVSQMKQHIYTVRVKPNRLELFKVRFPT

SEQ ID NO: 945338 - protein, 108 aa, Homo sapiens
MPCLLTVAFLPLPLIFFLAIFLSPLAVSFCPLILIYIFTFSSSLVVSSLLITGFSSSPCSFLLTSLPLLSLYDYFPLLLVAVFSPVHCLVLLFPLPPCCLPCFSFCSS

SEQ ID NO: 945339 - protein, 119 aa, Homo sapiens
QRSWSCEEIRAVTLPPLRSAISRFCPLTHSNTLVMVDYYDALGVQRHAYPEDIRKAYTKLALKGIQIVLRIKTKHRGTFMTNMAMNDSMVEEHAEVILTDHLNRAAHSVTNMMSSGCLV

SEQ ID NO: 945340 - protein, 81 aa, Homo sapiens
RNVTCCTRAGHEGEIGAPVESGGGDYGIGGFSYTLEKRGYVKAGLWTSEAVIEHPDAGRQLYMGFLRAGSNGMQTFTLFWQ

SEQ ID NO: 945341 - protein, 118 aa, Homo sapiens
HPREWVLQKGMPHKCSHAKTGRFYNVPTHAVAIVVTNQVKAKILAKRINVRIEPIKPKSRNSFLNRVKENVQKKKEAKEKGPWVQLKRQLVPPREALFVRPNGKDLELLDPIPYEFMA

SEQ ID NO: 945342 - protein, 36 aa, Homo sapiens
MPQYNAFVLSLTSLMHSTGMHGLESFMGGFSDVCPC

SEQ ID NO: 945343 - protein, 114 aa, Homo sapiens
MRTTERYERDTEKKSVRGKGKGPKPKRKKSRYKSWNGPCGPWSKRRKHLVVQDTQTCECVLRTHSRCKARQLELNQRTCGCDKPRRGDAHEERASLKVSGTTTLSTGLVHAIGP

SEQ ID NO: 945344 - protein, 110 aa, Homo sapiens
PAVWPWTSVNMSYDQLIHLHSAPQRRRLNRGLRRKHHSLLERLRKPKKKAPPMKNPKVVNTHLRDMFFLPKMCGQLVGVSTGKPFNQVEIKPKMIGHYLGEFSFTHSSLK

SEQ ID NO: 945345 - protein, 62 aa, Homo sapiens
MCGQKGLIGYAHHEPESFNGSLRNVAVDETEHAGLYLTVADLHAMDFEPRVTDEYYSDSLFL

SEQ ID NO: 945346 - protein, 111 aa, Homo sapiens
VIPRGSCYRNRGAVQSRVLLVAALLALLASGRASEAEDASLLSFMHGYLKHATPTAKDALSIVPESHVGQHAKGWVTDGFTSLDYWKHVYDKFSEYWELDPEVRPTSAGGA

SEQ ID NO: 945347 - protein, 133 aa, Homo sapiens
RALGVSECAVHCGRNLSQLLERALWRHGSQTCGFYMGVRSAEDMLDSLERDYAGKRPGTHQIREKGFTFLRYGRLERLNGYAHQEPKAFNGSLRNVAVDELSTQGCTVTEAELYAMNSEPRATDDITGTLSSW

SEQ ID NO: 945348 - protein, 93 aa, Homo sapiens
HEGCVYTARVCDAVKALKAVRCDIPVASEALYFQLDTTHLKTRLEEIRMAVEEGATEIDVVINRSLVLTGHREALYEENRQVRKGCGEAHILY

SEQ ID NO: 945349 - protein, 99 aa, Homo sapiens
GTRCIRCDADNPNGRYYCGGQCTCDMSKHGTDDGVVWMNWKGSCDSDGEDEYEDQGLLSTEIVPNTENFASSVCDNIFVHYGIGIFFHTLYSSKTLKQT

SEQ ID NO: 945350 - protein, 134 aa, Homo sapiens
MSEVLLLLGHDLMTLSQTWHWFICLKRISLAENRLTHLARWTQADPLADLHLQDTSYSLLLDPALGGPETSLRHLYLLGNPLRWWTIGWLRDLLHHGRDDVNSTHDLNWRFKVHQEQHLSHVRYEHCKKGMLNH

SEQ ID NO: 945351 - protein, 66 aa, Homo sapiens
AAVTDYRQSALSSLASDIIDRLAVRIYYADVQQVYQSVSLDAYATGPSDYFVDHVLTFDSTYEITV

SEQ ID NO: 945352 - protein, 130 aa, Homo sapiens
PGCRNWHQEIENYRTCDPFWKYYYYGYDYIDFNTEIPPCVPCESTAQITKQIDRQNQSTCIAPEAYLEDDCPATLQKYLIYSINILHRQDPTSVMVISHQAHAGRNWRLAYYYYLVGDVLYTGGTYQPWV

SEQ ID NO: 945353 - protein, 118 aa, Homo sapiens
FAREAVRDHEPGGHAEHTADVHETHATRCSRTSIDEERPGPELWWDMARLCKRETSNSRKVQITYSSLVNKEQDLLGIVLQDTNLLEQVLNQGTGISASFGAKTTAVSRNINVRELTK

SEQ ID NO: 945354 - protein, 66 aa, Homo sapiens
HEQGSNCLGVDSSAPKACASWLIYCPDFPVTTLCSARSIPDCPSGLIGWHTHTAWVTTLPTPKTNS

SEQ ID NO: 945355 - protein, 61 aa, Homo sapiens
MSQLKVETNHCIPFLETDYAQSHLFEKPMVKWMTAVQNVNLRVNAFCDTEMTLDLPTIVEP

SEQ ID NO: 945356 - protein, 121 aa, Homo sapiens
MGGCPTGQQPIPEICPIPILAEKLHEQIYTVTGPSRIPAIKDRHDMPYMDAVVHDIQRFITLMPYNLPINQPETPFSEDTSSPRLSNEPAAHSMNTILSANLLPASEHDGGPMTLPFDWGH

SEQ ID NO: 945357 - protein, 68 aa, Homo sapiens
MGLRVIEVVQGQGPGKKGGFQGRATKMSRRMQAQALLQDYISAQSATQSGLRALPSCFHRNLLVNVID

SEQ ID NO: 945358 - protein, 78 aa, Homo sapiens
RTLDPGELKYVHRVPTTKEELCGVLGSTMRSDLQIHIKCFKRHLQGGRMLTVHFILFDAAPFFPHCSLTLDSRDAPLV

SEQ ID NO: 945359 - protein, 92 aa, Homo sapiens
MTRYSWSSFIPMCCPYEVHTLQADLRFEHRAVLYIAQMTVHDVKLIWMPLDDCTFLPEFCAASLRTLHHSRLCDLGFYGTGDYSWVQLSHAK

SEQ ID NO: 945360 - protein, 109 aa, Homo sapiens
MVLWEERDIYACQFTTTVEYCCAAELFTEGSIRKAEVLSREQVMLDDKALFPDGCGQADDRGADHDIYVLRVTHPPEQTGHFTLTPLNPERHPLVPADRQRVTDHMLHT

SEQ ID NO: 945361 - protein, 82 aa, Homo sapiens
GLGTFCWNQENNVPNWKGPQKRSPFPPTEKGTGACLPVGQVGPPKEEYKGPPFPTQGGFCFGPQKKREIFFPFPSYQWKKFY

SEQ ID NO: 945362 - protein, 69 aa, Homo sapiens
RNAVDCANPQTMENATYYGHEESVTERMLPIEQSRLYVETCCSYASPHWMLDVREPLSETCVTTNRSVQ

SEQ ID NO: 945363 - protein, 80 aa, Homo sapiens
ARTLAKCACPEAKPSVTSSYSPDLERSQLVIYINPMYMSHRSDLHVISGQLVIALAFEDIVVRRQTGVRCMTQVSNRNHV

SEQ ID NO: 945364 - protein, 348 aa, Homo sapiens
MTAPRATHIRGGTINRRTSTPRCTSTEHNQIASTSHGSSLNNYKLYTTKHQQRVQHITHHQTSAVELLWHAPRERCQLAATAANSPRLYPNLMYQTVSLDTYLTLAFYTRSISSEVPGAIIVDSHKTHPVRQHLLSSLSASSNGYFYFSHQRSALCIFPTELESTCQGRHICKRGIPAPRNSNKPHLPGSSMSNALTPTILAKQTVTVQHYSTLCSTDDSLPLGQTDSKTIYIVDHAQTQLPTTKPRELHVAPHLERLQGDYYIFMDANTRSYFMQHFEPSLTSQLLTAAVHRIQTQRSTAGARTRLRSLGHHCRISGGAHFCDLVPYTARRTYQFVFLRSPRATTTP

SEQ ID NO: 945365 - protein, 119 aa, Homo sapiens
GGTPRPFRMKAAVLTQAVLFLTVSQARNSWRRDEPPQSPWERVNDLATVYMDVLKDRGSYSVFYVEELLLGQLNLKLLDNWDSVTSIFLKLRQLGPVTHEFWDNLEANAHAYVHDVQKS

SEQ ID NO: 945366 - protein, 218 aa, Homo sapiens
TSSTILAYGLRAYDSPWPSTCQSPYGNHALEPSHDGKDELLLPSIISLGLTRYTVCLQTEIQITSNGWPKLKPSRPDYLPKTTYMSTRVYVTQSDKIYELMRHTYRAWRLLVDHDRVLVQLIIDHRTLYIPMHVKLIVRRGSALWTLGYLVQRVMLLTGMRCLTVLNHKAIILDTHCLMYPIHITELLRPNWTNLSPYRRTNGSICHMHSSLGLTCVF

SEQ ID NO: 945367 - protein, 133 aa, Homo sapiens
TTDLQRIDNADFCTYVLHTTDATPELTFIISLPEDSQGDAAHKTETYEPVTEHPTLYKDNSNAPKCRLLYPKERRHGHMTNFFLCPQSIDTVFCNDLLGTEGDHHKEYPECADFNLPEIPDGHIHECFQAPPA

SEQ ID NO: 945368 - protein, 213 aa, Homo sapiens
MIHSVKLTPSSCMQQLEDNYRFAHTNVETVVNEYDDNGYGIILFGSSHVTNKLEDKTVAYTVHCAHMTDDNKDLIQGKDWLIAYYDVDYEKNAAGCNYWRHRVMMVAKKLLDAGHKLNFAVAAAEPLAHELYDSGQESTAGEIPVDAIITAREKFVMQEDLSRDGNALDRSLHEYYDGNLKRYLKSEPMPESNDGPVKVWFREFDELANNEDR

SEQ ID NO: 945369 - protein, 219 aa, Homo sapiens
YDSGTETYCEHLTVVNEYADYGYGNMVYGSSHSHCQIRRQYCPIHNAPNDHYISCISMAMKSLLVYKPCMTDYTIDAITAAWTDLLMTMTKTHEKHAAISILLQTLGLMTDVYDCMLLAGKLCCDSPSNLDYDQGDDSSRALLERPLLTYPELIRDKLGNHEDLYRYRDAHDRLLQHTSDGILMEDIESMNICMMAMIDLLTGLVAENLTNSFVMVHIW

SEQ ID NO: 945370 - protein, 129 aa, Homo sapiens
NCDPPRTPDYTCLLSDMKINYTTIFIHHAWHDSVSGKKYPVFNPAPEEELCQVEQGDTEDVDQAVTAADRLFRLGSPWRTMDASERGRLLYKLADLIDRDRLLLADNGVNEWWLYSNAYLNDIAGCINT

SEQ ID NO: 945371 - protein, 118 aa, Homo sapiens
REEVDVSKQLHSGGPENDVTKITKLRRENGQMKATDSCHQKECQGYKPLSKQQLHQKLTETQGELKDLTQKVELLEKFRDNCLAILESKGLDPALGSETLASRQESTTDHMDSMLLLL

SEQ ID NO: 945372 - protein, 178 aa, Homo sapiens
RHTSPSKREVEQADNKVSQIQRMPMVQAIACLPHQRGRKLKIRHGAVHCRHREPARQLLRTRLSLLMLVNSRRQELECTRAQEGVGPFSVTSSAPHRPFYTCGISFLIRTASPCIAQVQLDKNPHSTSAKVSPGQAARIGARSQGIGLAPAVVSMSSVRFTVRNPLDSLGSRIFSMDQ

SEQ ID NO: 945373 - protein, 108 aa, Homo sapiens
MYDTPQEVTEARLSYLTETISEADADDGHGLEEQQKRIVLDPTGSMNIYLMLDGSDSMASSNITRARMGLGNCIEKVEYCYAWTRQNGISLMLQDSSLIILVTMNQGH

SEQ ID NO: 945374 - protein, 86 aa, Homo sapiens
VAEVHSEHLNLDSLMAEPKRHNVLLSTERSCSRVLCAYATDGCEANTVYSGTHRIMVELICLQECSNLSYYCTPLSKARISMRHLI

SEQ ID NO: 945375 - protein, 93 aa, Homo sapiens
MCDTPQEVTPALLSSLTETIDEEMLTYGTGYVSTDAYDSTVTLELHEHISGARKIIQHCRQQLYPSHKATRQLNGGPIVLYLRARRMVIADAP

SEQ ID NO: 945376 - protein, 189 aa, Homo sapiens
MAPFFSPIFLPFSQGPNRTLKVLANCACQPPKKEVLPTRDIKPLSACEEPKNMSRKELTIQNGHNKASCERAAQYASAYDRVMCISEVVTPRLLCTEGVSPYDHSNTWRHDSVHPLVAHNTSRFIQVGVITWAAVDVCHNRKRQNLVLAHARDFLINLFQVRPALKKMPRISLGVLSKGFQPTRGPIKN

SEQ ID NO: 945377 - protein, 85 aa, Homo sapiens
FRGHLNTTQDYGHHEVSRVFMDGTRTFPYYGDEILDLYVRDELVIPYDILPDALHGGCYVDPMCAHLRAITLCMREKIGFPATSS

SEQ ID NO: 945378 - protein, 115 aa, Homo sapiens
IVSFPLACGTLKWLTFMSLLYVFTSAYSKGAFRRDAHKTEVADRIKDLRDEHFKALELMAFGQYLYACGIRRSCHTSDVKQLNLQKHVMLMSQLYLCLKPMLKWLTVEPRKNYYS

SEQ ID NO: 945379 - protein, 232 aa, Homo sapiens
STLYDDYKTTLRPRDLTTRTPLECTDNAQELVDQPGLKEFGTAFLLLVTMCRQVHSRWNMAAGPIPLTIIGNLFQKELKNIPKSFTRMAQRFGPVFTLYVGSQRMVEMHGYKAVKEALLDYKDEFSGRGDLPAFHAHRDRGIIVNNGPTWKDIRRVSLTTLRNYGMGKQGNESRIQREAHFLLEALRKTQGSLSTPPSSSVCALQRHSQTILFRKHFDYNDEKFLRVKHMDL

SEQ ID NO: 945380 - protein, 153 aa, Homo sapiens
RPCRRHLAEKPAMGAGGSSTLARFDLLAQSRPGWLAVASLDLTAEALGAVAWRRAWPTRRRPLMQQVGTAVQLWIYPVKSCSGVPGSEAECTAMALRSGNLRDRQWLVINQEGNMDTARQEPPLVLSCLTCDGDALTLSAHYTDLLMPITAHH

SEQ ID NO: 945381 - protein, 118 aa, Homo sapiens
SLSLSLSLSGSLSLWMNIPPEEREREREGREEQIEANRGAHGGTGARETERERERQRERERERERARQTNDVRADKRKSKCTERGRGKKSKSEREKREEMRIRGREEGEGEQRHREHR

SEQ ID NO: 945382 - protein, 40 aa, Homo sapiens
MPAKVLYSLCCPSGPYTWSTSDLYKCINVGRIVYSGHGPD

SEQ ID NO: 945383 - protein, 152 aa, Homo sapiens
MQIHGKLLWRRMQTELHPVNHTIKIPLYSWCMSMFRQSSTISISPVESGTISNGPFISSTCYNRCYGPTVLCSMGPLCDSKTEQSIEVLFLIHWTPLMCCRSAVAVKIQMNFRVVREHWIIPDIAALLACSSGSPHYVPCINQYRPLGKTPS

SEQ ID NO: 945384 - protein, 96 aa, Homo sapiens
TETLAEAVIHSVASMKLLAATELLLTMCSLDGADGRRQAKEPCVVSLGAEAYQTATDYGKDLMEKGKSPELEARAKYDCVNLLSYVEALGTQPATQ

SEQ ID NO: 945385 - protein, 78 aa, Homo sapiens
HESNLHVSINLSVNPAQIMLKGKGYVGAPGILTRLSTVFENYVADSPVCCKRSRVGFVATQVYRKSMRRLAPMLSTYR

SEQ ID NO: 945386 - protein, 213 aa, Homo sapiens
AFVGHTRTSHCTRSLRNRQGAAFLRGVSSERAQDTDCAGSASSSAHMPFTGYEGWVGTLVQNPQNGERKPQRVPEAKKVCGPSSFQIVLVKLERTVTLNHTCGPELLAPERDVVPSETKCENASWGETQGAGNDTHLVALLNGIFNHEVTLSTEDTVPESEICTRGLLAPVGASEGDYTGPLGCVNHNVGSWKEIYNPRVCAQCPLGTCVYRV

SEQ ID NO: 945387 - protein, 64 aa, Homo sapiens
ITRTSHCADLCCAIHCREHPVANRQVFIYVRNTDIAIGSVDIMKDMCMVNFYGHKDRVLGLKAL

SEQ ID NO: 945388 - protein, 107 aa, Homo sapiens
MNSPWGSQQTDHGYIRYLRCTDDACHKHIVGGGNFFLYVELDLIACFEAHFNLDQSPFYELLSYDKARILLFQINAEPWQVKMSLWKSTLSEPVDVCTGIACAGHLI

SEQ ID NO: 945389 - protein, 193 aa, Homo sapiens
MGPDTVWRVFRTRGPRYRANNEARYPTDTLLCPDKLRKRASHTVPGTTTPKNLHSLTRNYGEPWVTNRCELLGKHQSAQTFPCHLQRERPFQGASFDFHDIYQGKGFTLWRTRGLRTHWSCQSSNTVAEFKKTFRRAGSLALSKAVSKASRRRGTDALDFDILEIQTACSDVCCVPRHTDLYPEQVLGHSQRP

SEQ ID NO: 945390 - protein, 90 aa, Homo sapiens
HEGKPCQRQTRREPDADLWRDALRDTSEELRYPRQAPQEFTAASGNFFFEPNLDINNFLGKGKERAHQKRTSKRAPQKDWSQRNELFRNL

SEQ ID NO: 945391 - protein, 157 aa, Homo sapiens
HERMSCATIEHTGYHVSGARTHFTHADMSYLERERIVGPFCGGPKAHPERYGYQRTWSWLEGLIAREPWAQCATIESRDQGFWGFWWAFGAVEGISERIWIHTNGHVNVEVFAEELRYTAVAACVGTGVMVGIPVKLGTFGQAPFLPVSATLRGSGP

SEQ ID NO: 945392 - protein, 143 aa, Homo sapiens
CCVQTCLCLRPYKATDLTFVERTMCTVGLENTNSGTKLSDICDTETRYIGDTLRSGAISLIFSLKEKVGAMAKALRLIEEKDVNLDHIGSRPLRLKKDEYEFFNHLDKHNLAALTNIIYNLKDDIWATVHELSRDKGHTALCP

SEQ ID NO: 945393 - protein, 197 aa, Homo sapiens
GTRLLRAHTSLCSGNNLNYILPGEHRAWRTIGFARRIYEDSEAHLQLQGFYEEVANPLVTGVEIGVPRERYSGPYIQNTYQHFYQGSENVVAARLWDQDMNRFKAEVKGHGATNELTFTEERDLKEKEKGLHEPDYIFGNYIERVCAYLTIEHMLEKRKNAHVEEENLTGRPCTCASRSLCDSTELNGVTKPEDNAD

SEQ ID NO: 945394 - protein, 139 aa, Homo sapiens
IAPSVPTTIHVCKDTLVGALLRPDTIDLPLRILVLTQRAGAIIVPEGLTIQNITGQTQSRFDIRRTENSGAAENPVTVHATPYATYEACRMILEIMQSEAYETTLAGQSPLEILRHTGFGGRLIGECRPLKNIGHDSGP

SEQ ID NO: 945395 - protein, 74 aa, Homo sapiens
MWKQQRTYTQCQSPGCAIGLSGHVSNEHTLVQEQTLKRFEYRLVCTFCDLRNPKPVRKAFTLQHMMRLALVVCA

SEQ ID NO: 945396 - protein, 108 aa, Homo sapiens
MGTCVCQIVFVLFPPFGTPEWDHEDDANLMFITMCFCWHYLCGLNIVAANYSLGYWLLTRMKRHGRGEIIGIQKLNSEDTYHTALLSGSHEEVSRDAEGADVPLRQLE

SEQ ID NO: 945397 - protein, 113 aa, Homo sapiens
MACCLPGEYGGYANDKIRQLTKMGPTALLIELEDWRRHKVKAHYGGTTVHNVSNKYQISQNMFTGSSRHALMNGASHPMADNRTMSTHNSMFFITCDRDNDALVDITFQTSAF

SEQ ID NO: 945398 - protein, 34 aa, Homo sapiens
MCIAVTYDVKRILWVHGVSKGVSHEGAVECIRLP

SEQ ID NO: 945399 - protein, 224 aa, Homo sapiens
WVLWHFNIYLSIGNKLRLLGGLGLNTFECQNKNFPRGPLSIFCEKPAARGRGEGAPFLLSGPPKEQRVVNLHTHDIVDKLVDNVDNRSTGFALPRMSPKGTYGLKSKLDHLGIPKVCIDVADLSKVKNEAHMNIVQSVHMSVLNNSEKVIKLLGPCVLEAKHMSIPGEVELNKRCVVLIIEAHFECPIVMGQVVNASYMIIASSPKGVTSIPEASVDAIKQRLS

SEQ ID NO: 945400 - protein, 96 aa, Homo sapiens
MFLGSTAYAALRTRLHARERTFDYLLPTLTTGVTFSYTSVGMPLGDCYAPDGADGACPKGKPGHYIGTERDPGYYCSKYTYVCPNEIRILGRGRYI

SEQ ID NO: 945401 - protein, 58 aa, Homo sapiens
MVAYVVTYCGGSQALANCGPIFRTILFPSAKGFDLRIPPYSYKPSLGLCRPHELTLVL

SEQ ID NO: 945402 - protein, 130 aa, Homo sapiens
KVCILSLLRSTYSAISTVTVFRLCKRVKRTAWRILGRVDPLTITNGVKVEQLEHKPIGRCLMILTNEYWNIDRPYFGERLMRVIDAEVRSYATDLGRGSIYIRGNTALQDCASSTTGLTVAFTGCWYTFP

SEQ ID NO: 945403 - protein, 122 aa, Homo sapiens
AQAPQSATATLKKARYNASVPGDHTRDQALYPQDHRKGQSQEREGKGLDAKPGCQGAPVGHGACATALPLPRPRSDPPVRFCELGSLNQTCPGLCLLHCRPTPKCPKWGRTRDSVKLEPSSL

SEQ ID NO: 945404 - protein, 106 aa, Homo sapiens
MYTVERGGNLLTFFPGGGRFTAEPICLSTVTDDGYHTHLHTRLVGLGASWLHRRCDVGCRQGALSDTNVEEVNGSCNISERRAILCRNQGPINEQGKGPACLLAHL

SEQ ID NO: 945405 - protein, 69 aa, Homo sapiens
VIPSLNFLSSWITRVRHYTQLIVVFVDNTVFHHVGQADLKLLTSNDSPTSVFQTAGITCDNHHAMAVLK

SEQ ID NO: 945406 - protein, 35 aa, Homo sapiens
MGSAISLVKVFLWDSELMSRYGHRVLELWVFWGEP

SEQ ID NO: 945407 - protein, 111 aa, Homo sapiens
LIRVLEQSRHFVMRPEINTIHLDTRQGQLLSEMCILIGENDTFGAETKKNCDLNENIEKEYCIELLEASYINTVVYEYLVETSIKQSSELEERDALGVRRAAQRPLAELVP

SEQ ID NO: 945408 - protein, 131 aa, Homo sapiens
MTCTNGTSKGEGEEGGAGHQTRTSSGCRERMYLVCAHIFAFFNGTFVHVTDLSGKETIWRVTWWDEGKGGTEMNPYHMLVWWLATEVAQRCKELGINGLHILRATGGNMTQTPCDLEAQTGLRDLGRLGMS

SEQ ID NO: 945409 - protein, 125 aa, Homo sapiens
GTGFVPIARLTEEAPHLFVARAPRCSDLSLCIPCGNEHRRDATRLWLIWGKDPSGPRRVPGQVSAPAFGLSHPGGEPPSTAESLCTAPRTGGAGLSHPRTCSHSQRGERWPRLEPGSPTSPPHPP

SEQ ID NO: 945410 - protein, 69 aa, Homo sapiens
RYYGLYVIVYHTRVAETHSHAMTARSDTEQVRQSVPEDNRTSVVVFHPVQLLIARLPRMVATYLAYAQR

SEQ ID NO: 945411 - protein, 77 aa, Homo sapiens
PEANQRPTCNGSDMLIAKVIDASTNPVKKLYLDQTLIPVRRISSLNHPQCRKFTMNPGKYAQSLQCQIAEQIRKTIG

SEQ ID NO: 945412 - protein, 33 aa, Homo sapiens
MAKDEEDLELSTQLSLLPKDFQCAYNVGGGAPP

SEQ ID NO: 945413 - protein, 128 aa, Homo sapiens
GLGTPTAPLCADCAVDSLVERCVDLEIRGFNTWEIWASLWWLVVWAKGRSKASFHTVSDELVNYVNRDTTWEGGHTLYNADMSYLKRVCGTLLGGPKAPQRVLFTEDLKLLEASMHGNTGHRVPPFEI

SEQ ID NO: 945414 - protein, 112 aa, Homo sapiens
GNTVSADHNSDVYAHDEMGHPEIGDAIGRVKEVLECGIGGKCNRGLTVVVAFPELWEPREQDAVRLQRARTVGCGVELLQGFFLWGDDIMDSFLTRRGQICWYHAGRGFGCH

SEQ ID NO: 945415 - protein, 92 aa, Homo sapiens
PGCTNLARGRRKMSVAAVADTSDDARSLADRSHQGPRGRGKRLTPTLRRSKWRPKPRLCTDTPYRRTEPGVGHLAVCAQRPQPPPVESSWIK

SEQ ID NO: 945416 - protein, 131 aa, Homo sapiens
PESGEGGAAADPFTLFSHPLLQTCFYGRVKHSLDIIDPRTLFVTEGRHGCDLSGPWAFVPCDFRICGSLREGEDGGVKRIWEVRGERKVTSLYLELAGYGSVWLSVSELIHCAVCSLHYIIWISQQPSDRF

SEQ ID NO: 945417 - protein, 120 aa, Homo sapiens
VLNVLPPSHAIETTAHSTPDTCYRLAYTMTLLYEMCHAPELIEVIIALMYLTILAQHSWYWNTLSYIILLLESHSYMCATRTDSYKITIITSDSATTKENSLLLLTKMSPVSIRQSLESS

SEQ ID NO: 945418 - protein, 73 aa, Homo sapiens
MCSIEHTTEILLCLSPGEVASLNEGVKFYRNKSTGKDYVLHETTSRLMSCKNMCMHHGWLFITDIADLAGMCG

SEQ ID NO: 945419 - protein, 102 aa, Homo sapiens
DDYETGRYGTGVFDQNEYLRYQEALNELATADNARIESSQRHDQTAVKDLTQVPEVSPTTMQVTYLPYSQRSKRAKHYLELKSFKDNYNIIVEYSVTELNDS

SEQ ID NO: 945420 - protein, 82 aa, Homo sapiens
MAAMCSPNVLCDDMRKLKARMHQAIERCYDSSDDCEGYLGDSDWLIMTSSTQSSHVYLEQNEMCYGAEATSTVHDVDESRTR

SEQ ID NO: 945421 - protein, 214 aa, Homo sapiens
PGCRNWDRAAVRGSMQMMAVLATVPGVCSLFQIRTSYRQAQILCVEALVREQWILTVRQNVYYRGAYLGFADPVYYDLHVFSMLSSEPCAHGLRVTPDQSQLISQPYATKDYAGSELTLFQIPLLAEPGLQRGPVALMHDVHLSFQLDLLELERPESLNQSVVLSCWRLTDMWSLQGPSVREAAGVRPTVVDTDLRHVADSETCTEGLLDLWWP

SEQ ID NO: 945422 - protein, 137 aa, Homo sapiens
ERPEPAGAWTWVTHGPIREVCMARSGSDEDAPEQSRNHDRRRLQERGEERHEAELITDSDSTVHLPERRDHGHVAVGRKLQIHVKMRMDHCTITEHIVDVLHMHYTQKLEYGTDYDEMADYQPYDFELDACQVIRAG

SEQ ID NO: 945423 - protein, 141 aa, Homo sapiens
QTRAADDPAAAMAMLRRVPVYAAHPTPFGAYGGLLKDFTATDLSEFAATAALAADKVGPETDDREIMVNDLQSSSDAIYYAMHDRLRVGIPDETPALTINRICGSGFQAIVNGCQELRVHDADVVLCQMNRMHKPMLTVSC

SEQ ID NO: 945424 - protein, 68 aa, Homo sapiens
MRQGLEKEPGVMHVTDVDTYSRKQTGPRRMSDHYRSIGHAHGTQKALSSIRVHLRNWYSDLLLTDVYR

SEQ ID NO: 945425 - protein, 134 aa, Homo sapiens
EEHATFREHTLIVTIYRCAERRFRECIVAHYNYVPQAETPVLSHTTYMRANSCAFYVMGYTDLCDLGQTELKPLKPPEVSYDRLLGCTPICILDSVKTNQIWLLNYRGCRLLVVRDLNVISVAFARNTLSPHVW

SEQ ID NO: 945426 - protein, 108 aa, Homo sapiens
MCTPRGVRLSAEARTQVEVLRRNLFQEAVEFLYRILPQLTFLRAPLDIPIPDTFTQEMMRRKHDKPEKKEVPKCGFLPVNEKVLCLFGLCKPQVWTLRVRSVEYMDST

SEQ ID NO: 945427 - protein, 30 aa, Homo sapiens
MDNSSNPILETILTIGFTNSMLDQDIPGAA

SEQ ID NO: 945428 - protein, 81 aa, Homo sapiens
MLHTPGLSQTLTPGHTRRPCAVSLFACERSFQTSWARGALRLFVYPRHMHQIPYESRFVHKGLDPSGLFHIASTKGRVFGL

SEQ ID NO: 945429 - protein, 122 aa, Homo sapiens
VSASVLCETGESSLSKLCGLYFRALYREDMCRAQTLMNVYMTARVLLYCGPNSLAWTFQISESFNYMGTNWIPIGHREEPKWLKDLTGILFNQCWKDALYLSEATSSFGIDVSLGVEHVTLM

SEQ ID NO: 945430 - protein, 114 aa, Homo sapiens
MRPVLREGVTSIPAAFCLSDSVDLVVTWECWLWRIPDMTYYVSLAHTDTTAACRIVAHPSADAARVIELVKIMLHAYARVTVANICAVGLRLHVDTAMYYLVYYKRCCYVLCIL

SEQ ID NO: 945431 - protein, 70 aa, Homo sapiens
ETLAEDALLTVTNMKLLAATVLLLIICSLEGAVVRRHAKEPCVESRVSQYFQTVTVYVKDLMVKVKSPQL

SEQ ID NO: 945432 - protein, 82 aa, Homo sapiens
GGGTETPVGCEAAQHGGSTKRNYLLTAGSSHLIIKDLGEIHSWLLDHRPVIQSETRYFVKDFEDKRGLREMRDLENLKNMIH

SEQ ID NO: 945433 - protein, 202 aa, Homo sapiens
DLVGELLGDARSSAYNHPKHMCTDYIDRGACVGVYMHTHTLYIVSVCVSHSLLLSNKRDSVHSCLLEEADYATLMGVPDSIHHSPKTGVVRNSLEHNTDSELVRARDTSSPIARALETNLLRTDALKVIDRQTNVPKAQGRSGCVYIHIQVRYCFVMRWTLDEFISIHPRVLLSSYEQHKLMKSANSVTDETAGYNYRRVSL

SEQ ID NO: 945434 - protein, 70 aa, Homo sapiens
ETPGFHCVCVGPKNKGGGTTVDLPQKKFLRQKIPTWTCNQVLVNKASKAGFQSPESVLPASIFSFAIIKS

SEQ ID NO: 945435 - protein, 128 aa, Homo sapiens
EREREREIERERERERERDRERDRESHRDRERPCERLTYFVPFTLFLPVLLSPSIHHLSKCSFCHVVFLTIVLTASLALISSCSLSCSLLSLMYLYILPRSFSIFSLLSYFLCFGYFCLLMTSFCLFS

SEQ ID NO: 945436 - protein, 118 aa, Homo sapiens
VSWSFHKLQGVNDIEEGFFSARGHRPLDKKREEAPSLRPAPPPISGSAYRTRSAKAAVTHKIEKEKPLMLEAVFTLTHTCMRCVLQDVSLHEALLQHGPIIHSADELIFNVEAVQPAL

SEQ ID NO: 945437 - protein, 102 aa, Homo sapiens
KGPSSRGRLAGAPEAQVHANRTLRVQVNDRSHAIERSLDHQEGPPGVDIILVVCGAVVLMKGAVPTLFFGFTPQLQGRFLGLDPHGEEESPSLQIKKAGVTL

SEQ ID NO: 945438 - protein, 83 aa, Homo sapiens
MQGQAPEAALLLPGEAKCPGRPQILPSELQLHRPAGGFHSGGPLWEIQPALSDGRVVIDLPSVRVCRHQTLMQIPRAPTGRAG

SEQ ID NO: 945439 - protein, 120 aa, Homo sapiens
REREREREIERERERERERERETSTTPQALAAFHIMGSRLFPPFACSVTALALTFAAPDIPALSATPSALTSVHAHRSHNTFFNCPDLSAFLLMYTSRIHVLVSTELHEYLIPPLSMDSY

SEQ ID NO: 945440 - protein, 110 aa, Homo sapiens
MHVRGGGTTRTLTPDTMSTKQITSRYSMHSACREGCQCLFSHDLANSRPFTICMYYQKGYCAYGTRERYDHTTPSAAAGGAVCTMDHCVPYPSLHNSQPSSEGTCVHCED

SEQ ID NO: 945441 - protein, 109 aa, Homo sapiens
PPGCRNWDQACVELGEKCARCVVDIVDDVPGAGRLYAGALSQLIELKLYGTAETNEGMTYMIGSDCMDARVVLHVYAAISAGRTFYADSGLCRIGACVLVTRSCDHIMG

SEQ ID NO: 945442 - protein, 163 aa, Homo sapiens
MPMTTIAVSWPRRKHSHNTNRITCIKHITIYQMYTNYIHEMNVQHDHALKNTMLSLRKPHLYTHTHTLPLPPYGMVIHKVSTWTHTTLTLLSTETDSHTTETTRTDAHSNHDYPPLTATSMKHDTPRAIATCNYDNYTNARVYLNSAAATTHTHTTTLEGHIT

SEQ ID NO: 945443 - protein, 106 aa, Homo sapiens
FLPDEETSNTGYPRLMGTNGKGIKCIAGIAKKANRPLSVEQVKVAPTTAHEVRIQIIATSLSHTDATEIETECVGLALPVIGHHEAASVRDSFGPLVTNVPGDRGS

SEQ ID NO: 945444 - protein, 101 aa, Homo sapiens
RAACIGHRMARSVCAQASGGPQVRKRETSSPGDECLVCHCTITSLSGVNLTSCKAQSVSKLMFLAVDEDHEYCLWYRYGVHAEYHCPVRSVIERTAYIAVC

SEQ ID NO: 945445 - protein, 104 aa, Homo sapiens
MTDIALPYIRSCDPRHVLCQESTMCMTEDLDSLAIEPIGDIQEDRWDIYHTVHHVCVQTHNVAHTGETVFDGYETVTGYDESVNCRLSHADMHGALGFIFGLST

SEQ ID NO: 945446 - protein, 122 aa, Homo sapiens
MHSEYIAQRTSLPYSYPQRRTSEILKRSKRLTLTAEHDCIVEDLELPSEFAGRRQHVRLDGTPYHTGSFRQSTDERCWYTRFKRFSDATTTFTAYDASGVPTFNLLIFMTQLEVYNHRCFHL

SEQ ID NO: 945447 - protein, 140 aa, Homo sapiens
LDWTDHPESDHVGYHGLNVSLDGAQETGCISKSDASVYYELYRCIANLDLHQRCLTDAQTPYPILPCLMTVNNPGQSDICQVKHCRHREPCHFYHIERLISSLHTLYVRSTSDCMYAENILMHNSKVLIPDHLSLIILEG

SEQ ID NO: 945448 - protein, 188 aa, Homo sapiens
PPLHLYKSTGKKSQESRDLIKLWTSSLIDLSRLSTPNHKNIIFLAPHHHDFKNCPQLGSKALLSKCKRTEFIQTYLSDHSAIKLELRIKNLTQSRSTTWKLNNLLLNDYWVHNEMKAEIKMFFETNENKDTTYQNLWDAFKAVCRGKFIALNAYKRKQERSKIDTLTSQLKELEKQEQTIQKLPEGKK

SEQ ID NO: 945449 - protein, 133 aa, Homo sapiens
MTSAKHMLTSPSLVTLKGKRIEPGGYPYAESEFKEHELKMLHKLTHHSVTGCSLGPGNLLASGTISGPDPENLGSMLELSCKGTKPIALGNGQSRKFILNGNIVIITGYCQGDGYRIGFGQCAEKVLPALLPS

SEQ ID NO: 945450 - protein, 201 aa, Homo sapiens
EEAMKQINDYVEKEYSRVVDLVKELDRDTVFALVNYILFKGIRERPFEVKDTEEEDLHVDQVTTVKVPMMKRLGMFNIQHCTKLSSWVLLMKYLLIVTAIFFLPDEVKLHHLSSASLHLPRLCITGTYDLKSELGQLGITKVFNNGADLSGSQKEDPLRLSKAGIRWADIDRERTEAVGPCFKRACQCYSPEGKFNHFGFW

SEQ ID NO: 945451 - protein, 121 aa, Homo sapiens
MTAIRSTRPWTDSLRNTIGTTVRFPKRGTVVAVFGDMPLEAGNIYLSPGGATQKIGLLACLPELCYLSYNPTPLGGASISVGDLYVDEQWILTCRGGSPPGEPALCLETKSHATLNFPQRS

SEQ ID NO: 945452 - protein, 203 aa, Homo sapiens
TRWRKGVCEETSGAYEMESYADHTNYDEHAIFLTKKFSRHHGPTITAKLYWRAAYLRETLLQDFIAVAHSVGIPEDSIFTMAEEVNEFLGSENQSRILIRRVRRAVLPPEEEGSGGGLPDTEVTKREDSCHLVYSIDPCMEDDQDVILYSYIHGQRDSPVRRLDEQRQQLRNSGEPCYLPLTEGARYYRISAPQPTLMHLWLL

SEQ ID NO: 945453 - protein, 71 aa, Homo sapiens
DNYSTLTADCLFKVVFRSTFYTCLALDTHNLYILATLTTIEMLMATILIITDSIEHASKAVLLSIVRVTNI

SEQ ID NO: 945454 - protein, 242 aa, Homo sapiens
AIASDSKLSQSAFGYFMTACAVIILTIICYLGLPRLELYRYYQQLKLERPVEQETKSRSVQTCNSQPTNESHSIKAMLQNMSLLALTVCFISTITIEMIPDATVERKSSIAGRSTWERHFISVYCFLTFNIYDCVGRRLTDVFMWTGKDSRWLVSLVLSRLVICHLWCCATLSAAVLNLVFEHEGWVIFLMACFGVSNEYLADSDFHSAPVNSARRPPNHLAFFFVLAWAWGLFLLSLPALV

SEQ ID NO: 945455 - protein, 95 aa, Homo sapiens
MLAWNLLEGADDSAYLVRRICDNQGSMCSKLKECCERPLLDSTALSKSSADACTYAEAEDDFLGMYLCEYARRHPDYSVELLLTLAMTYAALKRV

SEQ ID NO: 945456 - protein, 30 aa, Homo sapiens
MIYCVFLHPYAIRCPGYSVELLLTFAWTYG

SEQ ID NO: 945457 - protein, 131 aa, Homo sapiens
RNAAMEICMNVLDDRADLAKYICENHDSISSKLKECCEKPLMEKCHCNVEVLMRCLLTEPSLAAETDESKDVCANYAEAEDDLLGMHLYEYARGHAEYSDALLLRLAKTYETTLEKSCADADPHVLCQSDC

SEQ ID NO: 945458 - protein, 55 aa, Homo sapiens
MVLYAFYPYHAFTDHVQLVRGYDTAYHRVSHVIYISLSTLLLLESKRILDVDTLD

SEQ ID NO: 945459 - protein, 102 aa, Homo sapiens
PKQSDYNVIEAYFNSLVGVYLQDEYTYLYVLSRCRHRSYSLYKTRSTFSDNRPRRPMMTTSVSLRRKNRATYQLSFKTSRLHLTMNHLLTQHTIKASPALAI

SEQ ID NO: 945460 - protein, 90 aa, Homo sapiens
MTYIKLYSSHPVGPIYHPMEDLMYVQEKENILLRISLRTSTALTFEQTIITMNAHGSSTLTGGVARDPNSSYTGCCTIHWHEIYTRGGAV

SEQ ID NO: 945461 - protein, 109 aa, Homo sapiens
WSPGSRIRAQATKSLEKKKAGKTKPGPLSLFPPETRAPNSPQAGGERFPAWMNMPFKSLALSSLGGGGGKGSPKKKFFANNNRPSPGGHERKLVPKLQNSKRKNRGARL

SEQ ID NO: 945462 - protein, 213 aa, Homo sapiens
MATPEAAHADKLLRALALWPRLLSAASQAVQLTSRCWLNLQEYQSKILMSDNGVRVHRFFVADTANEALEAATRLNAKEIAIKAQILAGGRGQGDFITGLNGGVHLTEDPTVVIQLTKQMIVLNLRMTNSDGVVNTEMDAEASNIPRDSYLAFLMDRAVDCSRAGRYAPVERPHWRCLIQTRSSVFRSRLTFLMHDGHASSPDGRIPRIRWPL

SEQ ID NO: 945463 - protein, 126 aa, Homo sapiens
GERERERERERERERERERERERVRELVRATFPVLPLRLHFPLCVFHLSVRSFTTLTIFAADPIVPLHAISESCSGDILYLVFNRLCVFHPHCSLLYSSFPIFPNFLCSQATRHIELPSVMTTYPS

SEQ ID NO: 945464 - protein, 102 aa, Homo sapiens
MPCAEDYLSAVLNHLCVLPEKTPVSDRLTTCCTVSLVNRRPCFSALEVDETYVPTEFNAETFTFHAHICTLSEKERPIKKHTALFELVKHNPMPRATESFFW

SEQ ID NO: 945465 - protein, 82 aa, Homo sapiens
CTNIARDVIEGHTLISLYTERVRYTNRQHYCHEYLLKDPLILNVPPGFQFCAYGQHAALKHRWAPWFTHRMYRHTCSLSSDA

SEQ ID NO: 945466 - protein, 123 aa, Homo sapiens
EEPYGLSGSELLLLTLAVLFLTEVTLDISGSKMNPSRAHVIELKDLDTVNVDELKDSGRYYVPQLERFDFGQLNLLLDNWDSVTYTFNKLSEQLEPATHEFWDNLDAKVQAYSDDILTVAGGD

SEQ ID NO: 945467 - protein, 124 aa, Homo sapiens
MALLTGFNNNVAVTDKDTFEFKHISLIPGKHTDMSQMSFLSSEVLVGDLMCPFEQSGLGAERKPRLLNGYLEGAKHFPQGFSSDKAEGAFFQWLAVDGLGNACNNSGGGLLRDRLDVVVDHVRC

SEQ ID NO: 945468 - protein, 56 aa, Homo sapiens
MAETVGSFFMAVIHSLKNGPRATHLFHFIGFNRVKPRPDDGITHSDMIATVARSYE

SEQ ID NO: 945469 - protein, 209 aa, Homo sapiens
MSTKCGNMWTRLLHPSGGHEKDTKEENGYLAWIYRNTSTEGPDYLATVDGDPKASQNCQVIHRLAMPNLKDQLYYLRGNNCSSWFGDMHQVAHTSWCCPDSSSLCIYVVDMGSETRAPKLHKGYEPKGIHAKLRTGLSSHQTLAVQTGSDDQIPGDTKGNGKGGFVLLDRETFEVNGTCEPVGAVPLAMTFGTRLYTVMSSTVEGRSHV

SEQ ID NO: 945470 - protein, 166 aa, Homo sapiens
MTPGGRPCQSASDAEGPSGKRPVSGPFGTLDRSPKSANCDNCGTHIGLRYRFEAPLTWPFVRTHHPHQCYILACRRGWSRHIGEQTLACPGLQISPVPLTILCRAVCVNFVPRRGSPSWVLSVVPNVFRGGPPSWVPSSVIYLKSPTPHTECDLCLSRSATFGGPV

SEQ ID NO: 945471 - protein, 207 aa, Homo sapiens
RAVGVVDHDSVCREEKHNEHMWQQRLLLDKGPHSEADPLCSVNPKALLKDTGPLRNFLLPGLRMHRKTFTRGGDAGGWGFEVPGSKRMPHTSCRPQRPCRRNRNGLSGGGSVNGLNGLHVDYLDREQSESDRPTDQCEGSHGGVRVLRFCAFQAFTGLWLREATMTHSHAETQDAMHKDRIGHTQTLRTYMCQVESYTLNVGARIIS

SEQ ID NO: 945472 - protein, 224 aa, Homo sapiens
MIRDAAYLRSKGDENPDLKYAPMRISAEHTRSTPAAVYAMRSNHSFLGSKGIGGKKSRTESRALAGPNGEAGATPGLTFHSNPLSGFKLFGLVAHVFLLGFITLELVGVELGVNPRNMGRQVRKGLSAVIGLGVGPQVGGFGLEEGGVGFVHRRFAFGGDALELSMWPTVAMIGVITAIRLARLSPLWWACSRGVFDMFFRGAVDFEGFDMGACMGIRVDTYPR

SEQ ID NO: 945473 - protein, 87 aa, Homo sapiens
MTNYFLRMIHLSDDNTKCYIVGADNVGCKHTQQMPMYLRGKGARLKGNNTMKRKGIRGHLVVVTNEDLTEISDMWVANGSQLLTVLV

SEQ ID NO: 945474 - protein, 139 aa, Homo sapiens
MSEPIILLVTGAGAQIAYSLLYRIGNGSDFAKDQTIVLSTVWIITPMMHVLDSVLMQLQDCALPLLKDVIATDKEDAAFKELDVDILVGSYAKKGRHVEDLLKADVKVIVVAYPHNTNCLTACKSAPSIRKENSRCLTR

SEQ ID NO: 945475 - protein, 135 aa, Homo sapiens
AFGTMECVTYITLLCLCSSAYSRAAFRRDAHMSEVPSGLDESEKVQSLGADMPSLSLFSSVHQASIVQSVNEVTEFDSHELLMSHLQLYGKPMMKWMTAVHNKNMRATHAYCSTKMTTHSSRDWRDQRMTLCHCF

SEQ ID NO: 945476 - protein, 105 aa, Homo sapiens
MCLSPGAFRYLPQEKMELRPPCTLANSMRTARSGTFVTLKRLGVCRASDFHYQQFTILPWTACGVKLPTMWVQAFISHDLPELCLMNQQSDTLYPLNRNFPLSPH

SEQ ID NO: 945477 - protein, 75 aa, Homo sapiens
TVSISPVMGPGQEVEKARTEAVTEAVAEIVDRTEATIAVPGTIKADPSKGNSASPKAHTLTHTEFPVLLEGALLL

SEQ ID NO: 945478 - protein, 111 aa, Homo sapiens
HEETLHTDYIDYMDELSSFIVAQPNIPWLFLTDPTLAMEVYCGPCSPYQFKLVGSRAAATARYAILTQWDRSLKPMQTRVVVRLHKPCFFLHWLKLYAIPILIIARVLVLT

SEQ ID NO: 945479 - protein, 105 aa, Homo sapiens
PLLGLCTLCAHNGVQLSDAHSSDGDHRFKDPGDHNLMTCLSIAFAHNRQNRSSDDDVQLMHAVTACARTRAGAVSITSLLATYCEELMADEQHTPDIETLVAATT

SEQ ID NO: 945480 - protein, 114 aa, Homo sapiens
MDICSNVLMTGRTLPSLSVKIKIRSTSKLKECCEPAVASHCIAEPGTDVRNNYAEAQDDDLGMTLYEYARAHLDYSVWLLMTLAWTYDATLDKCCAAAHPHECYATECYEFSFA

SEQ ID NO: 945481 - protein, 68 aa, Homo sapiens
TYTCVLWIMSPMLVDCDYTQTFSDVCQTEHVKHKVIVSDRPRRHAAQKRYALLGWLTHEGSEMLVVYG

SEQ ID NO: 945482 - protein, 92 aa, Homo sapiens
MSMAAGMDYRDGTTQNRETCVAAIVAVLLEPGHYTEYSCGGDLAVALLTLQLNNGDEVIRSIAANVEIDRVQTDCMQGLSRILFNDDDEFRD

SEQ ID NO: 945483 - protein, 134 aa, Homo sapiens
MGRDFPYSVGDPSTRGVSVDHKYTTSSLGVMRRKGVCPSFDSVQSDQRHSFQAGGSSSAMLQPMLDNQVGSKNVPYVQHGTLSVNRTMRMVKNVFVYADHRDVYTRHARRICIVTQQGIKEENCFLKPGQIWAI

SEQ ID NO: 945484 - protein, 94 aa, Homo sapiens
MLNSIYQWPEHSELTTLGVDGKEFPEVHLGQWYFIARAASTKEELATFDPVDTHCLQYGWWLCPDADPPSCYHTHEMGSVCPGGSTTWLEGAQS

SEQ ID NO: 945485 - protein, 82 aa, Homo sapiens
NVHGHSMWAHMTQSCEHTTHTNLWLSALYPKSDRPEDRSQVQRVRTPALTTEFGEAQDNGGFGESLHKVYAHIGPKGTGRKI

SEQ ID NO: 945486 - protein, 112 aa, Homo sapiens
AVHCGEGTHSSISLHVKGSFRVSYSKNETYQLFLSYSSKKVAMLCSQQPLWMILKLWQLPMERENILAFWKPMELTSVALGLLEDSMNSYMFWIKPPRSAKALDSDMRCPGF

SEQ ID NO: 945487 - protein, 151 aa, Homo sapiens
EREREREREREREREREREREIERARDTLCARYPSFVLLASSLPLAYVSFPPLLSPFSVHSLCLLLPSSCSLSSTFHSLFCALLHLSLLSVSHARFLPSISLLSGILSCLVLVLICSLCLSFLLCLFVLFLLLSHSCGFLHTLCFSFLVCP

SEQ ID NO: 945488 - protein, 132 aa, Homo sapiens
PCLILALLSSLADSGFPRSPFRLLGKRSLPEGVANGIEVYSDLNFKVTSRFAHNVVTMRAVNRADTGKEVSFDVELSKTGFITNFTLTIDGVTYPGNVKEKEVAKKQYELEKFTVSGNVAVGSVTFELLRGL

SEQ ID NO: 945489 - protein, 130 aa, Homo sapiens
TKRALSTLKLWLNTDILSSVGIYNLGHKALKPPPIKLYWETQWTSGNHRPGPLIHSTSGLVLAIDTKRAQIYGRRQIILGKEGTEELKPVDDPRLMLKGFKAVVPVKHHYLRAFLFVYPQESLVNGSAPC

SEQ ID NO: 945490 - protein, 122 aa, Homo sapiens
MSPRATIFASDTSVSTIAYGCVVLRDRNMGTPRDIEMLLARSRRGRSAKALGQGNTVVDRGGSNPGAVGAHGTRCRLAPQGPDCGPGVEHGQAFFLWAEDTMDSYRNRPGHEWWVSPRGFGA

SEQ ID NO: 945491 - protein, 81 aa, Homo sapiens
GYNKANVGHLKNPLVFHEENPYRDIPIPQTHNWRSTAPPPGGYRPSEQRDIILHIAQCTCKASLLFKSKSPHVETSTTVLC

SEQ ID NO: 945492 - protein, 105 aa, Homo sapiens
MSSLESVRMVAFVTCGDMTRQDVLAWVSSEALHPCCRALTRDLEFLILVLSRPFTGWLYLICFKEVDLLMYEEWDALDLKTKDRCQRAALALMCTAVAAADAQCL

SEQ ID NO: 945493 - protein, 142 aa, Homo sapiens
RERERERERERERERESERERLTAPQLAPDISLSSLFLFVILPSTSCPLICFSAFSIPCIPDPSGLFFVLPFYTRFFFTFDLSTLSSISFLVSFLSRSSLAPPVSPCILLFPPFLPLLIYLLFRPLFPSSSPSCPPFPFLFP

SEQ ID NO: 945494 - protein, 117 aa, Homo sapiens
LKRHLSETQSCSSAWSGSKGPLDQLEKGGETAQSADPQWEQLNNILSMPLLTADFHKEDTAANDWTPEGEEDDDYLDLEKIFSEDDDYIDIVDSLTVYPTDSDVSAEHVLQLYHGGR

SEQ ID NO: 945495 - protein, 82 aa, Homo sapiens
QRQTKREEKRRGREPPGPEDEDSTLDESDLYSLAHSYLGGGGRKGRSTREAAANTNRPSPGGHERLVTKLQNSERKNQGARR

SEQ ID NO: 945496 - protein, 110 aa, Homo sapiens
MARQHLAGSTLTEDKCIHNPEYLAERPDIEYRQYTTELMSYGLCVAERQGMENESVVMHYGCREMSRKQTGVRRLSQHYSETLLSITERMRCLSDDGDTGVNAALFNAHG

SEQ ID NO: 945497 - protein, 72 aa, Homo sapiens
MTRCCYFPLPIRDDMCVLCFQADIEIRNTGLNTHCALVRSRSEGYFYNADYYFLAGNDFMVPTVYAHLAIAF

SEQ ID NO: 945498 - protein, 78 aa, Homo sapiens
VSLDQEMFSEVCSPGGTSRVTYGTGPGSFYPTTGTDDALKDRKSDITSELSTTIIDVASMRIVRTVYGKFWILNYLSE

SEQ ID NO: 945499 - protein, 69 aa, Homo sapiens
GPSRGSPGSLVSFFNPQAQDGEEVFFANPKGSLILLLVQFVAQFFGSVSRPIIVGESRALIGITETFLL

SEQ ID NO: 945500 - protein, 114 aa, Homo sapiens
DLGHGSRLRIAENRYLTMHIFRKTLTDKTITLKVEPSDTIQNVKAQIQDQEGIRPDQKKLIFAGTLHLVLHLIGGMQIFTKTLTGKTMTLEAQPSDTIENVAMIQTRGISADQQ

SEQ ID NO: 945501 - protein, 140 aa, Homo sapiens
VTSAEIFPAMAGFQTHLGKAVYQQTTWIKALSRWLRIHACPEPSGAQDARDSVSSSGHPLATIAEKSAGRSFQGRTGQETEQVPCTYADRGVDCASVIVVTSNPDDLARILMHVMNSNAPIKPGIAVHRQSEEALSTPLS

SEQ ID NO: 945502 - protein, 70 aa, Homo sapiens
PGCRNPDQEEAMFVLSASERLRLVDHSRPGIQYQPCQHETLPTLQTQNQLRIAAHACEPSYYKTLMQENL

SEQ ID NO: 945503 - protein, 42 aa, Homo sapiens
MTRWTGPTDLVALLTLTEVDYEKHTDYVCDVTYQGLSLAGTA

SEQ ID NO: 945504 - protein, 103 aa, Homo sapiens
PRGYQDMRDSRVTFASDFRDAEDFSGPEYLVFMLKKKHISSQGYEYHEVSGRTRLADESRWCHNTSSKSFIARAETCGPAFMQLMDAPASFIGVTVVQGGCGT

SEQ ID NO: 945505 - protein, 130 aa, Homo sapiens
GVKEANRERRPYSLHCAGTALDRSCRPGIPASRWTRLPRALVVHMLTQLMSCGIMWPHCEEIGSESEAIEDSHMLSGAMNAGIQTPFQGGAREQLCESSSLVDTYFYLKERVIQLTLQRRKMAVFEEDDG

SEQ ID NO: 945506 - protein, 76 aa, Homo sapiens
SPGLQGIRHEASITQRFFLFLGVDLTRGPKPGECKSWSYHFTFLPTHNTVGQKSSINYWQKNPPIYILLGPFFPQI

SEQ ID NO: 945507 - protein, 59 aa, Homo sapiens
MSLCVAIPTSDSMKPIMTESMRSPVYYYFTSVLVVILRYLRATFFPRIAKADDRYLYCR

SEQ ID NO: 945508 - protein, 77 aa, Homo sapiens
RGLQDSGTGPIRFICMYLARTAMETGTACCKNRRECRIFVDFSLLKFYHTAVLGFRRIILEAEKMDRAASLGWPQCL

SEQ ID NO: 945509 - protein, 99 aa, Homo sapiens
LLDRNIPGGLEGAMCLYGDWDHRMVPTVETTFSSLYCLTREAASALYASTDQLTLYYLYIGGCWKPMPPYSFQDLLSLVLMMPLTIPLTYYFRLHSLDF

SEQ ID NO: 945510 - protein, 134 aa, Homo sapiens
DDHDVHMIRLLSLRIRYEVIMITRKNHFLRREPDAEMHICDLNRITALTVERPICGHLAPDEHYQTTCEALEAVRICANMNMVPSLCSESLHIPEALHPLHDVRINGACTAQLIEVFNRHAYEPLGLIALVGAH

SEQ ID NO: 945511 - protein, 191 aa, Homo sapiens
MDRSLDRGYRSGKNYRTKVLASCLGVPDAKIGIHDLGRKKDKWLSFRFAATWCQINISSCHMKRWSMTKFVPISTWYYVGKDGFHIRVRLHPLRVIRINKMMSCAGVARLQAGMLGAFVKPQGTVARVLIGQVIMSLRTNLQSQEHVIVALRRAKFKFSGRQKIHISKKWGFPTFNADEFEHMVAEKRLIP

SEQ ID NO: 945512 - protein, 171 aa, Homo sapiens
SCLIRKVVLRRKSSCEAYGEDMDSYKSRVPCVCPGTRRAAVATIQRSACLRPLYDCLLVMIVIPRLSFSTVQSYSTTSPTMSLNWLDMHKTTYWRSVFFMETLRMLFLRDNECRLFMQATNSGRGAITLMHTEVNGKDRQHVTVAMILECIVYQKVYTLTAVSLLNPAELY

SEQ ID NO: 945513 - protein, 57 aa, Homo sapiens
MMTPDTNLFEDLATVDWSNTSEGKSLASISIKLYAFIRTVAGNMTDVHAFDVGLRCC

SEQ ID NO: 945514 - protein, 132 aa, Homo sapiens
MGDGPPCTEITRDLVGCPTPLKPNTNQTPMQWRLILGTENPPAACKAWAINIITVGEVEHNQIPQDPLEPPDFLGTDRTHGRRKPKTKEGATSRERGNKHRPGGAQMAHWKTQHELPQTRKFGQTAPSSHSA

SEQ ID NO: 945515 - protein, 66 aa, Homo sapiens
DDDDDDDDDDDDDDDYDDDDDDDDDDDDYDYDDDDDDDDTDNYRIRELRRQPETAYYIYDYTSSLF

SEQ ID NO: 945516 - protein, 71 aa, Homo sapiens
GIPPACLGYLHPGGEHLVLPVLGDILRGSLIKRGARCLHRLIYQKYIIWGIIGPFIVIMREGAYWGQYGVC

SEQ ID NO: 945517 - protein, 156 aa, Homo sapiens
MSDESDMDKAIKETSILEEYSINRTHKLGAGISGPIRVCVKKSTEERFALKILMDRSEARNEVRLLMMCATHPYIGQIIEVFANSVQIPHESSPRARLLIVLEMMEGGELFTDAAENRTYHRSMPVNTTTHSSGSAALVVMGTDTSSLIDLPRLPK

SEQ ID NO: 945518 - protein, 86 aa, Homo sapiens
GAVSTEQTDASSLYSIVLVMASGYIGCVLEYGRLWTGRALIHYILSIRSTILAVRHTSNASLIGYSVREIFHNTTVYLSSNVNLEY

SEQ ID NO: 945519 - protein, 147 aa, Homo sapiens
MGALTPTNGQELGTPPKLSDGAWVGRVHSVHSPGAKIDSEELVSRKKKNTLDGFTGGGHKPVHPVKIKVGGSQVGLLTGKQGQPHGAGWPAGVFVAATVVASLGTEAFAVATPKPLFFGTRGAGAMPEKKKRHTWVCQLPWKTGKTR

SEQ ID NO: 945520 - protein, 136 aa, Homo sapiens
MALFVSKENKNLPRKKVSSKKANNKASCERYAQYAPGYAKARAVSKVVPPGFLCTAGVSPYDDPNTSRGDSGGPMIVHKRSRFIQVGVISWGVVDVCKNQNRQKQEPAHAPDFHINLFQVLPWLKEKLQHEDLGFL

SEQ ID NO: 945521 - protein, 35 aa, Homo sapiens
SCIHLSYLIWTITSNEEIWCPIVTYDRSCLSGRIL

SEQ ID NO: 945522 - protein, 35 aa, Homo sapiens
MGSNWITPRYWTVANSCFCRLVIVDVGTVLIYLPA

SEQ ID NO: 945523 - protein, 148 aa, Homo sapiens
MAQKIRPPPASKMLSPKSPELGLRKMSKETAFHGTDIKGESPGTNTRGRFPRKKKKARPKLKKRSNPGHRCSLCKMDNPSQVVKYFQHFSAPETIPTTATEIPNKNTRVKPQTGELVKIKLTRYLWNKAPPPGIESHGQPGKFKLDPQ

SEQ ID NO: 945524 - protein, 32 aa, Homo sapiens
MGKSFKRRKPMVLLPHIVTLNGEGKFAGAYNL

SEQ ID NO: 945525 - protein, 103 aa, Homo sapiens
KNFFFLKRGGGLNLKSPQKPIQKKPGPKGGVNQRGVWGQQTKPGSKGQGPPPKPKTSPPSPKKAFSSKGYQVFCQAQNSPFWGVGPNNEKGGPLGKRKVKKTG

SEQ ID NO: 945526 - protein, 99 aa, Homo sapiens
ASSVEYQCQNLYQLEGNKRITCRNGQWSEPPKCLHPCVISREIMENYNIALRWTAKQKLYSRTGESVEFVCKRYRLSSRSHTLRTTCDGKLEYPTCCKR

SEQ ID NO: 945527 - protein, 40 aa, Homo sapiens
MWRILTHALRNADGKGGATNPIRPLGEENNAQADRSHRGE

SEQ ID NO: 945528 - protein, 218 aa, Homo sapiens
IHTLVILFFSVSGRPLSEGGREPGESRNSGGEGPPIPLTPPSKKREPPPPPKALYHKKKKPPPEKISGSTGEMVPTVQHKDILAPAQATQPKNPTNHVPPYHPPKTPPKSTPRCSPRPIIPYHDQTSIHTIRSPKQTMLCAPPTRVPHTKAPAHAIAPSYNPNDSAAQTSHQRPPPQTNGNHTPKNHHTTTHQRHTTRHPRGYLNEPHPTPHNAPMTP

SEQ ID NO: 945529 - protein, 186 aa, Homo sapiens
GGAPPAPLKKPKPPPGFSEKKEQSKGAPRGKPGAQKPISKKKGKRPLNLPAPPQKGPIPGPQQRGAPPEKKKKTSPQPGGGAKIRQKRVPGEKTGPPPHGKDPLIFWARGFPHKPPGISPRETPRKPPPPGAPPKKTPPVSWVYAPPLEKKKKTPRISNWAPKKGGRKTGDTLSSGGKTPPPHLPH

SEQ ID NO: 945530 - protein, 134 aa, Homo sapiens
MGLTPEEVPHTGSKTGSDLNFDRRLEGILKGLGLREHFDFVLTSEAAGWPKRDRIFQEALRLAHMEPVVAAHVGDNYLCDYQGPRAVGMHSFLVVGPQALDPVVRDSVPKEHILPSLAHLLPALDCLEGSTPGL

SEQ ID NO: 945531 - protein, 100 aa, Homo sapiens
YKNLRENLGIPLPDNGLCREIYGLRPQKHSHQKPKLDKWDLIKLKSFSTAKEITRINSHPTEWEKIFTNSVYDKVPISRICKELILTSNQITPLKGGQRI

SEQ ID NO: 945532 - protein, 98 aa, Homo sapiens
MRGNNTTQTTVGRWGQTRQHLKIFAAPPPKEGQKRRRFRPKPQKNAAPPPPEKKEKPPPPQKKGGDTKPPQNNLLGGAHLLNQIKKQNLIPPKNVGRA

SEQ ID NO: 945533 - protein, 219 aa, Homo sapiens
LFYLSPKKKPHYHTPTPPKTPHQPTYNNTSQLNHPKPRPNPRTTTSTTITSKTPNPPQPLPPQSRPRHTRHASTLPRTTDPSPTLQYPPPPYPPKPPTQTTSTPSHTPPHTLTPTLPLHPTPPAKSPTPTRNPPNKTKKHHPYSPPTPSRPQPSPHNGHTLTTHPHTHPPPPPNTNPNNPSAPTPTLTHPTTPNRPLNKLHIITPYHHTSHTPTNTHTA

SEQ ID NO: 945534 - protein, 181 aa, Homo sapiens
NGNTTPSHFFNRLCHQSSFCRLGEIRKGPVPRKIGGTGMQGFPFKQGVFAHVRVRRLIVQEHSCSVASSPAERKRNPVCGCIVYANMSVRHLALVKKGPEYTPGVSYFTVPSRLGPQRANRIRKLVNPCKTDNVRQYVVKKPFNKEGKKPRSKAPKIQRPVTGCVQQLKRRRIAVKKQRAK

SEQ ID NO: 945535 - protein, 182 aa, Homo sapiens
PTKPYKRGPKIPPQNLGQGAPQKNPGLKKKKQKTAPPKKKKQRGPPKRPKTPRQKKGAPSQKKKKKAPPQPRPGEKNRKRAIRGKNTPHPNRSGPTQFFAAPVPQNPAAIIHPGNPVTLSTRGARQNKLPPKLLCSAPTLLHKTRTARHIIIGTPKRRRQHRYKVVLPPKQFFSPTLPTQCP

SEQ ID NO: 945536 - protein, 111 aa, Homo sapiens
KRGSAPSQNNSVFPPGVHLTNTVFPPGKQWGLGAPAPPFIGLGDHKTSPLPEGPFFPGVPVGPGWPLSHQFWSPSNIFKSICGPPPQGGVPSREGGPFIPPPPGRPPPLGR

SEQ ID NO: 945537 - protein, 130 aa, Homo sapiens
PRGVRRSKILGPPGAECPDEITCEDDPPQAAKIILFYKEQGVLEWPGGVNPYKDGFPPQAPQWGDNRRKFRPDGDTRFFRQKISFAKRGQLRKDFEGVWVREKYRFLFVGDGPGFLLGEKNRTGKPFPPP

SEQ ID NO: 945538 - protein, 98 aa, Homo sapiens
KSAAPRGPKRGGPPPVSPPPKVREPPGVQKFGPGARYKRARAKFCGQNQGGRYLEFRERNPKQQLQSQKGTLKGKRACISPSSKNKWKTQSKSFPLNL

SEQ ID NO: 945539 - protein, 176 aa, Homo sapiens
FPYPRPFVLDCNRNLFSRIHYAMFPKLDLPPLRDQTGAPPVCGRSKLVIPGLQDFGTSLVDQEARYAGYVVAPLNDGFETAPLSPGTSTQLSELIALTRALNFSKGKVTNIGTDSKYAFLVLHAHAAIWKERHFFTANGLSIKYHQGPGSVAHACNPSPLGGRGGRITRSGDRDPG

SEQ ID NO: 945540 - protein, 109 aa, Homo sapiens
GGKTPAFFLPKLDPMGRGLSPGGGGGLWVTLGGAHSRFFTAYGGSRPKDGPGPHLVLREGGVKSFPRPLGPWGGGKTPPPSLSGGPPPWAQTFFGALGPNFGGRGDPFF

SEQ ID NO: 945541 - protein, 114 aa, Homo sapiens
NLLSIWGWEIPQDKVFFNLKREEYWPGVKFVPKQRLQSKSAWNPSYCPGITGIGTWRPSLWVFLAWKPNRQFSPFPGKILFHKHIFSPNGSILLNKSYIRPAYSQIIFVKPYRL

SEQ ID NO: 945542 - protein, 160 aa, Homo sapiens
KGGGFKPWIFPKTPPQKTPPQRGVDPTGGLGAPNPTRAPRPRAPPKSQGQVPPPLKGPVPQKGPSFLAGPKIPLLRGLPQKLNRGDLGKGGILKTRWGGPGPPPGKRSPRGERKEPPFFLKKVGGVLGIPPPAFFKRECSPPTPKKAKPGAMAYKGPQNF

SEQ ID NO: 945543 - protein, 72 aa, Homo sapiens
LNLRALPPALDYWIPGLHLMQACVNLLASSDPLAWARKGAGVIGISHCIGYARNTSLAVYAHLNMRITYILC

SEQ ID NO: 945544 - protein, 158 aa, Homo sapiens
NVFSSFVSQGRHNYKGRAMKTQGPPSPANRRGPITWPLPPWKKTPPPLMAQSPNPKKRALSQKKKKKPPHIHKFWTNKENRATPPKNVALYTGTKPLKSLPQKKNKNPPQISHRGNPGKTLPPGSPPKPLPPCLGLIPPPPQLKPKLPLDFPPGPQRV

SEQ ID NO: 945545 - protein, 219 aa, Homo sapiens
SSFFFFSPPFLPKDTTPHHKNNRSKKRPKERKQPPPKSTTQSGKNTHIPQKRYDKRKPQPHHNPGNNTHNPRQTQPTKPTALNLRYPTKTNKHSHPNLRHNSRTNNNPKQPQNAEGNNPLHTYSNTPPATPTNIAAAPTTRKAKKNTANVLKTRRSTTNAPTRHRTRTPNNSQNHTTRPRSLYTSTNQQTQTPRSKTILIQQHADLQHIEHTTPTKPLL

SEQ ID NO: 945546 - protein, 152 aa, Homo sapiens
PIYLGNLKNKPNPYPNLEQGDKWIHTPNAVLARTNTRGAPPFKKKKPAPKPGIGLTKEKNASCGQKFPPPHLSKLFLLQGPGPIPRSHLFFSSRDPRQILQRGEHSTITPRFLFLYPDTLFFAHTSPLGYPLGKQIQLWHFVKANARQKGFP

SEQ ID NO: 945547 - protein, 210 aa, Homo sapiens
MNLMIFPKETLVSRWVTHHSGIKLPPLVWGAIRFEALFRIIQGHVQKEIDLIMGPNGKPLGTGNAKIPYTEAVCNEFLRFCKLVPLGISHRPSQDTPVRGYSFTKGATVIPNLYSVHFDKKYWRDPKVFHPERFLDSSGYFAKKKTLVPFSLGRSHCLGEHLARMEMFLFFTALLQRFHLHFPHELVPDLKPRLGIPLQPQPYLICAEKR

SEQ ID NO: 945548 - protein, 66 aa, Homo sapiens
MGLEAPAICSKGSLSHCKDEELNEVILQLFLLHKCLVEDYKLDFLSHILIILHSLKENGPRFLSNG

SEQ ID NO: 945549 - protein, 121 aa, Homo sapiens
AQGVPVALEGQNAAHAIQASPGPSMGGTKLFRRSFPRQMKRSFAGLLDVFMAGVWCQLRPTADILGCPVPGMDSYVAKLALNLCQQGNHVWIFKIRRRYEMYARELSEAVKSIFSPTIVKE

SEQ ID NO: 945550 - protein, 168 aa, Homo sapiens
MHHHTRLIFLYLHPKPPSPHLFLPPPSLSSQPFPTTPIHTTSSPTDPFSTPRSHTTTYTLTLQPPPSPAAFQNEPPPPPLHHNTSPNPLLKKHATLPISYLTTTPIFPTKHTLQQHSLPSITTHLIVQTPPPDPPTTTTELSPPLFPFPNPPPHEQPTPSTTSLNPIL

SEQ ID NO: 945551 - protein, 67 aa, Homo sapiens
AIPAYVQLLVDYSKMEKISFRNPVRQGQGPLVLRPPRCTLESLGEGWIRWFHAFWEGKAGGLLKPRN

SEQ ID NO: 945552 - protein, 201 aa, Homo sapiens
KFYPDWVSQGFRKLKGHRKKPESSLPFGMALRFNQGGISFKVWEPVQCLGPLLSGEELPSHFAIHRGMPQRRGLSRYQQLKNFQGVILVSNESKKLQQASERVNIAFKEDRPEDSNTYLHRVARAGRFGTKGLAITFVSDENDAKILNDVQDRFEVNISELPDEIDISSYIEQDTVEDSATFGNVPSCPSGERHQVWVVKR

SEQ ID NO: 945553 - protein, 83 aa, Homo sapiens
ASTIFSTLFFRNRMLPQHLELNIFFTRGTPMHHNYGKLRVNPREKGTKAGAPPGCGRFYFEWIPRGHVIRHEGKPKNSEAAII

SEQ ID NO: 945554 - protein, 96 aa, Homo sapiens
VLAYKSYIATETSMFYWLCPLVVLVTLPQQCIWAKILLAGWYKAKSENCHLGIVLKIVPKNPMPVKYCNSDVTPCELPVLVIGSAFPVTKISYVAR

SEQ ID NO: 945555 - protein, 119 aa, Homo sapiens
SRQPRVKLWHFNSNKFPPGLAIRGHLSKNCFLRVSQSSILRVSPQTKSLVRASKAPQTFKFLKKQNGRSRFTTENLRSKENQVFLFYAKLLQTDCGSRGNLMPFRTFDWQQYLCSFDNK

SEQ ID NO: 945556 - protein, 102 aa, Homo sapiens
MERICISLGARRNLCGKDIKKEAELGMYIQGLAVLGLIVRVVPVCPHEEENAKPAFIEGNLRVLCSFRCISVREPWPSLPCWRVVETGPHYPGGNSVIRRGV

SEQ ID NO: 945557 - protein, 108 aa, Homo sapiens
SSFFFLYFNHPILPNIHFSTLTITILIYQITQHSSNLTSYHPTKTHISNYPSSHTQHLISSTSSINNQHPPSPPHFYLPHPHTPPTSHHYHFNIINIPTTNHPHKPYQ

SEQ ID NO: 945558 - protein, 102 aa, Homo sapiens
ARWGAPFYFFGPPPLFWSQKSSKSPPYLQNPPPPPPKKNTSPPKSPPKTFKILQNSPPPPFLEVSPIPPPTPKKNPPPPENLKKKNFSPKFFWGKKFLNFFF

SEQ ID NO: 945559 - protein, 108 aa, Homo sapiens
LFVFNKIPKKNLKMGGFVFVQTPAKVLVFWLPSRRGRHCHRGLAYWKRVKSAEVVIFSQRVQWFPKPQNPRRGHTGNRHLSRFSVQFLAVSVDYPDFVLIHSPWNMWT

SEQ ID NO: 945560 - protein, 197 aa, Homo sapiens
KQRLALKKRRGGKGTKSDNGNPTANSTGVQGSFRPHPPKRLGQQGPTTTPGELQHFKKKPGLNTPAKRADTPGPKKRAPFPRKKKKARPKKRPGRNTGKTRFLGETDAPHKARAPKLLAPRNTQKPPWKLNREHPRKPSPGGRAKKTPPHSSASPPTLRGKKRGLPWAFKRGTPKGGGEKRAQRRTLREKETPPQKP

SEQ ID NO: 945561 - protein, 112 aa, Homo sapiens
MQFSKIDPHQYTKKTPQQQNTKNTVQPTTPGPVNKHHQKFEQNTAPTQRANHRAPFKHKKAPHKQQAATPKTRPPSRKQNRHTIKTKNTPTTKTKTSRAPQTRKPPTKPRAK

SEQ ID NO: 945562 - protein, 203 aa, Homo sapiens
GRSGTPAMVEGIGRPITCARFERPTFFKVGVPLRSVSWRAQNGGEPAPMGIGPILGVNQAVLRGGLRHVSFVLVNQHVFAVGSLIVQEVVYIPERAIHYRFLKRVGHALRVCVQIVLHCVHQHCILSSTGAVEPCRCLWMRWTPSRVLKRSEAFLAEPSAFVASAPVSAGTPSAPAEAPAPDKVHVKQHSEEWFQHVVFGHVD

SEQ ID NO: 945563 - protein, 79 aa, Homo sapiens
MLALRLTHVGQLPDYTPPVQPEAGLPRNTGYERIARRPLSPFCGRLNNTSELTDQVGQVLLVVDNTDCKAPAIPCDDRW

SEQ ID NO: 945564 - protein, 210 aa, Homo sapiens
ENGFSLYCPGRSRTPGLKLSSRLLASLRAGITGVSHRARPPSVDSYPFLCPILSPLTSSFSSSSFLLSYIYSLFTSDTLLSPLSLLLPFLPLLYFFLSPSSFLSPSPPSPSPLLSTPFSMYLLSPLSLLPFIIPLLSFHPSPSSLPLPSYPSSAPSLLLSSPLFSHYLFPPPTSPHDLTLLPLPLYPFLFAVPLHLPSFSPPSALPYLLF

SEQ ID NO: 945565 - protein, 104 aa, Homo sapiens
MSTEDDRRESMTLGFRLVKVYSTKKTGMRLLDEKVTLFTDYYDMRVHASKIIVKLFIWALSTHLKPSLKCKWLIWERGMLTTGPEKSCYDGLKNAMRCQNMCTK

SEQ ID NO: 945566 - protein, 109 aa, Homo sapiens
MVILNRSGQRLRQTAAIIPAAIPNITRQTILVMVSHSVGIKRLANLIGNRTTRHHRQAKIPLTALLIEARTGDTAADQPQLLTHQFYNLRISFGPGNQSRRIAGQHMDK

SEQ ID NO: 945567 - protein, 76 aa, Homo sapiens
AIKLDDRINGRFDYGCETQLEGNRFGPSLSISSYKITHARIPVPVSSPSKSHRSKGPSIKRAAMQLKTFSLAIKLC

SEQ ID NO: 945568 - protein, 117 aa, Homo sapiens
VRNSKRLIALISAIGMSIFLQNYVSLTEGSRDVALPSLFNGQWVVGHSENFSASITTMQAVIWIVTFLAMLALTIFIRYSRMGRACRACAEDLKMASLLGINTDRVIALTFVIGAAM

SEQ ID NO: 945569 - protein, 150 aa, Homo sapiens
VVRLPAFKRKTLVLIGTSGVGRSHIKNALLSQNPEKFVYPVPYTTRPPRKNEEDGKEYHFILTEEMTRNIFANEFLEFGSYQGNMFGTKFETVHQIHKQNKIGILGIEPQTLENGPTGRPGATGKGFEGIRKPDAYYFGLLLVIMVVMNP

SEQ ID NO: 945570 - protein, 140 aa, Homo sapiens
MGWSCLETRVLGLGAQRISRLLLKDKELKDIRALDKAFIPELREEFSKLQNRTKLTVLEGDILDEPFLKRACQDVSVGIHTDWILSALGALTESPFDCHVKEPQFLLEVFRQNQGATLYNNQTNKRNGALFPQDVAEART

SEQ ID NO: 945571 - protein, 40 aa, Homo sapiens
ARQVNGNPSLTTTPPLMAVKGGRWGFFFTTGGFTPKRKLF

SEQ ID NO: 945572 - protein, 126 aa, Homo sapiens
MFYLKKWSAVVMWIWQWSAIRALSAVSRGWMPVLDDKLKTNKRTVSGSGENVIISFHNWCMSLWVKQNNRCPLCQHDYVGQRIRQGERLEGSLTDLFRDLQVLVIHCPTQARTLQGMNSSHMTPRI

SEQ ID NO: 945573 - protein, 133 aa, Homo sapiens
LSAITLFGFTNVDGLQGYEAALSIDDDISHIRAHTNYQGPLTKANEQADLLVSSAFMEAQELHITHVNVTGLKTKFDITWNQAKNIDNIVLSVKSYTCPLKRQELIPEVYVLMHYGKWMLHMYLHLENCHLSM

SEQ ID NO: 945574 - protein, 71 aa, Homo sapiens
PFDPYVLWAPLKSARMRNEMEKPSHDQRLSLMIDGYYASTGNQFGTLLHCIALYMLIIDGRAYSTDPSFGS

SEQ ID NO: 945575 - protein, 182 aa, Homo sapiens
IEKRVRTESRARQEKEKTPPWKPIDGSASKCRNQAMTAIRAGGDMALASVLERPLPENQRGGYGLGGRAELLDQGPGSLRDGLSLAAPGWGDPEEPGIERLHGTTTRALKSRHGDKVAADSRATAGANMATQKVKKVIEINPYLLGTMAGGAAECSYWERMTARKRQIYELRKKERNYGAAG

SEQ ID NO: 945576 - protein, 36 aa, Homo sapiens
MYMNFPHDDSITTMINERSVQVGQTHTIARSVMHVP

SEQ ID NO: 945577 - protein, 205 aa, Homo sapiens
MCLQGTKPMGLFSAIREPELHDWGTHIHLPSGTAEGASHSRCLPLSINSSSYPLTIINSFSRPDISSRIHFTCIENYTEIYALITSRQKSAPSYKTIGGRLAPISLMTCLTTSHCTSNDTALTGKRRQHTYGMRPDKHAPFFPAGALLTSPTPIDLPNSLPTLNDHRLYANCHIRLTRSSNCSRTTYIFDIRSTTVPTSSNIQSS

SEQ ID NO: 945578 - protein, 49 aa, Homo sapiens
QGARKHSRGRHVGVPHTAGYARRGRLSGFSTLGPINDVLVLSSYATSYP

SEQ ID NO: 945579 - protein, 117 aa, Homo sapiens
MIKPDAVVHALIMDAVDQRMLSNTILIVPMRELLWTKEDCQRFHREYEGRACYQTLPESMVRWPPRAYILAHEGAIQLWRTPMGPTRASRARHVGPDSMAGRLCLTDSRSTIHGSGV

SEQ ID NO: 945580 - protein, 113 aa, Homo sapiens
GKKRRRCPALATVAWRSGETGTENLSLLGLTVVMSFKREGDDWSQLNVLKKRIVGDLLASYIPEDEALMLQHGHFACAICPHQPILYTLTMLTAHRACNKHLSSLLFYDNKHP

SEQ ID NO: 945581 - protein, 151 aa, Homo sapiens
INCVPLLSLPSVKGRTHIYSQPNYIPLPFSLFLHTINSLYLHYHPFNHHLPKKKFYHITPLFNYYNNLFSEVTATPQPPHLYTTLSLITPDLNLFYPYHQQPITFNSPFIKTKLNLTFIHTGAPNFPHNFLKNTHSHLILRISYSKFYINQ

SEQ ID NO: 945582 - protein, 69 aa, Homo sapiens
TIAVEATVEIHVDCCLDLYSQLQGTIETANIAVYSGSRDLILIAEPPLITGSMLVEIKKDLHELNNAGI

SEQ ID NO: 945583 - protein, 113 aa, Homo sapiens
MTTLIRTARPSHRSSTITLCDPYLIGPLNQIVMETVALTRITYATVGIDLEYLALSDLMNSLNRARTTLMENIDSSETPGEHPLRTTDTYSLTTYGKSIYTDLPNKDAIYYIP

SEQ ID NO: 945584 - protein, 69 aa, Homo sapiens
GGRLAVWSVCSGGRDGQTRWCPGVRLNHYKTLWGLVATSAGAKNPLNAKTLKWDHFFGKDPFPVFQHPT

SEQ ID NO: 945585 - protein, 117 aa, Homo sapiens
MYVWTTTHWGSLAHHINNIKPSFSRDDSVKLIHLSSMLMLSVNLDINSGNSSYSESNYIHLAAFYNVMNGKTLAVSNQMALDHSTLLPAGEIPRKLAQFAFLKGGPTEWRWIQTRNS

SEQ ID NO: 945586 - protein, 146 aa, Homo sapiens
ARGKTAFQPFQAILVCVCVCVCERERDTHHHPTHTPSPPPPPPPPTPHTPPTPPTPPPPPPPPPPPPPPTPPPHPPHPPPPHPPPPLPPPPPPPPPPPPPPHPPPPPPPPPPPPPPPHHPPPPTPPPPPPPPPPPPPPPPHPPPPP

SEQ ID NO: 945587 - protein, 111 aa, Homo sapiens
MDKDNAEIMVMLQEAMQEHVNANRDRANPVTDPVSVAVTFTFTEGEDVNRASLITSTNTNTSYGDAYASPVQNSNTTTLATATVAAVAAASVSISHCHTATANAEVIRDGN

SEQ ID NO: 945588 - protein, 86 aa, Homo sapiens
MTLPNSLTDRLSNRTANGTTSAINPAKNMSNSPVNNPKIQPTVPPWAKSIIELKECSHHMARLGCHMIRTKKPLITEPKTRNVTGA

SEQ ID NO: 945589 - protein, 132 aa, Homo sapiens
RLVRERDAYKEKYEKLVSSGFRENGSSSDNPSSPEFFMESDTRFQLATLISAPRGSGSGVGLLVLEPCSPPPHHPHPHRVWPPWPPTHTQTHTHTPHTHTHTHTPHTLLKFVVVVAVLNWGGNGCLAHGLPI

SEQ ID NO: 945590 - protein, 120 aa, Homo sapiens
MLSPKPQQLNQQNCSPEHYEPQLKTQRTLLEGDPQEEPDLYIDKPQINLTTYCSAYIPTSSANPDEGYKVSASTHVKTLGQGVANEAARNGLHFLTQKTTRALEKGRRWIKPETESRALN

SEQ ID NO: 945591 - protein, 183 aa, Homo sapiens
FVHVRAGLKDGFVQDESPMFPVGKNVVYTCNEGFSLIGNPVATCGEDLRWLVREMHRQKIACVLPVLVDGIHSHPLHPFYTVGEKVTVSCSGGMSLEGPSAFLCGSSLKWSPEMKNARCVQKENPLTQAVPKCQRSEKLLNSRCVCKMAYECGPSLDVCAQDERSNRILPLTACQIHVLPLSR

SEQ ID NO: 945592 - protein, 44 aa, Homo sapiens
RHPLRTTQPAGLIAAQGPPVADFFFTIVGFSPDERYPFGPFPEV

SEQ ID NO: 945593 - protein, 138 aa, Homo sapiens
MPHVGRCMDHPMAAYHSVWPSAPRSVYISSETRSQGSCEAITSTDHGHVMSKVRGYCAISSIYYRKLRDTNQRAMRMGDCWLTEKDQIPKLCQVLCHRDKDQPAGYTRTLQIPNRHLHRAKMAQIEYEGNCLPPLPID

SEQ ID NO: 945594 - protein, 132 aa, Homo sapiens
MCWSCLVTWVLGLVCQRISRLAVEENELDDITTFVKAFRPELKEEFSKLQNRTKLTVLEGDILHEPFLERACHDVLEDIHTDCLNDEFGGTHRESILDGNVIGTQLLGRGPGPTQVPTYIYNRRIKGFGPNF

SEQ ID NO: 945595 - protein, 67 aa, Homo sapiens
LWVCSLGVTRLGTTGAPRFVYLRLLSANPVWVESMNSMSGSDQTEPREKYVLRTIVTIVQEQHAGKS

SEQ ID NO: 945596 - protein, 105 aa, Homo sapiens
LFYSTVKAGANSLPLTIFPALTPFPPAFSAAQFPPCNPPLARKKILPPYPLGKGDPKFFIGEGGAITPTPISRRATPFLSAVWRVFSHLFPPALIFWPPLSPNFL

SEQ ID NO: 945597 - protein, 101 aa, Homo sapiens
EDPQSSHPVKKKPSKNVFRAPPQAPFNSPCLPGGGKTPPPGGGPKSGPKENLFFFIPGGSPPQREEKIGAPPLAVFLKFPPPPHFFIFWGGGGPPPTPLLK

SEQ ID NO: 945598 - protein, 77 aa, Homo sapiens
TCPPKHTHTFATYSDTEPAVLIPVYAGKRAVTMALTADRNAVNAHADRLNPGGTQIEVTLDVAANGILSVTGVNGTA

SEQ ID NO: 945599 - protein, 191 aa, Homo sapiens
RGGKAKKKKEENRPHEDKRGQPHKTEGERKALEESKKRGKEKRGSQHTRKNPKKRGEEPRQKQTSAKAGRGAKKGTTGAKGQNPKGAMREKRKREEKDQAQRSQKARGKAPKGKKAAKPTQTTNKKEIEKKKGKREEENYRPPYKKRARGEGEKLEGTEEERGKKTIKQLGEKEETERRTRARMQERKERE

SEQ ID NO: 945600 - protein, 81 aa, Homo sapiens
RVADSCARMSYQLTDVVASQGQEIKIILLITEKAVSSKCKRASGCDNGCLHSHVLGMLRHDIDGDSVEVQFAKSRYPFTGL

SEQ ID NO: 945601 - protein, 95 aa, Homo sapiens
QYRYLYMHRGLHHYFRHLTFLNSITHLGGYLTVDGYLYMRHHDAFSTHILISLHILIIADLSTMTTDFPIALLTQTMSLRHMTATHPLLIHEYYF

SEQ ID NO: 945602 - protein, 129 aa, Homo sapiens
MTRPSLYRDYQLDFSSSHDTQMSTQTIITSLLIAHPHADPIPNTSSTQFITTHPRLTLYKIPSIQCITSHSHTTNPQSTPNQPAPYIRTTLHTQYHTYPPLQQTPTRTRQSKRLKPSYSTNIYTHPTNL

SEQ ID NO: 945603 - protein, 96 aa, Homo sapiens
RGVSGEARPCQHPDLRLPASRTVREYMVFGPCTCYGHFFLSFFLSFFLRQSLALSPRLECSGAILAHCNLRLPGSSDSSASASRELGLQAPVTTPG

SEQ ID NO: 945604 - protein, 190 aa, Homo sapiens
MIAYTYYEKAHTKGSIHDLSKKAFVQGYPINYVISSDLPKTFLSTLPLENSNYVTNWEGTGLTTDLSRLHRLEVPLLNTCVLLALKYRSPELTHRLIDNNRCQLVQALLISNELDQYHTLLQSVHIYECAYTICDGVYCSTCYECTGFHGLHDDIGSTLLTMCVIRRLIFHDPLIITLGMDTSSELTLYR

SEQ ID NO: 945605 - protein, 40 aa, Homo sapiens
ASGGVLVPVFLLRFWAGLPPLNDPFVSYFSKVFKSFGPLR

SEQ ID NO: 945606 - protein, 148 aa, Homo sapiens
NRPPPTTRTPDEKQPPGQETALGGANPPKSRDPTAKAHTTPKPKPNDHHGARKATSNPKPPTNDNRGHAREAQTQGQSRTKGAGTKGGHQNHQGPEAQTKKPTQQATNNHKQGNQTPPPKETREGKQTRQRQPPPQGGAGPKGTAKQR

SEQ ID NO: 945607 - protein, 75 aa, Homo sapiens
STIYASGQAQPLSQPETLVMPWGHINASVMNTRPCYKYIVSDTDQGNEIFNALKLNYRLHSLDRVVVNYEHLWLS

SEQ ID NO: 945608 - protein, 201 aa, Homo sapiens
LFRTGFADTTQEWRKLPLTAKMGKGPTHINMAIVGHRDSVMYTITGHLSYKCCVIDKGTIEKLDNEAAEMGKGYFKYARVLDKLKAERERGITIDMSLRKFETSKYYVTIIDALDYRDFIKNMITGTYQADCAVLIVAAESGEFEAGISKNGRTREHALLANTLCVKQLIDGVNKMDSTEPPYSQRSIDEIVTEVSTYIKV

SEQ ID NO: 945609 - protein, 35 aa, Homo sapiens
GGGGPESPNRDPNGGPVLRLDGKPPTWEERRGEAK

SEQ ID NO: 945610 - protein, 215 aa, Homo sapiens
AGGGQRGTFFLAQVLKRGLEEITGHGGLRGYLRFFFRTNDAKVGTLVAEDKYGNKYYEDNKQFFGRHRWVVYTTEMNGTNTFWDVDGSMVPPECHRWLHSMTDDPPTTKPLTARKFIRTNHKFNVTGTPEQYGPYSTTRKKIQGRSPIYHLTGKTMKTRGNMPNFERFLELLFSWLPIPYQSTLLIVGGLSSNRFAPPSVRVLGLARRLQGPNWA

SEQ ID NO: 945611 - protein, 75 aa, Homo sapiens
SFVEWGGDPAHLTVKLLALRSKTSVLYGEILARQELFLIMAWLLRLLQVPDEGQLPYLESILKVAFLSASFKGMI

SEQ ID NO: 945612 - protein, 195 aa, Homo sapiens
ATFFCVVSNLPELDMQAWASPINQFLVDASSNNGRQSPPKTTPDFMTNTGTCIPWRTPYCYVHGQKKHQRRNRAETCPLAAEYSKRNGGTSNQPTWRNNELVKKQLTIDAQLKPVAPIKTMAIIDKIDKFRTLSGNSVVTRKALVAALLTSAHDCRAVQASGAIKRSPGPKLPKSGAVYKLRGRAYHIRGRGLGA

SEQ ID NO: 945613 - protein, 126 aa, Homo sapiens
GSPSVNEPDLDTRPPPGCKRPDRTGTCRPASMAVEQWRTKSGTRALLQDQLCPLIIKAVVQIHQTGMKTVVLCTKKEIKNLKKMTVVQLQENRGKIRMMTMMMMMGFLDRPFLQDSKSRMILLQGP

SEQ ID NO: 945614 - protein, 146 aa, Homo sapiens
MGLELACDRSMRTSWSEDSHDFAGREGSASDRASDKDFIPDLREESSNIHISTKLSVLQGDILYEPFLKLSLARRLGRNAHRLNDCCLCSPHRESILIANRKGTHLLLEACIQASVPVCIYTSDIDVARPNCYKGTMQYGHEQESL

SEQ ID NO: 945615 - protein, 75 aa, Homo sapiens
VALAEAGLLTLHFPTLLKRANRGVRILVMSGDYICAERHPMRRTTHSQLSKTTPADADRGGYNLQEITLTSDKLQ

SEQ ID NO: 945616 - protein, 123 aa, Homo sapiens
RRRGEKNDQGERGQSTIGNDRCVGQGTRGGRKNGNKRKGKKYRMKILGEKRRGENRGRRRKTKRGRKKRKKKKEERKERGKRKKEKKKGRKRRRKEGKRTKREKKEKRRREKKKKREKGKGKK

SEQ ID NO: 945617 - protein, 70 aa, Homo sapiens
VSSCPTPRDCASFFSPGIWMGLLTSLFMLFIFTYGLHMILSLKTMDRFDDHKGPDYFFDPDCVTLCQWGG

SEQ ID NO: 945618 - protein, 260 aa, Homo sapiens
GSLDLESWGGAFNNLIYTLFWVTLESDLLSSIFCFLASVSCYFGLATMGWSCLVTRSGGVGGHRIVRLLVEEKELKEIRALDMAFRPELREEFSKLQNRTKLTVLEGDILDEPFLIRACQDVSGRHPHRLYHEMSLGVTHRGAIMNVNVKGTQLLLEACVQARVPVFIYTRSIEVAGPNSLQEIIQNGHGEEPLENTWPTPYPDSKSLAEKAVLAGMGWDLKMGTPGHLGVKTPFFFGGGGHSFFANKRSPPHTGPLQGL

SEQ ID NO: 945619 - protein, 107 aa, Homo sapiens
MRTLGSPEAPLGRIMLVAAITHRINYCKYHPCYFGKVAMNHYHLKRNQSLCPTVNLDKWRTLVREHTQLNAAKNNTGADPIIDVVRSDYYKALCKEKLPKQPVIAKG

SEQ ID NO: 945620 - protein, 64 aa, Homo sapiens
METVGGGIFKYRSYEKNLPFVANLYPQEIINRFKGARPKWVFQKKSEFSQFKKLGAHWAIIYQL

SEQ ID NO: 945621 - protein, 72 aa, Homo sapiens
ITYSTVGGGGCFSPTYMTSRYTMYLAGTQSTKTQTFRKTYPIIYEIVEGYSSERLNPLAREDGPLKILSLDK

SEQ ID NO: 945622 - protein, 104 aa, Homo sapiens
MQRRAWYEDATFRVSEKKLITCYDHALIIIVLICFLVLYAIFLTLTTKLTNTIISDAQRDRHRLNILPTIILELIALPSLRMLYITDEANDPSLTIKSMGHQWD

SEQ ID NO: 945623 - protein, 105 aa, Homo sapiens
RSILPKKGAAYGSNQKYHPLHTFYQGIPANPLSPFNILSAVIDSPTTSLSNLSKRFYWWDAPIPPHPIFHISFTSLGYLPFTSIIPKKNINWCVHDKVRQLPIFL

SEQ ID NO: 945624 - protein, 73 aa, Homo sapiens
RAFTLGESQSLSCLCFLECPTSCTIDTICWQTDGYARITAYGKAKQDYLQHLLHKDWAVHHDETGSPTRYVML

SEQ ID NO: 945625 - protein, 102 aa, Homo sapiens
MGAQIPFPKRDAPALIQSPSGISPEIPILDRSLLSKKRDPHRTHLLRDHKFYHVWGGQKKTSNFKKRNLDRLQTEHRKIIRQLILSGLSTSCLNLSQENSHL

SEQ ID NO: 945626 - protein, 156 aa, Homo sapiens
MVRAAAAGRISRSIPGHVLRYLGYANEVGEAFRSLVPAAVVWLSYGVASSYVLRRIAIDIGKKAGEEPSPEAGRIARVTVAEVDTFVWHALAYVDIPGYTIKRTCAASIYVLGTATRWPLDDRKWTTTLGLVTIPIIIHPIDRSVDLLLDSRLGKL

SEQ ID NO: 945627 - protein, 128 aa, Homo sapiens
MQEIEELPNAFDISNLNRSHGRMTQPYLTGYICLPFFTKTATHILEMGRLSKNGLSKSWIPPPPAPMISLHARNPSQCQILLNKSQVMAISIHNLYTLSRPLNSYLSKNPEIASPRISTFFILNNGVF

SEQ ID NO: 945628 - protein, 175 aa, Homo sapiens
MRIFAPNHVDGKSRFWHYVCQIKKMKKFSGEIAYWGQALEKSPLRVKNSGIWLGYDSRSGTHNMYREDRDLSTAGDGTQSYRDMGARHRDGSHCNRNMKVEENADSKCRRAGGKQLHDFEAKVRLPHWELGPAVQGTLEEQRGPTPFVRVKGPSNGEGPKKAKEGPLVEETGRRG

SEQ ID NO: 945629 - protein, 169 aa, Homo sapiens
GDIDLNDPGQQRTVYATPCCALRYNQVMLFSILPKRAKWWLRTLDMHDGLYLPRYTSSRSDGSDDSSSAALRKPSYREQGLLQHLQTLIETCIASLQNNSKLTVLERDTHVLPYLRRGCQDVYVVIHTACTDGSGGTYSEAMLNVTCKCTHILVKGPCTRQGFNFMSTS

SEQ ID NO: 945630 - protein, 68 aa, Homo sapiens
PSNEWAGSEREPITAVITDLLPVMMTRDGGCEDTANGQGLWIHVKKNRWPSGSWAQPEYQPHTVILQH

SEQ ID NO: 945631 - protein, 70 aa, Homo sapiens
AGEQPTVEPQKIMPPSKPHPPVVGKVTHHSIELYWDLEKKAKRQGPQEQWFRFSIEEEDPKMHTYGIIYT

SEQ ID NO: 945632 - protein, 85 aa, Homo sapiens
HEDIRGVGRIQNAFPNLRYSNTHTDSFRLFNSIPILDGSQLSTLRDPSKTPRLQITNINTFELNKRKPPILTESVQFDYSLNIET

SEQ ID NO: 945633 - protein, 71 aa, Homo sapiens
TDDIYFDGDMAVVLYLDEAWWRRLCMDDDVDDSIHKLKEKATTRNGPGFASDELSQAQMRLDYHSIVALWR

SEQ ID NO: 945634 - protein, 33 aa, Homo sapiens
MRIFFFPTGRVYNPKAKFVWENLQDFNRRGGPP

SEQ ID NO: 945635 - protein, 222 aa, Homo sapiens
GVPKVDHPILAQTINISLLGEHYIALITTQSPNITEHLTTYIDHLKVTQTNYVKINDCLNVLTKNNDLQELLHPLTSTTNNPVNPLKHAHALNRCMSRVPCNDYSWGPTYRQQTNTDFLTHYTLNCSQLYGEHSMQHLLSNKRSTSIQFALTLNHATLLRRHDTYRKRRPGTPLERGFLQMLRFYWIKRHLRSQSSLKDNSPPNSRNIISAFTQVFSRATLD

SEQ ID NO: 945636 - protein, 101 aa, Homo sapiens
TALGVGGGSVPSMARRLLLINGAKMPILGLGTWKSRTMQVIEAVQVCIDVEITHINCLHVDHNETEVGVRIQDMIREPVVKLDKLFIVSELWCTYHEKGLG

SEQ ID NO: 945637 - protein, 70 aa, Homo sapiens
DLTGTACSKAQIHLPKTDIMDETLKLPLTYSSTAKHGDHPELPGSRCSRAGPVSHKNMRMICTGEEMMDM

SEQ ID NO: 945638 - protein, 70 aa, Homo sapiens
SPVLLPTPRRVTARPRLPEIQMCKPFSETLAKLELIGEEKAIVYNDITIKATATPCFVFWAEDSLKTSCS

SEQ ID NO: 945639 - protein, 182 aa, Homo sapiens
MAEKPKLTTSCTGQNGVHPVAPGCSWSIFEEKFIKSADEPVKLTNDGYLMFQHVPMVEIDGMKLVHTRDILNYIARRYNLYGKDIKDRALLDLSIECIAHLGEMILLLPVCAPDEKDAKLALIKEKIKNRYLPASEKASKSHGQDYLVGNKMSLADIIWWNFYTTSRSFAPEVSPAVLMLRA

SEQ ID NO: 945640 - protein, 236 aa, Homo sapiens
PTDSKGRPQQAPTLRSREGPHAQREPARDRQEQRIPITVGGQRPAERVSDRTPPGRRQAPTPRRDSREKKGNHSPKPSRSRDARRAGKEGGGGPLKPRRSRPGRGGRAGDGRSAGGTHKPDGEAAGPAKEPRTTQPTEEPSAGGAPRGTGHGRHARRPLNGGSRAEAPAGGAGAEDAAKDHREGREGDHGTTRYRPPPPAKQGRAAGDSGEPTSQGRRGKGARQPHPPTTPPSHPP

SEQ ID NO: 945641 - protein, 259 aa, Homo sapiens
VSSLTRGTRPLATTGIRTEHNQGLFSSLRPPSDVLSASNLRDHLIGHVLLMGTVNTAYVVRLFLTTNHELHIRQNHSTVVEAARNSLANLDLQDSYNNLSLGLYLDKNDVALEGSKPLIPEIGEEKQEAYERLIETQTRVGGETLCMYFKKPTLDEWGKTPDAMKGGMGRGEKANPGTWEYLYPGILPNGTPISGNFMETYFLEEGEVKKKMGETLPNLNRLVVPREGLGKFFYKGPIFNLIKVSLPNYFKGPLKKKGF

SEQ ID NO: 945642 - protein, 186 aa, Homo sapiens
LRGHHQRTETILIWTKRRVGTPLMERNGKGPRQSEGTRQSGHYGRGGAGRRWKHADVGRCRDHPGPRITPYGPGPESRIHLWRNWLTGLERHERIEAPWAREDEMRGYAEKHIDYGKLGDTNERAMRKADIWLTEKDEIPKLDQARAPRDKDQTGGYTRMLKSPNRRLERAKRAENENKGKRLPPR

SEQ ID NO: 945643 - protein, 223 aa, Homo sapiens
TYVKGVKLYIKLILWAHTKPSMRFLPPHFRPICEAYSVIQSTNDLGKRNTKFSLGGGPPHPFSTPPHIGFGNNNRPDDEEKKRPHHRRKFDNEPRSLGVEESHYWPLDNRGHHASLGYISLLSRCWLENIPTREMRPLEQKNVLLCRVETRRRPALARRWDLSGYSLSNVPETLPQRAQPELRSKRHLKSRVSRRAINRRIISHGARNSGYSRWVFRRAEATL

SEQ ID NO: 945644 - protein, 97 aa, Homo sapiens
STECEAGWGPLNVGKTLLQKRLQEVSSRRGKGVLREPSTPRPTFAMDAYDPTHFSVSCVQILIYFMDNNLKTHATLKLFNKTEPTLLHSHAGDEQLN

SEQ ID NO: 945645 - protein, 76 aa, Homo sapiens
MDKLAAYERIDADTGAQWEQGTAYGYKVDADCRTLATEKLTQTLECNHGNTTCAVPYGGEFWHHRDLRLRPRSSTI

SEQ ID NO: 945646 - protein, 207 aa, Homo sapiens
AKRVAACGAALHDQSELVDKLKKCNMNTQLPTLRAAECVLVHMTPEQAANLQKWAANTSGRAMHINYEQVNMVDRLAAYDDRKLRRTPVRPRGRDDLQAIRVTPRTLPDKWAGYMIGRKHDGPLQQDTSSCTEHDLMTWLGTKGRNELGLTEIPINRTKAYNEPERVPLGLPEENCMLFSSARPRGDVYTTLLSYSGPSARPKVLFR

SEQ ID NO: 945647 - protein, 123 aa, Homo sapiens
MMAGAPHLPEGEGASNKPHHHCMKTLLCYTVQMLAMDCKTKNSPPYSKSTNNCKAISQLNVLDRGKHPSMKKFEMTDDWIINENDNRACRQMEIRAYVTKTVEIIDGNISSQGLFYGNMTLNF

SEQ ID NO: 945648 - protein, 140 aa, Homo sapiens
YLLTVHSAWLILTSTVHERMTRKCHLAPMVDPPHIGGPRHPSYGNSISRTRGLLCTVRAHNTVSVSKVNCILHLVRHRAVPIWLIVGREKGLVALFDHIDIILNHANHSKPLIKLAHTRLHLWKRECNNNTGLPNDNNRD

SEQ ID NO: 945649 - protein, 104 aa, Homo sapiens
MRHTDKRDVHTSHDLNPWSYSFNHIALGVPVTDHITAGDLLMHLIGSASLAISTINLHSTIMILAIRILLAILEIADALIQAYGYTLLVSLYLHDNTSRDNNRI

SEQ ID NO: 945650 - protein, 56 aa, Homo sapiens
MGETRHEIKVERINSGRQSAFRFGGDLVIYRMVDLATPIILMHLACKPMGVILGFQ

SEQ ID NO: 945651 - protein, 126 aa, Homo sapiens
MGAAGNKPELYEEEKLFKNAREREKYDTMPDLYAEDKTMLALKKDYIKDLSLPQLQVQGSRISSIDEFCRMISLDCPLAMERIREDLPITIKDYKGNLNRCIADVVSLFITVMDKLRLEIRAMDEI

SEQ ID NO: 945652 - protein, 238 aa, Homo sapiens
EPGHAYSVTGAEEVESNGSLQKLIRIRNPWGEVEWTGRWNDNCPSWNTIDPEERERLTRRHEDGEFWMCFSDFLRHYSRLEICNLTPDTLTSDTYKKWKLTPNTFWMNPQYLIKLEEDDEDEEDAESVVNLTRVLIQKHQTRHRKMGDDMHTIGYGIYEVPEELSAQTNIELSCNLFLTNLARERSDTFMKLREVLNQYKLPPVEHILVPLIFEPIMDGDFRIRAFLERKLTDTLTKM

SEQ ID NO: 945653 - protein, 128 aa, Homo sapiens
RHLVQGRMTHLRWVQAQDRYGNAYRVFKGETEYCDIEECCSVINGYYNLRDLPQLTIEYKDPSKRITSSRRALKTTPEKYVATHRHSIGAPGMLNDTDVGAALSTVKGLRYVAGLNSQCESTIKQMHN

SEQ ID NO: 945654 - protein, 184 aa, Homo sapiens
MTRVSCKAHKGNFVMQTQVSTAELIKQKKEYQSLKTVFAKIRQAEKIREKRMKRNEQNLKELWNYVKDQTYDWLDYLKETRRMEPRWENTLQDIIQKNFPNLARQANIQIQEIQRTPVRYSTRRSTLKTHSHQILQDQNEGKNVKGRQRQRAGHLQREAHLTKSGPLSRNPTSQETSGSNGQHS

SEQ ID NO: 945655 - protein, 118 aa, Homo sapiens
SNSNSMSSYTSQTLDQVTGSVSNLSRLNHVAIALPDVEKAAAFYKNILWATFVKRSLLLNMEYHDGYVNLGNTKMELLHPLALDSAIAGSLHKNSAGGMHHICIEVDYINAAEMDLII

SEQ ID NO: 945656 - protein, 74 aa, Homo sapiens
LCDDVCVICISPTRPLDRWVPKRCAGVYQWILQTGRIQHEVKFNYYTQLIQNLTNGTSYPKDNNAILFYNPYQQ

SEQ ID NO: 945657 - protein, 80 aa, Homo sapiens
FPRDIFLHERVICLGGAISRVSSLDKEEWVKRTVARFQKVEVKGLIPRPLKTVITVITAEPPGLRDPIYALRSVAPRSEV

SEQ ID NO: 945658 - protein, 136 aa, Homo sapiens
SGREGGVRLNFVGLRGDFSESLSLNFQPQSTAALVPDGHGPGLMTVPSRFLTLLAHLVVVITLFWSRDSNIEACLPLTFTPEEYDKQDIHPIPLCRLVAALSVTPGPLLLEELAGFLSGSLHVQQGPRAHFRWGSL

SEQ ID NO: 945659 - protein, 103 aa, Homo sapiens
VAHPEKVDVKNDMEYIATAALLVPSSTPKVQCMASRHRRNQNKSLVKLLLNHYCQMYLWISLVTNCVIGCLEICSQSKPEGGKSSLREIKKEEYVVIQTLGLY

SEQ ID NO: 945660 - protein, 70 aa, Homo sapiens
MRANLARSGHLSLFGPLKSIGGSSHRLDGGTLRDSTLTPPDAMLFSRLAYHARTRTAPHLFQTTARFGHN

SEQ ID NO: 945661 - protein, 188 aa, Homo sapiens
MTPWGRATYTLLLTEKLRKFRFRKETDNAAIIMKGDKDRQMVALEEEFQNSFPRGAQNGVAGQTAQVRGLQLQVPCMTMAECPTLWVIILSRPVGCKPEQQMIDGGEVKQAGADQKATKWFEIRPLKTYMRRGSRKAPFFRNLWLGNRILEAGPSGDLGPWNPRNRATKKFKCRTRRSLAPPPGAHLI

SEQ ID NO: 945662 - protein, 274 aa, Homo sapiens
RGHNVSADNTNSNLYFISPTSAPLRGGVLRADGVRPSQNKIFVAQRDSEPHAQRTDRIQHHDITRRRGTKPRIPPSPDGRERRKHFPQRTSHTVQTPAKPARSSPTNRLKGAPPRQLRPQQRGQECTRGEREQTQHETRRIARLVQTYDTRRLQRQREAHTRPRYTPWRQSTGLRPQPRNRLFAHLGNKHSRERGNNKSATQTHGLTRTPTQLQKAGPSTTSAITPKETDTNGTRHARRARRANAPMRDSNTYEQAREPRAGPTEMAKLGRQTA

SEQ ID NO: 945663 - protein, 225 aa, Homo sapiens
GREAPSNIFHPGTAEQAERDPKTVQDPTPRDAIFFRQEMQEKTGNQLADQINGRNEEPSRRNDDPEENIGDLMTEAGEEEPGSANKIPATQNSRRPLISDTGRSDLSKAAEDRKGSEQPTTVKKQANTKKNAPSEPSKQPRAKRQAAPSRINTVGHTGKNPAKGGNIINQTLKRLGGGVPNTSKSAPKRNPRILPERDQAPTRKFATQLSPQERVSDPHWRDGCG

SEQ ID NO: 945664 - protein, 99 aa, Homo sapiens
RLVFPLLKKDVAVEVSIRIKDRTYHASRSYAKTSMRGLLSRRVRNHMVGAFELSLACAALYKIRVADQRKKAYADFYRTYDAMKDFKEMRKAGIFHSVE

SEQ ID NO: 945665 - protein, 80 aa, Homo sapiens
YGRGSSAETFFFDGNLCISLNGFGLCRLCLTGINGAHCRTKIPVDRKWINYVMQNGFQAFRGYRSIAHYSGCVIESVKPR

SEQ ID NO: 945666 - protein, 117 aa, Homo sapiens
MTTSHGREAATAAVYSAAILEYLTAEVLELARNASNDLTSKRITRTHLELCMRGDEEKDSLIWLQMTAVVTLHTSTRFFLGKKDHTLSKGCVVPCCTRTLNTITGAPWWRGQTVITA

SEQ ID NO: 945667 - protein, 149 aa, Homo sapiens
MAGGAFFKLSAFGPRCRGSVALVEAPLLSLSGLEAIQRTPKIRVYSRHPAENGKPNFLNCYVSGFHPSDIEADLLNTGQRIENVQHPHLTFSKDWLYNLLYYTEFTPTEKDEYACRANHVTLSQANIVKRDRAIETSILRVTDPPFGIA

SEQ ID NO: 945668 - protein, 104 aa, Homo sapiens
MAKSLRSKRKRKMRAEKRKKNAPKEASRLKSILKLDGDVLMKDVQEIATVVVPKPKHCQEKMQCEVKDEKMTWKWRLILRETKGLFRPAWTVPNMDEPKGKEKA

SEQ ID NO: 945669 - protein, 138 aa, Homo sapiens
NKKGREQSLFPEAKGTTQPLFLITYGRHTPSIKMVKQIQSKTDFQKTLNTAFDKLLVINFSSTWNHPCKIINPFFHSIYEKYSNVIFLEENADYCQHITSECEFKCIPTLHFFKNEQKVSEFPIANKENFEATINELI

SEQ ID NO: 945670 - protein, 115 aa, Homo sapiens
KKKASLLIFRGTENGNTPPIFIKKTEEPPPKEFSLFDKDGEGTITTKELGTEMRTLGQNPTKTELQDMINEAQAHRNGTIDFPETLTMMARKMKDTDSEEQIREPFRPFKKDGNA

SEQ ID NO: 945671 - protein, 150 aa, Homo sapiens
MAGVDAWPQLFLEDDDEHIGGHAIQIIHYLTGHNSVHGLGNAIINSGPREDCTRIGRAGTVRRQAVDVSHLRRVNQTICLVSTGAREDDLRNIKTVAECLPYEHINADTGCWNSYAIKKKDYWTVRPSPTYDFASCCPLNLLPYVAHSAL

SEQ ID NO: 945672 - protein, 230 aa, Homo sapiens
ALMERGISLRHAVFLWHEGARGAAGGSLRLGYHAYPAYVFFASNSHLCEGTSSVKALRRATTLRSQLIWTGVTTPCRRWPMSSTLSASQKALKEKEKAFWSTLSMDDKAEMYPIKFKESSVEMNRGSNEWKTGAGGATFFIGSTALGNMWQNAYGSAPSPVKLLPRAGAQPDPEDAGHAGETHPALTLPAGTTKEPAAHSEMRPALYQPPRLHPQQPTASYRKPVPPPSD

SEQ ID NO: 945673 - protein, 214 aa, Homo sapiens
GRHYRTGAEKALFVSEQLLTGLTRLWEKCRTPPSEYIILKKPDGRTKPIPKKGTAEGFEPADNKGPLRATDGKKKITTVGSSKEANKLQMAHSNLPRANMDGPKKRDKRTKLRRPKQQEQHSSSHLAQQPQQQQQAAPTAATAAQERANIPCLHQETTEWLFFSLRHKAWLLGPPKRGIHTRPRAPRKEKVHRFRAERALHTPGQQNNKAPKTT

SEQ ID NO: 945674 - protein, 243 aa, Homo sapiens
ELPHPVSYSARGSARRAARWEDPSSPPTQNFLSARPGAPPPPPSHTTATADPHLTHSPPPPLPPSPNHPPTTQQQLTGPNPHPPPAHANTRATLHTPTQHATPHTPHRDHDPRKPRRPATPPTPNNIHPALTATPTTPQPPTGAPHTHARRTPPLPAHASHPLPHRNPTPTTAPHATDRSPTHTQRYPHPTRSPARTPPHRTPTPTQTPPTIHPPPHTHTPRDPTTQPTPTAHDCHRHKARHP

SEQ ID NO: 945675 - protein, 232 aa, Homo sapiens
GVNIGQALTPPQIFFFSARPPHGPPGRLRRSHMAQPKRIFFDATPESLQENKIPSKKPSDTNRTKLRPPKRPRRQNLQTITQNRQHPLHTRRPILQTHTRNAPTHEPHTNLLPLTHGAAGELLPQFWVLLTLRQAPSRYQCTANPLQNRDDTARISTAQIEHTAFPSAHERNNPTSPQALRRPPSAQSNPRPAPTACCAHGNSRYPRAQPAYARRSYHNHIGRRDLQPSGEC

SEQ ID NO: 945676 - protein, 57 aa, Homo sapiens
PREIGSRELLKTERADHLVEINMHDSWRFKYKGWRRAGTVNDGTVAVRRNEAYLEFG

SEQ ID NO: 945677 - protein, 266 aa, Homo sapiens
GTGGQPNRKRARPTGHKGKRGSRKTSPDNKQPGRDKERARQQTLTRSKRDANGFDSGNAPRTHNTERAPETRHPDQGALDSMHHQPNNKETPRIENQTHGGRPSREERNSTAKTPKKTNAQRQEATEIQTGGKRNGGAKPQKSAHRRNRPMTQRAAHPRTVNRAGPQKQDGTSKGGPEKRTHTAPKRAALTRKANALKKTTREQRPGEKTPQRDPKPPNKGNARGERHTTQEGHRGASGQQHTSSNGEKRGDEQRRRDTTQDTHHR

SEQ ID NO: 945678 - protein, 64 aa, Homo sapiens
MHWTIIFIGVNLTLFAHYFIGLSRMPRRYSDYHDAIHQMKQTIMCRRTDLCNRSMFHPFHELGM

SEQ ID NO: 945679 - protein, 65 aa, Homo sapiens
SAINARSNSVSFLEEYRGGGRFIENSFTPYNFNRPPRIANKNQQTASIHQYHKTKTEKKSNLQHT

SEQ ID NO: 945680 - protein, 361 aa, Homo sapiens
SVQFLSCLSIGTGQVSSQARTSKVFPVSSMRKCRVRLSFFQAGTSSRQHKLGTGPSHQHSAVHNTRGTMSRTAQFHTQQHSKPWLAAQHTISQAVGLVLLEIAHPSSGAGIHQSGPPHARATFQGKEPLLQYLATSGVHKRKQNTRRYIQEHGRSNGKGQIKQVASKAKGPFFIATKCEANAHRRTHALVARALWHKVFTTTPRKICDWQQTALDTWQQFTQYFSTLMEFQFIQRIRHKEDNTTHQTTQTHWYGPALRAPRSELIEARRRAYMHCGPPNSKPHMCALSPHRSRNYTYQGRCITTVRCGNSVGNHSNMHVAIPICSGGIAKAPRMSSQMCPHVCEYAYVYTGNGSHFTKRRN

SEQ ID NO: 945681 - protein, 66 aa, Homo sapiens
SAIMAGELADSVVKPGWRLGWGVSSYYIRCRTPQQTFYYSTTLSLIPIIHKPKTDKHYQATNEFTP

SEQ ID NO: 945682 - protein, 135 aa, Homo sapiens
MPRSHQDIATSMPSIVSDRIKTLVDTPHCTDAMKTPIMLSRMLANSDLVKVFTVGGLTGIVLANSELDIGLHDTYYVVAHFHYVLSIGAVFAIIGGFIHWFTLFSGYTLDQTYAHFFGLSGMPRRYSGYPDAYTT

SEQ ID NO: 945683 - protein, 172 aa, Homo sapiens
LTPEIFAFAKGTTQTVGEEGGRVIEQSLHRTASLGAQLILNKLATSRSSTVIQCYNWVYPDKLLLGKRRETGLSSVSADVLMKTGHCRGVLTPPKSAYTRSRVPHLRNLDLNRLQLLTSKTKGHPLLLNMVRLNTGYLAPARLQRLHKGTPRSIAEVRYMTIAKADVLMLGA

SEQ ID NO: 945684 - protein, 122 aa, Homo sapiens
MSARMLLRALAGSRSLSFAWGFQTPKIQVYSRIQQRMEVKFPELLWLGYPSDIEVLLRMERELKSGHSDFLQQGWLSIFDYTDTPTGDRHVAAYGVEDADLIGEFNSVAAFKLNAYHLPYAT

SEQ ID NO: 945685 - protein, 153 aa, Homo sapiens
SPTPTFSVKLEVEIIGTLFFLLVDGPSKSLGRGPEYLGGSYVGVVGSVISRFLEEYLSSTPERLKLLDAYLLDILLTGALQFGYCLLVGTLPFNSFLLGLIYCVGSFILTGCLRIQIIPHNKSDFQGIFPERGFGDFIFASTMLDLVVMNFVG

SEQ ID NO: 945686 - protein, 113 aa, Homo sapiens
VFRHYGPGQILTNSLFPHFPHPTTHKERDLCKTFKTPPYPPKTSQIISQKKNFILTKLPKPPKKPPQFLSILLNRTIRRPKPHHPFITTKPKTNLKNSPIHPPQKIQFQINTL

SEQ ID NO: 945687 - protein, 112 aa, Homo sapiens
FFTYDSSDKLGRGLTWPALLHLLAWRLFSVLQRFRLTHVIQQKMDSQNSRIAMRLGFIHPTLKMTYWRMDREMKKRCIQTCLSARTGLSISCTTLQLPPLKLSGIETCKQHY

SEQ ID NO: 945688 - protein, 242 aa, Homo sapiens
SSKRDRPKMEVELPLSDFRTEARLAKGISMHRFHMRRKIMSCTYYLNHAETEVQGAIHAHPTQDAMTVQVVRGTVEGQQYGDVVPGLHGKKYVVYIERFARGNGGLSGTTGPWVGIVYPDAEVGSLTKAVILWTRRPPETDPRNGRVLNLAKVGSWTKGEYEERKPIEKDAGSKGLSLIYRCFDLHLEAIELRKHNHNTQQTMSADSARSTLNYMNACHGVLYQIEGNRGTTLSPKDTHYWL

SEQ ID NO: 945689 - protein, 65 aa, Homo sapiens
SVLVFKGSIVLGGLASSIVVSQLAVCPAQRGDGTHASDDSLLDLQTSVGTLRDLETTDALTSSHH

SEQ ID NO: 945690 - protein, 70 aa, Homo sapiens
DQSLEDEECSGQSSEMDNDQLRTSSKLILFNYKRAAQELNVDHFMVVRHLKQIEKVKKLNKWVPHELSEK

SEQ ID NO: 945691 - protein, 54 aa, Homo sapiens
RALGAAPEEAVPPVSAGPGEKPSRCLWEACCLEKEQGALKVWWHSVGLELNGGM

SEQ ID NO: 945692 - protein, 96 aa, Homo sapiens
MDHDGTPENEGEETAQSVSHWCPLGISKFRGILKLGFHHGTTAIHTTETVYKSIEDNCLKLAEPRFRRLNYRDPVQTVVSHNPWSPEEGTLDLELW

SEQ ID NO: 945693 - protein, 191 aa, Homo sapiens
MFVATLCQAGLFGTIFPTACAHFMSLCHILVILEVFQPCSLLHLYGDLWSVIFEVTLVTVLGHHDPHPYKMVNLIDKCCVCCDFSTNWLAFLTLSLSPGLSYSVRHSEENNLSCRIRHELLQSSPARVMVVGRGLVRRSLGALARCARRGLGPALLEFFAHRFAEGPGPVTMAPIEVEVLACPDRQLHCPG

SEQ ID NO: 945694 - protein, 134 aa, Homo sapiens
EREREREREREREREREREREREREREREREREREREREREREREREREEKPTPDESGHDPTPPPAGPTTKNPQTQTPPQHPSHTRAHTHPNQEPHKQTRPKPKRHPTTNQHTSPKPAPRAKPKGQTEPEKGPR

SEQ ID NO: 945695 - protein, 124 aa, Homo sapiens
STCVLAGMATDFGNMPEQKGVIRAEHGPTCMVLHPLAGSPSKTKLTWLLNINLKGWLPKSIINQILSQTQVDFTNHLHKRLEPTLPLKPGVEDQPAIPNCAQLHWYTHSSESLLETCKSKISIW

SEQ ID NO: 945696 - protein, 112 aa, Homo sapiens
HVGPSGEVTPIPHSAKEETEALRELNPCRVTQPWTGLWNPVSPDTSMGLPLAPPCCGEMRGTHMLTGLNLFYPIKTLETGTQVVCSHQPGCGLKAGCVGLWGGAGLPRSYIP

SEQ ID NO: 945697 - protein, 77 aa, Homo sapiens
MIFNITHTESIMNVNVKGTQLLLEAYIQSNIPVFMYTISIKVTNPKSYKEMIQNGPRRRPCMKTHNPLHTRTGKNLL

SEQ ID NO: 945698 - protein, 128 aa, Homo sapiens
MAASVLLLVPGFPLINAVADMFKGHIKYRTGTLGDRQSADTGYLRRRSDGTDDLGATRMGVIEFLLALAQDMILAAIPAVGFAMVFNVPVRALRWCALLGSIGHGSRMILMTSGLNIEWSTFMASMLV

SEQ ID NO: 945699 - protein, 86 aa, Homo sapiens
SGVKNVKQERGGSSGPKFRISLGLPLEAVTNCADNTGAKNLKIISVKGIKGRLNKLPAAGVGNMVMATVKKGKPKLKKKVHPTVVI

SEQ ID NO: 945700 - protein, 71 aa, Homo sapiens
LEDDSRDGQEDMEASLENLQNMGMKDMSVLDETEVANSSAPDFGEDGTDGLLDSFCDSKEYVAAQLRQLPG

SEQ ID NO: 945701 - protein, 127 aa, Homo sapiens
MINLCMIIAHTGLRQSPSGRRFPPPSSTTSCTVTLASIPALSLTLARSLQLTPYVTLIFTFCSPTSPYSPHPPLNPSLLPPSPISPSPSPFSPHWPFFPNPYSATPARLHFNPLDLYFSSFVISQSP

SEQ ID NO: 945702 - protein, 74 aa, Homo sapiens
VNWMCHAEQKDESLFDSLESSMDTGSQQTCLGGGVSNLTSSGLNTIERYSEGLGTGYDDVCIGHGAGMPEMAQH

SEQ ID NO: 945703 - protein, 122 aa, Homo sapiens
MVGLLQVIWSEGEGCRSGNQVRRSGRKKPALVGSCRLCAPCLPACPPDPSSVRITDRRLHCPPGTNEHLEGLVPGARRPAEGRGGRLVEETSRRLLGGFGAGELCVNNTRKVFWRRVLRPVS

SEQ ID NO: 945704 - protein, 182 aa, Homo sapiens
GGEGHPSPLITFLARCQAKVEQAVDTEPRPKLHQHTRWQNDHHWKLALDHFWNYLHWMHTLSGQVEELLSSQITQYLALMDYTIKEFKAYKSELEEQLTPVAEETRSQLSKELQAAQAQLGTDMEDMCSHLVQYHCKVHAMLNHNTLELQIHLTCHLRKLHKQLLHKSHDLKHLAIYQARAH

SEQ ID NO: 945705 - protein, 117 aa, Homo sapiens
MMTMAALWNRKRGKVGKRLRNRMVAVSVWKEVDMGDFSFCSVLRKILILLICDLTPNPVLSETCAVSTQGEMDEGRYKMCFVKQMLEGSMLLKSHHHSLNLKYPGTQTLRKAAGSFA

SEQ ID NO: 945706 - protein, 76 aa, Homo sapiens
PTPKAPTPLDPLEDHTPPPMTPSPTIKTQKGIVKEQFLLQRLADGAINLYAMEVVLSRASKSLSEGHPTAQHEKML

SEQ ID NO: 945707 - protein, 108 aa, Homo sapiens
MGKTQGTIYPESNCSCCEPRKSNMLCASKIQWLERHRINIPIPERRNRKEERSNKFQATPDWIFHLLNIVVQGLVPSGLQDALALELWVQLQCSSHELEVHSLQVSRL

SEQ ID NO: 945708 - protein, 160 aa, Homo sapiens
AGRWLHHTGSHAGSSGLLRNRGPDGSTEASQSLNISTQTQDSSEYKITIHFINQNGETLTTKGKMGNSLLNVKVKNNLDIDGFGACKGTLTCSTYHLIFKYHIYKLTITDKENDILNLAYRLTSQLDYQIYLTKSIDNMTVQMPKTMANTKQSIDIDNTC

SEQ ID NO: 945709 - protein, 326 aa, Homo sapiens
SISSSSSSSSSSSSSISSSSSSSSSSSSIIITCITISTTFSCTPLLCSSISLFLSSFFVFPSSLPTLFSISVSSSSSSYFLLLSSLFFLLSFFLSLLYPLLFPSSSFSLFNQSFSHLLLFFLSPLSSLLFSSLLFSSFSPFFSFLFFLFSSSFLPLPFPYLSLFSLFFSSLFSLSFFLLSPISFSFSFSSPFLSLPSSFLLLFSLLFSLLFLSLLLFLSSSLSLSPFLLSFFSSLSLFLSSLSPSFFLSLLLFLFSSLFLSLFSPLLFFFCPLFPFSLSLPSLLVSLFLSLLSLSLFSFSLLFSSSFSLSSLFLSLSFFSLFLLSS

SEQ ID NO: 945710 - protein, 73 aa, Homo sapiens
MGYSSETKLSREQSGSNIGLLAIFAGLQPLPIPRQTGSGVDLRQTQTALQLRVLTCRMKTNKQKGTWHPKMGE

SEQ ID NO: 945711 - protein, 97 aa, Homo sapiens
PRWGQLASVFAHAPAAASMPQAGPLGDLRACCPQGKFPDPMTVCSPRDGKRTKCGTMPSDLPASQRCQIYGMTHGCCTPILKYIDTYCKLYGKDLTY

SEQ ID NO: 945712 - protein, 153 aa, Homo sapiens
MLVLEIITNETAGALNLLAQQATKMRNVIYQNRLALDYLLAQEEGVCGKFSLTNCCLELDDEGKVIKEITAKIQKLAHIPVQTWKGESPDSLFRGWFLSLGGFKTLVQIVLAILGVCLILPCLLPLIVKNIQTAIEALVDRRTTTRLMALTKY

SEQ ID NO: 945713 - protein, 103 aa, Homo sapiens
QSPTHAAARQTQPVKPYAHTHRLDIGTTFAPCPGALSRHCNHKMLFIELAPGHGRGLPYSEQPTQERSSRERPGQGPCTNTNTSSPAQSSGSRPACAFFRKHS

SEQ ID NO: 945714 - protein, 89 aa, Homo sapiens
RAFLSSPFIFTLLGNHFFSFDMALLPLSSFAFLSFFYRLEVQQWSHFSLAITSKGDCSGATFFIYLLNLRFITLSIFTPDCHTLVSYFP

SEQ ID NO: 945715 - protein, 206 aa, Homo sapiens
LVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFCESWPVLAPALAPARTPCPTSLVPDYPGPCPCRGPSLDLFDLSERDEGRSGRGRLSGARSGRGPWLRREYLTPSPAPRLEHSRTERRDGCKSLYTLLPG

SEQ ID NO: 945716 - protein, 109 aa, Homo sapiens
PRQKAIILGSFSGSTPNDYDAGYNLESVYAFLRSRLSIPLITGLDFGHEQRTVTLPLGAHAILNNTREGTQLTIERSLSRFTRTRFPGDDHHLVITNRFENVLFFLTNR

SEQ ID NO: 945717 - protein, 101 aa, Homo sapiens
MDRVKAALALAGRPPSQTSLEERVQHLLDAVEHRQLDLLDIIASCHAIALPFGPPHHEPVACQRLIQTLDVPPYCSFRTMLVFQMMLATDFPHPDHTRIQY

SEQ ID NO: 945718 - protein, 146 aa, Homo sapiens
MAEKPKLHYFNARGRMESTRWLLAAAGVEFEEKFMHVPMVEIDGMKLVQTRAILNYIASKYNLYGKDIQERGLIDTYIEGIADSRDLDLLPPVSSPARLRAYLRLIAGWIPLAAPLAESQLSDSRSYPLLAARSGTLPPSAGTPGP

SEQ ID NO: 945719 - protein, 73 aa, Homo sapiens
HPAESLAPHLHLLEHKVFCLNTSFDLMPLWCCPTAAPAAAAAPAKVEAKEELEESDEDMGFGLFELITKKQPT

SEQ ID NO: 945720 - protein, 30 aa, Homo sapiens
MRNVYTIAPCRDKSTFFRRQRCYIGLLRYG

SEQ ID NO: 945721 - protein, 69 aa, Homo sapiens
GGLVTNVDSQGVLCHLEPTLDPPLSQKDDPKVRPKYPLTPTLPIRCEGLTGPRASLCRKPYLFSLHYNS

SEQ ID NO: 945722 - protein, 68 aa, Homo sapiens
TSPIVFAYPSKTHTHDSYTHKIKTHKDATRKESQLPSRLISHRLKAKAFGTSLFQNRSVSLHLAFADP

SEQ ID NO: 945723 - protein, 71 aa, Homo sapiens
WPAERERMVFFLDHELHEEEAQWVNYHEDELCGKDEPAFWIFDTLITHTNEVLCPIRENQRPTYSCRHIAK

SEQ ID NO: 945724 - protein, 127 aa, Homo sapiens
LLYGDDNLRTREHAFAQDLLNPSADEERRTRSRNRLAHSPKSYAMDAKCPPRYKTTTVFAMHKRLFRGSVAPLTSASLHEEKQGLQKDAPLGGRCTKSTVSPDEWEPFGINTFWKKKIEHAYAARRN

SEQ ID NO: 945725 - protein, 124 aa, Homo sapiens
MAEIEKFDKSKLKKTETQEKNPLPSKETIEQEKQEANRNEACAANMQLYIPQALPSYITSFSCLTFEDAKELDQRLNDCAAPFTIKTTDHQSPPAFPICYHTAARKERLHVVKKKWVKKMAGHK

SEQ ID NO: 945726 - protein, 228 aa, Homo sapiens
GTTIADHTEEEVEEEEDGQLPNTGLLIYRRRPPSPYYTSRRIQTTFHISIILTLLLGRPDDFLKPALELAYCLGAAPFIVSCLKGEQRLLKLGDSYTFYDDSPAGGELLLSFCLSVFSLLCSKLRAARTASFACFWYCPCFARSEVPIAQTLPVWAFLPGSGLLRRGPPRFLVPGLASFSLHRLGSSVRFFVPMGGLPLPVGARKAPTKRPRPSAPATPQPIYSSNVL

SEQ ID NO: 945727 - protein, 134 aa, Homo sapiens
REHMILIPRNCKFKPEIFGRSTTSWMPRSLCPHPPGGPRSLHFAVVGLIVEECKLLIEASESVHLLKAFKEEKPGPASGSVSLPFVLNFLFFFFLKKENFKKTPIKNKTSLCFCEKKHQKCRNLTFKWDGGRAF

SEQ ID NO: 945728 - protein, 100 aa, Homo sapiens
TSRGWNSLEGSREDREMWESLELPRELLNGFDKNADSDMNNKVQTEVVSYGDEEVVGNWRKGASCYVFAKRLVAFCPCPRNFWNFELERDDLGYLVEKNF

SEQ ID NO: 945729 - protein, 166 aa, Homo sapiens
MHDCWEEQHTVYASIVNVQFSLLIVATHCHSQSQSLCILSPRLHPSASVSFYQPCISPIHSLYPSLVHAGLHVNCNTLDIIYPQATGLFPNFTLAKLKLSAHIPLLLNRIKRNDYLYLLFTSLPIIVRALPSHHGPHALTPVLITLRNNYRSFYAEELHSLTLEEP

SEQ ID NO: 945730 - protein, 139 aa, Homo sapiens
WPGKNTMMRKAIRGHLENNPALQKLLPDIRKNVGFVFTKEDLTEIRDMLLANKAPAAARAVAIAPCEDTVPAQNTGLGPEKTYFLQTLGITTKTSRGTIEILSDVQVIKTVDQRCGVKKGSPPPQKGVLRGEKKYPAGC

SEQ ID NO: 945731 - protein, 163 aa, Homo sapiens
LPNQEDVVQLGELDKMLMMQKLLKCSRLVLVIALMLALESSDQGYPTQSARYQWVRCSPDSNCANCLGEKGPLLELLSGESNKIPRVRTDLSPKTRMQDLNRIFPLYEDYSGSGFCSCSGSASGSVSAFLTQMDQDYQLVDESDAFHDNLRCLDRYLTSDRQD

SEQ ID NO: 945732 - protein, 70 aa, Homo sapiens
LLGSMTYSHENVPIKRDIIGAYPEDEKREHDPFRLKHSPNVNLTDVNSLRCFEMTLVFCPDRTVVWCDGC

SEQ ID NO: 945733 - protein, 65 aa, Homo sapiens
GTPKKKCFNSGSANHTIQKIQGLLNVNQAKERKSQKFPEIANGALGFKPSRQMKVDLTERNGKKK

SEQ ID NO: 945734 - protein, 112 aa, Homo sapiens
LPGVRVNLITLTHYLTPSILRPPPTPTKKHTAVFLQTKTDPLPPNPPRLNLLPPIPLLHLTQPHSHTHLTPHPKPPSPPPTTPPPPLQPHSHINHKHSPHPPPPTPHTHTPT

SEQ ID NO: 945735 - protein, 78 aa, Homo sapiens
LRLKRDAAEAFYIANDEIPYFTCSYGKGYNLTECHGDDVIQLKRQLLPSENLHTIEECKDRVPEPREEKLLQDDQNNC

SEQ ID NO: 945736 - protein, 110 aa, Homo sapiens
RGSDDNFFFSRGPYRSEGEYYRCGYPPPMVRKKGTSTLKERCAANRLETGLRGRDTNFGTEFPPHAEYGRSVDVNGTAQLGESTKPDMEERKVFKRTDSGIWDEKDPNMW

SEQ ID NO: 945737 - protein, 225 aa, Homo sapiens
CVTDLDFKFGGNGNRDPECVPVGLASSALATMLESISIHVRTGCGTDCLSLLLLYCLEHGIQPDGQMPSDRTIGGGDDYLNTCLSATYAVKLVPRAEIGDWVPTVVGEVWTGAYRQLLHTEQISSGWGYAANSYARGHCTMARVINGHELHRIQTLADQSSELNTERFTTDLEKDMILELICLLMERVYAMTAGSTAWSAHLPVSHVCQVARTLRSFLTRKELGY

SEQ ID NO: 945738 - protein, 137 aa, Homo sapiens
MRECISIHVGQAADQIGKPEVSCTDCNTEIQSDGQMPRDKTIGGGDDYFNTYCSETWAGKHVPCAGIVDLEPTGIDEDCTVTYRQLFYAEHLITGREDAAKCYARGHYSIGKESIDLESDRNAKLAEQCTGLQGCLA

SEQ ID NO: 945739 - protein, 116 aa, Homo sapiens
FREALNTYRRPTTPPPRIFENTSGPPPIADQPELYASYVPAMSYYFYRMMFFEELSKTFFTNLMTEEHPRNYKLQTNRARSSLTIKNRLDTLERLNQRQSLHCKKVNITTAPPNCH

SEQ ID NO: 945740 - protein, 72 aa, Homo sapiens
VANSKRLSCFHAGCPRPPCWGRFPGCWPRPGSQSAFNRNQSSTSREPPNAKPDCLKVVFTFSTTVFLWVSII

SEQ ID NO: 945741 - protein, 151 aa, Homo sapiens
QGASAYFGRMCQMTQGAFEVPEADRIACIHIDAMGSESQGIQQLMQAETRQNVKEIEARKRKNRRLKQAKEEAQAEIEQYRLQREKEFKANEAAALGSRGSCSTEVEKETQEKMTILQTYLRQNRDEVLDNALFFDCDIRAENHENYRING

SEQ ID NO: 945742 - protein, 169 aa, Homo sapiens
LKTPPPPPNFTPCFTAHKKHRRTPEKKLKSPTTPPHYQKLLHIPPRQPRLTPIPASNHELHPTTPPQHPQDPQITNPTPPPPPPPTPPSPHSFNITTHTHNDHLPPPRTPNTPTTHHSPHTHAPPQTTRLHNPPPQPAPPSPPHHTKQTTTPTTHTHSTPPTTPHPIPP

SEQ ID NO: 945743 - protein, 133 aa, Homo sapiens
ELEAYTISSAGTARGGSADAPKVADPHQAHRTSWRTDHSICYYIPNHGVFTLYPRHTIPKKNPGTCTKQHYLQTDCHHFLSRPYLPPSLHPPPTPPPSPRLPPPPPSPPPLSPPSPPTHTPLPPLTDPASPIL

SEQ ID NO: 945744 - protein, 136 aa, Homo sapiens
TKAFIKKKWITHPPPGEFNEVFNDVRLLLKNDNLLREGAAHAFAQYNLDQFTPVKIEGYEDQALITKHGDLGNGKFLDPKNKICFKFDHLRKEATDPRPCERKNAAETRKTSIETALRAYLKEHYPKGICTGNGKK

SEQ ID NO: 945745 - protein, 145 aa, Homo sapiens
FSKRAHGAYKESYSSTKGEGYAGALKAKKGGSQGVHGHDTKMIHISPTLRSANTLRVQIQSKDPCQSAPSRTMFYHYAIIKLWVSTEAAMRQHRTSNTLGCIGHDAANKPHFKQAVWNLCDLGEHNVNTLIRADGVVEGLCSTAS

SEQ ID NO: 945746 - protein, 138 aa, Homo sapiens
QIIQNMPQILNFFYNMYMHWMQARHHYHQTLLQLPPAMGEEGEEDHIQVAESETEEEVMTVQAAIIARPTDTSCRHEIPALQPEPSLSGTVPISIQEPSLHYLGQSLNWGGVSTRQGGRPKRRPPLLFFCSQKTPWTG

SEQ ID NO: 945747 - protein, 174 aa, Homo sapiens
QVVLHRTALSYTVGLNSLASSRPTSPRATYAGLMRECMSMHVLHSSDQIVDACMQLYCLEHQIIQDFQMLRVTDTAEADAKLDEMFTGTFTDNDVPYQEYLAGILRLLLKLRTAIYRHVLHHWHISTGMQDTDRSMPEATAALARVSLASISAMYERWATSSTNIHDYLDLSQV

SEQ ID NO: 945748 - protein, 116 aa, Homo sapiens
RPRKRKVVLLKPHEAGGQGGAIYKDEDGSTHKLKEKAKKPKGRGFGSQKGSPTPMPEDYDNVEQDGDEPGPQRSVESWNLFVTGIHEETTRKNIHDKIPEKGENKNIHSNPDRRTR

SEQ ID NO: 945749 - protein, 104 aa, Homo sapiens
GHYGRGNTYDAFYFGSFTLNKLNVSHECVAQYHPKFCHMLDRSLASVLAWPPKEYPDIDAPEKMGVLVCGYTVGIVTWTYASLQAGIEWTMNPEDVFTAAVGEE

SEQ ID NO: 945750 - protein, 135 aa, Homo sapiens
MEALFGAFLFISIGPYSRSVTPAAKMVKQIQSMTAFQEALDAAGDKLVVVDFSATGCGPCKKIKPSFHSLSEKYSNVIFLEVDGDDCHDVASEREAKCMPTFQCFKKGHKVGEFSGANTEKLEATIKEFSLTMIS

SEQ ID NO: 945751 - protein, 286 aa, Homo sapiens
RAHSWRGRGHASPFILHNGSTDKHTCVCVYYPIVEAASFKYTQLLIQRPKAERDATKSLILRLSDSEEQGRQISPVGTQLFEAWITTLVDKLGTRVYKFLHNTIIWKEMPPCLEDTQGTRCILPVNYPRKQSNLSRTQINSISEGSRTTIAYAGCSLPLTTTKLPTGTKGNFPYSYSVLMLRPLSPMNAYFTGEKNVTVGSLIFMSNTLLLVGFRSRAQRRSPRTSAPRFIAIASLITASTWSPISVPMSGAVINHLQTDRSVYNKGFAQLDKYLSGVSLHIKISR

SEQ ID NO: 945752 - protein, 117 aa, Homo sapiens
HYGRGGIPEADIIRSEMSRSEALGELGLLFISGLEAIQRTPKIQVYSRHPAENGKSNFLNCYVSGFHPSDIEVDLLKNGERIEKVEHSDLSFNKDRPFYLLYYTGFTPTEVKWDRDM

SEQ ID NO: 945753 - protein, 87 aa, Homo sapiens
SNYIQKASALVLINQRVFRGMHKLILQPEIHSRMFTQMIQTPFIMIKLLCFFAYENCPFSHKTFKNLYLLRVALTLLSIFDRVMNPL

SEQ ID NO: 945754 - protein, 102 aa, Homo sapiens
MTPAPPQSQPPSSADHLFPPPPTSSPTSPYLPDHLPPAAPPPPLLSPLHLLSFPLPLSPPPPPTPPPRPFPTTSRTPPPSSPPSPPPPPPSPPSAYHPPPLP

SEQ ID NO: 945755 - protein, 152 aa, Homo sapiens
MARTKLTGLIKTAEKAPEKKGAIKAGRKKRSQQKGAKNPLGNMGYQRQFIPAFEDNTPPTPDIPITHRPAVFTTIPPIRPFFTLTPISPNPTPSYRHTLTPPLPPQLTPPHRPSSYALDTSHTTPHPPPAHPLHPARPHPTTRPHHTHSTHP

SEQ ID NO: 945756 - protein, 140 aa, Homo sapiens
MVPEARIRSQTCGNVADYLQGCCLQKDPKLEKEAKDTDPFSDRSDCIQSRLTQNVVTEGRVGRHIQDVKTVIKCEGTRLNASGPKYDEEPKPDEKPEEDENLDEEVKAIHYRHLSNDDVFREADEIDDIKESQKQTYSDA

SEQ ID NO: 945757 - protein, 383 aa, Homo sapiens
PPAPPLEPPRRAAPFYKTRRTADSTALWFRRRDTTPRSRPPRRSDARCVLRSAGRGPAACRRPAYPAPARARARPPPRRPAMGTAREGGGGTGGGGGEGAGKAGTAKGEREPPRITTQAPAVVTCACAVQDGEIIVHITMIYNIITHTSYFNNTYNIIRSIMDVMKYQRKYMRIVRREQERQNAFRNQIQVSDSRRDVGARYRRVYVLVILNSTSCPVVRQQYVYVALGDAAAPRDYLVSVPIASMYYYLLIRNPVTDHSIRVMLGQRVLVLRRRIAYRAVRPAHTRRISRISCKRVILVTLIRTYDADTVLISMIMLYENTITLRTSHVSVCSIRRNVRASCSARRERSAAVVYRSYGVVCGHARTTHSPHPPPQTARAAAS

SEQ ID NO: 945758 - protein, 113 aa, Homo sapiens
MPRPRATPAVYSAAILEYLTAEALELAGNAPADEESAIFIKVTFACWSRPFHTTTDLLLCEERSPPALSKAMPENSLFSQTSKSPSPPPPRICHPRAPPTLGTSHRLQLRKVN

SEQ ID NO: 945759 - protein, 140 aa, Homo sapiens
MNTSYGGRYIAHRNDYKVDRTFIADTNMSDYDPEAFNDRYSEVYYHALERNEPQQRDNSNKLRQKQTQLGEMFDDPVTTRLMLTISDGSMLCDYLEYKRGFSIEDLATLYSYAEFQYESMLNSRAEQYLHHFRALDHCAA

SEQ ID NO: 945760 - protein, 66 aa, Homo sapiens
GIVTDRKTGSSKGLGFVDLTSEEDAKVAKGAMEDIPGQFPALGPPWKSAYLTFKGQYRVGFDWIFI

SEQ ID NO: 945761 - protein, 73 aa, Homo sapiens
VIICSEGYEAPDATIYYSVLAAQWPELWISYYARAFTGHVDSLSADDKHDMPMVTLMIGSLYFSILVHSAYCI

SEQ ID NO: 945762 - protein, 75 aa, Homo sapiens
GELELRHLGRVVPLVFGTNHPLFFAHNSLRGRAKPARTQNDCKINGALQNNSYKTILNMITIELIEKKKITLKYA

SEQ ID NO: 945763 - protein, 162 aa, Homo sapiens
MPVAEVVRVGRACRACTARVGGAVTAYVRAPLSDAACSGGELLVDEVSCQCAKTSHSKRKYDKLQDHIFILVLYGTFAAVTECSRAMSACECNDVVNAGLSCVARCEVDCADNDWHICSIAALCVDSDDDDAAYRRESISSNHRRARDDDDIKRTMSVASRD

SEQ ID NO: 945764 - protein, 120 aa, Homo sapiens
GKALDQHAEFTEIPVPLLATVSGGSIRYNMAKTYDHTVTQMSCIETLIGVFQKHAEKEECKYSLSTTEHLRFMYTDLADLTENLYDPVDQVPMMKKLDTICVAYLDCQELTILFDVLAKG

SEQ ID NO: 945765 - protein, 122 aa, Homo sapiens
SVVWVPNYTIAMTQTMDLHGEKPFKLAEGPSNIMLDDINKQFLDDPKYIDEEISPPNFHIISLKQMLKKLGVPKTHLYLKKLIGEVSIGLQETFIYPDFLKIMLGKRSAILKMILMYDQKPR

SEQ ID NO: 945766 - protein, 343 aa, Homo sapiens
MIHRSHYQPSLSASQYSKHQLITSTHTRAAKEIGIVKQKKRVTSKKYQNHAIKDNGDLRITTDWMSHRASYGPSVCIYVSIFHINMKSTKLINIYRISSYHAIIFNHHVDRPRYNRIEENDSYHDIADVNIIDNSQTHDTSLMIRPYLYPHTIITNTVTILRIRVPPLYLHTPHHSPLSQLYSHALDSLLLVSHLYTSTHYSTHITPHIYHSRSADPTSHRPSNGVVLWSFYNIFCKSTSEHKVQRKLTHTQQMSDSDSVLIQRRCRETIELARDAADEADGVDAISVSREREARIYLIQVIITYETHIDITSRGASRSAREYSYAMHVICYAHSRAVSGVSV

SEQ ID NO: 945767 - protein, 98 aa, Homo sapiens
MQDKGGSPDAESRIGHPKVPGSSIPKMKDDLPWTFGRDCCCETEQTFCIPYRKGPDLEEKCTRLTVMRIPLALACVFRKAQFIIGKKGNITMPMGTWV

SEQ ID NO: 945768 - protein, 72 aa, Homo sapiens
RLQCIGSRMGYERLSLTRVIGMNPVPNGLRFCQMTSIFKMRWASKEIGIESLGTLLKVFTGGNQQNTPKRRE

SEQ ID NO: 945769 - protein, 141 aa, Homo sapiens
PHDDRPDLNFDWTRSHCSLEELKLINKRAVYQNNHRVEVRTVSTTEQLTHLRYACDCLTLCDYECLMIPYHYDDGLIAILKKNRLTLWQRHRKVLRRFDDLELRVESFQPVWQIGKLLCMRNLLATYSLNVMKDKDYIMLW

SEQ ID NO: 945770 - protein, 201 aa, Homo sapiens
EEPRQQDAPSAPPPACECHSLGHCHCPQSCCMRKTELAPLIALFQPSKVIQHQPLMPCTRCHPAAPYFKGTAAANGELTDLSLDDLKGKYSALSPYPSDFHPLCVLQTFVLLATYANEFYRCELLKLSHPQRIPHFSPPPPVKYTQTGTAPWPTTTPDYRPPRPRPFPTTTGALVESSWICLHRIIPYLPPRRANKNSPLH

SEQ ID NO: 945771 - protein, 66 aa, Homo sapiens
PEDDRLHAEVSCSGSYSEFELHYMFDLEASQTTTMTELYSEFAVKKERATYLEKVCDCVTFIRHES

SEQ ID NO: 945772 - protein, 75 aa, Homo sapiens
GEGLTCTLKFFVFAMASHPWALKLRLRRYFFLSWPGRLIQRTSIDSEFTPRHSQQRHGKSNFLDLLWAWVSSIRH

SEQ ID NO: 945773 - protein, 105 aa, Homo sapiens
MTLTKPELIYNDEAEQKRPVDAEQKNAQDTAQVHYFMESYRDKCVEKQRKAKTLALKEVSPAVETGSVKTVLASPDVLAKRTRKVGREPSPRRTTEANDIVSKQI

SEQ ID NO: 945774 - protein, 144 aa, Homo sapiens
MPRVMRSRCQSPPDSSRVVQAAAAPPCGQRVKECVTVAAIEAVARGARTRSLACVTRAVDGTTACRYVRRDYTLSVVVDGSTSLSVCLRATRRANRNATTTHLSYSVDTLIVQSRQQTLARSARARVLQLRCALTCHTGTVTTH

SEQ ID NO: 945775 - protein, 69 aa, Homo sapiens
QLVVGQSGTRLRSYSCASLRFSSATMSDKPDMAEIEKFDKSKLKKTETQEKNPLPSKGGGEQEKQAAES

SEQ ID NO: 945776 - protein, 130 aa, Homo sapiens
STMMIKTIDHTECKDSVQIEASIRTYLIDLKHECHHTHEYDESRPVICHSICCYEDYNLAADTICKRNLTCAKPSMPLPWLYLTVIDSLHYWPTQQLMESFLVEQSFCWTPKETFVSGASNYKARTPSTS

SEQ ID NO: 945777 - protein, 189 aa, Homo sapiens
RPCPRYPGIAAIIGRVLQDPDHSWCENLHFQSMQARDTVLIIEGTLETDVKCAQGAKKHYDDKRQGVEAKFKILQDHTSLWGALSEPPKRTAGRKSAICHRKPPAHRPPLVAHALGGDAAKKRAGRGSACRRVRAPPIGSLTLPTPPPFPPRITTYIAILSAVSSVIALLMRLLAAVALDNRFEQAYYL

SEQ ID NO: 945778 - protein, 127 aa, Homo sapiens
LLFPLFSASRPQFARSLYAVPQLSDTADTMGYVDLMEVYEPSQADVAELDAESSPLPETGDMPYVDILTLSVTTEDKASLPVVKKALANKDLPDEEDTTGSGAPDSIHDDDIDPFVSEDDEHSYQAN

SEQ ID NO: 945779 - protein, 89 aa, Homo sapiens
KTIPNRKRAYSRALGLCAAHQPAPLSPCIPRPLYHALSDEYKTHPPPHAPHPKTANSKKQYKEQQPTKQHPPNQPLNTTLKSSTNAPAA

SEQ ID NO: 945780 - protein, 124 aa, Homo sapiens
MQAIRLELSLGVLPKLRLEFPEFEQGELTALDRLLLETCVEKAEGLHQPKPDAVAIVWGTQPSGVKAIGLRKYLSFLRDRNETDEAADSTRYHRCGPLRLMAWNESNRGYASKRMLARKGQGEI

SEQ ID NO: 945781 - protein, 52 aa, Homo sapiens
MSYELRSTSRPFFMRGGRRGTIRTIPEKGETTNNKSEFTLPPVLNKVKYLYT

SEQ ID NO: 945782 - protein, 115 aa, Homo sapiens
MTAKDDPNNRDLQTPAETQRPSNNARDQGKDKICPKSKPCNKLNNYTLIDTATMAVRLCHRGYVCRAPLYELLSDRLINLCPKHRAKSITPQTPKVQMVQLLAKEHDLHNRLYIF

SEQ ID NO: 945783 - protein, 102 aa, Homo sapiens
NSAIMAGVFKTQMGHIMATDFRSLDLDYHCRDYWGLNFLKPDHWDYGVWKFSRTLTGGKNRPELWETFGKVKSDFKLIMEIQFHGKVVQKVLEIIWGCWNLK

SEQ ID NO: 945784 - protein, 161 aa, Homo sapiens
MARGPKKHMKPLAAPKHWMLYKLTGVFDPRIIHRSTHDEECLPLIIFLRNILKYALTGYERKKICMQRFIVISIDKTGENFRLIYDTKGSSAVHRITPEEAKYKLSKVRKIFVGTEGIPHLATHDARTIRYHDPLIKVNDTIQIDLETGKILFHQVRHWYL

SEQ ID NO: 945785 - protein, 76 aa, Homo sapiens
MSGLKANSKLFNPKFIKELKGIESGPHWANTEFMVRFSDGRELCLDPRENWLQRVVEKFLKRPEKFIKANLLNHLM

SEQ ID NO: 945786 - protein, 179 aa, Homo sapiens
TLSFFGSAGRPGVWVLGGELNNHHGEEKGEDQDHQEGASGATSRGVGMVGQAQSEEVKGGFNMRGQNRGGFIGKGDLDDMVGSLGKNPTGGYLGGMVNEEAQGPINFTMVLAMVGEEVNGTDPGDGIRNAFGWFGEEATGTIQGDYLREVVSTMGDRFTGEEGDGVTGNTYGQDKGTEG

SEQ ID NO: 945787 - protein, 188 aa, Homo sapiens
MVYSERWVCSWHNHWCSLLATWTLQDDAAMMDAQRHKDRIDIIVTGTCEYSLSSHERSRLRVLNEALTSATLSEPKAGMNEIRTADEPLNEAEHRWMALGLRECPYRMRELLTYETCDHYEDITVRPCACELSVKRRISSRYDGQPSEPRCLGYVLDASTTRLIAGIVTDSAEFYITGAIGLVRVDYK

SEQ ID NO: 945788 - protein, 68 aa, Homo sapiens
EEDEEDEEDEEEEEDEEDEDEEEDDDDEKLVLAAAFFFLVYQEFNPPVHNITPFKEKIRTRLLSKLSF

SEQ ID NO: 945789 - protein, 69 aa, Homo sapiens
APVHVLTSTDRMHAVSVYMDPSDQNSARHCQLYSLLHKLGTALIRTYGLNITRQTYRQYAKDIQSIKLN

SEQ ID NO: 945790 - protein, 184 aa, Homo sapiens
MALKHVLSDLPTKLASNALVFKICHSSEDIWPSRDINTIPGELTDRFACENILRFIQCAPDEDMSRNFLRKRDKTLSDMHHIVNIDLMLEMSTYLAAVTPIIERDSVGHHYVNMTIPANAAISVATEETWRKVRKLLDAIHNELTDMVDFLFQGYKAGQFISFRNTNAGCSLWKEYMIFYLLRR

SEQ ID NO: 945791 - protein, 175 aa, Homo sapiens
MLATWEAGLLSHYYASLYFFSDPCSDKPCYVMMIAKFCYVFICNTSRHALTNIHCLSTLNEGNSEKQRILIGMMASAQYCTVHLHYVIVLMLVGPSFPARLHFRYECRSTRLDHMFNIDVTPAPIVTITHPSANPSRSVYGERYRAYATLAIVLRDRERTAVSLVKYVDSRRSTV

SEQ ID NO: 945792 - protein, 123 aa, Homo sapiens
MLSTSRYRSNVSSSYRNTTPSQCCCTWSSTCLPYQPFQIYDTVSQIHTIKLASHPVSLAIVLYSLVFHFVLRYVLVQCRPLQTPVHSHSMPARDTLSVRSFTISIFLFSRHARTPLLTTPEYP

SEQ ID NO: 945793 - protein, 185 aa, Homo sapiens
MTEKAPEPHVEEDDYDELDRKLNYTPSPQKALKELEEMDKDDESLIEYKTTLLGDGAVLTRSKSPQCMCYPIDPGLRECPGTKSPWTLLEIWKPSKRKPLVLMVDSEYRVHTYRTGVKVDKATFMVGSYGPRPEEYEFLTPAEEAPKGMLARGTYHIMSFFTDDDTQDHLSLEWNLSIRLSGQNE

SEQ ID NO: 945794 - protein, 344 aa, Homo sapiens
YGGGFVLVGVGRDAGPSPSGALLFFFRVCEGSRICYVLTVSASTRTTTPLAVPPTTLNLGPHQRVLGGALTQICPGAGIGSTSAGSTDKRRTHYSEKDTTVPSHEAVTHNFQIAINFFQPVVGVYINSAAYVFDMLIMTMRVMWRVVNSTVVRVCAIHDTFQPPLTESKKHKQGACNVRYTTDNQHAPGHPPSSQPHISHPRYRLRRGAERSTRASAVVGARMSCEESRSRSSPIYVVSTHTQPPYHHARMRHARGNTTGGTNSSCHAYYPHRGRGTRGLASSLVIYNHYPLFIAVPGLNIKDERLRSEVEVTSTSIHNQRTQRRVVVLQDASAREIPESLRSR

SEQ ID NO: 945795 - protein, 182 aa, Homo sapiens
SPRFLMPEIGLGLAFGLALRKISHASPPESSPSNSPPPTRISIKHPTAHPLPPPFTPLTLTYPHPLPPPPYNLLSSPEFFYLSLSPPQLSPPLQPLFPLSLPPTTPVFFSPLHSRSHPSFSILLPPPPSLSLNPFFYPPLPLPLPPPSPFSSPPPTPPLPPHYIPPTLSSRSLSPPPAPLIF

SEQ ID NO: 945796 - protein, 91 aa, Homo sapiens
MHVNTTSHLQQNTHRRTLALPPPDLTYLGRSSPESYANTYVHRTSEIRRGIELAHLRTTLIRLTRAPAIAILIYYRLIFAMPTYDALLRAI

SEQ ID NO: 945797 - protein, 198 aa, Homo sapiens
GPSTFSVSCRRMRLDCVKKITSPLSERNLVTYSPLATKVFMDGPRNCPQAPKVLPQFYTPFSPNTRFLYSPPHRPSETPHNPAHRPSRTPPHAARTANTSPSVQSLTTCQAPPHLNRPSPPPCPLPTTTHKPTFTPPLPNRPTRGHPNHTPYPPPLPISTTSPLLHHISPPFTPPLSRPLSRTRSTPTTAPPRQRTSY

SEQ ID NO: 945798 - protein, 238 aa, Homo sapiens
RAITRAGGRHAPPNGTGRHTGNNGSGNRTHTQHPRTEETSKNHQQGNKAILGGAHNAHPKESETQNGGEKPPTKAHTQNRKRPNRAKTKSGNEKTPTAPKPQKPRHPKDETTQSTNRKPAPKQRTQAKTPKNQKPPTADSKQGAKNSRTKLKDNPKAAHTNKRPPTRKMRTKKTTPSKNPRARPKGPPNKPKEKTREKGRDQKAQETSHNNNQHLGKTRENKTRANKKPGENNLKTNN

SEQ ID NO: 945799 - protein, 138 aa, Homo sapiens
MYALLPKAQAVGWTTAQHDPLVLTSEHFLVVVNQNDLYCAVIILDLMGLPSLRIPYITDEDNNHLPYHQFNWPPMVLTYQYTDYGGLIFKSYILPRLCLEPGDLRLIDVNNRVVLPIEAPFRIVITDKTFSTHEQAPH

SEQ ID NO: 945800 - protein, 101 aa, Homo sapiens
GKPFHLNAENDALKEPSEQRRGLEPTQNMGVIKPHSDLSPHPQKLLSSAHREEGSAFVFGGVCFCRKHGYQQVLNPPAEGTDCSVIPPASVKRLYLDKEVI

SEQ ID NO: 945801 - protein, 85 aa, Homo sapiens
LVQCDTLHLEARREAPPVDTGGNMVQLKQTGMHARDSKAGDSKADPPVLAAGTTANEIYTRTNQAKLAPNMPVGTHCHTRQIACR

SEQ ID NO: 945802 - protein, 70 aa, Homo sapiens
TGVKVDKASKMADSYGPRAEEYELLTPLKEGPKVMLVRGTYHNKSFLTADDMQDHLSWEGDLSIKKEWPE

SEQ ID NO: 945803 - protein, 103 aa, Homo sapiens
TLTAYKKECFTFGLTAHIAVSAAVFPTGTKGHLLDSFARTDLWDLGLDYSYGTGHGDGSLLNGHEGTCGLRETQPISITALINTSPIVFVPNALEEGRNVADP

SEQ ID NO: 945804 - protein, 63 aa, Homo sapiens
GTGAAAHFDVTPWVMSGPIYGAAVSSTLIALSDTRRQLGGDVCQGRNRTLQRIPARDLIGMKR

SEQ ID NO: 945805 - protein, 105 aa, Homo sapiens
MKCHLDIAEMREPVTNLGEMARTISLVGDKGTYTHALAHGRSTTGATHYEIAEGTRPAQELTDDTLYDIKIALRLASGKIGAERQRRLSSTDTCNWATQPMGTSL

SEQ ID NO: 945806 - protein, 122 aa, Homo sapiens
MAGGHWGSVLVHLIPAPRGAGIVYAPAPKTLLMMVAMDDCYTLSQSCTVTLGNSAKATFDAIGKTYSYLTPDLGKETVFTKSAYQEFTDHLDKTHSRVFDQSTHISGEVYNMGSFYKKNKVN

SEQ ID NO: 945807 - protein, 103 aa, Homo sapiens
MTGLTISQIEDDSDSTTMVTHKTVPGHGPYYERIPASTALAPDLTGERYHSNQLETRLTLFESRIHRLARYYKTKRLLASNRKYVSSTDFVLPPKFELSRQLY

SEQ ID NO: 945808 - protein, 155 aa, Homo sapiens
MAGELRVFRNLGSCRSNWSLRTRDNLRVPFEINWEDATVLCCSVSLYVSSLLPSVPHNTNPSPTLMYYITSDEMKCFLHWYANWSESQRERFLEDLVAKAVPDQPPFIFECQLHLWDQWFLGWAEQGPNEFVRQLEFKEPEFAAKFYQAMAAPAW

SEQ ID NO: 945809 - protein, 140 aa, Homo sapiens
GIRPHHNANLLFSRVRARPINSSQLIQPPSPFYKIQLTQPNYNLYNHSLPIKNIHNITLLTTFYPTLFTVFTLLTPLNHHKKQTPKTLITPSKPILNISSHTPFLSNPFIKTSLPLYLPSYNYPNFYQIFSNNPNFITNY

SEQ ID NO: 945810 - protein, 37 aa, Homo sapiens
MAANNRGGVTVRNLHFFDKDSTVTARLYKPCPQYEFT

SEQ ID NO: 945811 - protein, 69 aa, Homo sapiens
VHSEKPLTIGYTYCVHQQAAKAMARYQPPELNLLSLQGTIAESAAVDQKCASTLILLPALTKYRILENI

SEQ ID NO: 945812 - protein, 82 aa, Homo sapiens
LSALLPSFLMPMRHWSHDEADLNALTEAHENIDEARVHVTLVACCTEQAPVALTRNAKAVTARYKLRNCELLARVLLTAALT

SEQ ID NO: 945813 - protein, 72 aa, Homo sapiens
VLQIRKKNTQIESHSSPDVQNSLLEDKTYPDSEERTSIDIACSEGENSNSTDQDLFGGCQLNQRHSNMSHRK

SEQ ID NO: 945814 - protein, 118 aa, Homo sapiens
MPVLTRWAPFVRVEGRLFKTGCPRTAEKGEVRNAAGGVHIEPRNKQFPQLPNPRGSKASFSGNSGGSESSGAFAMTQKRRWATFRILTLPSDQMKNEESLLMMKTEGVNSANSDKSQV

SEQ ID NO: 945815 - protein, 320 aa, Homo sapiens
EICGCCFPYLLFCLGYYNFSFVRTAFFVFSDLLFVFYCYMLFFFLFHIKKNRARTRPTSHHHFTPPPPTPYTPLPTYKRDKEQLEKHRDANIPQRPTNTTHTQQYFKVHQCPLPLVASRCAGARSLYQHRYVVHLVCFVVQLYMISRTKQAECFVACADDRARLIHIMGVMESSSMWESAVARRYEPAARGVQPHNEKTGPEVLADRIIYIRPSRTSNAEVALSARSESVMVAKDRIYVFGVGARKRVLHASTHSRAVYPRSVTDREMIPPRAFIQPTNYAFTRTIIQSYYITTPDLDEDYRMFVVGVSKERVDRHCMLS

SEQ ID NO: 945816 - protein, 197 aa, Homo sapiens
NVHNERTGGGHDLSSSVAMTRDNQRELARQKNIKKQSDSVKVKRRDDGLSAAARKYWDAEIMQQKQKPSCHSPVNLKPLTTVMFPSAALTASQDPLAFFLDLRSAAEPLPGWGCPYIIRSSYVPLDRTPFLLPSLFLPTAKPLLLESSPHPPNSFKPSLCFPSGSNAECLSTQPSLNHTLFPATCNSFVRASPVGGS

SEQ ID NO: 945817 - protein, 102 aa, Homo sapiens
MTYDVRVVLSLLALSFTLPSLSRSSRTRGIDGRLDVVLFWALTPAVHLSTSSISNDLTLRLTIQFVFRTLELVYVRTDALPIRSLKPPVLINSHISAPNRTL

SEQ ID NO: 945818 - protein, 108 aa, Homo sapiens
EEVVESSGRGATRIVVDYLQNILDPDECPLALQAALAYALLSRATIIPTLEEPAYSLWGGSTDAFPNKRGRLQTSHPYLEPVSLKSLWTSHGISNPALLWTSVLSDLH

SEQ ID NO: 945819 - protein, 98 aa, Homo sapiens
PANEEDGGRRNGADSNKTLPLCPVSNIRVGAIQALNGGEGPLRPTKRRTNDRPPHPPTPPLPQLHPSHQTTRAAPTPGTRECILYPSPRATQAEKDAW

SEQ ID NO: 945820 - protein, 157 aa, Homo sapiens
MAEIEKFGKSKLKKTETQEKNPLPSKERGEQEMQACKKKRGVRRQYALCIPQALPSYFNSFELINCVRCKEVGSSLNDCAALFIIKELLTTKAAPAFPICLSICLAGKEKNLHVDEGRIAVEEVGRYDSEFYKKSKLAPGGTGGCIAVYSQGHFFFW

SEQ ID NO: 945821 - protein, 91 aa, Homo sapiens
MRALLTWCSPVRLAPRFARCATLAAPRLSARAPTSEKKSQTRHGTRARASSRRRARSTIHNVERPPDDHATHDTRSSRRGRLEGATNSDER

SEQ ID NO: 945822 - protein, 130 aa, Homo sapiens
GWFGWGSWLGSLGLNVVGDGQDPGIRYQAKRQILGKTFTGRTITLEGEPRDTIEKGKARIQDREGIPPDQQRLIFAGRQLMALRLKGGMQILGKTLTGRTITLKVEPRDTIEIVKAKIQVKEAILPDQKR

SEQ ID NO: 945823 - protein, 145 aa, Homo sapiens
NKHLCLCLLNKIKKTNSRASLKMGRRNHSRQTPLGSKQKYTISENCFWRPPWPQSPLAWAGFFLRAQLGPLWPFPPFGGGFPSSRPGVSPRWPGKTRGVPPFIPGGAHPLWPGGGIWQEGPPGCPFPTWAPPEGEWEFGTVNFLC

SEQ ID NO: 945824 - protein, 99 aa, Homo sapiens
RYHGNRERDAVLQESATHEVYYTGDCTQKPRIIYQTKKRKSSVKTHVDSDLPHLTKNDSGVDNSRAAYYEKIFSMEECHSEDSILRLEIDASDECYAQS

SEQ ID NO: 945825 - protein, 227 aa, Homo sapiens
GDLVRNPTKKATHGPLGIDLSRRRGVEMDILPRMKSSVFFKSNDVGWEETSPYRLGAQGRERIAFPSALFLITPRPPRGAPPHTSRPPRITPPVLYMAPRVGVEESSNREYIGKNTRGRRNDKTERLESGGTEVNSKQINHKQKRQEEGCGRATRTQEHAARRLLSPTHPHPSPDQHTPSDHSSTHEKSKGKTTTHPDTKPPHHATPHNTKAYDKNIATNRRNTLTS

SEQ ID NO: 945826 - protein, 139 aa, Homo sapiens
MGGKPAETILAGIILGLIGLPSLRILYITGGGNNPSLTIKSRGHQGDWTYGDTGYGGLIFNSYILPPLFLEPGDLGLLGGGNRGGLPVGAPIRIIITSQGGLRYEVAPHEGYAGGYYGQGSEIWGGNHRFMPIGLGLIP

SEQ ID NO: 945827 - protein, 169 aa, Homo sapiens
MHCCHCSPHANCMIEHQCLMLCTCCHPSSPYFKGQPHSKEEFKDLGLDHFKAKYTVLFFYPSHFTFGSTTHHVAFRDISNEFNDRYLYLQTLTQWIPTVAILPVYLHHDRMVDEAHMIIALLADATMQNIRDYVWAVTRNGLSTKTVFIVDPMDSSSTFAITISHRTDA

SEQ ID NO: 945828 - protein, 99 aa, Homo sapiens
RGEQVPGSVLRLNYGQNKGTKPKEGKRASHNPHEKKSKTNTKRGLEAGAFFYITGLGLAVSPSLPFSVFNRLLIFFFNVRLFSRAIVVYAGAVPPVKVG

SEQ ID NO: 945829 - protein, 41 aa, Homo sapiens
MVDRYKSVYNTRPLLSAAMTERLSCPIYTHARTPKTPGEDE

SEQ ID NO: 945830 - protein, 44 aa, Homo sapiens
MTIYVTVSAKVSRSQRRLDDVGRLRVILCDRTHLDAFEVSRACE

SEQ ID NO: 945831 - protein, 191 aa, Homo sapiens
GAVGGGKNPLTKGGKKGAKKKGGDPFSKKDWYEWKAPGMVNIRNIGKALGTRGGGTKISGLKGPFKGRLGDLQNDEGAFRKFKVVTGDGQGKNWLTNFHGMGLTRDKMGSMGKKWETMVGAHGGGKTTGGYLVRLVWGGFTKKRNNQIRETSYGQHQQGRQNPEEGDGIMTREVQTNGLKEGGNKLVPGRM

SEQ ID NO: 945832 - protein, 220 aa, Homo sapiens
MPLVALVRRVPSCGRGGAFLVSSSLLAVFVFFILFNNLIYCYIISVVSNAFDLFMFNVIFGCSGCGRCCVGGTAVLTHHISFSHTRHLRAPLRRLITLSRTAVLPAVSKTGKLNSTLDLLSNLHSIAYSLLIMIDESRTQHMITQHRTSLPVTAATLSQSIVTTLLDMSCLALAFTHCTSALIPVIAVRKHSILSCINVCTLLFAPYCIVESALRGASIG

SEQ ID NO: 945833 - protein, 144 aa, Homo sapiens
MAHASQVGVRGATSPIIEELITFHDHALIIMCLIYFLVLYALFLTLTTTILPGSILELIALPSLLILYITDQVNSPYLTMNELATNDTETYEYTDYGGLIFNLYILPPLFLEPGDLQLLDVYTRVVLPIEAPIRIIITQAALHL

SEQ ID NO: 945834 - protein, 70 aa, Homo sapiens
KTEVDGRSRGRGGMKDDRRHRYSADKRGGFNTFRDRENYDRGYSACLKEILFFKRGDALTVLQITPMGAL

SEQ ID NO: 945835 - protein, 107 aa, Homo sapiens
AAQVGRQDATSPIIEELITFHDHALIIIFLICFLVLYALFLTLTTYPARHHPRPYSPSIPTHPLHNRRGQQSLPYHQMNWPPMVLNLRVHRLRRTNSSTPTYLPDFS

SEQ ID NO: 945836 - protein, 251 aa, Homo sapiens
TLSSVLPAPARPFVADPPTTSLSSTPRHSGMCVSALDRERGIYINVSIERLMDSREVLSSLSPPPPVFALSAPPHSSPAATTNCERILLTLFRLRSPPITLPQPHKRKVIRTPIYKWPMNMRDFIKMHTPHSHTSNHSHLSSCQRVPPCPRDAVCLIYPTALHLSTRVRPPPPRRPRQPSFAVYVQRGWLVSARGYQYHPPRQSHAHEVHRRELRKVCSHLPNIPPRRLGHVTTAVTATAIVPLTHVYLLL

SEQ ID NO: 945837 - protein, 102 aa, Homo sapiens
LFYQNRVRGLGTFTIEDSLLWVPYFLLRVFIFFHPHQTFEFHTYITFHGCLLLLISFSGGRDSFFSPYWSSTLANALDRQDAVHISTAQLCHTNNALLPYQN

SEQ ID NO: 945838 - protein, 69 aa, Homo sapiens
GPITSTKQNTRPYHLFQQQTTQPKYHTYTTTLNHNNIYNITPSTNINQNYLLGGHLNTHTPPINNNATI

SEQ ID NO: 945839 - protein, 104 aa, Homo sapiens
MLVKTGGVKHLIGAINKMDDPTVNWSNEKYEECKGKLVAFLKKVGFNPKKDIHFMPWSRLTGANLKEQSDFWPWYIGLPVIPYLDNLPNLNRSVDGPIRLPIGD

SEQ ID NO: 945840 - protein, 50 aa, Homo sapiens
MADARNKLEDTWNNTDGDEKQAYLNKFVTLEEKKRKGYLGAILRNESLDL

SEQ ID NO: 945841 - protein, 55 aa, Homo sapiens
MFTTSVGGLDEEGKGAVSSFDPERAYQKRLLKSLEATTVPCFRPLLDNQIVFKNI

SEQ ID NO: 945842 - protein, 113 aa, Homo sapiens
IRPLWPWEPEANNVGSLKPTYAETQRLMADEQHKAHFTAQVHNFMELCWNECLENPGNRLNSTTENCLFRWADPLIDTTLDITKTVAQIAQIGGLYSIPQENDRSKGLVTKQN

SEQ ID NO: 945843 - protein, 81 aa, Homo sapiens
AVFPVVAAEMGKFVKPGRWACLLTLLRRKLHRKNIDDGTYIALQPCSGAELTVPRKVTAAWQEKIAEIKDKIFWKVITTIT

SEQ ID NO: 945844 - protein, 211 aa, Homo sapiens
YELVAARNSQRLPHPVDSKTTSDVLRFVLEQYNALSWLTCNPATQDRTSCLPVFLWVGTQLYNAIMNILQLEKHLFSLAQFLLPAASVQGTCYTLQITHMLFFRPLSTGLYDSFSVGTCQFCSCHYQSDFLTLFSWTLGTSISGDLQPVLWGVCCPNHWVPSKPRRVVAFSGGFLFRPVFFSLSFFPFPPPFSSRFVSLPFSLYSFSLLSI

SEQ ID NO: 945845 - protein, 105 aa, Homo sapiens
MSYNIGNASSPTDTDGSIKAVIGVLQKNAGITDLVGLTNSQMDPVDLDRMMKKRNTTSDGKLDFQEPINTVEVLPIDCHDSFLKALPSQKRHWDPFALVVKPTRF

SEQ ID NO: 945846 - protein, 99 aa, Homo sapiens
TFIVALTISLQSLRVEVFSFIRASDRFSKDMCNTPTYCDLRKAVNDVSNKGYGFGMVKIDLDTVKASRMLETKYNVWNYGLTFTHKWTTDCTLGTETSC

SEQ ID NO: 945847 - protein, 82 aa, Homo sapiens
IINYDLLSTRELSIPRMGRSGRYGRKVVPINFVKNDDIGILRDIEQYYSTQMDEMPMNVADLNLKQQISGMRKTVHLLGTPV

SEQ ID NO: 945848 - protein, 103 aa, Homo sapiens
ISRPACHLNPMIGDIPAPVQTSTIGTTQKALINRSGKEWHLRKFSATRALRYRIKLLTMFVVELTCKTKLADYLPPMAETGKSPATGLILRFNWHRCKVYIIN

SEQ ID NO: 945849 - protein, 134 aa, Homo sapiens
MHTNPHHPNTPKPPPPPLTPKTNTPPPPHTPPPPPPPPHHHHPPPPPAASPPPPPPHTPPHHPPHNLPRIHPPPTPPPPPPPPPPPPTPAPQQTTPHPPNPPPPRPPPHNTPPPPLPPPPPPPPLPLPTTHHTQ

SEQ ID NO: 945850 - protein, 84 aa, Homo sapiens
LDAGHCADHTWLVLSRFGLTFVAIMSDQPDMDDIAKFSLVETDDDRDAGETSTAFHRNDCNSRSTQANRIEACAANMHCTFHKH

SEQ ID NO: 945851 - protein, 128 aa, Homo sapiens
MVGHRWGLELGDLHIQHRCTSLPVKFKKLLGPGKIQHIFCTGNLCTKESYDYLRTLAGDVHIVRGDFDENLNYPDQKVVTVGQFKIGLIHGHQVIPWGDMASLALLQRQFDVDILISEHTHKFEAFEH

SEQ ID NO: 945852 - protein, 111 aa, Homo sapiens
LFDPELGQVPLLLLVLNLEPEPDMGLEDEQKMLTESGDPEEESDTESKCACPQFFWGGRAKSAQAFRGPPQIYFLLGAFSPLVVSVFTINPPSINKPPTLLGSLVEHLLAW

SEQ ID NO: 945853 - protein, 241 aa, Homo sapiens
PRTKRARHTSKNRKQGNPHNHTNNHTRDPQTKAREHNTTEPKGTPTAFYRGEPPNRQPHKEGRGNTERRTNPTPQVAHQPNTRNPRNKTNKRGRATRKTQHDEEARKTTRTNCTRRARDNDQKGRPKKSAHRRKTPIKQKAQHGGTKKRPEKTTKNEPETEEPQKPPHTEKRGPKPKEANNRTTRAKRRRKNKRETPDHRKVTTTPHKAPRSQEGTKRQSAHKNPTTTREHTTKQEQPPTK

SEQ ID NO: 945854 - protein, 92 aa, Homo sapiens
WGAIGRPKLGWNSGAWFGFSSEPMSDKPDMVEIEKFDRSNLRRPEPQEKNPWLSKEPMDQERQAAESNGGVRGHYARTIQQAWPSNLTSLSG

SEQ ID NO: 945855 - protein, 186 aa, Homo sapiens
GGGGAIHGQPHAVLRHCRREALGRVSFERGADKGPKTGENFRALSTGKGGGYKGSWFHRSIPGVMCQGGGFTRHKGTGGKAIYGGKFEDENFILKDTGPGILAMGNGGPNTKGSQVFIWTGMNIGEAMERFGSRNGRPAGRSPLVTGDNSDKVDLGVILTTRSFPLDARRAPLHPMCSEVLESLGS

SEQ ID NO: 945856 - protein, 69 aa, Homo sapiens
GNPWRSTVQTILGSYSGALLGFGSVAMSDKPDLVENEKFDKPKLRNTETHDKNPLPSKEPIEQEKQAGE

SEQ ID NO: 945857 - protein, 221 aa, Homo sapiens
PKSQGQYWEKPRLKSQVEAQAFVFCCFCFLRQSLILSPRLECSGAILPHCNLLFRGGSNSPASASFSSPDYRCIPPHLSNFCIFSRDGVKPCWTGWSQPPDLKCSARPSLPTLPRSFALAPPHPGQITESFNSSPPPLSPRLMTAKELPLLVRPFLPMKPPFLCATPNCPPLLPLLYTYHSLFLSSPFCTLLGRPPEYSLHPFPFLASYFFFPPPSSTTKL

SEQ ID NO: 945858 - protein, 145 aa, Homo sapiens
MSDKPDMAEIEKFDKSKLKKTETQEKNPLPSKGGVEQEKQAGESNEACAANMHCTFHSIAFLFYFFELINFVRCKEVGSTLNDCAAPFTSKNYWQRRPRLPFPSVYLSWLAGKERTCMLMKEEAGVKKCRCYNSISKTKLAQGVL

SEQ ID NO: 945859 - protein, 105 aa, Homo sapiens
MTGVIYEKDTLYETTGTEEDLLSDHNVEKTVLEDVLMTGKMTERKSGTLLEKFLPQLFHETEKETETFKEKVKKRRPNGELLKIGNLSVELKMRLMKMVGPHYRR

SEQ ID NO: 945860 - protein, 166 aa, Homo sapiens
PGPPRPPGRGDAKKEKQEPYEHREGEQMRVTRGASVAGGSELRERTEETSYSRWEDMACTKVTLGGEVSESIQTTVPPRRDTPARTTRRTNSTRLLSPRRNDSPAADERTQEPQTHNHTKRERSRQRNAKRRARDTISLTPIVYPGASPPNYTYSKRTLSSVCLII

SEQ ID NO: 945861 - protein, 114 aa, Homo sapiens
SAFDDDGPGTRMRYSIPVTGALGVVPPGLDEELCRKHSIGEAYALCSSASLNHARNTLIAGRAKILIPPKSMPSCRTNRWHECTPAMEHDRSVSHVGIEATDSTLAWRYGGLTK

SEQ ID NO: 945862 - protein, 67 aa, Homo sapiens
RVVTSGSGAEEFYNHRLKREFNMGPNSETHEHSYNEADPGTHHKTDTKSHHNDIPPFSGGAEYIPHP

SEQ ID NO: 945863 - protein, 68 aa, Homo sapiens
AGGVLVYWGARRPDFFLKGADSLGWTGLPCVLRSRSGSLCTGAGGWCCILSFCPPPFLVGVGPGRALL

SEQ ID NO: 945864 - protein, 146 aa, Homo sapiens
MAIPLCAGGVPIGCRSKIKDALGHFLPHGTPTLLIPILVIIETIRLLIQPIALGRRLTANITVRHLLMHLNGSATLAISTINLPSTLMILTVLILLAILEIGGVYIKAYGFTLFGRLFLHALTTSASPGFCSLRFFRATFSIAPIR

SEQ ID NO: 945865 - protein, 159 aa, Homo sapiens
MNFFWGGAFIAPTLLGLPPRVLLILFPPLLIPPFKYPTNNRLITTEQCLLKPTPKTFFPPPHLFWLSLSCYAGSLQYMFSQPTSPTCPLLLFHPPPTSLFSYVCSPPLLLCAPFIISLFYVFSSPYHLLPPVPSTPQDGSPGFFGTLFLLILFSVQIYK

SEQ ID NO: 945866 - protein, 140 aa, Homo sapiens
SLGDEDIVATPCYRPPEIMLNSKGYTKSIDIWSVGCILAEMLSNRPIFPGKHYFGAGGHILAILGSPSHEDLPCITNLNARNYFLSLPHKKKAPWFRLFPNAPPKALDLQHKPLPFNQQTRIHAQHSYPHPYPKQHYGPR

SEQ ID NO: 945867 - protein, 88 aa, Homo sapiens
MVNASPPQSISQIMHVARRADANNARAPLLPNLGQRNPFIQIYINNKTVDASIVRIAELDDIYVVRDAAIFNSYCSVGDPGRGSVNGR

SEQ ID NO: 945868 - protein, 128 aa, Homo sapiens
YGGGIPLLEIKPESLLALAGSRSLSFAWRLSSVSKDSGLLTSSSREWKANFLNCYVSGFHPSDIEVDLLKNGERIEKVQHSDLSFSKDWSFYLLYYTEFTPTEKDEYACRVNHVTLSQPKIVKWDRDM

SEQ ID NO: 945869 - protein, 191 aa, Homo sapiens
MVWKFPDRSCSAVGFTVRATITDTDFIEAFQLMDKISVLELYTYRQSERGPVLSRYTCKSDERTISETSEKLEVQFDVQIDKRKRGGQTTRVRLPADFVVRAHTVLHSTYQATQQQYALHTHIQYREHNNTFTHISTAIELSLTLITYIRRMYVCRCSLDAESQSEYSMDDSDCHMYVSDSDVRPRSWWSA

SEQ ID NO: 945870 - protein, 148 aa, Homo sapiens
MELHDSTYVDANCPYVLSIGAVFDIIGGFIQLIGRIIRLHPIPYLRQIPFHYDIHRRTTIFIATTLSRSIQDALALLGLPRRIHHKKHAIICWLIHSSNSRFINITHDLRSLRLEAKGSNEEKNRPYTWRAYLDAAETIRHSKNLHHI

SEQ ID NO: 945871 - protein, 100 aa, Homo sapiens
ECRTSTGSGSASPTLARAMCLVSLLPKVNYTPPLYHEDPDTETKLYVVMEPIKPAYYKNFSLGGPDTVANAHIPRGPNCTLDDRCCLFKNAYTTNCQTPK

SEQ ID NO: 945872 - protein, 102 aa, Homo sapiens
MAEEDFAMVASDTRLSEGFSIHTRNSPKGYKLPAKPAIGCSGFNGDCLTLPKIIEAGLRMYKHSNIEGHDYGGNCCKAAYNPEFKGLLSILGNTIIVGLDED

SEQ ID NO: 945873 - protein, 178 aa, Homo sapiens
GHYFERLRRGYCKGPETFFVFKVLKMSNEEAANLQVALLRGGRHAHSFMTGPHTVPQLASALTSLPPLAHLPSLNYSSQRLVSSLKFGLFFCSLTPTPLFSSSPTLLFPRLPRSPPGLPPPPLLSSSLFLSSSPLLHFGPPSLPPPSFFVSTILYLFSPSSSLSSLPLSPLLPSYTYI

SEQ ID NO: 945874 - protein, 130 aa, Homo sapiens
RVPEMAFETMGGPDWKRRGFYWRNGPQDQGVNMEPRIEWEKMLKGIGEHPVYFAGDELPTVRRNLDSRGVEVDPGWIKVTGHQVYGGHFLKPVLNHCNLCRDVAWFWRIQGMLVITANTLGHQLTITEVR

SEQ ID NO: 945875 - protein, 116 aa, Homo sapiens
DLTLNGWRQGCKGLRKGQDKGGFPLAESPLAVPRGPFFFRAEANTTSHGRKSATAVLYSGAYWSTSPQRYFNWPEMHKKTQRSISSPPSKWQFAIFEGYQLYSFNKGTTTKGQPPS

SEQ ID NO: 945876 - protein, 135 aa, Homo sapiens
PRLLFLGQKAEDQLAYWNGPLLESESSLSVSGIPLCKGDFYGKGIIPGKMDPSRDPTRENLVMEESKTLNSEDIPKAWKEKGPTGVAHLNQFKPEPDPMGKRLEDPEPPGQRQPPRDGRRLLAYLPTKHGLSQDY

SEQ ID NO: 945877 - protein, 237 aa, Homo sapiens
PGGVFQVLLWGGFLFSPFFFLSLVLSWVFSLFSCVFFFRPSSLLAPPAPRLVFAGLPFFLWVLGPPGAAPPADSVSRPVLCSPLAPPSAPWPPLWVVSAAFASRLVRFRLFASSLSAPPAGSFVCLLCPCRRSAGSVVCLCRPVWCRRFPAASLVLGVGWVFFALSSPCALRGPSLLPCPLSPFRSPCSVLLLRLPLFAFFLLRVFVLSRCLPSPLRSPSSLSSLCLFLSLNRLCIL

SEQ ID NO: 945878 - protein, 246 aa, Homo sapiens
MWCFLLEKRGNNDCFPARFRHACSLCPFFPQVLLPVLAVLEASPLLLSCRGRRCLLFSDPQFIVGVGVLLARASSGTLSPPILLFLLFPPFFPPFCPPPFFPWSASLLPVFPGRLSLLRSSPVFSFFFASPTPPPPSPAPAGGAPRPPLLGRPLSPRRFPPPPLSGRRRRALFSVFLLPSVAPLLLLLWCTVASLFSPRVLCPLLLLSSPLPRPLSFFSPLLPPLSFSSPALLAASPPSLLPASFI

SEQ ID NO: 945879 - protein, 150 aa, Homo sapiens
WNRGGGGLGKKDRCLGGAGVKIGTGFGLGIGFSLTFFKRRMGALAFGSGMGLGMGGSNWQDDFQASIIFYTENMAKGRSRGFTWEHPRGRAREIMVIPQEYWRGLEEGGILLEQGYQEGFKLQDLGMHLKPRLVLGLDFLSGRWKGRGLK

SEQ ID NO: 945880 - protein, 85 aa, Homo sapiens
FRRALKIKDFANTMPGHGGIMDRFDCHYLMATFDNVYIASFIRGPNPSKLIQQLLTLRPDQQLHIFNTLRPNLIDKGMLTCTTED

SEQ ID NO: 945881 - protein, 184 aa, Homo sapiens
KGGGGGNSNSNPHSTPKTRPLLWKDRGKKATQPYTLGQAHFNNGEDAEAGGGGSYIRCGGGASRDEGPGSKCSPEDLATGYNNRGQIKDFRGDFYEAMDDYTSGIEGQPNFGGPYYNRGLRLDRLGYFDDALEDFKEGLHLNPGISRCYFELKTDYSRQGRKTRKEWGQGIRDQNLDIGYFGYI

SEQ ID NO: 945882 - protein, 77 aa, Homo sapiens
APLCLPPAHSAIMAGALTSLEMVRARWFTQKLYCIHPQKSGQGPRCLECLKKLGTGLITENMSLNIEKVDKNVEGIE

SEQ ID NO: 945883 - protein, 70 aa, Homo sapiens
SPAVSLVALHEDKLDHTPDELDPPVNIGAGVKTLDGLVQTDAAQIRTYGLTMGRQGFRQYSKDLGAINSD

SEQ ID NO: 945884 - protein, 133 aa, Homo sapiens
SNAEETGVNLERTDHDEPIKHVLERDDTEIAPEALGGRIEHQFTICAHSVSTQQYPSANQVLKHCETTEPLVGLLEALNHDSDKRQGNVNEVPLRGTGMERSRPCNNDRYMSDMFLRGYSAMADLWNPFIARS

SEQ ID NO: 945885 - protein, 100 aa, Homo sapiens
KPNPPPPANTFNKALPLTHRQTTYPPCTFSYKPKGSTPHYYHRLFITTTTNERPAPPPRHFTPPPPRALIQSASTPPVAAVAMSGSLPAFVLLRPRLTFL

SEQ ID NO: 945886 - protein, 136 aa, Homo sapiens
DGGRRSTMYAGSNPVAIVSGARAIIGSFTGALAAVPVQDLGSTGIKEGSKRATAAPEDVSDAIFGHVLAAGCGQDPVRHASEGCKNSLLCSSMELPDDLEVGLAAGGMANMNLASYWAYLRTGAKIGEIPLTAGIL

SEQ ID NO: 945887 - protein, 67 aa, Homo sapiens
LKCGVCALRATMDRKDARTEKRHVLAQRLDHCRYWTASSCAMKILYHRHLLLKLRAAKTKLSQAQSA

SEQ ID NO: 945888 - protein, 29 aa, Homo sapiens
MQLPHTETIAVSSISTTRLESTPVRYIAS

SEQ ID NO: 945889 - protein, 85 aa, Homo sapiens
GGEMTTLGLDNGVHNAKIGYGHENVSVIPNCQFRSKPARFKIFTANQIDELKDLSGLFYILLFQKGYWLNWNVQRQVWDYLFGYF

SEQ ID NO: 945890 - protein, 282 aa, Homo sapiens
MDIENNNELAVARGGVRRRNDRESRTLLSESRRRDAAHSTTCRLTTYVTHDDITISDGDTTTLSNIRYRLYPSYINLCIFYWVVHCGVCDVFRTIRMNAVCLCVSTRYLYSPLLQQDKTERCDAQSDTKLTGSACVDAQTRDAVPPDGHTHICSTAALARSSRLAAHNDSDSCYTTIQRDVTDVSTLIPLVLNNRTCRLIRIRAVHISSSVTYYTGYRACRHTSRSSLQQEQHLHGEMTHARSSVLVSYSRTSVMLSLNCRTEQHQRHTYLSEGRTHTYTAC

SEQ ID NO: 945891 - protein, 147 aa, Homo sapiens
MILNKALLLGALALTTVMSPCGGEDIVADHVASYGVNLYQSYGPSGQFTHEFDGDEQFYVDLGRKETVWCLPVLRQFRFDPQFALTNMAVTYHNLNILIKRSNSTAATNEVPEGTVFSKSSVMLGEPNTLIFFVDNIFFSCGQHHMS

SEQ ID NO: 945892 - protein, 71 aa, Homo sapiens
PYMARENLIVRSNCNSTISSNLIIMPTLDEGIGGPNFLAGSKAALSEGDQKKNYIKVAKRVRRAARRAKDL

SEQ ID NO: 945893 - protein, 258 aa, Homo sapiens
VRPPLPLFRFPAPFFFSHGSKRHSMVSTEPGDITTRVRGRGVPDHRQGSKRTARRNRERRGCAWRAVRPPPGTDHTTTSAPQCERRQGVRVRRNHAFACFSPPPTVPSICFLSCPPPAPPAARAPSPHSLPPTPPSHTATRPAPAHGYSSERCDDSHSFILVPASGQSNYLRLARRIVFPVYRGSGLALSPPRRLRCFPPRPPPSSCVPVAHCSTHPHHSRVSYYLKPESTIHHNTLASPPHSTNTRTAQIRQVNYYT

SEQ ID NO: 945894 - protein, 103 aa, Homo sapiens
MTLSNIRPTTHVPRPSHSIVEPDSQASQYDTPHIPNTNSRVQHKDCDKSERLNIDNNRDMTRRDARPIRITPLYNKLRRRSTNPHHIVIPHIFIIHRILLFTL

SEQ ID NO: 945895 - protein, 137 aa, Homo sapiens
RSCSVRAVMPRSAAFSLSLGPTLFIVWPGSALQRDTQRFYVYSRHSAENGKANPPNGYVSGLHPSDNEVDLLKNGEGIEKADPSHLSFSKDWSFYLLDTTEFTPTEKEADARRVDHATLAQPKKGKGNRDMKQHHEG

SEQ ID NO: 945896 - protein, 111 aa, Homo sapiens
MSSGGVIGCEWSDTEACRGCKKGVLAETQDVPESDRRGNRLDCPAFRLTILDLVSYCSDASPPTAFSVRNTMRERLGRGLAAGPRLRGRIRDLVCRRVRRFLTREPIVMYR

SEQ ID NO: 945897 - protein, 158 aa, Homo sapiens
MVFVLILYVRARRTSVAVVVLAADAVYASVRTEALHTAEHSTKRSGTVREREERQAVMRDTRVSCNNIATRGSVMSDAVTALIRYVIYTRSSRHAPTRQESRSVRKRRRLCTVSAFSAAMPHGGRSDPSQIDGGTTYELYDERTRGDVTSIMQQGESR

SEQ ID NO: 945898 - protein, 163 aa, Homo sapiens
MPSIKLHSPDGEIFEEDVEIAKQAATIKTMMEDLGMDDEGDDDPAPLPNVNAAILKKVIQWGTQTTGGTPLLLEMMRPKKKRTDDIPGGDQKSRKLTKEHFVDLLWVKLLKHKEFVEVHANCCQYVKGKTPEENPQTSNIKNDFTGKEGSPRTHKGTPGGEKK

SEQ ID NO: 945899 - protein, 350 aa, Homo sapiens
TLISSSTLPPHKLFFFPTSAQQRQPQATTSHTSRRMYDAHGPVHYKNNDLPAPRWGAAAPGATTRGKGEEPGRPEGGGKEGEAAEPPTARARNHPTPRTDLERRHTVEHKTRQTRPPNPLPHPLSYYKLRKIRRGDTQPDAEEDVGEVLIDTQNDIILQNHSGTEYDVELIKAAESGEQMKTTKIVSRTTSRQRREERRDENIERRYRKHDTEKVNKKRKSECMIRRNDADVNHTSASIQAAGPIHSESMAKTDVTQRVRTNVGSDYKHERRGTLHTWRNHSEDTATHIDPGARILATANQSRDLHAQYEQIDAYEHRHYAYEYADLTVHIEILVAHIRHTNTEMVTIDT

SEQ ID NO: 945900 - protein, 134 aa, Homo sapiens
TRPLWSGQPSIKKAFKLITHYLKNPKHITELLTPNWTNLSPYRRTNVRISNMKTLFSAYSLRQIKTLNWQLTSQYLQSINKVLLPSLAAQHRHAYMERLKKGKELGKSYPAWLPKNITFSITSIRGTVCPVTHV

SEQ ID NO: 945901 - protein, 74 aa, Homo sapiens
TLDAGRTHFAYPIDEERFLNSLGVTNSCAPREPLQGPRMTFQLLINHDPFLREGAAHAFAQYNMDQFTPVKIEG

SEQ ID NO: 945902 - protein, 114 aa, Homo sapiens
GGPRTKGWTLDTAYRIIKEHISCYDHALIHRSLKGWVGLHAVLLTVTTELAYTHILDTQGVQTVGTILRGIMLHRISLQAFRIRYINKRGEQALRHDKVTGSAMLLMYEYTAYV

SEQ ID NO: 945903 - protein, 165 aa, Homo sapiens
FIRTHKTASSLNPACQSLTHRRHAQGMTGRTCKSNYFLKIIQLLDDYPNRLIAGSSGGGSKQTAISPKKPPKVVFFAPFMNTMMPKAIHGNMGNPAFHFPHNRDFGLFLPRPTQCGPPPFSTFSCLGVHTALIVPIIHLLLSPLLTGIFSSFPSLYYFIILPILP

SEQ ID NO: 945904 - protein, 197 aa, Homo sapiens
QLHRRVFILLSNSCKAHGKIFADYRVERKCQKSNEAGMHPYMAVELIVPTLDELDQKMKKLKQNRMRERGKWNFLWSIFRSHHQKTRYIFDLFYKWKAISRELYEYLIKEGYAYKNLFRNMEPTSGRTWIAGCPNQAGSGPNHRVHTLRLSRMLMAEAGALHPGPLDFRRFLAVTPPPFLEATGQCPQAPDWEHRLS

SEQ ID NO: 945905 - protein, 90 aa, Homo sapiens
TWLLSPGQGGAASSYSQISAYSTPWYDYQRVHVRLMSLTTCQRIDHRVTGHRNKYWKLGLNMDMGVDFPVGGDDICMLTQHYWVLEMFYL

SEQ ID NO: 945906 - protein, 84 aa, Homo sapiens
KGRGGARIFRRCARDVISSIRDFLIYGGLLRGREGLPGVGRGDQGGGHRRAPLNSKGAWGPSNWGERSIYLKEIGQRMKAGHHI

SEQ ID NO: 945907 - protein, 80 aa, Homo sapiens
RTRMAAYFGGLILHAWLVACTKDRFSSCHLNIRDGYHHAMILLTTISLTHDHIPINRWWHEQPLYHVDNQSAPLLCNTKA

SEQ ID NO: 945908 - protein, 141 aa, Homo sapiens
MVGGKAGKDSAKANTEADSRSLIGGGHLPVGLIHRHLKSRTTSHGPVGATDAVYSTAILEDLTAEVLGPAGNASKDLKVKRLTPRDLQLAIRRDEKLHSLITATIAGGGVIPHIHKSLVGKEGHPEDCLKVAWIPCFLRTI

SEQ ID NO: 945909 - protein, 200 aa, Homo sapiens
LPSVKSGAYPLPSPFMLPLHTQPFVSKTARCEQNSHTRTHNSFYQNPHQRLLFFWGVGQKCPPLKKITPNSPLRAVIYLSSHSLNKPPLPTSFFLLFRGSSPLLFPFSRSSSPSTSLRPPPHNITFLPSSFLFPLFAPFFFSLPPLPFLPLFFFSFSPPSPPSSSFPLLFPPPSSPLSLSPPSLFPPLSLPLLSIFRKKK

SEQ ID NO: 945910 - protein, 212 aa, Homo sapiens
ISPGLKRGNAIFTFPNTAVKCAAAPEKIMYLSEAYWRKTGKRSKANIIFNTSIFSVVWVKKYADALQEIIQERHLTVNYKKNLTEGRAVKQEAEFENLDIPGETQVVSYRIASCYTSNEPHHLSSRPGLSLMLLNWWMGLRYSSPRRSLNSFGCVPCPSFACNIRVAVLLHPPFLPVTFFFFWPLLPARGFSFVPISSLLPLLHRLALQWKK

SEQ ID NO: 945911 - protein, 156 aa, Homo sapiens
KGSALRVAGVTYLVSCFRDMAFNFGAPSGTSGTAAATAAPAVGFGGFGTSSTTAGSASSFSAPTNTGTTGLFGGTQNKGFAFGTGLGTPPVPSTDLGTALGTGLAFAGFTTHQQQQRSTLGAVFSQSTQAPTQPNQLLNTASALSAPTHDADERAP

SEQ ID NO: 945912 - protein, 85 aa, Homo sapiens
MPNILPLLCRPHPSHHQVWIAGRGPPDPPLSSRVLSHPQNLEPPCHSLKVVVFLTSPAPLRAPSTSPTRSLVLPPKLLFRRHHIK

SEQ ID NO: 945913 - protein, 43 aa, Homo sapiens
MVAFRISSSRDWNIQAPIQSPEEVRGLHLCTSLMDMLKAWLRT

SEQ ID NO: 945914 - protein, 75 aa, Homo sapiens
SSSALQMAAAVGRLIRAPAALHVLSMSLGHYCHCSTQALPHLPRTVQGHRFPGFQNSMLRGEGSTNKAPQAYSFL

SEQ ID NO: 945915 - protein, 116 aa, Homo sapiens
VLLLIGAESTLTTFCKDFSDYDSEGKSDGMDSTDCNFLYLELKKKVSRTEIHVKYFEPGGVSHGDVDVLSIEEDSYLVTGQGFVSSTELDCHMRLYTNIPPTWKSIEDDLGTNILR

SEQ ID NO: 945916 - protein, 103 aa, Homo sapiens
MPYQSRKDCLAPSMGHVPPTLNHVFQIVPPPLAACFLIQLCPPATVKNTRIFRGICASLTTWARKLDPRPPGPGNLGPGNVQIVSYLRKQQWIIAGRACNKRL

SEQ ID NO: 945917 - protein, 336 aa, Homo sapiens
PGPFGRHLWVQSRLSRRAGTTLYTNSQHIPDRPRYNVLITNPLLHPAETLRRPPRHTTVDRPRHISHDCSVCMIRVEELVEIVAFLLVSLLGAPLYMCGAVRHLRLHHRDALREAERDTDTVSSRPLPRLSRTHQTTPRDRDTTRSSSPCFFLSQRPPMVLCRAYEYYATIYTTCSFTIYIWYSRYIIMRGRTKYNPNTFHTIIFFYHTSLKVNCMLTTHRCPHMSPQHLVILSRRLPRLWSCKYRMSAEEDGGEKTEKADYRQTQEATKHTQQDLSVSLTALLHISSRISLATHALRSVPHLTPLLSFPDSFSSSHIFTSTPSTRTLQQRDRNYL

SEQ ID NO: 945918 - protein, 224 aa, Homo sapiens
LGGRTPGIGALVGGGGGGGAPQDPRPGRAPSRARTRSRRFSFDISPIAHPPCAHPTPQSVPLASNRRAGGLCVRLPPYTHTHTRQARSMGPAFVPARRSQSSRSSPPTPLRTARCCPGRRGALQREKRRMLEIIDSTRLLAPRTYHHHSRPLRLPPPPPTPPSTDTIPRSIASPHSLAATGRARASPADGCERHPYSPSRYPIHLSCAHRASHKLKCARCNRRA

SEQ ID NO: 945919 - protein, 119 aa, Homo sapiens
VKTYSLIEGYAKDFDPAVTECIQRKKFPPDNSAPYGARYVGSMGADVHRTLNYCLWGVARPRYQEEPQWKAELLYEGNPMAYVMTAARMTTTGKVAVSDAIPTHIHQRPPLTSGTPDDL

SEQ ID NO: 945920 - protein, 224 aa, Homo sapiens
LFKIRLRRAGPILCLLPAFGLRLFLATVLHAFSSFVPPFSSPPRRLFPLSQQSPFLFGVGPPPAPPLNKLPPYSLPPAHPSIPLSSLSFSFPPLPFPPPRLLSHLPSVSPGFFFFFPFFSPPLFFSPFLLPPLVFLPLLSLSSSPVAFLFPFLFSSSSPFSPPPFPPSSLLPPFSFLLTLSFFLKPFFSFPLFPFFLLSSLPSPPPPSLSPSPLPLFFPPSYYH

SEQ ID NO: 945921 - protein, 148 aa, Homo sapiens
MSNRLNELAMRVINFEETCFAKKRQDTCIHVCNELCKMQCSCRTIVNKINTSFFVSVFCCFKECMRFINYNLGNEATVFVQRVIQGVLATNVSNKRINEESDMLDTEQRVNVLDKETKEFVDRCKLTPMKQGFTTSHFIFEKVTLYKK

SEQ ID NO: 945922 - protein, 100 aa, Homo sapiens
GDPENSAHYEGGASDRVLSNGGEGEQYGSSKQQSAPTTRVRYYLAGERHMQRAHLSLHILNRGSKTEQEGRNHNETKIRPICRGGGGVCWCGFRGHKMTL

SEQ ID NO: 945923 - protein, 173 aa, Homo sapiens
MAELQRMFLPHVLIMDRTERLARDVRKEMAGHHIVALCVLKGRYKFFADLMDYIKALNGNSARSIPMTVDFIRLKSYCNDQSTGDIKVIGGDDLSTLTGKNVLIVEDILATGTTMHTLLSLVRQYNPKMVKGASLLVKRPSRSVGLKPDSAGFEIPNRFAADMPLAINPLPGW

SEQ ID NO: 945924 - protein, 101 aa, Homo sapiens
MTSKLPVVLLAAFLISAVLCEGAVLPRRVKDLKCKGIKAILKPFPPKFNQGPEGDGKGPPWANPEFIARFLGGKKALFDPKGNRVQSGCAQFFEEPWHFLL

SEQ ID NO: 945925 - protein, 167 aa, Homo sapiens
WYSLLRLDERQKLGNLGGSPQVVLLCCAFGRRDDLEDTGIMCGSSSCLTGRSSSTPWLKGGRRWFLSSPFAMIFLPFIMREFLKPGVYIYFLAPVSAPGIQLKDSASSFLKFPQEISNQPLFHLGAPPLPPWVWGCCPTGNSRVNAPVCSRPPLVEIRESLPFLAFP

SEQ ID NO: 945926 - protein, 201 aa, Homo sapiens
SKSSYAEEGCSLTVTRPQSQVTLVTVSGSLPKDDGTLAGLSGLRTINGPTGGDLADALDYTGRGSRNRSASLTGEVTLGTALFKRSEAGTTDIDSIYEGIDFYFLNYPDPDGEIGTLTCARAPSAHLRPPLEMPFWSGNRSMIVPCVEVLTESPRDTISGNTAPMDENSVGASTLMKLIVIVHMTKHPSLVQTGLRLDKII

SEQ ID NO: 945927 - protein, 103 aa, Homo sapiens
MQDHAASRLICTSGELGGCMPPPSRYIHPFFPSAPYSHEGLASTCAAPRTQEGSEGARTLSYDYGPIRGMVGNSDRVTPTHHTPRLPRATQLRVRHTRIDSMS

SEQ ID NO: 945928 - protein, 142 aa, Homo sapiens
MTASGPAYHSAKRVCGGKQRPVQKEGRNQNRTIRRTALSKTWVCVRPTSTAILSQIGIRDQTLPCRVNDEGMMTRKVKKNFASPSLRDCQGRYMDEGTLEREYNIAFFTLCRHTLTGTKDEYNAPTTTYIPLTSGRREACAE

SEQ ID NO: 945929 - protein, 77 aa, Homo sapiens
RPIRTVGTQYMVHGRGALISQESLRDVSLSPLHYERKNCQLVDQGIACPTGKGGSCKYEQGELHGDNMVANLTYVRQ

SEQ ID NO: 945930 - protein, 132 aa, Homo sapiens
KSDPQRGRGRPRHLFCENRLQVLTASYVTEQIIKTIELPKGFQGVGPSSNDETLLSVVGRAFHTSFAPITGQVSAVLKKNPAVYLNTSKPLCKAFIVTYEDIRKQEERLQYVRMKLQKALMPHILSRAADSE

SEQ ID NO: 945931 - protein, 372 aa, Homo sapiens
RPRAAEIVDGISVSAWRYKEVDGIMIARCQERMVETDKTRTTRLERRRQMAYMSWRQTRDTYNQHITARHTTTHRTNHSPPRPLHAPPSPAAHHTTTRPPSANPEHATRSRSDMETAVADHTISYKQLNIRYSSPNSIAHYRHSRGRTMELADMRKSAQRRINALYQRCTVHTTLYPTRARTRRTRALAAAGDFKRRVARNVMSLRMLRLPLRASTRISVASQRLRALLPLRPHATAPTSLARYVPSEHHDSLCDVCHITQIALKNDDTRHEEHTTARTHDVNSRMHDTRARPYIDARIRLHTLRPTHCDRDLAVQYNYYRGDEETRACRASSVNWSVVRVYYERRDTPDVLCICSLSAALVRLYIHRGIAR

SEQ ID NO: 945932 - protein, 199 aa, Homo sapiens
THSVPGGGTVKLKLYEDSAIPLPAESPKKGPKMVASRVLSPPPADPPTSSFSVLGDVGPPIRKPMNRGTLISLLVGGPHMFVSDSLMAWPRPSYPPSLTILYSPAGLLPAPAPPLSYPLPSASARFPYVGPAPSGFLRSFSPPLCFLFDRVVLLSFPPLFPFFTTILDFPRPLSPLTHSPHPSTPSPFLFSLSPPPSVC

SEQ ID NO: 945933 - protein, 61 aa, Homo sapiens
MIVGLRILFRSRCSSFDVTPSSTYTDHTPLISDIISDISQTHYRKTITRVVDSRPILVFTA

SEQ ID NO: 945934 - protein, 160 aa, Homo sapiens
RGGRRKGEKGRKKGGISRRGKKKRGGIEKREETAPGGREEKGEEKTKGGRGGEKGGKKKEGRKRGEKKRRRSRQGRGGKREEGQRAEGKEERREKRGKGGKGKKGTKGRGEERTEPETGKQGEEERAREKREEKKGGEEREKTKKPRKGRKEKRRKKGEP

SEQ ID NO: 945935 - protein, 113 aa, Homo sapiens
QGSGALQEKLPSVPHNTNPSPPLRAYITSQEMKGIRGGFKGAGPQGERFLGDLVAKAGPDRPPSIFEGQVHLWDQGFGWAEQERNEFGRQVEVREADFGAKVYQGGAATGGKG

SEQ ID NO: 945936 - protein, 320 aa, Homo sapiens
ILRVDPVRVLETLRHTLIPVISLTYHDILCNPHLFHYVLIASTRGSSRIRTTFSIRCIILASSTRFSGSDSKIDTTITSTRQCRALTDVHYDHTCSCIIITRRAHVSRIISNIRYSILHMTSHKNTEHILAPGANSREAQRSPLSGYYFKMNTHKSHHVIFLTSSSVLYYERSTTLALWATLLRDEVHYRELASNIVAPLTYVTNKFAPGSCSILTKASGSLTSTSCTLLIRGLSQQHMCHCATNGELLSYTLLPLLDAYLCALTCSTLHSETRIEWPITIQALLNHTNNREELDGIARAALIHGYARAGVSPQPMQLLH

SEQ ID NO: 945937 - protein, 127 aa, Homo sapiens
FKGPKAVCLVLKIVAAMVGQSKGIKKLLQAEKRPAEKVSEARKRRNRRLKQAKEEAKAEIDQNRLQREKEFRAREAAELESRGSCSTEGEKGTQERRTIFQTYFRQTRDEALATSGFWPVTFGQKSM

SEQ ID NO: 945938 - protein, 181 aa, Homo sapiens
GMGGGYKPSSGQSYRSVGFLRGLNLKEKIMPFMGWCVGTHTSDEQNHWGGGIIPKGDAQEGASHGRKGEFGGFGSVTGKIGWEIKINHEGEGNRARYMAENPHIIGTKTPSSDGWGFDYTKHPGKPDPRGEWNPDLSIKRAPEGRVGALLGFKFEGHLLRASDDHTGWLGDINAGAKEGGA

SEQ ID NO: 945939 - protein, 85 aa, Homo sapiens
GIHASGSFQFQFSRFRALNGLGLLYLFDLEAMQKTTYLQVNSRTPAHKEKINPLTCYGGANYAIRQCSCLTEQGRENSDTGALSA

SEQ ID NO: 945940 - protein, 102 aa, Homo sapiens
WLLDVGFDCLFVLCLRPRSPPIPHPHHERVYFDLFFFQLSLPSLLSVNVGSSAARLYLYVVVRGRPPVLYLGKFQTPPAFPHPLAPTSPHQPPHRHITGESK

SEQ ID NO: 945941 - protein, 141 aa, Homo sapiens
MVNKDKRGKSRYMIRYKRTLEPSSLSSTHDPLVKREPKVFNRGDATYYRPNSRMFHHEITYNLDFRGTYKFNTTDNSLKPHYNEQIRACAALAEDPNLSENFMMCQGRGHWYDIESGSYGRNVSCLQKAASVCSLSLCMFS

SEQ ID NO: 945942 - protein, 270 aa, Homo sapiens
MAGLPSQLDRCGPMVGGRGLGALKPRKGVNTMPHSSSQSQLYLCRRVAVMRLADALYRGSREGGVVDAGEQLCYEITNKLPPHNPYNPTTRDDRGVVLWGGSSRALNGSADAAADFTNLNGNSVLTQTKGDKDDDQLRILYNVCDGVAGRRRLRPSADERFRAVLAAARHASCSGVMYSRPTHPATPECRVPTSCMSVRDTAHTPYVRFINTHLIDVCNHIHKQNTLSPCSVRGQDGIFLIPTLIHHIKATPLIFTESGFEGARTASGGE

SEQ ID NO: 945943 - protein, 311 aa, Homo sapiens
DCRRGAATWGGGHPVDIVATYGSEVRICKNSLQSKLTPRRITNTTDISEKDTSNIEQVHNKVPCWSLVLRITQELRAGGDGEERRAGIVLIYDFLRYRDELCLSVLYFRWSCYSARRAPSSTLCYTLLSLYPCPEYGCCSCSLVVRVVGESVVVSSVYVCSIVVGRGGGSLLLYVMDCNPTERYDTHQGRTERRVVELGDKTFSLLLRYCLYILDRRATVTVESRDDNIKSSIQVREMISVCVAEYAKRLSSFSTHEPNTTSSCIMATSHVHDTLHTDACRKRYVVREIERSIERCSRRVVHVSSMCAVVE

SEQ ID NO: 945944 - protein, 74 aa, Homo sapiens
GTSTPYGALAWPGISGLGCSDAETAEAGELAHTRSINSLWCLRNHQQTNLTVCDTAECPPADFHDSSDADSSAN

SEQ ID NO: 945945 - protein, 84 aa, Homo sapiens
AWFTELCPDIPALYKDWIKEMIYVLLGRQAQQAGKKLSWKHWRVRGGLEPQWVYSALQWQSYNLGILSRLCKNRYKIARIYGKD

SEQ ID NO: 945946 - protein, 70 aa, Homo sapiens
PPRAARHCPAAPPVKKGPLYPREHHKEIKIEGKGEESLVTTMTHNSPLYFISLIDGGQHKTTTRNSPPVT

SEQ ID NO: 945947 - protein, 192 aa, Homo sapiens
MGGFLGWWDEGKVNLAIDRNIRYTQQITANTRKDSEDKCQQGDTQTEAHPTTLLKGVFARYGFVNGWVWTVGGWGSAVYYRLCLSGAHASFEGLYLTRSVTSASSSPLSVRPPRNVIWCNMSCHGEETSNYGGVMSNDGTERTSCDGKGRNNAYAYISVESWSALLAILHIVDMKIHTSCLLTNDYTPSFEA

SEQ ID NO: 945948 - protein, 385 aa, Homo sapiens
RSGALYSGRHPPGNSALYQGPGGTGSAVICSGALLYDDESPHRLAVRLARVLAECQEERIRGLYIPAHRAGSITMCHAEIRFMWVVGRVVRTRARRGVSARLERIRREEAEEMEGEDGWSGVVLFADDKNNMRGRKSTKSAVGVGAGRRVGGQVRRLARTRIPSAMDSAAGKKERPFVSTRTGATERMTREGAPPALPSNPTTHVPAAVGLLPLRPVPRAFDSSNDSRAGDVRARSLSLSRRSYAEINVSDLREADASGGRARCAELMQPYRRTARRLLARGRDEGCRGLSAGRACGFRRCWRWWSRVRSCECRVICGGRLFASCVAVCDRGVRRRSSEWWVSRKRCSHSVCDGRRATPRSYVLRAVYDSLNYMCAANPSMCHGR

SEQ ID NO: 945949 - protein, 104 aa, Homo sapiens
MVRARRPSDVVLSELVHVDIFDPSANFVETQKLITIYYAYQESHQSVLIKHQQPHPPHIAHYFSTHNKWPVDVTAINSRWSYSRSTVFAFYFLLFIFRFGRCTV

SEQ ID NO: 945950 - protein, 50 aa, Homo sapiens
MSETMWEFYDCIAIFVLELRNVSYTIDALTYRPPLSRFNAHLFPSRGLGP

SEQ ID NO: 945951 - protein, 308 aa, Homo sapiens
WRTVQAAAICTRERSAGYICAHGHRRSRVTTSCSIYILWLQRTYMCVWCRCCGDRRSEHYRVQGEERERKWQRVRMLQTQYDATPTEQTVTSQHSKHNHSIIVPVRTGQAVGAPRERQREEHTTRTCETQGVMWLEEMWVGRSRLAHKDKSNCSNDTHNTHNRHTRQYQTHVTQLLQLSTVVSGYSGMLSITPYARPRRVTRVRYGCSPRIVLNEDSDAPEYHRQYMSKSYREQIIVSGTLHALINYQTGIFSHTIRRHIPTIMMNINKCIDNQKLNGIILSVIDVILFSAHLHEIVTTHLALTIVEL

SEQ ID NO: 945952 - protein, 29 aa, Homo sapiens
MSDHTTQQSLVRYSHCAVYPRRQYAASRS

SEQ ID NO: 945953 - protein, 161 aa, Homo sapiens
MRGKNNIETRKKERKTTESGRPKPVREEKRNNRYSFQQQDEERRLVEFTPSLRATCAEEKGGRHRHAASGYREQDEDKRAWTPAKTQPKNNDETEVSRSKGTLENELTPRSRPLPSPQSTPSYLLLYDLRCECVNHASLADASAVVDELKICRTSNKRTTY

SEQ ID NO: 945954 - protein, 225 aa, Homo sapiens
DVAIFDAGDQSSDSSDQADAEDSLGSSTDCSEADKHCFPQASYKYKIRRSNTVPGRTDELALNLKGGGAEALLYRATMISYSMSGTAYAIYELGGASFPTKREWLRTSQHSLGSLTFSSLWTSDQITNRALLCRSIFIGSVVTATTKALSAMTNLDPQRETPPARLRPSCSTFLQGYASDRRPSSFAISSYGAAITIDLAFIHIVMLCAKYGLVLDDRHPIVLLQ

SEQ ID NO: 945955 - protein, 103 aa, Homo sapiens
PPLSLLTPSLPPLTFPFYLSLYPQVYRVPTNIIKYFSIVLHLNISTISITITNSPLIKPFSPLYYLILSHSANLSSISTPLSFYGVPLHALPLLTSIKLHNNL

SEQ ID NO: 945956 - protein, 94 aa, Homo sapiens
MRDRHTARKRAREYRITHISRPSAVDDVTIVISSSSYQVSHTSALYSIQTPNNTSSLTRLRNNTHISYNTVRSCRVAASTHARRSRSHRAVSLA

SEQ ID NO: 945957 - protein, 69 aa, Homo sapiens
MYQRIVPRVRNVWPEDTIVGFGLDRAVERHTNENNIACRGRSDDCVPGATRLCILPRCLFAVSCILVVA

SEQ ID NO: 945958 - protein, 119 aa, Homo sapiens
SKSMNEGRGGNSSARHVSCNIARATLRSTRPVYKLLTVIHYMRVILARKETLYGFPLGDSALKGSHSTSELLTKGRLLKYIASIPQWHTLLQIHRMSPLLEPCICEQLIYLDAFHGTRP

SEQ ID NO: 945959 - protein, 192 aa, Homo sapiens
MRLPPHRRRRYAERHPTLTPRPRHPTTCLTTQCPALARRRHVLVCGDEGRSAGAAAHAVVLLVANIETHAPPPRPKPKRELPLTLYLLYQMIKKNTVLDICYPCADSRVRICAILEDDVYILSKRHALPPNHFAHHHHRIRCNLLRSASLLLHTVLRGAVSGCGYNRCYVMVTLSDAPLIDNHMRARCNVVR

SEQ ID NO: 945960 - protein, 129 aa, Homo sapiens
MIKFSQTVTSNHSSYTFIFALFTRSSNANACNMITTSTIDTHNVVIWIGVRRYCWLLAGVSEYVGRVEIRKNTNKGADIKPTYRSVISLLVTVIGVEVISMYQYTSNVYTPTLLSSFLYYLLIDRQHDR

SEQ ID NO: 945961 - protein, 198 aa, Homo sapiens
LDGYRDAKSKPTHLTLIPFCPADFEFMKRLHCKNGKYGNSAGQIVSLGSDKASQLQAIIGFRHTLNYITVNVHHWYEQNIKQMYQLAHIKCSSDIIKTSVGPGSTTLENDETLIISDRILETVICPYLKEPLHTSDDNISNGNTAYNLCTTVTLYAIEKHKELENEPLSLVKSRVFRNTVASKRNQQMAPSQSYANSE

SEQ ID NO: 945962 - protein, 74 aa, Homo sapiens
PRRPASFGPREFALWSGAEVASPEVEQPATRKSNQQGNHIKAAGAVFLDSLTQHTNIYIPTHPLPIPPLPDHCK

SEQ ID NO: 945963 - protein, 108 aa, Homo sapiens
MTSDIHSIGWPTALKDAKHPTVIPDRIALIEKTDLSQVQMLTSDLTAPCVSAAYILRWQVNKNILSNTSQHSLYYKYKHIPTRCGGACRCRYSRGYKHENVVNLRGRG

SEQ ID NO: 945964 - protein, 51 aa, Homo sapiens
MNCNWRRFITQNSHAEKHGTRGPCATIKTEHAKCGYAETAPRHGHYTEGSK

SEQ ID NO: 945965 - protein, 73 aa, Homo sapiens
FGFKNMYAKVSGSINMDSPPQGLFRGLSRQASHQHMGYKKGPHVVENREECGPLPIVVASPRGPFRKDPKPKN

SEQ ID NO: 945966 - protein, 131 aa, Homo sapiens
MGSCYVAQAGLKLLGSSNPPTQPAKVLGLQAEPPCHLLLSSFRSLPSPGPPPPWLLMDYCSCLVPAVPPSGLCPHALLLSLRSSQVAAQLPSLLKHPLTREACPGHPLRQLYLPLPFISYSVLFFLNDPTN

SEQ ID NO: 945967 - protein, 191 aa, Homo sapiens
FFLRPILALLPFFVGVQCLYLGALLSTPPGSFLFSFFFFGDKVFPFSPPPPGGTCVFRDPPNPPPPGCLGVFPPPPLRPQNPGAPPPPPPILLFLRETPFSPIAGPPRGVFLPPTPPGVPLCDPPPGSSFWGTCGPLLLEETPITFFFPPPNPLNIFPLFPPGAGAAPLGTSPPDLFGGPLFYFSAPRSRA

SEQ ID NO: 945968 - protein, 69 aa, Homo sapiens
YRGKTAGGHFAFSILKNALPWEDQFQTVFNNLEHAPELSSKFDLSGPTNTSYAGPIALDSPNRAIITGG

SEQ ID NO: 945969 - protein, 113 aa, Homo sapiens
MTALNMYIWKLLRENHANCSMTFFSMNNSLIWSALHLNNNMKGNCITKEMMQTFYSRCYREAHTFKPSCICALKLGYRTSTPTKSGKLRMYFRIQGLPSYPCRTYCSVCNEKD

SEQ ID NO: 945970 - protein, 107 aa, Homo sapiens
MVNAIICMALECMGYPCFVHVALRNAIVITIRSGRLCVSAILVINCIEYGRVTLVHAATRSIVLSTDAYILTSVIDPRTELHAIMGCEELVTRIIAKIKSSEGTVQH

SEQ ID NO: 945971 - protein, 156 aa, Homo sapiens
RGFSQTPGKVSRDPFNFRPPPPFQKRGFWGPPQGLCSGDSWAFGGVTAPPFGKVPRFVAHRSPFKQVGVFKMRGPPGAPNSPGPMGGGGAPKFFSWGAPRGPQETPRKNLPRVWSLGSGGFKIKGGKKKNSPPPKKPPPHPPKEINLGKTTPPGFF

SEQ ID NO: 945972 - protein, 122 aa, Homo sapiens
APPKLFLRPQPGATEARVNPRGYVSPGGKNLIFPPPRTAPTPKAGPKAGTTRPRPAPRARRPPPRPIPTSRAPRARTRRRPTPPGTHGRNGATRARTKPRPGCPPHRPAKGRPKRPGDFPRL

SEQ ID NO: 945973 - protein, 116 aa, Homo sapiens
MALLGFVLQLEHPGSRVHRGGRKDPLRKTSLRETFRAGLKQKLFKPLLNDLFEQSPSLGPGDPNINKARQSFFLHHGRVKRQLSILQFKGATESWAPHKGEVLNAKRCNGMETGQD

SEQ ID NO: 945974 - protein, 145 aa, Homo sapiens
AGPCMGIPPRFFYNGTPMACETFQYGGCMGNGNNFVPKKKCLQTSRIVGACNLPKVRGPCRAFIQLWAFYPVKGKWVLFPHGGCQGNGNNFFSKKKSKKYSGVPGNGYKKILAFPNYNWPVSKSKNGQFFSRGPLAGSPKQPGSK

SEQ ID NO: 945975 - protein, 101 aa, Homo sapiens
MAYKEPCFTHLHKLRDHAPQFSPAVLKPGAVCHRSKPAVRPLIGDIADACNVRGDVECEVSNLRDDVSWTYDSKSRILCTKSVGELVALGLLRNLSKKHNW

SEQ ID NO: 945976 - protein, 106 aa, Homo sapiens
LFPFKPALLCIMKPFQKAQSLIWEFLLEPRQTLNDVDENGSGVSLYLLLTLPEFASYTEFPTDYTCLNETDLFETRPGAVRLTLERFVGGIGTDYSTPEVTRGDQL

SEQ ID NO: 945977 - protein, 117 aa, Homo sapiens
MVAELLPKNGELTIYTKLKGVFYKKEGLTGPSNRTKPSYPGTNARSGGTPHFLFQKPDLGWQKTHYFVGPPHNSFPREEPNPFGAVNFLSNGKNTPQPKNLWLPKPLPPFFPTFSFF

SEQ ID NO: 945978 - protein, 117 aa, Homo sapiens
FYFMPFFPSPQHFFFLMSLFKLPLFYDAVLVIFLRLAGNSWNMGGRGPPKQGGEINPPLTPGWAWPPGGGMAKLFPYDGGIILRRNNNLREPQSPVFWGTNPKGGGPPQKQGNSSPP

SEQ ID NO: 945979 - protein, 141 aa, Homo sapiens
PVGRGGRVRRPPHPPPPGAGTPPPGGKKEEPPGGARPATRQSPAERRDRGRETPPSRPGTARQGTSPARGAGHPGGGQAGRAARAPGRAPAGGPGPLPSRGPGEPHHGRRGRGPHVAGAPSGRAGGRTPPGGGPGPRPAPA

SEQ ID NO: 945980 - protein, 95 aa, Homo sapiens
MSGLRDRRRMGDRCMNMRVYSFVNAGSIQLMGRQSPPHSPGLNIEFLGKTGTHRVSPDSLEVLTYEDNRLGLTKSCDYRLKTPGPAPKRILAVYY

SEQ ID NO: 945981 - protein, 102 aa, Homo sapiens
VSPGDCTPPGNPVQGFFKGKNFPLGPPLGYSCENRDHLGGVQKHQCVFGEWNRALPVCKLIQEAPKPKCEKALFAFQESKNLCEPMENFMHQLRKGACQWGS

SEQ ID NO: 945982 - protein, 35 aa, Homo sapiens
MRALLRPDLLLRGSLTPVYTDWETPSNWGLTTPYT

SEQ ID NO: 945983 - protein, 166 aa, Homo sapiens
MSRRTCRQDVRVHACDHCTDHVPCALLDILYYIWTLITASRAYTLARTSRYRSVSRYSRTSVRVCDDAMAVTGVVYCAYTLLSLTVITNYGCILCCHYCVYSIGYFTRHAYCAHICALGLAEQVDNNCHVIAYVASTLATLSTYDVETITVVVAHYNPHWALAWSY

SEQ ID NO: 945984 - protein, 122 aa, Homo sapiens
SQKKNFFLGKGVSIPSPGEGDTPLRAKPHFKFFKKPVGEIGKARGPLLKKGGHPKPKGPLFPKTKRGPGPPGPPGFAPNEKGGPTKPPLGGAPNLGPPPQFGARGQMGQQIGEREFFPKIFK

SEQ ID NO: 945985 - protein, 279 aa, Homo sapiens
RQEEEREEHGGNSAREKRRVEDIGTARRIGKPPGEKTGTRRADTMTFKCKENRSKALGQRSRKEKNRENDKQKNEEAKQEERKLDRTEKERKENKHEGKKYKQKKDGRKRRREGGEEQKERDKQGGTNREENEGREKEERDKWEKRHNITKGERDEEKTQKKEDQEQAKEQVRAEREKKSREPEHGRNNRREAERGDGRRNEQRRSGEDTAERREGDEASRNETENGLKREEREHNEYEQTARERSRRNETQAKADGDGIVMTKGREEEGAQPTTDTNT

SEQ ID NO: 945986 - protein, 128 aa, Homo sapiens
QRERISSEPPPPPPQRRRSVAPFSEVLLSGNSSKSSGLRNFFVLVLYSVRTTLRLVKTRSPKENRAKPKRTTSIDRPTLPTDKPPQDQNKRLYGKRIIERIESLSQHLLSANFRPYDSGYGPSRRTPR

SEQ ID NO: 945987 - protein, 131 aa, Homo sapiens
VVRTWYEGIRLLVRIEHGTLIQHRGTSSSKIRLSPIVPPRNMTYLRQKQTYTAEDLDGVAPSTDVKTNPDLNLVHVKRKLPTHRIGFRKTKGIKTSLKVNSNHTGSDGNTGRSAGVGQVTVITDTSYGGIL

SEQ ID NO: 945988 - protein, 100 aa, Homo sapiens
MSTKNRKSASRGIFESLKDPPVGEEKTEERANPKGRQRKKSTHPRLDEQSFQNSFLSRDHPPSTEDDNPFSSFRRPYTTQDDTREEPLTSHPRYGTHHRL

SEQ ID NO: 945989 - protein, 128 aa, Homo sapiens
FQVEDYLPRTPHLRSEKPAIYDDERRYGRSRRRKPSGIGGIIKIHQLSAGILIYIRRLSRKSRRSQGRKPEVKTRKLSLRITHTKLYASPQRPLNNRYTKQKKARDRYFLAPRPSSTTPLPSRTDLAM

SEQ ID NO: 945990 - protein, 189 aa, Homo sapiens
ITTSNKITFSLVYFKLFDSWYGWQDPSRTTLATARGKEASLSKSVMEIPRRRTMERSGGFADVGTRVCLSFYRRWTNRVGALQVCVTMERETGGIHGIQPWACYLQYEAMSQRNLNAKTEQGPTGVTMTSNPITWGQIKKTTHEAEKLLERQGQATPDSMFLAMLAVVSCAVCFPCVEAHIGHMFLIHL

SEQ ID NO: 945991 - protein, 123 aa, Homo sapiens
ELARGISISSLNENKARNSLTIQNNPERTKNAKLGQSDDDQYVRNKSSLLDPVIDPPRHDPARKSSPPFLSRGTLLTSNTPAIPPRHNLYIPKPIHPKGITQRPPAHLCRAIAIIANPSTLPL

SEQ ID NO: 945992 - protein, 148 aa, Homo sapiens
AELAHAGETAYSGDPSPKPAGQAAEAQGRQKLQGDSEGREPHAEGDRRPEGGRCGTALLLVFIHHLPSPILPYFRYSPDPSPLLFFPILSLPSSPPDSLITSLPPVPHPLLSIPSFSHLHSPHTSPLLNPTLYLSSSSPLLLPLSSFP

SEQ ID NO: 945993 - protein, 196 aa, Homo sapiens
EEPVESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLSRERDAITEAGEGSHPISCLTPENRKGSWVKDTTLSNKTKWTRQGGIHKVRGKSWTQIISTTVKNDPPGSGNIKETHMTLIKTWRKLSFKINI

SEQ ID NO: 945994 - protein, 93 aa, Homo sapiens
MGQQLSTQQKQYIKVLKQLLKASRASVSQAQLRDPVQTVVSHNPWSPEEGTLDLSFGKKWGEIFDIMHKGNGSQFFNRMGLSKATFALLYTGP

SEQ ID NO: 945995 - protein, 126 aa, Homo sapiens
SSRRKRKLRHPPTHPEPRVYRKPTRQRSFYFLLDPLPHIPLCRHRGRSGTCVRSQGSTPNSRSVNGIRIPPRLTSSKYSLVTPTPNSPRTPGARGARARCVPVASVFLRHTVFPLLSLLPHSSLPP

SEQ ID NO: 945996 - protein, 44 aa, Homo sapiens
MIRAKHETEVSKHRDIPHKTYKNKPPKDCNRSPREPFASLADYS

SEQ ID NO: 945997 - protein, 110 aa, Homo sapiens
MRQSIALPKNHTPQHYYPQTKRPIPISGGELRYQGARNPQLSRPLLDRIRLYSSKTSRVPTFRTSFYLIYANFSVDNVINRGTPPTRVSEGATYISTTPINTSSASVVPS

SEQ ID NO: 945998 - protein, 66 aa, Homo sapiens
MVVGVSRASDVRRSPGFVIGLSQESRFDAEVEYTDTDYSYYSVIKYSKGRFFDSGRCGRFGRDLRH

SEQ ID NO: 945999 - protein, 112 aa, Homo sapiens
MGKITISEAEFLDMTEKQRLRLRTRKEPSSTSRDRLPSVSSRKTDASRSIITPEKELISYSAPRSCGGVKKRKKKLHIIFKKNKYKRKKAKSVASHHKADELVQLFLLRRFL

SEQ ID NO: 946000 - protein, 141 aa, Homo sapiens
TNKSPSIILSLFFITVRLLEIILEVAVSDQRTFWVVGTWYESSVGAYRRGLVVRSRLVIILPIRCGTRRFNRLVLGIRIQATTCRRVRFMRFLVIRYTQKVLIRRITFLRLPITVFRSSRKAHFIPGPLRIITFGLVIVIR

SEQ ID NO: 946001 - protein, 51 aa, Homo sapiens
MSDEKDLWCSPEGNVSSWWSACTGASDEGKTKSDHTSGSDRGPSREMFVDL

SEQ ID NO: 946002 - protein, 75 aa, Homo sapiens
RQNYQTEGKLESEGELGSEIRVVGKCLVEDDAFRKVKRKINKGSVYHSKELKEVTYDTNPSNEDTTREPDNTVKA

SEQ ID NO: 946003 - protein, 122 aa, Homo sapiens
MTSRDPNEQNCGLIKFWLLSQTSPPFEKCQKLLREALANLDITGTHGAAPASSSCHHHNASISTIWQISYPSNLFPALLMGCVHFLKNQLDQGVELEFKEAFKSLLFCFAVLNGTDKAFPLV

SEQ ID NO: 946004 - protein, 46 aa, Homo sapiens
MNQTEILEVKNAIDVLKNASESDSSRIDQAEERISELGETIRYTEE

SEQ ID NO: 946005 - protein, 113 aa, Homo sapiens
MLCGEPTRQPLTPTKTFTLPGQGRSHRPRFGNAHFSPSHPPPPTPTLSRSLDPIRTPCRPTNASLHHHRPTARHPPLLFFHLSATIPFFYALRYPFPASVSLPSPPPSLLHFP

SEQ ID NO: 946006 - protein, 135 aa, Homo sapiens
PGLPEFGFRRSVVRTPGWQDFGKTNFPVRKRRGPRGSSPPLPPLRSPSLPLPPLPAPQPAPTDSAPAPPAAATGPPRPRASPPGPLRRRRLLKYRKGKGTYVPLLPHLIHIYLRPTVAFACTSHSTESCNFINLP

SEQ ID NO: 946007 - protein, 166 aa, Homo sapiens
MAALLSSLVGSPRACSAFGSRCFSPFLFRLPPCLGQPLSPRACHSQPLGLLPLSLRAFSHSPPFPSLLFGPSCVPPSSFLLCHCQHSTLVLFALTSVASPILLALSPFCSSQLALRRLPFSALVSCSLFPPPCHPFQASPQYIFSAVYHRFRFLLCTTSLRGLVSS

SEQ ID NO: 946008 - protein, 141 aa, Homo sapiens
AASRRLLTEQDEIRTRGMKNFRHIQADEAKPLTRQGLRAPDNPPYDKGAFRSEINCPAKYPSKPPKITCKTKIYHPNIDEKGQGCMPAISAENWKPATKTDQVIQTLIALANDPQPEHPLRADLAEEYSKDRKKSSKNAEQ

SEQ ID NO: 946009 - protein, 127 aa, Homo sapiens
PGESRGNLKSLSQPSSRDHKCAPPRPAKYRNIGEKGLLHGGQAGREQPTKGTTLAKDYRSAGKTGVSHHARPTHHIFPELQSYVTQGRHTNRKIREMETELTTEAENRRTDGPRHNNPGNTQSGNRT

SEQ ID NO: 946010 - protein, 132 aa, Homo sapiens
MSFFTRQQQKVQSEGGKIPYKTIKSHDYSLTIMRTAWGNYPHDLITSHEVSPQHVGIIICITIQDEIWVRTQSQTISFYPWSLPNLLFFTFQNTIMPFQQFPKSLTHFSIHSKVKIPNLGLTKGKSFCPPTL

SEQ ID NO: 946011 - protein, 147 aa, Homo sapiens
MALSAPRARPSGPSPYPFLSSSQVSMWVSGWPPVCRLSPCAVPRAPCTFVFMAPLPPSPLPSCLVARCLFLFLTSRLPFSWDFFTACSAPFRSYDRPSPLAFWSVTSASRHLCVLPVPICFAPRPSGGLCFPLLPLLFSFSFRDPVA

SEQ ID NO: 946012 - protein, 103 aa, Homo sapiens
LLPWAAMGGAPLFCGPGVFLHPARVPSGAGACFFEALVWGGVPPPLSGTPFFVFFGRAPEAPNPFFPGPFDKRECFLAPPAGSRQNKRGFNFFSTLSQGSGRG

SEQ ID NO: 946013 - protein, 380 aa, Homo sapiens
RIISSSRRHCFDVVFSHLVYTISRHLTVSVYVTSCSLSVYQYSMTSSSLLCQRLDDSAYNGMSSPTTWSRSISRTLWEIRYLLSLCGCYIRSHSHDHSTHVSSLASMCEGVRVRGATTQTPLVSRRYRVDVGYITMKRGVGRAFTLCFALTYQALRVVSSRHTKALHVASYHTLLCAARRGGLAPSVVFCIIYSYVSRHDTLLSSAFVMRDERDIYLLGVHPHALYLLCFHLNEGREGCAFLTRLPFSTLEKRAALVFLYSYYKSYYTKRGVFIDINTRVVNITVRAALVVCIKSQKKYMFLFRRGTSSLRSSVRVSTKETNYTHSSIVEGVSPTTSPPGVWRAPALVKRYNTYIFRERGGGGSQRVSFSRAAACARGMS

SEQ ID NO: 946014 - protein, 138 aa, Homo sapiens
MWPDTVLGICCGGNNQQYNFVNGDICGINQELIPLTVRNARLNMNSSRHHDKGVTVIYRSACYEGHVYLLCIYGNGPALKYRTGSSSTIQAELIGLSPDRVGEGKYFVMVAKPKRSWADISEPTDLWLSRPHGGKQHS

SEQ ID NO: 946015 - protein, 73 aa, Homo sapiens
RRSLALSPMLKCKNAHCKLSMHGERQYPAQAWKEIGSSSVSLESPKHIEANVGGSNEDLGAKTNQGNMGAPNA

SEQ ID NO: 946016 - protein, 73 aa, Homo sapiens
YWMHIDKRLLANRNYGFVHRVWALHLPQGLTADAHACYTVHGYHSYDNLKGLKRYDVTLWQFDELATSYYTCS

SEQ ID NO: 946017 - protein, 141 aa, Homo sapiens
SAPFFLHRCLKGKRAPYRRGFFLPLPPSFSLSGGAPGGVHTAAWGPSVGKRGGPPPCTLKGGLDWGTLGVGSSSGGGLFLGPKGEFFWGRFKTHYPPGFFGAGWFIGTFKHFPPPLEGGGSPTGYSFFPGFVSGKGKNNTK

SEQ ID NO: 946018 - protein, 167 aa, Homo sapiens
NKRTHLSRPPAFAHPHRKGRQFGGEKRATPTNNGARENTNKTTPRAPGSEHDKRNRERRQKQEHARQGTRTNQRTETQPDEQRHTRRRRNDRTRAGTQGTGRNNHTTEQTEDRRKETPQQSSSKQTQAERQAEEQTGTTHTHTASTRADRGHHKNAANAGTHSHQPT

SEQ ID NO: 946019 - protein, 141 aa, Homo sapiens
EENRVLLAMVNPTEFFNIAVNGKPLDHISFELFAYKVPKTAENFHALSTGEKGFGYKGSCFHTIIPRFMCQGGDFTHHNGTGGNSIYGEKFKNYNFILKHTDPDILVHGKCWTQHKWFPIFHLHCQYVMVDGKHVVFGKLK

SEQ ID NO: 946020 - protein, 134 aa, Homo sapiens
MELFCPSCHVRPPLDATICDPLILSLHPLSLLHPPSCTSSSPLLFYIIACCLLYLFSFPISSLFSLLALPFSDSLLSRPLFSPLSPFLSPLFLSIPLLYPSYSPPFTSSFPSCLFPLQSLPFPLSTTSLSSFPC

SEQ ID NO: 946021 - protein, 144 aa, Homo sapiens
LTIQSGGCTCVPMSAPSRVIGAWATQNAGLTLTQVSVYPFWNRTNLQTKARMGIKELNNAKHTLHLIMCRERTYLFKSMKYSHKKSCIVPHNSHTNCQMCHMIRLHIKYNPRATNCSNTVDGLMSLRYRETHFGQLLHYYYAQT

SEQ ID NO: 946022 - protein, 99 aa, Homo sapiens
AGPSALQFRVVGLPLETMTSEGCSTIRGGKSSWRRRDPTKHDGIKTSFNISLSKPSVFTWVPDGEIKLFDYPTEHYFMFLFVYASHKSSQFLCRIGRYQ

SEQ ID NO: 946023 - protein, 36 aa, Homo sapiens
MGAACRDQLGQGDTNPVVLEELKTQHRYRGVEWVRV

SEQ ID NO: 946024 - protein, 106 aa, Homo sapiens
GLQELARVSTGTAKLCLFCHCHIERRAVFRGHQISIGFRYEIHTKVHVALGPDVSELITGSTFISCVFRQIYQPFPPQKETGVSNTMFRATMKNTAYATVWLRVGH

SEQ ID NO: 946025 - protein, 119 aa, Homo sapiens
RIGKPISGVSIYSGEDRSLPFFMKEEDQYINLLPSSWLITPRNGAISKAQCLFLLLANWAFSSVCSQVSLGEWKSMLLNPCVTSIAATMATLFMGSLDDDRSGWGRSLGKEAEWVIPST

SEQ ID NO: 946026 - protein, 101 aa, Homo sapiens
MLDYIYWFVYIEPALHPRDEAHLIMVDKLFDVLLDSRCQYFTEDFCINVHQGNWSILFFGCVSARLWYQDDAGLIELGRIPSFSIDWNSFRRNGQSSLYLW

SEQ ID NO: 946027 - protein, 118 aa, Homo sapiens
MAGCRSRALPHGEAAKAWRVKQQQLLAQMLSPSLPGACRRASRSECGAAEPTPTRNWRWPTSATRIPGSCPCLSLHTSSQAEAAGSGLSQPREGLPWCSGRVKGSSSTASGRPGRGGT

SEQ ID NO: 946028 - protein, 221 aa, Homo sapiens
EGIAGIDWRVGRGCMDWPWALTSLGSPKSLALSRYLIWEERGEWEERQDEGKPSLDYQALSHHQRGDHLALSPPSHRESFSYLSSSIITAFSGEHTGTHSILLNHRMAYSTLQPGHVTDACYPEVTMILRPSATEDSLIEPCREALAAIFPAQRITQAPTVYSLSIHGPAVNRHSIALILILFHKRYTLGHTPNPRMFFPAWPTGLGPPHCLSLVSPGRWG

SEQ ID NO: 946029 - protein, 109 aa, Homo sapiens
RQSLALSPRLECSGAISAHCNLHLPGSSNCCTSASQVAGTIGIHHHTQLIFVFLVETLVGFSRLSRFCHVCPAGLQLLDSCGLPTLASRAGITSMTTASSLGGEDPVIT

SEQ ID NO: 946030 - protein, 143 aa, Homo sapiens
QVLKMPGPTQTEDHTPQKKGKGPDRDRSEDTTVWKPSPWTTLTEKAPPLSTWRPRLLTDREQTPVDGKIPRPTQRLQNGPTPITHTDSLDETRATCTQVKETARGLTQSPDGLLTRTRMKPTIKPRIPDQCQATRAKYGTLQG

SEQ ID NO: 946031 - protein, 113 aa, Homo sapiens
MRVHWNCEGHPRSQRGELPANSRCDGIQLIKVSEAPVSEKGKEPPSVTLLSTGDPNNPDLCYSQALEITWGEAWRCCERKKSRLQTFSQTQDQEQDTIFNPDACVSHSLTLAR

SEQ ID NO: 946032 - protein, 80 aa, Homo sapiens
AGIRHEMEYYAAIKNDEFMSFAVDMDEDGNHYSRQTNTGTENQTLRFLSHKWELNNENTWTQGGEHHTLGPVGSGGLGEG

SEQ ID NO: 946033 - protein, 77 aa, Homo sapiens
LVLPRDLLYCCEQNANSDTDYEVQAEVVSDGDEELIGNRSKGHFCYVLAKKLEALCSCPRDLWNIELERNDLGYLAE

SEQ ID NO: 946034 - protein, 134 aa, Homo sapiens
MDRAVLKLSFCGICKWICGPLRRCLWKREYLHIKTKQKHSQKLLCDVCVQLPEFHVAFHRVVLKHAFRSVCKWTFGALSGLWWKTNYGHIKTGEKRCQKLLCDDCIQLTELKVPFPAVSNHSFCGICKWIFGPL

SEQ ID NO: 946035 - protein, 111 aa, Homo sapiens
MARVGSEASEQGLPACCHLSLPSLSLSFIFETGSPSVTQAGMQWSNLSSLQPPPPELNPSHLSPYHLPSSSHFSPSSSWDHRCAPPCTASFFTFCRGRACYVAQAGLEPLI

SEQ ID NO: 946036 - protein, 72 aa, Homo sapiens
AWKVRHLAYHQPRLMPVQGVVDFRESRDPYCYFLIINWFEYEQYPVMFNILRRFSFTFRCPIPFADLLLFGP

SEQ ID NO: 946037 - protein, 174 aa, Homo sapiens
MGFHHVGQDGLDLLTCNLPALASQNTGITGMSHCTRLEVTLELGNRQRLEQFEGSEQDRKMWDSLELPRDLLNVFEQNADNDMDDEIQAEVLSDGDEELLGNWSKGDSCYVLLKQLAAFCPCLRDLWNFKLERDDLGYLVEEISKQQSIQEATWVLVKGIQFFKGKLSLKIWKN

SEQ ID NO: 946038 - protein, 198 aa, Homo sapiens
GIQLGKEEVKLSLFADDMIVFLENPIVSAQNLKLISNFSKVSGYKINVQKSQAFLYTNNVTESQIMSEFPFTIASKRIKYLGIQLTRDVKDLFKENYKPLTAQGNKRGYKQMEAHSMLMGRKNQYRENGHTAQGNLQIQCHPHQATNDFLHRIGKATLTFIWNQKRARIAKSILSQKKIGFFLFFSFFLFINKGSHLL

SEQ ID NO: 946039 - protein, 81 aa, Homo sapiens
MPVSKPECTATTDQGFPAGANETRSAKRMLSCSQHPAPQDSTAYTFTGSLPIGHRTTLAIEYTRTHTCQLRTHHTSEGLWP

SEQ ID NO: 946040 - protein, 199 aa, Homo sapiens
MNLSLLCRFSFSWQTNLLCNLFCYFVILPFLLIISVKRFQGGMNQSPPLSHCYLDASELPFLLTMGTALRVTRVSSSLVPRSPTVALVILRPGFEPPRMGAACRDQLGQGDTNPVVLEELKTHAQKYRGVEWEIRDLTAFRAESFEQRFTHVFIDSKSVISIVFIDYRLTKSIPYRKQRDGSKWDGLASYLQQENVLKA

SEQ ID NO: 946041 - protein, 78 aa, Homo sapiens
KHCILVELVHERLRSQDRNCIHVSETCVECDRGDSTDILTFKDKSLPTRGTCIQTLNYGLQRASGLLNTLRCWEGVMA

SEQ ID NO: 946042 - protein, 222 aa, Homo sapiens
WYLSQVNDRMTAKEREKFPTGQQAVSSIGSPLGPQLRSGPLQSKHRLTCFLERLRRIRKKPMNYSMMSTITQGKEENPSAFLEQLEEALRKYTPLSPGSLKVQLILKDKFITQSAADIRRKLQKRALGPEQNLEEFLNLATSVFYNKDQEEQAQKEKQHQRKAAALVMALRQTNLGGSEMTDGAGQSPSEGFLSVWFEGHFKMSNENKHPQSCHYAEQSWAP

SEQ ID NO: 946043 - protein, 135 aa, Homo sapiens
IRHEVHWVPNCRQCSEGDFHGIMEVCDRGTSLIQGVVKEGFLEVGTLESKPEEHLAVNWAEERGWDRDRTFQAEGSLLCKAPEIGRCLRHLKIADVAVVGGAGERGIVERREVHTVPLIPYWILIMVWRAGPMGQ

SEQ ID NO: 946044 - protein, 48 aa, Homo sapiens
YTLRNGPYIMKKWGYYCFPYENRERTIPLQELNEWSFLFIGIRTPTSL

SEQ ID NO: 946045 - protein, 58 aa, Homo sapiens
MHTPAGEKQKEERKDSPKKRVRRLYDQRQIERVYTKRKALYSRRIDTDIAGQNRGTRD

SEQ ID NO: 946046 - protein, 134 aa, Homo sapiens
SVKAVFHYIFQAGFQLLGIPDSHDLGFPTYPSISLAPLLPGFPALEPLHRDLSDASPASSTVPSFQAAPFSPSSAPRPPPARLLIFPRPAQLCLFLQPACPDHLPFSTSPPLPTYPSPSVLSPLSRPHSPFLSF

SEQ ID NO: 946047 - protein, 127 aa, Homo sapiens
NEEMSAGFQGRGDDGAVRPRARYSLMGAGLSSAARQLLESWECQLPKAMQAVCLIAMESQTRKHKGFLEGKVYFSRLGSRWEKCSNLSLRSGGWGRFYRQRIMRCDLTASCHEVMSGLDLIRSQIKP

SEQ ID NO: 946048 - protein, 195 aa, Homo sapiens
GIQLGKEEVKLSLFADDMIVFLENPIVSAQNLKLISNFSKVSGYKINVQKSQAFLYTNNVTESQIMSEFPFTIASKRIKYLGIQLTRDVKDLFKENYKPLTAQGNKRGYKQMEAHSMLMGRKNQYRENGHTAQGNLQIQCHPHQATNDLHRIGKATLTFIWNQKRARIAKSILSKKGFFLSFSFFLLINKSSHLL

SEQ ID NO: 946049 - protein, 70 aa, Homo sapiens
GIQLTKEVKNLYKENYKTLLKEIIDHRNKRKSIPCSQTRRINIVKMATLSKAIYRFNVIPMKLPSQFSQN

SEQ ID NO: 946050 - protein, 231 aa, Homo sapiens
EFGTSWYLSQVNDRFTAKEREKFPTGQQAVSSIGSPLGPQLRSGPLQSKHRLTCFLERLRRIRKKPMNYSMMSTITQGKEENPSAFLEQLEEALRKYTPLSPGSLKVQLILKDKFITQSAADIRRKLQKRALGPEQNLEEFLNLATSVFYNKDQEEQAQKEKQHQRKAAALVMALRQTKPGGSEMTENGAGQSPSGLFISVVKDTRMSNEQATQSMSTMPRQSLEGTCPEC

SEQ ID NO: 946051 - protein, 129 aa, Homo sapiens
QKPINLSKTTEVVQRPDKSQRTFLERLQEAYRIYTPFDPAAPENSRALNLAFVAQAAPDIEKKLQKLERFARINISQLLEIAQKVFDNQKFNKQKQATQAAEKAADKAFKRQTKILVAAIQEVQNEIAH

SEQ ID NO: 946052 - protein, 108 aa, Homo sapiens
PGWRARDTSDTHLSHTPATEHLRDFATHRQHTQETPAHRTHPHRSSTHHTPAHTTHTPHTRRHRATHTATHDKQPTHRTADTPDTHTHTATTHLHTSQPPHMTQCTHT

SEQ ID NO: 946053 - protein, 132 aa, Homo sapiens
PLPGRPYWGEEPLCPASRPIREGGGEGGREVSPPPGQLPRPGGGGGVCSLFVLLFCLVCVVFCFVVLFCACCLFFSVSLAFCSSFRFSFRFFSFLLVPLLLSLLLPSPSFVRSSLFPLLPLFFLLVFLFRLA

SEQ ID NO: 946054 - protein, 121 aa, Homo sapiens
EVSLGAFGDTAGRGGTPQPALPADATSICFSRICILETLVPASPGHPTEVSTPCRFRRGVWVHLVTPQAEGGRHSQLCPRMPRPFASAGSASWKPWFLPLRDTPLRSAHPAGLGGVSVCIW

SEQ ID NO: 946055 - protein, 150 aa, Homo sapiens
ERERERERERERERERERERDCAYVRKHVEKIKNSMDGKNVDTVLMELGVRYHRLIYEHLQQYSYSRMGGMLAICDVAEYRKWAKDFKIPMVLHLSDTLHALCNRLVVAPDNLKQVCSGEQLANLDKKYFTPSDNFVLNIELPRLARHFS

SEQ ID NO: 946056 - protein, 105 aa, Homo sapiens
MRKTSLLRFQRCWGSVPRNTDEEQIHIYNITHITDPPDFCSKGLYLASCYLSPDWLPLALRPLCSSLGRRALRKDRNLSCFVGHLGGTSIWWSQGVAAPAFVMGG

SEQ ID NO: 946057 - protein, 134 aa, Homo sapiens
MKGKRTNRRERVRAQNLHTVMQELANKNERSVREWTKDLNTRRVRAKELGSNESEAGKVDIGRVGNMTREGRTLCRKREFWKTRIPKVGYTKKALQGDTGKLNHAGPLLRGSDIEGGWDVCEGSWYHSLGQGIG

SEQ ID NO: 946058 - protein, 109 aa, Homo sapiens
TREHKQIFSAEKADFQLLRTPCSTWKLTCPSPGTHAKRPFFQASVPGRCCAWFAAPANDGLHCVLSALFLLDSLHCVLITLSADSGHCSVNLLMDNRPILPPPVPSPNQ

SEQ ID NO: 946059 - protein, 105 aa, Homo sapiens
MDIACLSTAHIIDYLTCVPALAPARMAELIQKAKLADSRALRRHGTCMKQADRAQLSNEERNLLPGLQERAGPQVAGGHLSMTEDRHLDRSALIRLSEKGSRLNH

SEQ ID NO: 946060 - protein, 228 aa, Homo sapiens
QEFARVLIFHCCYNENSLPSYWFYATMAGPLRAPLLLLAILAVALAVSPAAGSSPGKPPRLVGGPMDASVEEEGVRRALDFAVCEYNKTNNYMYHIRTLHVVHTLKHIVSGVNYFLDMELGRTTYTKTQPNFYNYPFHDQPHLTRKAFYSFHIYTFPRQGTMTFSKSTYHDSYGSIPDLPIPITLYSHPPTSYIPPLYILSPTLTKASPISSTSIHTYKSSTNLYYSQ

SEQ ID NO: 946061 - protein, 68 aa, Homo sapiens
NTRIYKYSLTLSECRVDMNHTDTPPFDSPADPTMIAMEHARRISRTVEPRAAGIRYEPQSSLGNRAKL

SEQ ID NO: 946062 - protein, 147 aa, Homo sapiens
MNLALMERKTDLDIAYKFGLWLSCEGYESSEDQYVLRGSWGLEYNLDYTEFGLEKLEESGQHRFASFSEYYYKGALADSLNMSGDTIVVLLGIFVVYKLFLSDGQYSPSPYSEYSSFFHRYQRFTNSAGPPPQALSEFTGPQDTWHG

SEQ ID NO: 946063 - protein, 122 aa, Homo sapiens
RSYACSVLGRLNLSKTHDSSRHILYNTHGKSLTQNSAPSITYLIKNPNKFHGYQEPYFLKHQIAHTIEKNCVYNECGKAFHYKSQLIIHLIIHTGYRPYQCKCQITFTTNSNLNAHQILHTG

SEQ ID NO: 946064 - protein, 70 aa, Homo sapiens
GGSAGGDFRQQELENSRCEKKTSGGSDLNTGSAGAGPEPAVGRDIVREPSNTDPSLGKARCWMMGAEEFG

SEQ ID NO: 946065 - protein, 68 aa, Homo sapiens
PSVNANSNTPDHMGGFQNTNVENSEGPSFSQQGSLHQILKTLGHPECGQQSIQDQIGVSKQHDSSIPK

SEQ ID NO: 946066 - protein, 139 aa, Homo sapiens
MFHVTNGISAVTKINSACQRFNKFLQTLWSLEGPMVSSNLEALKIYRFLGPNVDLLNHNHLDKARICVFNNSYMILTCQVATYENTRPDDIERAFHTSLILLLVHVIGGNIHRGRSIDSTAQMCGLKPNFVSHYLDVSE

SEQ ID NO: 946067 - protein, 68 aa, Homo sapiens
GSWEVQDLGAASDEGLLATSSHGGSARAREQVIELAASSPFIICIAPFMKVEILITLINKCLVLGSTS

SEQ ID NO: 946068 - protein, 229 aa, Homo sapiens
SGICIQVEAEHKCWENVQPVDVIEKKTPFSWEKFKFAAEIRISNEEWNVNHQDNGENVIQGMLETFMAAPSITDRDLRGKNGFVELSPGTPCSMQPWDMVPCVPAASALAVAKGAKVQLRPLLQRVQALSLGGLPVVLGLWVHRSQELRLENLCLDFGECMETLWMVRHKVASWVETLWRTLTKAMWKSNVPLDSPKVPLGELLLELVRKGHFPSPQNYQFNHQFPLNA

SEQ ID NO: 946069 - protein, 220 aa, Homo sapiens
MLDQRYVTIVFRLTTYPVTRNKRMNVFIISALRSARSLKRWNTSLRACSLSISMPRASNRCLKAFRPDSLPSTILFADQPTSSAVMIVVGLASLEHTVLVNTRRMGKGIGTHNCFVGLHHETGNIADQAAGGHDLGGVDAHIQIEEIPTGFDGHHNLFKRAVASAFAQSVDCALDLTLLTNGNCQELATMPKSWQCTDHTLSLGVNVRSRMNFAYSEGTA

SEQ ID NO: 946070 - protein, 70 aa, Homo sapiens
NHSGQAFLQACLPQELAASARNLATGSRNAHSPGFLLNRVPSVQDPTENRTVQLTWQPLPEPLELWPKAV

SEQ ID NO: 946071 - protein, 129 aa, Homo sapiens; identical to SEQ ID NO: 946051

SEQ ID NO: 946072 - protein, 65 aa, Homo sapiens
MSEYHDEILLADVGHYDQLEERHYEKWPEHDNSICRIWAEREDIIMSREFVYGWNSEIMHQDLVA

SEQ ID NO: 946073 - protein, 134 aa, Homo sapiens
MFPRYLFDCGSTKIPLDHRHCFPRLSHKWTSSLTLNYFLWRDRKGAISNFVSFLAMLVMIQLLLLLAYESLWPDAWHFLSIFSGSAWLMTLLWLFGLMVNRIVQRVIFVTGYYGLTQGLLSVLRLFWGNLILHG

SEQ ID NO: 946074 - protein, 76 aa, Homo sapiens
MGRGLTTGGREKPGGTQIKPPGRKSPFGQRGKNQRGPNRWPFQTVAHPEGQRENGKRKNLVKIRVFGKPSYFFHGP

SEQ ID NO: 946075 - protein, 208 aa, Homo sapiens
FLHLLPGHPGISVHLLKSRQRFQTFIFVFCTPTGQNTMWKLPRLGAYTFRSNSLSYTLAPFSYSWSGWDAGHQVPRLYTAGSPVPCPRNRFSLLDLWACDGRGCRQDLCHALKTFSPLSWLLLTSANFCSWLEFLPRKWVFLFYSIIRLANFQTFLLCFLLNIISNFRSSHSSLKFHRSLQGLLLVSLLKHYRSDLCFSLDKYSFHLT

SEQ ID NO: 946076 - protein, 39 aa, Homo sapiens
MGAACRDQLGQGDTNPVVLEELKTQHRYRGVEWVRDLTP

SEQ ID NO: 946077 - protein, 153 aa, Homo sapiens
DPRDIDHYTVSAVFGGGAGGSFVSILTDAGAATLLKQEVLLMFFYTDKLLDRIEFYTYLLVNGTQRFEGGSPLYAQKHISPTTVGPGLRDLTVHQGEKSKGLKRISTVEVFLCAPPPDICVKYQFLSLNVFPPVSEPIGISQIEPFYLISLFN

SEQ ID NO: 946078 - protein, 159 aa, Homo sapiens
KQEEKPQRFRKEWDRAKPIEEAEHESTDQKPDEGNVFRHILLPIYLWEANDRNETWLCFTGESIKRPSIVSWKTGVFRNQVDSETHCHAYQVTWYTFWSPCPNCAREVARFLATDKNVNFTILKPPAFTTFQFPCYQEGLRSLSQERVPVEIMGYWIFL

SEQ ID NO: 946079 - protein, 103 aa, Homo sapiens
HVQHEGLPKPLTLRWEPFSQSTVRIVGIVAGLAVLAVVVIGAVVAAVMCRRKSSGGEGAGLKLRAATVPRALMCLSQLASLCDFKSLWHLFLRHLNVSASLLA

SEQ ID NO: 946080 - protein, 80 aa, Homo sapiens
MREITKAVLVKKMNDKYNVRPGVEAHACDYSTFEAEVSESRGHEIETILTDTVPRIYYRSKDAGLVVMPGSRSYSELSGA

SEQ ID NO: 946081 - protein, 162 aa, Homo sapiens
GGRGYLPMSGLGRLFGKGKKEKGPTPEEAIQKLKDTDNILIKKQEFLVQMIQPELQTGKKFGTKNKKAALQALQEEKKILTTSGTNCRDIIHLGVLARGHCATTNAEVLRTMDLAAQSMKKVYQDIDIDKVDELMTDITGPTGGGPNQDPVWGAYKSLAPGC

SEQ ID NO: 946082 - protein, 136 aa, Homo sapiens
GIDLKAGQDILANWENPNVLKNELAACGGCCLKSQVLKNLVQENHWDPGSKWCGGAKIGPLGWQARDKEGTVGERDGGRGVSKADEEGERRGTEGGVRGGGGGEGRGGGEVEGGGLGEAGGGGGAGGVRGGGRLLA

SEQ ID NO: 946083 - protein, 104 aa, Homo sapiens
MEWNQPEYRGMEWNGMQWNGIIRNGMERNGMEWNGMEWNGMEWNQLDCNRMEWNGINPNRMEWNGMERNGTERNGMEWNGMRNGMECNGMDGMHCYNHLMNIVL

SEQ ID NO: 946084 - protein, 51 aa, Homo sapiens
MRPSFNVHFPVRIYIGLCLTFVLTNRFTDNCRRQDLLRLLFLQIHSDVFLF

SEQ ID NO: 946085 - protein, 184 aa, Homo sapiens
GSPGLQARPGQDISPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPSLPTTFATLDIDGVRKNIFALPGKS

SEQ ID NO: 946086 - protein, 78 aa, Homo sapiens
QCLALLQLTHGALHPLSCTHCLALPSEMNLVPQLEMQKSPVFCLAHAGSCRLELFLFGHLGSTQSYTFYKAEWMHFLF

SEQ ID NO: 946087 - protein, 105 aa, Homo sapiens
HKVSLSLSCLDHYGGLQPRVTEDTLTSINELFETFEDAKADWGQSDKKVYFWFHFREREMTYQGFVPPLTERISLVHNQIRVVPVFWFWRLKLINKLIASILYGH

SEQ ID NO: 946088 - protein, 150 aa, Homo sapiens
KHHEKRKHQPEDGKGVRPCGFQPDVSGLAVLRKTRGITASSVMSSLPLWAQEQLAKLASINDVRHGGFDFAGPAECSVCLNPYSDTVEYRNRLHLSSAQEVRELGLGPIARKQQSQELGPWACPLFTGSIISCYQVEVASTKPESSVEKR

SEQ ID NO: 946089 - protein, 72 aa, Homo sapiens
QEFGTRPSPPTRHLPPLTEWEKLVCAKIVLSPQMLYTVNYSIMPNAAKSSSCTLQVWSILKLDILVCHYVIL

SEQ ID NO: 946090 - protein, 216 aa, Homo sapiens
MDTRSSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITGSKIERATATRRGASAHMTHQKSLSSVPNRARDTAGLQNPFREASPPSLRGTGLS

SEQ ID NO: 946091 - protein, 70 aa, Homo sapiens
ETAHTAPGMGASPWGVCPGALPYNGTCPAGLLRDSRDKPYSSPVRAEEEGTAMVAYSLLSDKLIKAETHP

SEQ ID NO: 946092 - protein, 81 aa, Homo sapiens
PVLQEFGTSSYRCDENVLELEIMMMFVYIIRECTKSYVIVYFKERIVWYVNYLSKRVIKGEIKRIETMNRVLENSEIASRI

SEQ ID NO: 946093 - protein, 68 aa, Homo sapiens
GRLEIIDFTFRPFSLWRCEIGGISGAAEARNEQEEQGGNSEIKRRLTRKVIQRPTVEELPEKKNPHPL

SEQ ID NO: 946094 - protein, 73 aa, Homo sapiens
ALKFITKLVGTHIRAKRKPEELTNVLAGMRKAAAKKDCAPTLPSPEIKNSLTEKANLDYKEIEKLEEGARRPT

SEQ ID NO: 946095 - protein, 107 aa, Homo sapiens
AEGKMEDYQAAKETALVVDEVGTIVKEALEGAIGGNAYHHSKGNQGPTNVVDQTLSQLTRLGKPFKSIGTWVIMQKNGAGFHTAGSCFWDSFTAGSCTVRWENRTMS

SEQ ID NO: 946096 - protein, 197 aa, Homo sapiens
GLSKGQYPTQTTYPEQPPGNPVYPKTLHLPQATPYTDATTDYSELYRSSFVHPGAATDPTMSDAFPGASMHLPMVQTVAVGPLRSTIPMAYYPAGPMYPPGITVLREGGHDAGARFGAGATAGNIPAPPPGCPPNADQLARMQGANVLVTHRKANFFMRGSDGGYTICRGTKATFVTGKTSHTFSTSDNVTAIGILT

SEQ ID NO: 946097 - protein, 103 aa, Homo sapiens
GIPEADSIRPERSRSGALAGLALLCFSGLEAIQRTPKIQVYSRHPAEKGKSNFLNCYESGFHPSDIEVDLLKNGERMEGTIQTCLSAGTGLSISGTTLNSPPL

SEQ ID NO: 946098 - protein, 163 aa, Homo sapiens
MARPSALLTTIACQLIAILNDQPETCDYPKPMCNTFILLHVLIEANSGGPLTNLAEEVIVVNTMTVTGEISMAIHYDRLREFLLLGVRMVTLSPSILDELQLWEQWFPDANHDELIHIVILGFLLHTGLLLGPVDANFAIVEQMYPTVRNVNELVKPHLVGVP

SEQ ID NO: 946099 - protein, 39 aa, Homo sapiens
MRFHRRCALPRCCPFCLPTSSLPVFGPGRFRALLGPFGG

SEQ ID NO: 946100 - protein, 129 aa, Homo sapiens
EGFENPGSRYCLPEAADARRPRGEATVIMCDQEAKPSTEDLRDKKEREYIKLKVIGQDTRAIHFKVNMTSHVTKLKESYCERQGVAMNGLKFLFEGQRIADDHTSKELGMDEDDVIEVYQEQTVVHSTD

SEQ ID NO: 946101 - protein, 68 aa, Homo sapiens
AETLTLCGLMDTGQPKLDLTEYCIVLLMSMELPTTTHNLEPMPNSYLAFQTIVACFKQLKIYMETLKT

SEQ ID NO: 946102 - protein, 133 aa, Homo sapiens
GNIIKRKRPSCAVKRKMSAVGQSYTIHRGTRDTRQATQQPKSGVTLHPRKSRKQSSKVPCIPAGTTRAKLHLKTNQSKINQTKKKNPTKMSKEVLKLRWGWTQWLTPVIPALWQAEVGGSPEVRSLRPAWPTW

SEQ ID NO: 946103 - protein, 105 aa, Homo sapiens
LRIRGRFQLSAHGPASFKTVYWFTGILCKLSLEGDHFTPSRAYGFVKAYTNFDADRDALNIETAIKTKGVDEVTIVNILTNRTNAQRQDFVFAYQRRTKELASPL

SEQ ID NO: 946104 - protein, 81 aa, Homo sapiens
HESTFNSIMKCDVDIRKDQYANTVGPGVTTMYLVIADRMHKVITALAPSPMKIKIIVPSERKNSVRIGGSILAILYTFQQM

SEQ ID NO: 946105 - protein, 102 aa, Homo sapiens
MTVQGYKDDGGNNPELELAGKLPRAFLGKNSRRADATAETIRCWGQKLEPRSWASPESSRIFQNRPEPSESFPGPPRFLWDPPGQRRTQSRRVEVNFPPKLQ

SEQ ID NO: 946106 - protein, 144 aa, Homo sapiens
ELSRSNTLICHIDMVFRPALNVTWLCIGELVTAGVAESLFLPRTDYSIHMFHYLTFVPLLEDLYDCREEHCGLDQSLLKHWAAQEANPDAWDIGYCALSPVPGAGPSRQIIEGTVLIIKSLCAAHDPRCQWTLSYTVKETQYVN

SEQ ID NO: 946107 - protein, 129 aa, Homo sapiens
SARCHLEIPDVNIMTQRYLLSKNVNMESEKFLDPDMYTLLDDFTSDLRSKKFRKLTKAICGLTDDYSMDRLLPYDQSDEESMTIVLQHIDFAIHYAEVLEFKEPKEREDESCSMLDEYFQECQDECRAY

SEQ ID NO: 946108 - protein, 189 aa, Homo sapiens
HRVTRALAINCGQAITGFDFHGGYSHPVTDGSIVRRGILETLLLTACEHEQASIERKAMEKEEKQALGNWKQLAKGLLIREALKRRYGPKSEAGDPHTDAGGGLCSDEQAVTSSEAEADRVLAAFWPQYREDEEEHKLMGGPQDDQSGPVGDPPDDAAHYRPGPCLGISPCRCGIYACRPCGACTPEGT

SEQ ID NO: 946109 - protein, 204 aa, Homo sapiens
LGDLSPKALFWKYRLLQTILMEPTILKAPTAGKAWEANYNHPPEADSVGTAFNLGPTVNQTEPNGDSTTGATDLSPEPKGFNYPWFSLEIQLTQQLQSFIPNTIVRGLISKVIRTLKMDCSGAHVQVTCAKLISRTGHLMKLLSGQQEVKASEIEGDTDQWKTENYIMESTEAQSEQEERSLELTEVPGSRYTDKLILAFVTEL

SEQ ID NO: 946110 - protein, 152 aa, Homo sapiens
MAGQRHLSREPLSRKKLYLSILISLQISLIIPFTAPDLIIFNIFFETTLIPTLVIITRWGNQPERLNAGTYFLFYTLVGSFPLLMELIYTNNTLGSLNILLLTLTAQDLIKLLSQQLNMTGLHISFNGKDDLFTDSTYDSLKPMSKPPWLGQ

SEQ ID NO: 946111 - protein, 81 aa, Homo sapiens
RVSGECAGQNQPVEWERHLFVHRVGFGNRKELLPTSDSNKPGFAAYKCESNPKNSQIKCPLLFLGPPDDPGLFTDEEMEAS

SEQ ID NO: 946112 - protein, 103 aa, Homo sapiens
MEGLYYFLGFLFLVARLPLDAAKRFHDVLGNEGPSAYMREHNQLNGWPSDENDWNEKLYPGWKREDMRWKNSWKGGRVQAVLTSDYTSLGGLKYNIGGEPDIP

SEQ ID NO: 946113 - protein, 145 aa, Homo sapiens
GAVFSGYAHLWKKPETFRSQGKLRGVRVGEGYSFGNVILASGLSSPLGLPMGSLKQPMQREGGSPGPATIRTLCLAALLDRGAQSPTLTIHQVLCEEQSGGGLWLEGAERATRLLAGHWTSALEQALGLAIGEVLQGSVLMRAYT

SEQ ID NO: 946114 - protein, 233 aa, Homo sapiens
ADTDLKGLGSRAMGPSRKFWVGGNWRMTGRKQSLGKLIGTLNAAKVPADTEGVGAPLTAYIDLARQKLDPKMAGVAQNCHKGTKGALTGEISLGMTKDCEATWLVLGHSERRHVFGKSDDLMGQKVVHALAKGLEVIACIGKKLDERKAGITERVVFEQTVMEDNVKDCSRVVLAYEPVWPIGTWQTEQPQQAQEVIEKLRGLLKSTVLMPWLEHPTNYGGFELGHLEGWPPP

SEQ ID NO: 946115 - protein, 206 aa, Homo sapiens
MPHLSTIVWPTIRTSILETVYRIRQLELVNTDCQTTFLTKAHKGLTYPILCEANMSEALYVESIVTTIVGLPAAILIILSTRIWSPPRNIVISNRLMTTQERVIKLTSDHMRAMHNTNGRPWPIIRRIREAFELPHLTNGDSRLNDLHHATNCLLTYPWLCHYERAHSELAYSVRFLGINGTIRLLIQPITLAVRLGLHFRMAILG

SEQ ID NO: 946116 - protein, 152 aa, Homo sapiens
ATLLSADASWQPTISSQSRESYCTDLLASGYSQPKSYLQASYTYLSLGKYFDRHDEAMDGVCHYYREVALEKRKGYERLLKMRSQHGRHAMLQDMMMPPDDERRPYTLMNAAMILKNPHLCDYLETELLDEEETADTKMADDLTDRHRLIRT

SEQ ID NO: 946117 - protein, 137 aa, Homo sapiens
MAGEVELVELEVFSEDGTDLLQSDIKLDLLTSCFFLFVCFEMESVLPRLECSGAVLAHFNLHLLGSGNSPASASRVPVISATREAEDENRWNLGGLGCSVAEIMPLYFQTGLHNETLFQNKMESAFLRWNLMLVEML

SEQ ID NO: 946118 - protein, 163 aa, Homo sapiens
RGPLVTMNHIEQTFCPVNSIQTPNYEMLKEEQEVDILGASHNLATHTHTGIHIRSKTYVLRPHLFGTVEHPLYDTCCQALITFSYSAKNRYKKMDTIFPETKANSYTVKSLNIGRLKESMYTDHSAKGDTDRLTDPNVPQEGFIDVMISCRDLYPTIYRSSSL

SEQ ID NO: 946119 - protein, 67 aa, Homo sapiens
NHHVKERMVQDGRIVLTSDGPSIKTSIRITIHKKDFTESYENQVINQIPGYSIIRKEARHDGSYLKS

SEQ ID NO: 946120 - protein, 125 aa, Homo sapiens
MAAGMKAHTGRLDIADHTSTSHLRTGNEDLTIHEELQAQYQRVVCYQDDIGDIADYGFSEVEDHVEEGDVAGDDDDCDYDSPGPQCPYDSDCESQSLIEEFADELQASVHTDAVEDPTSSGAFCI

SEQ ID NO: 946121 - protein, 201 aa, Homo sapiens
IENFFSKMAACKFNIIARAFSSSAPQNQLVKTPIQVFGISGRYATALYSAGVKSKELDGIEGELVKIQDAIKTDKKFRQFIKDPTIKRSIKTEALKQVSSKLSLSNSSKNVLSLIAENGRLKEFDGIVNAFKILMAAHRGEITCEVTSAKPLDDATKKEVEDIIEFAKANQKILMTTKVDPSIIGGLIVTIGDYVDMSIAG

SEQ ID NO: 946122 - protein, 205 aa, Homo sapiens
MAGEIVFEDPRFPGGKHLAYQNSWGLPPGPMGVMTMVNGATMGEVLPPGVACVQVGIIPWGITKALSEEAKEALIAKGMDYRRRLLRVNIRVRADLRDNNSPGWKFNHWKLREVPIRLEVGPRDMKSCQLVAVKTEYWRLPVAEIEAETKLQAILEDIQVTFLTGPSEDLRTHMVVLIPLEDFQRILDSGDCSDSILVLTVRTGS

SEQ ID NO: 946123 - protein, 124 aa, Homo sapiens
MAGEVREEGIAYSEVLESVFWVLVILRGSAGDSVKSLKIQTVRKVEVMFRRPSSQYLFSLLDMIRNYQFDSCKNPESVCTYLGEWVMTLALSHVEGYIECYQLVVVILQITLSIFLISVMSYFL

SEQ ID NO: 946124 - protein, 72 aa, Homo sapiens
YGRGGPAVGVGMKAEGTMRGSENCVYGRLERRLLSRNSEILTTYSLLGIRSPMVTANSIIVLDDDDEHEPSV

SEQ ID NO: 946125 - protein, 136 aa, Homo sapiens
GSRRTAGRMTQITVIVNGVVMAFGASHPTHVNVHIHQESVLTQLLKAGGFSEFLFHPGDTVPSTVSIGYEHLALGVTQILLGVVSCVLGVCLSLGPWTVLSASGCAFWAGSVVIAAGAGAIVHGFATAMAAVVLCV

SEQ ID NO: 946126 - protein, 108 aa, Homo sapiens
IEDGNTSVVPDQEKEIERLTSLHTMLEGSHTEICKDLSEEVTLRLKQPGSSQVTDYRYLWHELDEADYRCIRLMAMKTCNAYAGLYDIILTNFEKFTKPRIESLAMTY

SEQ ID NO: 946127 - protein, 115 aa, Homo sapiens
MGWVWWWPPVIPVIKEAEAGGSLEPGRQRLQGTEIVPLHSSLGTRAGLHLKKPKTKKKLLLKLKELKIKGFLKKQSNCHHITFLLCTVKASQNQDGNLQKSKERKPLQPTITILK

SEQ ID NO: 946128 - protein, 42 aa, Homo sapiens
MATLALSRFRVPARSPLSVPRPLTGSPFRGYRVPRHLAEGRA

SEQ ID NO: 946129 - protein, 79 aa, Homo sapiens
GTDLQRLGSTAMAPSTMSFVGGNCKINGRKPTLGNLIGSLNAANVPADTEVVWAPPTAYIDFSRQKLHPNIAVAAHNCY

SEQ ID NO: 946130 - protein, 79 aa, Homo sapiens
HYGREVRSGLNRVDCFCKTGALWNVYLAELGKEMEKGKKITGVVYNSVWAEPSHPSVSIHFKRSICFLFNISSFFNMNK

SEQ ID NO: 946131 - protein, 162 aa, Homo sapiens
HSEKRRATRKTRMKSVEPHEPEPGKWGERNGGKKKGGGKQDKRGLEKREEGRERGEKGEEKGDTKEEGKGRKRRKEKGREEERGGGKRKRGEKGRRGGKGRRQERKKERRKRKEREGEGKEEREEGKEGGKGGGDGKEEGKKGGEEKKGEKKRRREGEEEER

SEQ ID NO: 946132 - protein, 139 aa, Homo sapiens
RGASYHLKTYMPLAAADLTAAKGGENFTHMGRIFLDHIAGTRLLSCPNSNPNLTNRSQLISTRFTGATARPFLFNKVANLQYSQVHYRFMLTGRHMVPDVTCKRLRKRRVILERVLVLQSQAFEDHVPSHNSCIHRVLF

SEQ ID NO: 946133 - protein, 55 aa, Homo sapiens
MTCCLAAPQSCVRQISRSASVRMLMHDSEHRDQWHFHLGGVELQFSGSDMAYMQW

SEQ ID NO: 946134 - protein, 140 aa, Homo sapiens
ITDVRQVTRVKSVWIHSSPQAKAGGKQGSHQCKHTLDYLPYKNTLLLEDHPTGENDMAIMKPANKYQYNSGFDLPEGPLTTSFKGKYGCVYYWMKAFFDRPSQPTQETKNFEVVDLADVNTPDLMAPVSANELTDTALCA

SEQ ID NO: 946135 - protein, 142 aa, Homo sapiens
AAARTKAEACKGKLNHKEVLNGLKVTYLTYHQLMAFPKKKLQGLVAATITPMTDNGEINFSVIGQYVDYFVKEQGVKNIFVNGTTGEGLSLSVSNRRQVAKEWVTVKDKLDQVIIHVGPLTLKEPQELAQHAPDQRYPVFPG

SEQ ID NO: 946136 - protein, 85 aa, Homo sapiens
RGGTEAFSVSRVVIKLQEEMEVDAPGVDGQDGLRERPGFTEGGRHNFNVRPHFGANGLPKHSYWLDLWLFILFDVGAFLFVYFLP

SEQ ID NO: 946137 - protein, 198 aa, Homo sapiens
FEAAVKVLVEVGLDGAGGEIMVASGKLSTGRFLPLPTIREIIKWLRLQAAKQLSQNFLLDLRLPDKIVGKAGILPKANVNEGALGPGGITGSILKADVVELLGVERATRLIPGLQMLSDAAPGKLRMVHGDVLPLKVERAFSEGLKGPWEDDPPKVYIMGKLPLRVSLPLIIRCLEFPGELQRDLSHYRRPGYRFSVC

SEQ ID NO: 946138 - protein, 164 aa, Homo sapiens
FGHYGRGTFGESRFLDTKRLCLAKLVWDETFLPGRRNNQEFVAEPLSIHRESEEPDDRHTLMALKRINRELRDWARDLPEQGSAGPVGDDRFNWQATFMGPKDSPYQGGEFFWTINFPTDYPFKPLRVEFTPGIYHPNITSIGSIGLDILGSQWPPALPILKVL

SEQ ID NO: 946139 - protein, 128 aa, Homo sapiens
MGQSQSGVHGPGGGRKDARARKRNYGPPVPTRVGKRKRKPRGPDAASKLPLGTLNIKCRLKLLKLERFKDYLLMEEEFIGNQDQMNPLEEKQEEEGSKVDDLRGTPMLVGTLKEIIDANHAIGLTSVA

SEQ ID NO: 946140 - protein, 113 aa, Homo sapiens
MTEKAPEPHVEEDDDDELDSRLNYKLPPQKSLKELQEMAKDDESLIKSRKTLLEDGPVVTDPKAPNVVVTRLTLVCESAPGPITMDLTGDLEALKRETIVLKEGSEYRVFTSK

SEQ ID NO: 946141 - protein, 124 aa, Homo sapiens
MGQKGQNPPKGGGKKKKGPGLKKGGPGKTRGSPKKKPWEKNPLCPRGEKPKGPQPGALPKKGPTQRAKGNGRRKNWGKKREKTGEKKANLKPKGPNRKKPLKTKRNHPEKGSNVGPKWEQGAPF

SEQ ID NO: 946142 - protein, 93 aa, Homo sapiens
PAGKMAVGFKTGEPLRVSRRFLKENCRPDGGKLGEFRPTIVNMGSISPENGSVLGKLENPTVIWGVKAELAAPSTDALDKGSVVPKGDLPPLC

SEQ ID NO: 946143 - protein, 143 aa, Homo sapiens
MLTLLFQIHFLMILSSNWAYLKDASKMQAYQDIKAEEQELQDIQSGKRQLNFTHKCLQKCSATYYSLTNHRQSSETDVIHQLMRCQHLLLLKLWMILGNLTGNPFLDKYDAHVAFKGTLANDVILGIVMVHYVGIYRHYMSTL

SEQ ID NO: 946144 - protein, 226 aa, Homo sapiens
RAAGIRHELPAALRSAGWHSGPGKAGPALLQVCGAKCPGGAPRGENREKEETTRIGPGVMESKEKRAVNSLSMENANQENEEKEQVANKGEPLALPLDAGEYCVPRGNRRRFRVRQPILQYRWDMMHRLGEPQARMREENMERIGEEVRQLMEKLREKHVSHSLRAVSTDPPHHDHHDECLYALNLMASLKSYGNRPLLSTYIVMMCPCVNLNLSLATWVSITTSN

SEQ ID NO: 946145 - protein, 158 aa, Homo sapiens
DASGRVLAGRLAVRNEDYKQVEHAIGDIMLGSTSVLIHTSEGAGLVVLKRNTWLLTETSMIGIYVHIRAYISEAMHVTVANAKSIVAEGRVLTQNHMLTYNDTMTHCQCDPSCVQMSLDRMMTLIKNRVHVLACKSNLIHVGSIENDRIGLYGPIWDL

SEQ ID NO: 946146 - protein, 74 aa, Homo sapiens
NRIWDKVDEELTGQKSNECFTGKGFFREFMACYSSRMYAPDHPAGLCSKCSKAKSFRLKDLRHLLAGDPTCRRS

SEQ ID NO: 946147 - protein, 82 aa, Homo sapiens
TDRGCARVRDRVTVRECELTDTETVRAREIMINHVLKTRQMVIDVLHHAKASGPLTAVNIQLAGMIQTTPDVIDSIGCTAYI

SEQ ID NO: 946148 - protein, 88 aa, Homo sapiens
KRISKKKTHVKKCTNAVFNELLVFDIPCEGLEDISVEFLVLDSERSRNEVIGQLVLRAAAEGTGGEHWKEICDYPRRQIAKWHVLCDG

SEQ ID NO: 946149 - protein, 204 aa, Homo sapiens
KGKEQARKPDNNSIKTRLFLCVRNFAWEIKLDLELSDRESEAWDMDRSLGWQGNSVPEDRTEAGIKRFLEDNNDEGKPNQVLKGFLRNANFNQQKVKTWDSRPKFPKPRPKARDLYDDDLKLALLSQSARPRSPWGKLDPYDSSEDDMEYVGFATFPNQVHRKSVKRGFDFTLMVPGRAALGISTLVNSLFLTDLYRDPETFLV

SEQ ID NO: 946150 - protein, 145 aa, Homo sapiens
LQEFGTRIDRRMYHRLILKAKGNVGKYELIIMDHIHWLKADWDRKKLLADQAEGRMYMTNEAVSAVNSCLQAKNEESIKTIFKEEDVMKMKPGTLTVHTGPRDFIDQALQYDMATEYNRTLGDVRYPIAPIVSRYTDEWTSSTYA

SEQ ID NO: 946151 - protein, 130 aa, Homo sapiens
SPGCRNSVRARMAPNHRGIFDNQNPSYQAPPQHGAPHGPHLSITRASPQHHTGPTSAPHGPHLSITRASPQHHTGPTSAPHGPHLSITRAPPQHHTGPTSAPHGPHLSMRHPSLTSGLVPKKPYPNYSLG

SEQ ID NO: 946152 - protein, 142 aa, Homo sapiens
EEAMSVSLKVSGIKEEIKEPENINAALQETEAPYISIACDLIKETKLSAEPAPDFSDYSEMAKVEQPVPDHSELVEDSSPDSEPVDLFSDDSIPDVPKQDETVMLVKESLTETSFESMIEYENKEKLSALPPEGGKPYFENL

SEQ ID NO: 946153 - protein, 47 aa, Homo sapiens
MNAFSVSLFILAYNMNSATLSSIRLFYDVPVSLNIIYYPVPFLSVPI

SEQ ID NO: 946154 - protein, 159 aa, Homo sapiens
GFAGYSPPLGCFHGLALMFMAFPGAQCKLSVDLPFWGLEDGGPLLTSPLDTAPVGTLYGGSHSTFAFCTLLVEVLHEDSTPTANFCLGIWCFHTYSEIWVEAPKHQFLTSVHLQAQHYMEAAKTVAERASVEPSSCRIRHERQREEGCCAEAAAGLRGV

SEQ ID NO: 946155 - protein, 210 aa, Homo sapiens
ERGHQGQRCPGRIQGPHCWDAGCSGAPQAQVPSVFSFNFAAVLVLLLYPQELDMDPNPQAALERQQLHLQERHHLHLKSQRPPIGSISSMEVNVDTLEQVELIDLGDPDASYVFLPCEDPPPTPHSSGMDNHLEELDLPVPTSYRTTSMTSNCCTNLHNPDPSDDEHIHPLHIMKRMKGVDDGHNLDPALTLAPFYLPHLLFSHDTTAQP

SEQ ID NO: 946156 - protein, 116 aa, Homo sapiens
ACPEDWLLYGRKCYFFSEEPRDWNTGRQYCHTHEAVLAVIQSQKELEFMFKFTRREPWIGLRRVGDEFHCVNGDPLDPDTFTIARPGECVFVEPTRLVSTECLMTQPCVCIKMAYT

SEQ ID NO: 946157 - protein, 163 aa, Homo sapiens
ILGLQEFGTSPEASPGAAALPYTGGMNIFRLTGDLSHLAAIVILLLKIWKTRSCAGISGTSFISLYNTSMKVIYLACSYATVYLIYLKFKATYDGNHYLRVEFLVVPVGGLSFLVNHDFSSLEILWTFSIYLESVAILQLFMISKTWERDHYPTTPVLGPLSS

SEQ ID NO: 946158 - protein, 72 aa, Homo sapiens
CRSGVSNPRAMDQYRPVACRTWAARPEKMSSGQRALLPELRLLSDAVVALDSQEHAPYCELRMRGIYVACSF

SEQ ID NO: 946159 - protein, 132 aa, Homo sapiens
MGARKDLRAGDRHVTGTPKVELRIQNLGFNCRIWNLEYRIGKKNRDDKRPLEEEVPNTRQMESGLAGFPCILALKTKCGVQSFYAESFLPTFFLQANIQLDPGTYLDPGYLIAIYQPTLILEAPLVWRCREG

SEQ ID NO: 946160 - protein, 140 aa, Homo sapiens
RHELVPNSARGTLLHCWWDCKLVQSLWKSVWRFLRDLELEIPFDPAIPLLGIYPKDYKSCCYKDTCTRMFTAALFTIAKTWNQPKCPTMIDWIKKMWHIYTMEYYAAIKNDEFMSFIGTWMKLEIIILSKLLQEQHGHRK

SEQ ID NO: 946161 - protein, 187 aa, Homo sapiens
MREATVPSQYMIYRRQLGNIYQESLGRAPRVNPASQPFGCPIWLSAPSLDDAHLPPPALLDPAISSHRLLHARSLALPTSPYFPGICSPPPTARTEPPAAFFMVGPSPPTLLRAMLPLPSSSTSSPPLPPSFAPPSLCNVHSPPHPRTSSPPLLPTLSAPRLTRPPRAAFLTASPSTFVSLRTPPPL

SEQ ID NO: 946162 - protein, 72 aa, Homo sapiens
QTKPIILGLSHPTSLILMVCLFDGFEMEDSLSHHKLKCSGIDLGSLKPVPPEYRRRIWLNLPSSPYYRCLTT

SEQ ID NO: 946163 - protein, 114 aa, Homo sapiens
MSVFKLRPSFCLGPNFGLLWPFPLLGGGLTFNGPSFNNVGPGKPLGFPNLIAWQHIPFSPVGVIGKRPDPFALPKSGPTLNGNWNLYPFFFFKIRLNFFKKAFFLPMGRMGKIP

SEQ ID NO: 946164 - protein, 97 aa, Homo sapiens
SKGAASTILASEPFAQKYGLQSKRVEILAHEMMTDLPSSFEEKTIFWLAFILLNNLQPTIAFLPTNSLLMNHCHFVQKDKVQPWLLQDIIHLEETWP

SEQ ID NO: 946165 - protein, 69 aa, Homo sapiens
MSSLIILKCYTVLVWYFVLILFFFFIERILLCFPALSVMAASRLIASSASRVHAISCLILPYYLGLARA

SEQ ID NO: 946166 - protein, 157 aa, Homo sapiens
MLKGGARGRWGRPKLPDVPRCSTSRSEASVPRPCRLVLKHHEPAAWGFIAFAYPCKSRDRKMVGDVTGAPGCLHRSAWTWALILGILMTILLIVIPVLIFQAMDRSGGITEARSSAHDLYPTYSNFHSSPCPRSRVYQPFILTRFSTMAFNKVHVFL

SEQ ID NO: 946167 - protein, 66 aa, Homo sapiens
NSRPASTEKTTEGERRFRGKGPGTSHFQSRELQVLPGETLHVEPSPLPFSAGSGVRAGATPIPEWD

SEQ ID NO: 946168 - protein, 172 aa, Homo sapiens
MLFPPRWTGAAGAGAWLRYRGLPPAVQFPDPLSVLIAPRRAGPELPGRLSCGREVLEAFEINNGRSSLFKVILLGDGGLGRVTYEQIVTNEVDTQLHTIVWNFKSRLEWMDICQQIGTRQSGAIPKPDTIYRGSDCCCLLSVEITKLPELSGGIIYKRVSRELPLGIGYKMT

SEQ ID NO: 946169 - protein, 98 aa, Homo sapiens
AASDTGCKTTEPLLGPGASSKNIIIWNYWKMVESKAVFSLGEFRQYLHLWEEPWLGMWRNSSRGAPWADGVSLQDGAFGSCLGAPSTGPYPLALDSVG

SEQ ID NO: 946170 - protein, 116 aa, Homo sapiens
MDEMDKQNVSCTYSGMLLSLKKEENSGVGTVAHVCNLSTLGGQGGWITWGQEARDQSGQHGETPSLIKIQKLDSTSKKKEEKAEEEEEQEEAVETWYCTRNVDMMLSEISQSDNAM

SEQ ID NO: 946171 - protein, 97 aa, Homo sapiens
RRAIRLRETTEGGRKRTREERPGPPAPGSARELLEVVEPEVLQDSLDRCYSTPSSCLEQPDSCQPYGSSMHWRKNMLALLTWEKLKRRGRGKEGGES

SEQ ID NO: 946172 - protein, 73 aa, Homo sapiens
QLRHGSPTHGNSVGFLDHFCGSKQKGGAEYELTLEPYTDMAFLLYVIQSKYYPLEFSNPDVSSRYTTFSSNPD

SEQ ID NO: 946173 - protein, 107 aa, Homo sapiens
ELTQMPINDRLDRENVISLHHGILCSHKKKHSYILCRDMNGAGRHFPQQTNVETKQTPHVPTYKWELNNENTWTRGEQHTLELVGEGRKRLRGIGIAVKIVHAGVNT

SEQ ID NO: 946174 - protein, 34 aa, Homo sapiens
QGGAGAGDDEEEESPPVPPGLLDCLACQINRISA

SEQ ID NO: 946175 - protein, 60 aa, Homo sapiens
AQQTPVGMLLYPQLTHSSVHMLDNFYNFDFIICCSGPDDTKPNLKCSSGKCGSEMDFRRL

SEQ ID NO: 946176 - protein, 60 aa, Homo sapiens
VGGLCSNGQDQGSDLRGRKELLKQLDDLVELSQLLLALTGVRSKLSKIVRPVHCPGSPQF

SEQ ID NO: 946177 - protein, 61 aa, Homo sapiens
MTHKGDTPMTILRQLMHFDKSCHGEQLSVLWAGADDIEHFSWRSRLSRLGEIYISCDADSV

SEQ ID NO: 946178 - protein, 67 aa, Homo sapiens
TQTPGHRRNRTSPWTWAPAPQSRRSDENLGGLRDVTPIPLTALAGRGVAVVAVCEQDSSNTVNNCPS

SEQ ID NO: 946179 - protein, 63 aa, Homo sapiens
TSVTGAECLRVQSRGATSGPVGRSRSLAWEHAYDLYSYLFYGLVIAQTATLWDLLNLINTIYV

SEQ ID NO: 946180 - protein, 33 aa, Homo sapiens
KGSQLPDRTRLRGTKHVQEKENSAEGLNKGVYD

SEQ ID NO: 946181 - protein, 86 aa, Homo sapiens
IPMGTDHLSAFKKVDGSFQAYTVSNFYASSTYTLYLQVSSIPPFCRLLRDDGREFRACNLRWVSSKQWDKKAAGAGQVNSAAQKGK

SEQ ID NO: 946182 - protein, 145 aa, Homo sapiens
GCGLCLSLQSELQVWFLLLLKAQAVWPRVLQVLGDPQLRHRDLLEAKNGESEGPTSRERRGLVGTGDGCGTQASPQSAPQSASPILLAQSAFILFQPLAAALTAGTGVLSLHARDYLAWSLSGSLHRASLQIVQEQGGGQGVLSG

SEQ ID NO: 946183 - protein, 112 aa, Homo sapiens
LEMEKMCFPKSKHLTNICYEDPKKSSQRPHTDTRTEHENIVPAFKERKRTFQQADSKSLGVGHGLMPVSQHFGRPRRVPVGIRDQPGQHGQPISTNTWPGVMVHCNPSYPGG

SEQ ID NO: 946184 - protein, 33 aa, Homo sapiens
MCTHYDPYCSLREASVTMDEQRYLPEFLAVNGV

SEQ ID NO: 946185 - protein, 116 aa, Homo sapiens
VEAPEGFYNHWFTHSGRFYFYVLYPSYFYLFYADFLKYPFNAFEKEKKVCIYFKNCFKSQFATCLYQMVLCLNRLYATFMETAIRCYEHFLYPWSLILCFIFLQYDIMICYVVKSL

SEQ ID NO: 946186 - protein, 174 aa, Homo sapiens
GRSAAPTADSHSSSDKSVPGAQLLSTEDKQAAETMGPPSAAPRGGHRPWQGLLITASLLTFWHPPTTVQFTMKPCRPVLQRERCSSTGCNISTIQAMAQGKRQKEPSHAGYTDKQIQGRYSGRETVYPNGLLFHHLEDAGSTPTHNASYDLTSNAAPVHPSQAFCGASWHVWVW

SEQ ID NO: 946187 - protein, 71 aa, Homo sapiens
IRGRVDRRRQKGQGGQSLALSPRLESSSAISADCNLRLPGSSFFCPTLLSSWDYRRPLPPAIFLYFFSRGV

SEQ ID NO: 946188 - protein, 95 aa, Homo sapiens
KTTGEEKSILCIRNMKHGTYTYSVATLIVLMGMNKPWVSWKALGLVSLHTWLFLKHFLSLIYGVPASVEGRRKGAGGSVLRMPLSQGAPWFILED

SEQ ID NO: 946189 - protein, 66 aa, Homo sapiens
AKSVKIKKNKDNVKKAMQPDTFTPWSSLTKRRPEKLKQSLPPGLAVKELMNQNMIGNCHYIKSLKI

SEQ ID NO: 946190 - protein, 33 aa, Homo sapiens
MPNSPQLKPIQPKPTVMGEPFTVNPALTPAKDK

SEQ ID NO: 946191 - protein, 99 aa, Homo sapiens
MREDDRRALQRNESTRAIPYLEYHFLISPHNHFLSLSVCPFLTLTTKLTNTNISDASGNRNRLNYLPAIILALIALPSLRILYITDESTIPPLPSNHWP

SEQ ID NO: 946192 - protein, 34 aa, Homo sapiens
SPAVATHHPTDVLATPLDTDVSCTEIRTFLIKYS

SEQ ID NO: 946193 - protein, 64 aa, Homo sapiens
REDTEGEGGETETVREPKAVSGWVAGGGNSLKKSSQGNAKENELNGGEGENKRPGIRRRARGKN

SEQ ID NO: 946194 - protein, 68 aa, Homo sapiens
MDKFLDTYTLPRLNQEEVESLNTPITGSEIEAIINSLPTKKAQDQKDSQPEFYQRYKGELVPFLLKLF

SEQ ID NO: 946195 - protein, 77 aa, Homo sapiens
RPGGTEQKRRTYGKLLGGNLSLSHWPIPASANFKVKRRWDDDVVFKNCAKGDDQKKDKRINDTLRSEFHKKSMKYIK

SEQ ID NO: 946196 - protein, 72 aa, Homo sapiens
SSLLLNLIIIGSDLHGQWTSSWQLPERSLMLDWKDPGYRGKKGKIFNLTEVAGYIRQRVTSSGIIRGGGLTL

SEQ ID NO: 946197 - protein, 65 aa, Homo sapiens
TGLSSVARCPLRLVTERLLKIKLKYTNCKKKSLKFFVEPGTTPVSRLGGPRWIMRSRDRDLLANW

SEQ ID NO: 946198 - protein, 42 aa, Homo sapiens
RPRDTAAKDDSKGYYSVVESEEPILRNMPEPSKSAPAPKKGF

SEQ ID NO: 946199 - protein, 73 aa, Homo sapiens
ARAERRAAPPLCNCAVSLLTETSLELQLASNDPFRGQLFSREGALDLKQMAMVADKPIFRKKPQEDFAKAGMC

SEQ ID NO: 946200 - protein, 98 aa, Homo sapiens
WMCNNALLGLVLFLTNPAESAVYNFRCLIDHSVVFVFYALALQLYFLLRWQVATLPQSTSEVVGLEHRAANVCVLCDASNDESLCRLLAYRRGGILGD

SEQ ID NO: 946201 - protein, 43 aa, Homo sapiens
REDDRRARAPRTPMPKKKDELERAKSNLLTQLLPNKPVCPGQP

SEQ ID NO: 946202 - protein, 104 aa, Homo sapiens
FAAASTEDDRRVGGDRVSLCHPGWRAVARSRLTATSDSPVQAILLPHPPEYLGLAPAATPGYFFVLFQRRVSPCCPSWATRPPWPPSVTGRATAPGLLYFSREG

SEQ ID NO: 946203 - protein, 105 aa, Homo sapiens
IRSAKVTAPLSTVSIACYRIRGRFDRLREDDRGRGRANSSTRGRLSIEAASNSSSLGGSLPKPQLDPIPLGLRVGVAYLAILFILPTSWGMMWPGSYRLKACEYC

SEQ ID NO: 946204 - protein, 69 aa, Homo sapiens
RGPHTVREDTEGGSRQGRLPFLQQPIPPSGLVKNLGRMAHTVDPSIGEARQSYHLRPGVQTSQHSETPS

SEQ ID NO: 946205 - protein, 116 aa, Homo sapiens
GTAIGIMSGRGKGKGKGGAKRHRVLRDNIQGHYKTGYPPFCSARGVKRISGLIYEETRVLKFLENVIRDAVTYNGASQAQNCSQPWMYICPKKSGAHLYGFGGVNLDKRSPENFKT

SEQ ID NO: 946206 - protein, 139 aa, Homo sapiens
SSQVPGKWWISPPLLNTQKTGRAAGNTALSMNNSPLSEPWELSRRVKRERFPTNWQQGKCGLSYGPSAAEMGFVPFVVEDSTGFRKCLLYRQNWGSLAPPEKFQRWQKRLQGMFGEHWHSRLSLAVIQASDIGMARLAV

SEQ ID NO: 946207 - protein, 52 aa, Homo sapiens
NSRPRTDREDDRREEVAVPPGLVGYVMVTEEVSMGRPLAGFRDDDQEEGRWA

SEQ ID NO: 946208 - protein, 68 aa, Homo sapiens
IRGRVRHGCAEDDRRGTGSVLIQIVCQELSLIYRNNIGSDWLSIVELCIIRLIAAACGNSNQFQQLKT

SEQ ID NO: 946209 - protein, 50 aa, Homo sapiens
IGSPHECRRHLSRGPRGMYLTPQPSGDEPLFSHHVFFISIELVAPLSLCG

SEQ ID NO: 946210 - protein, 36 aa, Homo sapiens
HHSAWCVVPPGLQDRSGPTVSTPIAVNVPLNKVGET

SEQ ID NO: 946211 - protein, 134 aa, Homo sapiens
GGLSGNLKSPFWKLKFREKFSRAGGPPAGFPETQTGGPFGPEREKRKPGTQGKKGGGGKLFPRAGPGVGGPFPNLPFPLGFKKKTGPLSPGGRKVVNPLGRVPLSLETPGKKARKRGGAGPKIGTLNPLTSHSP

SEQ ID NO: 946212 - protein, 65 aa, Homo sapiens
MEVQTGMVGCAGHGDSSAQAPAAKSGANSAGRRAQVSNVFNIPRLCSSSVFQTVGNLQNFSNLFF

SEQ ID NO: 946213 - protein, 48 aa, Homo sapiens
DCDRNHVWSRQRRGLGGGAKRHRKVLPGINIQGITPGFPPFGLRPLAF

SEQ ID NO: 946214 - protein, 76 aa, Homo sapiens
MVDRPRIRAAFDGCEKTTEGAFSKRLPKWRRCKSWCLMVEAIPGPPGHSWLNSLGPESGLRCEGINILAILQQLVL

SEQ ID NO: 946215 - protein, 50 aa, Homo sapiens
LITFHDHALIIIFLICLVLYALFLTLTTKLTKLISRSGSVYLPGIILVLS

SEQ ID NO: 946216 - protein, 144 aa, Homo sapiens
GERSSFRLGPGVPSPQPDVTMLSRLLKEHQAKQNECKELQEEEEARGYRCSDLPDRSFGGSLMVLPSLHEPELDHVKTLQSKLPHLPSRQPLDRVENFRHSNWDLRARASGRTMHARICYKACICPSSLFLPNLSSTYREGGAD

SEQ ID NO: 946217 - protein, 102 aa, Homo sapiens
RGRATRLRETTEGPSGSNSRMENQTRMFSTHKWELKMRMQRHKNDTMDFGDSRGKGGKGLRHKRLQIRCSVCCLGDGYTNTSQITAKELTHVTKHHLFPNNL

SEQ ID NO: 946218 - protein, 105 aa, Homo sapiens
MHYSPDASAFSSIAHITRDVNYGLNIRYLHANGAFNILICLFLHIGEAILGSFSTQKPENIGILLLQYSNSFKGVSVRANIILRGTVILYIRHPIHGDRLVQCLG

SEQ ID NO: 946219 - protein, 107 aa, Homo sapiens
MSAISSPEASELDPLLGIYWNWSYWSTTVSLRLALFIPDVCWDRILSLEQLGPMIIQFYSVMWITAAEEERPEFLNEMFHYERCFRMKVFQKPHPHNFPLNQEIFLL

SEQ ID NO: 946220 - protein, 140 aa, Homo sapiens
KPLSSRRPHIAPDYTSYIRQTQLRRITVASYPLSGLQIYSHIADDSSKPGNSLTPHITYWENSLCCNHVLLINITLLLQDSTYKSQPYTPLHNHNTWGSLTHHINNIKPSFTRENTLMFIHLSPILLLSLNPDIITGFSS

SEQ ID NO: 946221 - protein, 75 aa, Homo sapiens
GDTPGTLAMRKSNYLIRKWTPRVRRLDSDPRVQELRRVDRLREDDRGHHHCLSFVNQPMTLTGASQPPNDSGLAM

SEQ ID NO: 946222 - protein, 114 aa, Homo sapiens
MKTVFGVEPDLTREGGSIPVTLTFQEATGKNVMLLPVGSADDGAHSQNELNRYNYIEGTKMLAAYLYEVSQLKDYGQALCVPSPMRRNPALNFNLSNCPGMEFPLSFPLSVIQT

SEQ ID NO: 946223 - protein, 29 aa, Homo sapiens
REGEEKREDREKKIKTYRRKKIKNLKSRK

SEQ ID NO: 946224 - protein, 50 aa, Homo sapiens
GGAWSGGGGGGRNDGRSIAWTHDGRNYWRPGLEWVLVRKTRKEEEKNNKY

SEQ ID NO: 946225 - protein, 41 aa, Homo sapiens
MYKSVGFSIFTMFGTIPLISERFHHPNQFFSFFNYEENSNM

SEQ ID NO: 946226 - protein, 102 aa, Homo sapiens
MGWNHPATFTANGASIFFIWPLPTHREAYITDHFSTQKPETSGIILPGLATYRQQPFIGYVLPVEAKYHSGGATVITLLSGHPILGRPSSMNLRRATQWTSP

SEQ ID NO: 946227 - protein, 33 aa, Homo sapiens
MASICDASVSVIREDIGFIVLALPSEDYPGHLL

SEQ ID NO: 946228 - protein, 69 aa, Homo sapiens
GGSRRDAPGGKMEDYQAAEETAFVVDELSNIVKEAIESIGGKLINTANEPDHKCIEQTLSQSPSWAFYI

SEQ ID NO: 946229 - protein, 104 aa, Homo sapiens
DCNRKSCLAARTEKAWGRVVLSAIVRSGITSLTKAIRRLDRRGGVKRIGLIYEETRGVLKVFLENVIRDAVTYTGHARTVTAMDVVYALVAHSVWGGVNLGRGL

SEQ ID NO: 946230 - protein, 105 aa, Homo sapiens
PNGITPLIPRVHPKHLRNRGVSSLSSPSLLKTTPNSAYTGSLTSYSFEYSSLLHSDGIYGSTFFVATGFHGLHVIYGSTFLTICFIRQLIFHFTSKHHFGFEAAA

SEQ ID NO: 946231 - protein, 29 aa, Homo sapiens
EKTTEGEEKRKREEKKEGEKRKEKRRREE

SEQ ID NO: 946232 - protein, 53 aa, Homo sapiens
GGCPNSVRALPAVRCFSTSVVIPFAKLVPPVQYTVRSLCHSSLFCCIQNKLER

SEQ ID NO: 946233 - protein, 43 aa, Homo sapiens
SPIIPPASAHPVEGSAPQPVVILGEEVGSHSSPPPGINPSPSR

SEQ ID NO: 946234 - protein, 43 aa, Homo sapiens
GRPRWVAAAAAAIVPAPVSVRPVDLQIGDKPFWSRLIHFPYYL

SEQ ID NO: 946235 - protein, 73 aa, Homo sapiens
IRGRYDTADEKTTEGEPSPAETSFTKEAYKNTSRLLKSIGNEEQRPERVKPFMTGLQNKSSTSCYFKNYRSYW

SEQ ID NO: 946236 - protein, 83 aa, Homo sapiens
ATFPNQEVGVQLGELDKLVMMQKLLKCSRLVLALALILVLESSVQVILRGERYQVRCNPDSNSAKCEEDQCFLLPVNPTKIPV

SEQ ID NO: 946237 - protein, 95 aa, Homo sapiens
EQTDYTLSIHPWRLPRYGQMAIIEIHKNIASSSPPSCHITSLTLFYSPIYPLNHISPYLTRKINDSLNIQTHPIPPHIIALPRYSYYLPFILIIL

SEQ ID NO: 946238 - protein, 64 aa, Homo sapiens
STQHQVQTLPPPGCYTARKLPSQFVVDYYETSPLLPQLYSNPKKQCADPSESWVQEYVYDLELN

SEQ ID NO: 946239 - protein, 102 aa, Homo sapiens
ENAPCLAALRFNPFWDGQGERKTFPKNADQAVFVGRAFLTAKKEELTSFAMNNSESGGFLLLFSGCFLALLCCSLQPRLLGSRNSPASASQAAGTTGHITSG

SEQ ID NO: 946240 - protein, 90 aa, Homo sapiens
AALTDLWDPYGGTLDVGMWEAFVVAQTYSLKDPGEPLPVSVWDLESSHLLTYRPHNEKPCCDNLEIFIYFLYECRTSCFCSELLLLRRPT

SEQ ID NO: 946241 - protein, 77 aa, Homo sapiens
AKAWVALGPTGKWKSSGSSGSEIQASEIGILATLPLGNLNGVLCYVAKLVSSLRGNNIELGTLRKYYRVCTLAILIR

SEQ ID NO: 946242 - protein, 69 aa, Homo sapiens
PNRLKRYRYEAGLAQFVRLLLHSVLTSMLPSTRVVAASNCVAEQDVFSLAIEKWLFIYAGDLINGARQV

SEQ ID NO: 946243 - protein, 73 aa, Homo sapiens
PGAASLISSGRMVIILAPGRMPTKLWLVFYLWAIEIFRYSFYCRALTGLEGAHWLYTLWIPYIHWDVWWKLSQ

SEQ ID NO: 946244 - protein, 168 aa, Homo sapiens
PNRILSDISPLQRVIIAVAVVIQAGLLIILLPRQRMKLLQLMRVLFIQQVTPFIVFCVPRCCPFRADKGQRQAAMVAVVQVNFSRRRVYRVHLALHLRHRQPHDASQRAFLTHPVSQDSFPAGRALQQHGGNNTLPTSSPTVKVSAKLRRFRQSTVAVQPDWVVPGCS

SEQ ID NO: 946245 - protein, 71 aa, Homo sapiens
DGAYGSSNTIKAREPARTDPLVWEDWVPPTPNKSGLIGRILTVLQHRSIIRVMTKIGVTRYAQVSICPGSV

SEQ ID NO: 946246 - protein, 105 aa, Homo sapiens
ASRGIRSTRLTPEHLPCSELLHRRSLLQRTDEGDLCEYTAYCLLYHCCAFTAWVRGPSGVERAQLLAEVIENLECDPRHYQQRTLTFALRADDPLLKLLQEAQQS

SEQ ID NO: 946247 - protein, 75 aa, Homo sapiens
ERHRFEVSNKTHTFVSAAVASKLTTFRKFDLLANVVTLPKRKRKYNGVPRLKEKYHRELVRMKAPKNCPIQAWVP

SEQ ID NO: 946248 - protein, 42 aa, Homo sapiens
GGVGSWSGKRLRKICEEKNSEVNRIIRIEGLDRWCVVALVCA

SEQ ID NO: 946249 - protein, 94 aa, Homo sapiens
DGWLLFSAPKPRHARPQKRPDSGAGLTDAGASDVLIFCYGTQTIRWNIYEFRSYTSALKEMIPGKFETLIFGQLHSEWLDTDVDLEADDTCFKL

SEQ ID NO: 946250 - protein, 186 aa, Homo sapiens
ISRPRSNNGCEKDDKKGLFFAKASFLEIDRLLPCVGKSLRNRPLNAPRERTGRTWKFQLTSLKHPTNWMIIRKCFIVGSRTMWAPSRCSRFRMFPFAGKAVVLMGKNTMMRKAIPALENPALEKLLLQSGGNVGVFTKDFTEIRDMLLGHVPTAARAGAIAPCEVNVPAQMVFGARGTSFFPGKYS

SEQ ID NO: 946251 - protein, 73 aa, Homo sapiens
FAASTVGGHAACTVFARGLIFPLNRGANEQPRIHNHCQRFKSFPVESERPSQETHNEYYKAFSEMGTFNRTWY

SEQ ID NO: 946252 - protein, 173 aa, Homo sapiens
RAAFSLIQENEVLFTMCFIPLVCWIVCTGLKQQMESGKSLAQTSKTSTAVYVFFLSSLLQPRGGSQEHGLCAHLWGLCSLAADGIWNQKILFEESDLRNQDCRRMCLPEDEVPKRSGCESSTASSTFQEFLRQYNCWKREGRDVPGIELPAESDLWKLCNRGIDLCSFLLSRE

SEQ ID NO: 946253 - protein, 72 aa, Homo sapiens
GSCPNSQWEDASLLPCEDGLGLLGVLSSKENADLGLARWLTPVIPALWETEVVDHEVEVEIILANVVKPHLC

SEQ ID NO: 946254 - protein, 69 aa, Homo sapiens
TEGEWKVGGSDGEGAIGLSRDPKSRNINDRIGYKPQPKPHRSNVEVLKEMDYLAQSRWEWDKMGRVQTR

SEQ ID NO: 946255 - protein, 32 aa, Homo sapiens
LRSAVKWNDETAKSEHQKSPVYLMHDLYSSEK

SEQ ID NO: 946256 - protein, 105 aa, Homo sapiens
MPLVNTSRWDPAKEYRGMLDAWTARRRSELTNQMARECLVCRKRVIHNLSLTDCWHPTLMPDIGKSLTQVRAMMYSGELKFEKRTSSAQVEGGVHSLHSYEKRLF

SEQ ID NO: 946257 - protein, 92 aa, Homo sapiens
FAAAYDYGLREDDRGESSVLRGLHVDCGKLGNKLTSSCGPSSNRDESAVDCSCHLPLCEVFVVLLLCIPFISPDGKKILQARLVVVSVPMAP

SEQ ID NO: 946258 - protein, 29 aa, Homo sapiens
MRGDYPGLEPSGSATAAWRLSQIVQDQGV

SEQ ID NO: 946259 - protein, 72 aa, Homo sapiens
GICRISCLSPPSYDHRVTSSLPQSLAPWSELRYTIRRIIFNSYIFPLIPRTRRLRLLDVDNRVVLPIEAPFV

SEQ ID NO: 946260 - protein, 64 aa, Homo sapiens
PVIDNPRTSPPAQPFPLFQQPLMRLQSSRKSPVKTLVKVSPGGKKWTFSPPENYDLYELGRRWI

SEQ ID NO: 946261 - protein, 114 aa, Homo sapiens
GGISVSSAILTQTNNDEFVIVGGYQLENQEMICNIISLEDNKIEIREMETPDWTPDIKHSKIWFGSNMGNGTVFLGIPGDIKLFQKLFYMLVLKYYEEQTTFTNSQLTKSRPLP

SEQ ID NO: 946262 - protein, 74 aa, Homo sapiens
ITLEANEILQQHKEGKVAVMKMMSWPSCPDRPEEESDYPLASKDAKQLLCGAAALMRMTIGWTCSPSWCGCSGF

SEQ ID NO: 946263 - protein, 108 aa, Homo sapiens
KTIRRILVLKMQLRNVADDQQKKICELEDGYLKYTETKQKIEINVILQDLENHFKRANLRVVGLKSEVEKEIEVGSIPNGIIKENFPNLKKDINSQVQEDYRTQRRFN

SEQ ID NO: 946264 - protein, 114 aa, Homo sapiens
MAHAAQVGLQDATSPIIEELITFHDHALIIIFLVLPGPVMLFLNTHNLTELLTSERLREIGNRSGTILTRPYILVPTSPYPSLRILYITDEVDPYPYHLQLATMVLNLTSTDWR

SEQ ID NO: 946265 - protein, 39 aa, Homo sapiens
NSRPRRREDDRRGLLRVAAKPENAQWASGNANENYRFGS

SEQ ID NO: 946266 - protein, 93 aa, Homo sapiens
ITLKEANEFCSAKGKVALVNEDDLVAMPWTDLRIGIPTSSKARNTAVWGAIGTHEDDNIGWIALPSCVDVVVLDSSQEIHLPDQYDQYINTLL

SEQ ID NO: 946267 - protein, 82 aa, Homo sapiens
MMPANAVQICNDLSAYQQMSGLNNVIYIHSETLFGLEKTKEILSFVTTQMNLEGVMLSEISRHRKGNSELSHLYMKSKKVEL

SEQ ID NO: 946268 - protein, 42 aa, Homo sapiens
AFSQRVCRQNTGVVKTTPKSLGETRIHCRHWTRIFGSTTTGL

SEQ ID NO: 946269 - protein, 97 aa, Homo sapiens
KAPGRGELGDHSDRSSVISCPKAPGPPLESQQLVEIDSLLFEQGVWVPELDVKGDDEDVDETKMTMETHQDGSTGAHSESPEITSLHSRKGNRARLL

SEQ ID NO: 946270 - protein, 68 aa, Homo sapiens
PGPYGVEANTQNDPGGGGSSSSIAMAVAEEIRKQAQERRAEKGSRLQQICELSHSTVVAGLAATRDMF

SEQ ID NO: 946271 - protein, 66 aa, Homo sapiens
FAAASTRLRERQKGSMNILETNSFSKAQQSNRKSQQRNGKCKKITNGNSGIKKYKNQNKKLNGLTQ

SEQ ID NO: 946272 - protein, 151 aa, Homo sapiens
VPDGPKTQGLVGTSIYGPLLILPLRCLIQSGGPLISPRRIEDLNIARFLDIYTNILMELNFQVRMCPETNLTLGFLSEPVNSGKDSDLASGVSVKLRLKECLKICSYGVKYNKSSPAHARTSLKCFIKGLDDLITCFYNPERKRETDTNVK

SEQ ID NO: 946273 - protein, 106 aa, Homo sapiens
FPGFFSFSETGSCSVAPAEVWQDHGSCNLNFLASSNPSHLNLLSWEGLQAAPPAGYFFIFCRGRPLCCPGWSQTPGIKQSFCLSPPKSWDYRHEPCARPNVLLKMQ

SEQ ID NO: 946274 - protein, 101 aa, Homo sapiens
SAGTPPPPAPQAEDHSSRILYPRPKSLSPKMMNADMDAVDAENQVELEEKTRLINQVLELQHTLEELSARVDAVKEEKLKQKTENQVLGQKKEKPMSASRV

SEQ ID NO: 946275 - protein, 76 aa, Homo sapiens
TPSQPPRLAQVLGTADHLPDDYQVSLSRFERSIVCVFITTPFSVEMVYSVRLSGNILGLRRDGLVGSTYSALLLVV

SEQ ID NO: 946276 - protein, 44 aa, Homo sapiens
NSRPLDREDDRRDCGNVVCDKIKPNQQPILCNQGRCVDSLGFLA

SEQ ID NO: 946277 - protein, 61 aa, Homo sapiens
MQFPDVYNQTTTATRPGVYYGQCSEICGANHSMPIVLELIPLKIFEIEARIYPIAPPLPPL

SEQ ID NO: 946278 - protein, 32 aa, Homo sapiens
MDVLLASGGRILRSGDRDHPGNAVKPRLYYKY

SEQ ID NO: 946279 - protein, 101 aa, Homo sapiens
STRLREDDRGEGALVGSVLSSRRQGTPQFPSNSLITPRIGILYINIEAGAGVVVHTVIPALWEAEVGGSLRSGVRDQPGQHGETLSLLKIQKLARRGGVHL

SEQ ID NO: 946280 - protein, 125 aa, Homo sapiens
NDVARARNGALCWALQEATCGWLLGVVLPKPSWTSHANMPHFLPSCPGSSPEAQYMPFPAYASDGVICSFLWHPTVSFTVYIFTCNGWDQAIPSPLTIWLELNVTKVASPWLRDGRRGGICSWVP

SEQ ID NO: 946281 - protein, 155 aa, Homo sapiens
PPQMQTRHGDGLIMCRKSRFWYCISVEEVKSSGIVYVGSEVPPGRIRLVRYDSGAAPKHVREYGTDHAGVTQCYRDMGARHRAAQSIQIMKVEEIAASKCRRPAVKFHDSKIKFPCPTVVLRRQHKPRFTTKRPNTFFQVQGPRPGVPQINSGTP

SEQ ID NO: 946282 - protein, 55 aa, Homo sapiens
RPRDYGEKTTEGYGREDDRRGGSLWSAREEAGGLLRAQEFETSPGNIGRPCLYSS

SEQ ID NO: 946283 - protein, 119 aa, Homo sapiens
LRPYLSGWRASPARRTDADRIESTQAPAIGPQVSEHSSSGFTRIPEHIHKVLQLMSARRDPHRQRRFSTASSRAASWIMDSPSLAPLPLPAIDNVAGTSASPCSRTSQAPSFLPQRKEL

SEQ ID NO: 946284 - protein, 150 aa, Homo sapiens
RTCQVGGFTIQETRDAEPHREQFNAAPWPPVSEQRIIQGFTKQNTRSSHPVLQMLRRCESSIACSASLRLNESRPLMDSWIAHASPYLPLPAIDNVAGTSASPLQPSNFPGTLLSAPEEGAVVSCCLWAPSSAVLGSVRHPLIIKSTVCS

SEQ ID NO: 946285 - protein, 108 aa, Homo sapiens
DRGSARPGTAFLCGFTAQRASWTWVSEPLHVRRNSTRVLDTQTDPVEWGWRMRVERIVLPGEISSDWWALELLPENAPCCPKGALPFRPGEVSLLCHGDKGRAEIMSF

SEQ ID NO: 946286 - protein, 121 aa, Homo sapiens
MQSSLKTLYRARPINLEGGAPVTPIEKCERPRFQDKGKAFPPTQPEGSSLQASSWKPYSSDYTRKEFDPAVLRLKSGMQIFVLGQETILEMEPSDTIENVKAKIDYKKGILPTSRLIFSTL

SEQ ID NO: 946287 - protein, 179 aa, Homo sapiens
LQLLLPAGCRVFPEATAGSCREQLRCSAILCLPRPVPRLPAELTIYTSDNYTEEMGSGDYDSMKEPCFREENANSILLPTIYAIIFLMACGQWMVILVRVTRRNEKHDGQYLHCHGRLLLSSRSLWGIDAVANGIWEFLCKAVHVIYTVKLLQCLILAFIIWDANWAMFQANNIRGQAV

SEQ ID NO: 946288 - protein, 40 aa, Homo sapiens
QIFICSQEESIKPRNLWRRLTLTVFRIMASSPLLCFDVLT

SEQ ID NO: 946289 - protein, 133 aa, Homo sapiens
KWGKPKKSPGKAPNPGRGGGAPAFLKETLKVGEPPPGGLGQGEFPAGAPAGSRNQPGPWPEEKEPDPRKKGDWPQKFLVPKDFQRKKLKGPNVESLKVSMAADTFYTLVHHWTKRRAEKLEAVPCPPVAVKLK

SEQ ID NO: 946290 - protein, 52 aa, Homo sapiens
EDTEDGCEKTRRLLLLRHEGYAARRHEGTLREDDEGTLLEDDRGYAARRLQK

SEQ ID NO: 946291 - protein, 64 aa, Homo sapiens
DAKSVKIKNKDNVNLKFDAADTFKPWFIIDQEKGRTEAVPPPVQLKELKLNQTHLIGTCIILKY

SEQ ID NO: 946292 - protein, 64 aa, Homo sapiens
MEAGKITGPQDRGEIKIANEVSGAVIDNSYEKGFESSNPLTNMAPRFYYNQLAGALWHIPVPAR

SEQ ID NO: 946293 - protein, 144 aa, Homo sapiens
NRVSIHGNGAIPDTACVSLMTTNQTRWAWLLSCPRSHSSERFGDLAMRTELVVELGLSDPGQPSPFPWSWSSSGLLAFSLSKLLPMCVGQSDGEGIKPKKGQTRAGVWWASHLLIPALWGRPEGRFTRFKEFRPALGPMGCPPP

SEQ ID NO: 946294 - protein, 80 aa, Homo sapiens
GLRRPRLDAKELQHPGDKMPTGKQLADIGYKTFSTSMMLLTVYGGYSAVSESTTISSGAGPAPRRRTEDLDHVELGGFFS

SEQ ID NO: 946295 - protein, 111 aa, Homo sapiens
MAPKAKKVKLLPLLKAEAKAKALKGQEGQCKGVSTAHKKIRTFTHLSGGPKTLRTSGRQPKYPREERLPRRNKLDHYGYHQVFRWTTGVLAMKEDRKTTNTLVFHCGLPTT

SEQ ID NO: 946296 - protein, 54 aa, Homo sapiens
RQEGKDRMGSPDPLSLTRGEGEWHSSVSKCPQMPVGALAWACALQGLAIGLLEQ

SEQ ID NO: 946297 - protein, 40 aa, Homo sapiens
KNRPELMTLGIRDQIGGGWLCLNSHHKASNSLKKREERGA

SEQ ID NO: 946298 - protein, 69 aa, Homo sapiens
ATDLSDQIRENDDMSESLDDWKDIADLMTRLGWRMEVKTDTATQRVEVAIFINWQPEKIEWLFAANYYV

SEQ ID NO: 946299 - protein, 178 aa, Homo sapiens
MLPRLVSNLVSWAQAIRPPRPPTCWDSRRELPRPAYLLFLLSWGSPSPSAWQEGGGARRKEVQNTQRCPRFRLALAFSHRPAIKREKQVQEGPGIMEAKKTSLGSRGDSSGGSSSALWELRCSVPCPAFSHSSWLPKKENTFEAGQGVTSVLSTGNGVLALLSAWNCNGMIFGLQPRL

SEQ ID NO: 946300 - protein, 56 aa, Homo sapiens
MSTDTVFSLPSYEDQGSKLIRKAKAPFVPVGIGFAAMLHMDYINWSRVLVHSSDLR

SEQ ID NO: 946301 - protein, 48 aa, Homo sapiens
GGPTAPPRADWATAPDDFNTAFLLLPPQKSTVNMIGLKVGNKVKSFQT

SEQ ID NO: 946302 - protein, 51 aa, Homo sapiens
GSSAPRVCLLASTVFGTEHIRGDSLPASDLPPISSPLGPPGTIFSAISCFW

SEQ ID NO: 946303 - protein, 79 aa, Homo sapiens
FAAASTLREDEQKGEKEREVEEIVELAKVYNKKKFQSLKAVSTELISANNTIKKLDNIEVIRKKAYIVSINEKTKGQKL

SEQ ID NO: 946304 - protein, 70 aa, Homo sapiens
IRGRSTRLRDDRRGGGVRQKHQLYYKKGAFGGRSPGVSNLTRLTELEASYRYRGDRTLCHRGLFDQTYPA

SEQ ID NO: 946305 - protein, 194 aa, Homo sapiens
MRGRVDVDANHAYQPYIFAAKKNTCNSRLAVQLNLKENNAKQGDVDQAKEVVADLLQTGKANTQQPGDRAYRFDPGEIITACPYWYMYQDILHTKSIFPPKRNVTPYYVIHVCSRKSSIRLSGTSALFSQPFINMNLVIASFLFYCLCDGLKAFMAIQDNARSAAGCNLNCGWCSSNSYLATLAAFVNPICHML

SEQ ID NO: 946306 - protein, 103 aa, Homo sapiens
MGFQEAIAQNALPSPWNLPGPELIWPTQATEACRAASGHWPLPMHYSKTINPCMLWGQQRSHFRARILYFLAASIAAGQALNDSRCHCHFYKALFRVKSLFVS

SEQ ID NO: 946307 - protein, 44 aa, Homo sapiens
EDDRDGCEKTQRVCENDEGTLREPTEGRCEKTTEGTLREDDRKG

SEQ ID NO: 946308 - protein, 106 aa, Homo sapiens
TPSSSEEEELGQQAAGRNFRNPLAQVSGQESLRSLLATTLPLQLQLEAPDHLQGSLLLAPHRRGVRYRFLRTSTEAKFPGALWQLLALQSCNWPKSLSRLHFPPSV

SEQ ID NO: 946309 - protein, 101 aa, Homo sapiens
YLDRYFKIAILKKLNKIMLITEKKFRILSDKFNKEVEIIKQNQAETLELKNATDILKNASESPNSRICQAEERINEPDMYFKIQRRLKKKERKAAAVRAAA

SEQ ID NO: 946310 - protein, 56 aa, Homo sapiens
REQGELGYIHPPQAGAGFLRESRSYEFYDLGGLQIPSWVFGLSLGSSPLVFREFVG

SEQ ID NO: 946311 - protein, 87 aa, Homo sapiens
GNPPTRGNKKLGASHPGRPFLELVPPGLQNSRPRRLRLREQTGIPGQKELEAVLYEPLVVVGIVGYVEPPGCREDDRREEEMPVCVF

SEQ ID NO: 946312 - protein, 69 aa, Homo sapiens
PLSLSLRPSIAVRGLIERNGGFCVFHVDINLGAPEETSEVDLDKPFWQIIHPTYPSGAAEPAQCCRGVR

SEQ ID NO: 946313 - protein, 141 aa, Homo sapiens
QDSPMRGICHAKTHCCLSLSHFFTQAVLRFFPYCAENETKSFLMSPKSCGFVFPQSHKLDKNGIGTEYILNICMKNGTHTFSRASGVEATVMAGGDGDLTALKKILRKPLSTALPLFFPDVTLDGGSELGSSFVMLPPAVV

SEQ ID NO: 946314 - protein, 181 aa, Homo sapiens
MTFINTYVTMNYPQALPDTGYSSHKCLTISIGDMLCLAERLLEQGWTCANLFMYVFIYIQRTVQEPCDMRIRVYNSWRLLTVISRSTEVTRSGTESRPKTQMNIFFNLAENLPPSELRIPYKTIRTATNWRRKAGIPALETPKFLVVYPEGPASLRSRSFNQAYSSPIMENQAFPVFGPVG

SEQ ID NO: 946315 - protein, 68 aa, Homo sapiens
AAPLQAEQSRRQGAPTHGPQLIMMDLELPPPGLPIQQDMDLIDILWRQDIDLGVSLEGFDFNQRPKEY

SEQ ID NO: 946316 - protein, 152 aa, Homo sapiens
KGFTQRSHIQAHERIHTGEKPYKCGDCGKRFRCSSNLYTHQRVHTVEKPYKCDECGKSFRLSFNLYRHQRVHTGEKPYKCEECGKGFRSDSSFQSHHRVHTGEKPFRCNVCVKGFSHSSYFQAHQRVHTWEKPYKCEVCGKALKLSLEFYKH

SEQ ID NO: 946317 - protein, 79 aa, Homo sapiens
ARATVLPDNRSQTIYPETVYAIDNGTWRNSYESRTGEVKHYDHALYWLDKPLYLLYNGITRNNFARGARAMTRQNRRAI

SEQ ID NO: 946318 - protein, 117 aa, Homo sapiens
LIHHDQVGFMPGMQGWFNIRKSINAIQHINRTKDKNHMIISTDAENAFDKIQHFMLKTFNKLGIDGTYLKTISAMYDKPTANMLNGQKLETFLLKTGRGMPSLTTPIHSVGSSGQGN

SEQ ID NO: 946319 - protein, 115 aa, Homo sapiens
LRRSSDLSLPSWDYPCMTPYLALFVVVLSFFTWFRTCHPGWSAVCRLTATCLSGWSDSRVSVFRVAGIAGVCHHAWLIFVFLVGTGLRYVGQAGLDFLTSGDLPPRPPKVLILQA

SEQ ID NO: 946320 - protein, 136 aa, Homo sapiens
PEGSRGLEVALDCGLRAKEFCIRLYNRSLTRNPKLAPLEARTECIGSSLYVSGYVPNCVAYCRKQVLNLSPHLRLEALCGLVSDACLSVRRSCSSLRVLYVNLRSPELYKYPRIQTKRTKLLPYLRPFGCLGGSLV

SEQ ID NO: 946321 - protein, 101 aa, Homo sapiens
SLASSRLECRSAILARCNLCLLGSSDSLASASQVAGIIGTCHHVRLIFVLLVMEFHHVGQAGIELLTSGNPPALASQSAGIIGVSHRGSQCFISLSHCSVF

SEQ ID NO: 946322 - protein, 67 aa, Homo sapiens
AGARREAAPGRARNGKRCGGGGATGIAEERRRCAAPGSLLVALCREEVRRRVAAFCWLYLRSIFIMG

SEQ ID NO: 946323 - protein, 73 aa, Homo sapiens
ATLQSHTLADSIPSSPASSQFSVCSEDQEAIQAQFGRPSCLYGELQLIIGMPVFLQPTDDIAPGYHSIQRPMV

SEQ ID NO: 946324 - protein, 66 aa, Homo sapiens
ELPQEHTRKAKRIHRPLKELDHRHRLPEMAKNFCREDSYHSVVSCAAVVLTPMEPMIVKEKNQFPG

SEQ ID NO: 946325 - protein, 81 aa, Homo sapiens
ARGQLSKEERGGLFVLQLTGWEQLKKNGQRMDELFVLILDGFCSQLASSLASCCAGIIEFRAAGWKTTPAAHKYYYSEVSD

SEQ ID NO: 946326 - protein, 52 aa, Homo sapiens
TAAQAKAKTTGARLILRYRLQRPPKIRNYHYGLTSSPTRPLGARGLRMPLSP

SEQ ID NO: 946327 - protein, 186 aa, Homo sapiens
KAAQDCPNRKLDLSEDELTRSTTCGNLGCSEAKNGTLPAFSVRCSQSLVYSTTLQTNRETKVLAVTVCETLEEHQIDRAHTHDDELTTLTELTLNLCKLSLTSDLGSYHTCCGMLTNSDVTSVYDQTVCTILATMQYAIQVRSLLNIHQFHRHEPHQHPRRGRALGVVLVCDMRCVARHYTTARPG

SEQ ID NO: 946328 - protein, 91 aa, Homo sapiens
FGTRFYCILGQKLGEKNKQTIFGDTEEFQAVYMELQNLVPKSARGTLSVNSSDGIQVIIDAYKFLSSEVICGNGHCEKALPLVTNVTARTE

SEQ ID NO: 946329 - protein, 121 aa, Homo sapiens
LDVCPCGMDVDGDRWDTRISDKWVKMQIFMTSLTGQNITHEVEPGGHLSANVMAMMHAIKGMPLSPKRADGSLLLQGKRDCEDGPYFLSLTYEDPLRESTTDTWLPDVCNSAGYGRLVSAA

SEQ ID NO: 946330 - protein, 35 aa, Homo sapiens
MEKGHTTENEPGGTPGDTTAEGQTQLPWRTHHYAA

SEQ ID NO: 946331 - protein, 107 aa, Homo sapiens
MAGPRREERKKVERRKETETQKGEEREENQHDKSSEGPTPGTRNKDSDKKRDRGDKPKEGRPPEKTAEPRQKETNTEGNQKSDHTRNEAQNPPAKRTGEKGHEQDAA

SEQ ID NO: 946332 - protein, 129 aa, Homo sapiens
MHIALFYKKTIRDMLCPTRPSLTRPKRHRHAFNMGLSNSSLIARYRDERKCTYLCQSSGYLQTRNQTCCNRLKVQQHRRAFMMLDNESSGQSSRYSTKHFRVCNHAFGKTRKYALEVVREKKDSTAAIP

SEQ ID NO: 946333 - protein, 75 aa, Homo sapiens
LLTTSNLITPVCYVWNYLGIDDDDDDDDDDDDDDDVDDEITDDNRGYTRRQNEHLTQTLGYNESYDIFCGYNTHS

SEQ ID NO: 946334 - protein, 34 aa, Homo sapiens
MGLPGPRLRGAFHLSVIQHAIPGIYSLFYTRSLC

SEQ ID NO: 946335 - protein, 224 aa, Homo sapiens
MHHESFCEALPGDNVGFNVMIVSVTAPRCGKVAVDSENDPPMLAAGFTCSGDDPGPSRSNKRRLCPCIVLAHGLQCMEVFLSCPKSTVRCFLSFKVLPNFLGSYNAAISSLPPGMSYFSKRLTHFPPFWSLQYAPMLAYPFALPPLRPVIFPLNHFFEFPIATPNPNSSLLFFLLSRLLNSLPLTATGSLPIIPFILYSPSPRIQHPLLSSPPLLPSTPLLHFP

SEQ ID NO: 946336 - protein, 68 aa, Homo sapiens
DAPGLLGILARGCLCKEPLFSKHRRKLHLYTLCGRLFPRWAKRSQDSKNNKMCAFPRVNVKFVCDFLG

SEQ ID NO: 946337 - protein, 214 aa, Homo sapiens
MQAGTMNRMMNALGTYTIRRSHRVIQQWHLLYNKQKHIYNSDDEIMTTPTALTCEHYTDTHSTDYTDCDTTHMTVLVDYAQITVLHILCSILTLTCDKLSTPHRTLIDYDTGQQTSTLEHVPNIVTFYLRSDQIDDRTENTSHYTRRINIIVDVTKQITRTTVDHHTGYLTRLEIDRNDENSQQLTVDRYNIQYEIYIGTVRTTLTTHTTYIEH

SEQ ID NO: 946338 - protein, 627 aa, Homo sapiens
TQRSCMTSTVACVPPVSCSLGRLALVLTTGVVVVGVCDCCDFCHNDSCTTRVSPVQPCRLASLLAWCCECADLRPLVVGSRAVRPAMVELGGWRGSRTSAQQGVCTQCWSAGPSLLHNTMQYTRRANQRIHRDPAYGVHSQSKRTILSHSLLPTRGIVICLCDRTEDEAERRYKRAGQQVAQGAEYHTIHVVRQFTVSTVTLYNATVTSRVGETDYGQLVSVSAASMRYAVGCSVVSNRTVVLCVYRLIGSVVSTVSAVDAWRCQSGDRLDGASPYMYTYLGRVVRRSSALAQYSVSTTLRLQWEHGVMYDRDRYRMAQYRTVYGSTRGCVNISQIDRLDMTIVYTSAVGDEDSESMKTSVKTVVGLQVFALCSVALYRRDTVLQNYSHFVTVRTYMSDVHLCHLLFVATSTYDDVDEGSFQSSDVVGGYCIDVWAQETHDHDAKYCTRVCRMPNNTLHYCDRDSLNNTHTSPYRSDQLYVAMLRLSPLTHCPPILDVTPNVSALLGFLGSIQIAISLAARRLTEWLRVECKYPRYHNYQNIHHTTRPTSSVDIIRRRVLTDICDARMQEYEQLCYVSIATVTSFLCERRNWATCFPAARPGQRTASVSDCGCARCGIVSGVLDSLS

SEQ ID NO: 946339 - protein, 234 aa, Homo sapiens
MHISATEQINTQYQTRRNSLHITMPPISKSTSPLVAGTCTVLCSLHSISTSVWLITYHYWSVLLSSNQTDVIVSSYTLHTAHVSQSHCRDYHLCRPYPPSNHHHHIILNGNIIILPHRDVLSTHVLAIISRLGRTASDTVTLHTPKIRSTRTSAHTNRTIAHAHISHTAHSHDLVSIPVAHSHTVHWPKDLRAQPIARCIIQHLQATYTSSNHTPPSQSSSTHPYHMPITLITG

SEQ ID NO: 946340 - protein, 113 aa, Homo sapiens
MSDQLPAGTSPRLGPVAVAALGKKHMTHKAAWRSAYEVYDHTPLQKPLKLVLKVVGSEVTELIRFGQDSRYYDDRSDHERERHDVLRRMKKRYPTTFMALGVFFFFMFMTGGY

SEQ ID NO: 946341 - protein, 239 aa, Homo sapiens
VGIRSELARERPGSQNRGKGFFLGRETPPAAPREADSKKTSRLARTKRDTKERLVGPSRERGLHRGGGAGPPPKKDSDRRAQHPPGRPQKEAGGARGATRSQAPPPRRKEGEGRTKNKPPRRAHPAGNRNPRRVSPPTARRKAPERGTAHRKRRHTRSFPGTPPPQSTRPDSPAPRGQNTPDAPRRRPGPSGGAAGGHPTRPAGGANNPAPPKPRRRAPREGGEQRHTAPPRPRPPARV

SEQ ID NO: 946342 - protein, 67 aa, Homo sapiens
MAPGGRRSYYSQVPKSIVQLLNWCKAHFQVDEWGTYLPNIVSCGNFQLANGLTGATSEPHSFFTCGS

SEQ ID NO: 946343 - protein, 118 aa, Homo sapiens
MPVAAVSEPVMLLFMPTTTDSSSSNRCCVSLALMLLPSYRRAQMALINLFIQPIGNLTTSVYFSPLRNDVTISVQPLIPKSYALVVLLMGAIAKSRYRCYKRSTFIVRPLIEAPLRTG

SEQ ID NO: 946344 - protein, 112 aa, Homo sapiens
MSSSVYVSEADNCSVASEGVRASVTPVTGAVWYTIRFAESSLYLGVCTGTDIRECVGGYKHVRACVTPDSELTRDAYALAACTQELVSRQVICGNDLRVISHYESSDGGEQN

SEQ ID NO: 946345 - protein, 118 aa, Homo sapiens
MRRMEMVRIETHINGMDLTIRVSHFTCQELHDVRAISAYMDEGSYTIDLHDVKDHSHQYSPRLWCPRGIVIKEESRGRYSIMSVANKSIFNRRLSRILARVPYHCTPLKTRGERDYCP

SEQ ID NO: 946346 - protein, 149 aa, Homo sapiens
LPMFQQQPPGRRAERTCQPRFREREQSGRETMLTRADPEPRWSEDEPPGDSASDAPTTQSDEEEPHARPKKAKSSDPSATKDKGQNEKRMLRAKRGPTAVEQSMPQRAKNSTTMTSLPVQSAEEQMLLHNITTITKKLVTQQKPATSNG

SEQ ID NO: 946347 - protein, 346 aa, Homo sapiens
RCCRNRHEKSLNDQPEIADVGSLMSAEETNRMVDTDSRHEERLYVRNAPYCFNAQKRTTTRPQAPHHGTRSNSPRTAVIHVKLQWSLQVDTYRHYRQPMEPQLQLGVNASTYVTLLQRDFRTKGMTCALRVVDIIQTCAPIHNNMSRPTGTDIIAYRLHTYELLDTHNCNTNTRQRHYVPPLVVVTASSYYRYAYGITLGAEQPQITLAIIIETLHISKWVGMTSCGIFAYLNQYTTLKDSSARHRHEVIANDEVPGQKSRDTRHALDTLISWNWAGRLRENLPTHNILIGAGSTTVRRLDITEQDFQLRSEGCLSVLLVHKSCPCGLNGDHQDYVTELKRTTTIN

SEQ ID NO: 946348 - protein, 115 aa, Homo sapiens
MDSQVVDNHPTDSFDDISLRGGYWVSDSQQVSCLGHRTVSLTIYRKSLSSLSVRYVCYSLKEITDTERETRDLGRWVDAGRIIYRKGLCLITVPARVLSIRIRTLVCGRRAICIT

SEQ ID NO: 946349 - protein, 92 aa, Homo sapiens
GLDLRYMCEITGHEPSSNAGWQSRSVTMLIFGPSILSSLLRTCTNGQAVHVRPSDFLHSFNVCLIRTNSFVDIPVVLGSLLVIPRSVALSDA

SEQ ID NO: 946350 - protein, 84 aa, Homo sapiens
MEIRTHKRRKYIAKENPRPVHTKQSRLTRSDNPARQGAKDNICAPQGRGLSSDYQKPLGTTEHGRDSQQDQQPDAQHKSSPHYH

SEQ ID NO: 946351 - protein, 246 aa, Homo sapiens
VSKTSSLPYVELTFYAAYDREHVYLVKKDRHIGYRGKGTRHLLDWAGSGPGLPLTDDYGNGTGKTPKPPCWQQPDAQDALTRAEEERTLSPVGPQGTPCRFYRPHRNARPKTAGPAQKRQGSYAPGSTTQNLEPMERGATPRGARRPPGKRTNPPTGPHAPGPNDEERTAHSPNARPLLGDLHLRAAADPAPDDVPLEHFGITRQPLFSKSPTVAQRHIVSPLSLPLVHPNGVARNPDPLHNNTTH

SEQ ID NO: 946352 - protein, 169 aa, Homo sapiens
GIEVYSSMTDIPSTIGVSFHQSSISRLPVTSMGSENTEHASPDHMTLRHSISADLLTPSADGFVSPGASFLYCSSLSAVTRAWVVTGCPHRQANCLIDRTSTVISAARGRSQHSIVLVRDALCKHSVMSPQWTLRTRRRSETQNRIMHTVRPPKRHQQSTASASYLTRT

SEQ ID NO: 946353 - protein, 126 aa, Homo sapiens
MRLGGMPDPMSHTNLRTRIELRLVILYPHTHSSSILHPQRSPYVLFRWNTCFRTNGAWSVPYTRRAIAPLGPNVTGLNSLIYSRYYMNGGSALRRIGVYISSYKTCSLTCADSLNQPQAYPDHSTL

SEQ ID NO: 946354 - protein, 270 aa, Homo sapiens
IGTSHHVWEGGGGVTPLSGQPPRGGDGRWGVQPPHRPADPSGTGRSAGSRPPPTQAAPPRTVHECPLPTSAPYLGHMRGPLSPSAATHLDNCTHNYSHLSTVALAVYKRRLSLGSIAHMCAPLLLSPPHFIHSALPFPLYPCPLIARFTLGPPLFQIYVSFYLRPPTSFLAPSFNPLSTFLYDRYPPHISPDSSRKYYMMIAVSTSPASLASIGQSPIDVAMRIRPLHLTFQHSTVTYVIFISLSSNASPDCTITHRGYGAHGTPRAIFR

SEQ ID NO: 946355 - protein, 292 aa, Homo sapiens
TYVSPQAAVYVLGGEGFNAENDTRAAGVFLERATSHHAPTTPVHKGGAQHNTRGSPALRNPHGQAPPQQRPTNKQEDKATNSDTPQHLERPPPPKNAPHGGHRAHSDHRASPGANNTATTPIARATHTRATQNPHTRQGPPTREPPQTTTRPPGPLQTHHRQPRTPHRGERPPDHPDHAQTTTTHNPHSNKPAPPHTANPTPPPTAQRRTDHNRHREPAEPQQTTHTEQPHPPLTAHNPPRADHPQSARHRTPQQPPRHAPRPTTRHPRQHTHRPHPRPTGPPQHLDPPHRA

SEQ ID NO: 946356 - protein, 76 aa, Homo sapiens
TVMVTHDVHIAMCSFSFSDSSITDVHATSLLLVITTVVMQLYGMDMTSDNVSKSHTRSSMVPEGLYRDSSFSYCAL

SEQ ID NO: 946357 - protein, 178 aa, Homo sapiens
MSKYRGLTNAGGGSTAPASTLRHPDRNALQRWGEDWIARQNETAGDSRSAERKLRWTARGKATHAQESLSCDAGTIPGDEGHKRGELTNLPLRVISRADLRTDARRRTKPGRLGSYLPSFLSGKQAHIVVETKSKRAAPFIHREKGAPHYDSLSHEVNGERLMLPMNRIPPRQGLVAL

SEQ ID NO: 946358 - protein, 47 aa, Homo sapiens
KASRIKPRDQGRNGGTKAEQAQGRRPRGWATLLVNTSRPPLSALYGP

SEQ ID NO: 946359 - protein, 70 aa, Homo sapiens
GGIACDYGWLSEVKQQIVDIHKQALFTHCDQSMRACETITQQTCTCGQRDQRKHLALAASKSTTSTIHAS

SEQ ID NO: 946360 - protein, 121 aa, Homo sapiens
MAASVSRAGHYPCRRMCSKRRKPFHDRSHKCSVHNQHQKTVVALVYLNIAAHQSMNCRKYMYLDPCSFPSYHVSKYLTHTKFQRYRVQTLRTHNAESSLRSSTVTRRSREPEDFQWRVFIH

SEQ ID NO: 946361 - protein, 93 aa, Homo sapiens
RRQRRRQRRRQRQRRKWRKAVRRVETVTARLVTLTARLVRWLRSPRPLQRMPKAKNDFIESLPNSVKCPVLALKKLQKYRTQDKEFSFWLMPL

SEQ ID NO: 946362 - protein, 68 aa, Homo sapiens
RMVDTFEGPRLFSGTIRFNLDLRGSAQIAHCGRPGNRQLKLVVALQEACITEGWENLAGQSVCWPAFV

SEQ ID NO: 946363 - protein, 68 aa, Homo sapiens
LMPGPHRSGPSLGPFTPTKGSFGGFGGNGVAHQGGGGKGGDFPPLGNKRRRLRSSGFFRENAGDDTPE

SEQ ID NO: 946364 - protein, 77 aa, Homo sapiens
KPVGKRRPVKVYPNGAEDESAEAFPLEFKRELTGSDSGREMAHGLLMTAQGPGRPAQAVVAAKMTRALQDGDFRGSR

SEQ ID NO: 946365 - protein, 84 aa, Homo sapiens
AYQEHIEEQNLERQVLQTQCRRLEARHYSLSLTAEQLSHSVAELRSQKQMVSERERLQAELDHLESALLACNALPRGYLKGYPR

SEQ ID NO: 946366 - protein, 40 aa, Homo sapiens
LLLVSLFCARAWPLAIVRRAAVQVTFTVDRPRLSTTSYLS

SEQ ID NO: 946367 - protein, 41 aa, Homo sapiens
SSQECLRNSWCRRSDRTLYSKDRRINLMEVDEPRWLSSEST

SEQ ID NO: 946368 - protein, 106 aa, Homo sapiens
SLEVWGSQEALEEAKEVRQENEKMKQKKFDKKVKEVVPAFLNEAQRAETGVDTVIRHKELTQVSKAYNREELKARLYFVWELDLGPLWASDLIPKNLPLLLMEALA

SEQ ID NO: 946369 - protein, 136 aa, Homo sapiens
MVPPHQCHPGCREGGLPVCITVNTTICAGYLPTMMRVLQAVLPPCLQCTYRDVRFESSRLPGCRVWTPLLSCGSQLPLVDPCRRKTSDCGGPKDTPWTEHPTLKAFLFLLKDPSPEALSKQSRTSLGGPLDNPPLS

SEQ ID NO: 946370 - protein, 74 aa, Homo sapiens
MSKNDDDSSFEMEPPTVVLDSLEGIKTELPEQHCFEITVLAVRSSTWETLKTYWEDNLLSLSRSTEELDLSEPS

SEQ ID NO: 946371 - protein, 32 aa, Homo sapiens
MAADCREDGELNVLDDILTEVNQMMNCIIQRV

SEQ ID NO: 946372 - protein, 114 aa, Homo sapiens
ELGCNIELKPFLDSTPKGRQTFEWKRYKLPVEKTISCWHSGFLLLKVRPRDLGGPGLQCLRGQTWGIEGPLGAGANSLCLRAADSWSGLACICIDFQIPFLQLRHYPLLMQGPA

SEQ ID NO: 946373 - protein, 124 aa, Homo sapiens
LLLLLVSNLLLCQSAPLPICPGGAARCQVTLRDLFDRAVDLSHYIHNLSEMFSEFDKYTHGGGHYQGHQQLPHFPLPPDKGASPTDESLFWSLISIMDPWNEASVSGHGSTWYGKKPPEAFLRL

SEQ ID NO: 946374 - protein, 70 aa, Homo sapiens
ILLDFQRRLIPICWTLFHKIMKEGTLSNSFYEASITLIPKSGKDTTKKENYTPISLMNIDAKILKRILVN

SEQ ID NO: 946375 - protein, 117 aa, Homo sapiens
QAELTSNVLKTGVVRCCVGQCNNAIPVDTVLTMKKLPSPIATGRKTRGATSALLCGAAHRAPGVPDSLPEQVRAMERTVENIVLPGMRPCSSSLLRTRTFFCAAWRGPVKASGGFWS

SEQ ID NO: 946376 - protein, 118 aa, Homo sapiens
TARRRCCAHSVASPQCWPQGSLSLTCPRTLCSPCSWSPTMSSWKAIKLCLKDQKSRYFCAASLHAGPWPPWGPDWAGPRHGLLHRVYAILIPAPLFEGVFPPLVHFYLMAVILSVLCA

SEQ ID NO: 946377 - protein, 39 aa, Homo sapiens
ICPAGCRCQVTLRDLFDRAVRLSTTSITLSVFKRIRGIP

SEQ ID NO: 946378 - protein, 114 aa, Homo sapiens
HNCTSKPAQLVCQGGARPVFPLRALLASDFIGGVHVGFEVGTAGRRVRAGGHFDRSLLCRPHSCKAWDSSTLTTNHTLRYLRCLANQASPTNSSIRIQKYDRNFLWCDFVGPFW

SEQ ID NO: 946379 - protein, 33 aa, Homo sapiens
MLEGPFSQPLHCGPLSGLAEGELAPSACGELEG

SEQ ID NO: 946380 - protein, 64 aa, Homo sapiens
LECFPRICGSALENCNTNEFYMSYLFIACAGAGATVIALLIYMMATTYNYAGLKFKSRECCTKF

SEQ ID NO: 946381 - protein, 51 aa, Homo sapiens
MLEGPFSQPLQLWKPLSGLAEGELAPSACGELWRERGRVPARFRVGAARRA

SEQ ID NO: 946382 - protein, 61 aa, Homo sapiens
AGVAQTGSGKTLTYLLPAIVHNHQAIPRERRWAYFGAGTNSGTGQQVQQVAAEYCACRLKS

SEQ ID NO: 946383 - protein, 56 aa, Homo sapiens
MERIRLASLFYAFPMLLESILLTTSFSFAAPLGHDFIIFFRILDLVVLSMSSVSVV

SEQ ID NO: 946384 - protein, 175 aa, Homo sapiens
MWAQAEKEAQGKKGPGERPRKEAASQGLLKQVLFPPSVVLLEAAAPGGGQPRSGQAQWPSRGLPSAASILQATRPECLLPAEPPGQHHPHPGPRQGHHTLLTCSASLLQAERPPPEGPALRQLSLAAGDTVPPALTVVQGRGPTLLSQARAVRFRGEAGCCHVSCVNIKGLSRHA

SEQ ID NO: 946385 - protein, 52 aa, Homo sapiens
MRKCTRSFPGSEVLSSMRRSAFLAARSGSGAYSCACWHFGRPGPPEESLYLW

SEQ ID NO: 946386 - protein, 40 aa, Homo sapiens
GRRMADIIRLREDGIHVCYKAEESSRTKMGPATFHYRTLH

SEQ ID NO: 946387 - protein, 106 aa, Homo sapiens
MGLGAGLGYLRLKAAVVLRRKRGLRVVICGQWVSDLHRDSSTFGKGGTGGVLGQARYFDSMGTFDDRPPVCAQVVFDDSLRIEGLGPRVSRMGCLPVEVVTLRLAV

SEQ ID NO: 946388 - protein, 73 aa, Homo sapiens
WYSVPGGMQDFNYLSSNCFEITVELSCEKFPPEKTLKTYWEDNTPSLATLSRYTEELKDLPTFKVTLRMPPSS

SEQ ID NO: 946389 - protein, 65 aa, Homo sapiens
RMKVRVQRRAFVESAALRAKKDLKKSRTRVPVIVEKSKAWIGDLDKKKYLVPSDLQVGRSTSLIR

SEQ ID NO: 946390 - protein, 96 aa, Homo sapiens
NNCVLSHRKYAEALDYHRQALVLIPQNASTYSAIGYIHSLMGNFENAVDYFTQPLVLGEMIHFLFNAWSLHNVIGDSEAYIAIKDKLKCYDFDVHQ

SEQ ID NO: 946391 - protein, 77 aa, Homo sapiens
QPCSQLLSWAGVYNFSGRQCKVLVDLQFWGLEDGGRLLTAPLGSVLWTFGCSNPTFPFRTALAEVLHEGSALQQTSA

SEQ ID NO: 946392 - protein, 79 aa, Homo sapiens
PFQPPLGITDSSKPSGIFGKKTLGLSTQCPPPPNHYHHAYNIGMFQRHPSFKQSNLSASIMRFHQKDRKPRAYLDACIF

SEQ ID NO: 946393 - protein, 99 aa, Homo sapiens
LWGSTGEIHVTFAFFLREAVPRELGTLSSGCSRQKGSWKGHSGAFGVAPSARGRGRKAATPSASFCSIAASSRSNNLRFSSLTWCELSALLHFNFKPSL

SEQ ID NO: 946394 - protein, 79 aa, Homo sapiens
LPENRADLYDWFIPGVVIIMADNDTDRNQTEKLLKRVELEQEVQRLKKEQAKNKEDSNIRENSSGALSVHISVLMAEDT

SEQ ID NO: 946395 - protein, 74 aa, Homo sapiens
GKALWDSVMALRLPLRLKFGYRELARSQRQRIWFAGADSYKDAVRAMFARFTMEGERERERDDKEHKWSISRIR

SEQ ID NO: 946396 - protein, 60 aa, Homo sapiens
GSGARWRCSARLCRTAEAKGDAGLWAASLSLRVTPSVKRPVPGDEVQLGPMTRAYLYYKR

SEQ ID NO: 946397 - protein, 38 aa, Homo sapiens
NADGEAGRWQRTGQIFKQTYSKFDTHNDDALLLRAALC

SEQ ID NO: 946398 - protein, 91 aa, Homo sapiens
YIQLRKGPNVVGPYGLLQPFADAIKLFQRAPKTRHISITLYIPPDLSSIVFYYEPPFYPIPGQLGLYYSSTGYAGTSILDRVASLRLIGHC

SEQ ID NO: 946399 - protein, 67 aa, Homo sapiens
TLRWEPSSQPTIPIVGIIAGLVLFGAFAGAVAAVRRRKSSDEGGSYSQAASSDSAQGSDMSLTACKV

SEQ ID NO: 946400 - protein, 86 aa, Homo sapiens
VLMLLGVVAVVIASFLIICAAPFASHFLYKAGGGSYIAAGILFSVKLASGSRQWLTWKATETCGLAGFHPFWLGWHFWPTGIFFLC

SEQ ID NO: 946401 - protein, 83 aa, Homo sapiens
VLKIIPCMWDFQKLSMSVQKGPPVYCGSCRIRHEKPLERESISTTPKCFLEKAKDKQKKVTGHNKKKVALEDQLKTDFICPEM

SEQ ID NO: 946402 - protein, 66 aa, Homo sapiens
LGPAYQTLAGRGVGPKQLGPKLDPPEGGFPKGSRSCRGPPSRGPVRREGRKKPGASGHPYWPFLPG

SEQ ID NO: 946403 - protein, 115 aa, Homo sapiens
RCQTLEDEEEMWFNTDEDDMEDGEAVVSPSDKTKNDDEDDDEDEKGRYRYHCQRKQNLIHNNGNGLSVPVEKNWSSPLPILHTKGFVNADTDQAFTLLLLVPINGQEKGYHILGA

SEQ ID NO: 946404 - protein, 71 aa, Homo sapiens
NQDSGLLELQKFTHLGTLRALQQEYDRMSDLCAAESKLLKNSKQQKMGYVTHLLFGSHYSFFRLNGLPLYL

SEQ ID NO: 946405 - protein, 67 aa, Homo sapiens
KGSLLLLLVSNLLLCQSVAPCHLSRRGCRCQVTLRELLTRACPLHHNLSQKCQRIHNGYPWGVITKA

SEQ ID NO: 946406 - protein, 77 aa, Homo sapiens
AGQYPPVRRCLVLTDFGIAVFEIPQESRGSSQILSSCALLLPGDLTELASSSRIVLVLKDGEHVFISRRRQLDVTRL

SEQ ID NO: 946407 - protein, 59 aa, Homo sapiens
QSQPGARSPRPEPAAAFEGAQAPVKVTNFRLAGGKKDEPKSGRGLYPPDARGELKARYV

SEQ ID NO: 946408 - protein, 89 aa, Homo sapiens
MDAAGGHYPKQINTGTENQILHILTYKRELNTGYIVDIKLATIDSGDYYREEAEGGKGRLTGYYAQYQDDRSFVLQTSASCNTPMSQVS

SEQ ID NO: 946409 - protein, 99 aa, Homo sapiens
MEALPLLAATTPDHGRTEGCFCCRYCSCAGWSCAGLGDRGARTREECHFYAGGQSVPGRGIRVSVADHFLHLTKRFPSQRLLRNSCDRWNEELKLLISW

SEQ ID NO: 946410 - protein, 76 aa, Homo sapiens
GFKWSLKPGVGGRVGVSLPLKVTYLETKPTVLAVTLIIGLSQRRQPLLPRRRHSLLSTRGSSDAAEAALKVFALPS

SEQ ID NO: 946411 - protein, 105 aa, Homo sapiens
MPPCELGARILSKACTLAGQVSNRHSSPQIEFTGLYSPKIKGPGSLGPSRDRGRGTRGPEHSPGATMAKDAVHLQGTQGEIYRPAGRTRVTPPRGANKEPLASAH

SEQ ID NO: 946412 - protein, 134 aa, Homo sapiens
DYARRERMRSRQAPRGAQGSDTSLDGTGKPEQQKTGTRERTDASLHRLSGTIAGLAQYDGWRAVMTLAQILLRVLADVIVITSTVTRMIYPQVRQSFQNKQLRRYTHCCRDQRLILNLPRDMNITGTPQNTAST

SEQ ID NO: 946413 - protein, 36 aa, Homo sapiens
MGVVCGDVGVLWMGVVCVGGRVGVAGVGGVRVVGGC

SEQ ID NO: 946414 - protein, 42 aa, Homo sapiens
MKDRIFNRALRKPNTLPTRDAGPKRTQTGTATGEGPRPRLGR

SEQ ID NO: 946415 - protein, 244 aa, Homo sapiens
LGRGGLCVTGGGPHPPKDPFVEGGPAGFPLLLGRFGFAKAGQKEVEDDLPGGIRAPITRRGPQHWGGGDIPLKQEAGNTTAFQRGSYEAWRGHDHCNWMHYKEEQAPKGVGEYEAFPCKPNLGKQGPRRETQKKTFPHLLRKSPDHGGWGLAPKITTNFVKRGMAHGEGKKTKKFPPLPKGKTPGSPPLGGSWGTNLTALLLGKHRKGANHSAWGIFRRTPSWGPRGDNTKAPGTQRGHWRFNM

SEQ ID NO: 946416 - protein, 78 aa, Homo sapiens
GLRNLAPGGIGAVAFYTEDAAPPQADVSVSAALSQSVPPFCSPPFWGSAHFKLLPWTFQGTVISSPQIISSSSVWGIF

SEQ ID NO: 946417 - protein, 33 aa, Homo sapiens
MGIEHAEKLEFLNKAKMLTKLREEVNLNGRKKN

SEQ ID NO: 946418 - protein, 189 aa, Homo sapiens
HTGIQLPALGGLSSLIRGLPWMTDFETWREGLNDAEKLEVPRISNCETVLRLQATCPARWREDGGVMSRKRCRMSMTVLPPRGALCRARETFLTVFRASYWVDPGSQVCKYHSAHKGHHPCHRTMVFICFILDQSLHQLIKVSWVVCSRKALPWFKALLGSIGISHRDTHRPILAPDGSALNFAESARC

SEQ ID NO: 946419 - protein, 152 aa, Homo sapiens
MSIPRAAGIRHEGACFVAVMDACVRFSALSQARERVCRAAQYACSLFGHALQRHGASPELQKQIRQLESHLSLGRKILRLGNSADAPESDEMFTYQTDVLRFCITVRHPNRGLYFACDNGPWAGRLDWLPGGSREVGPASFRNHKVSLIMNI

SEQ ID NO: 946420 - protein, 220 aa, Homo sapiens
GIRHELLSDLEAKGEKGSELVLYKPGTCVKGLTIEPPPADPRLREDMALMAEGALTPELRGDLWELPFPCPDGFNSCPDICFREAGCSFLCHKAFFCGRRDYFRALLDDHFPESEEPATLRGPPARNLHGISPGRFTHALYYMYRDHTWVVPEGGHDVLERSAKYPLPGLRGCAGATWLNAEDPVAEPGTRLRLPLARPEDPPCSRAPALAAVRPPLPWP

SEQ ID NO: 946421 - protein, 69 aa, Homo sapiens
PWSVQATVASLDSRALGDVGSDGYEKHSRGSCEAQRSIPILDFVADVVLMCVVDSLVLCATGLVVCAVV

SEQ ID NO: 946422 - protein, 104 aa, Homo sapiens
MNIKGSPWKGALLLLMVSNLLLCQSVVPLPICPGGAVRCQETLRDLFDRAVVLYHNIHNLSSEMFSEFDERDTHGRGLITKAINSCHTFSLVTLEDTEQAQQMK

SEQ ID NO: 946423 - protein, 177 aa, Homo sapiens
GQLLNGQEDRTHQKNFDGEIHKGGEPDIQQGIAELVPGVPVGDEVQMLDIECVQLNWNGPWTSSIDPIVIFGVQNRGNWCITGTEDIKFPHGIPLDLLDRVKIIQDHAVYSTGNETDPLKSCARRQGINIHDEGVKPLGEIGTKNTLKYSVRLLTRATCLLNINGTGQIEKEMLNRP

SEQ ID NO: 946424 - protein, 229 aa, Homo sapiens
MRIMLRDRYGPSVRRLTMFELGLGGHLVLVGPGIRRNRRNSTYVMTIVPIVHDLDVSVASSPLGRDDYETQGLSTTAGLRRAQWERISRKRHDGERGCHVMRTAGEVSVGWYITVNGYTFRGPCLRQARCRCASSPPRKKLSAKFPQSLDDKMASCLIVQRPIQADRINSTRVHDQGAPQRQHSDLTQRTKRPRQHFSETRPGTWWTVRDTGHQGTAVHLQPLNKTSPI

SEQ ID NO: 946425 - protein, 221 aa, Homo sapiens
MTHSLDKGDTTSHHYHDVSDNAGGVQLTRTEYKNVVTSKPLFSTVAEGCILGVYIVFSAIVHVCLLVSPYNASQIRLFLSDSSTSRCTCAELAEVSERAANGPTSPLSASTRTRNATEWTCTQGRRSQRCLTDDEIARIRLLDRPDRVSCRGRGVANKVFAHPTYSKPGFCYRLHTGFPDHQSAGMYPLRGSCPYVSNRGTWTMAAVTGTRRQDVVQLESS

SEQ ID NO: 946426 - protein, 178 aa, Homo sapiens
MTPKQGPSQNLLDELLAYPCDFTSDSHNAPAYSGLLKHTHSTIIPSAWRRCRRENSSIPRTSTTQLVQHKVCTYSGHNSVLLLASSTVVISCQHETLVIEARSSPYVPRHIDHSYTATNLNGCGDVGCHREQWRYIRAAETIASIVTFANFAEDDDSSCIFDSACDDTECIARTAATR

SEQ ID NO: 946427 - protein, 114 aa, Homo sapiens
MCRSPSRWYVTLYSPDGVPYNQYECLCTFRASNAPEESTKKCDRARTRDVMSPWLIEGRLPNRVCISTTRKSILKNLVVYVVSSRFTTCNTCQCREPTSALLASYAHVSAETSW

SEQ ID NO: 946428 - protein, 96 aa, Homo sapiens
GLVSLTVTRRGISGHNAAPVPCTPRKGKPTRIKDFELMQDMDLDEPLILARRRGAEARRLSIKVEMRATNGLGAGLIAAGHLNQGISLLADFILRG

SEQ ID NO: 946429 - protein, 114 aa, Homo sapiens
MGRLRCRTLASVCMLRITDADVRTHRMGSIECVLPFSTAGIFVDHKAVYAFLLPQISRYAVPCGTEDIERLQFDIFESTRGPTLIFFPLRLLSGSHEPSSYLGVRVYSDLRLGV

SEQ ID NO: 946430 - protein, 72 aa, Homo sapiens
FGRGPLLFVRVYRLGPFAHLTYSFLASHLTELLWPQSFHCSDSMHKGTHQTVRCNTTMLKSSRIDLRLCVDH

SEQ ID NO: 946431 - protein, 118 aa, Homo sapiens
MTLLIIRLIYTLAVSNPTASDHAEWEFEHSHNYKSVYIALHTGKDTIRNTDHSIVKMLTNSKYVGTTYDALSPEQYTAIFDTKTLLITILIYEVEQKTPLYESTDLYSSYGKTVVQSP

SEQ ID NO: 946432 - protein, 237 aa, Homo sapiens
SLCWAVRIPWWIMAWQVLVQGTPKTVGYGGPLCAVGPQLTPKQLVGGTHRGQWGRWGKVIHVTRSVTCDKGSMWSHSAIMWDACLQTETSYKWEPTHHHKDEGIIAHLDLHLTGRVTHITQAGTHIFTVTTWTHFTHPMSRAVFSHYSNIHTRTVTVTIYPWCYSQRQYPGPIPRHSIGVVSIPSSQGGCFIGVESLVPRCGQSAILVNNRSIKSQYILDSPLIYWVLVTQVLQLRL

SEQ ID NO: 946433 - protein, 75 aa, Homo sapiens
TDDDDDDDDDDENDDDDDDDDDDDDDDDDDDDDDDDDDRQKRRQMTKTTKSPTDVARDYRMRPKLEAASNTLPVV

SEQ ID NO: 946434 - protein, 175 aa, Homo sapiens
KCVSCNDHEHEHQRIAMGKQAPSCLLLVVYNLSPDARCVAHLCPSAPGRGLPECQCDPFDDLLLTVARRSKYPSSIPVYLLASVTVFPRDNSESNRILPQLGREGFELHIVDSKRVVEQQHFVTAFVSRSRIGTHEKSDVREKELELQRERILFPCKALRYGSKSLATSTCCWSV

SEQ ID NO: 946435 - protein, 436 aa, Homo sapiens
FLHEVGEYEFLQTSQHEHQADHLRGIYSIGCVYGKGTSDGLICIHDDLGLSMLISVQPIMRGYYRVKGFLDVPIGNYWWPLVTHDVWYPLDCQSWEGSLDRATRCDRTEASLFHPKHYPTYVPQTAIHILGVVSLRIHIGDNIVDIIIMKLLENSRCTNDDTNSGIYYAAPEHSLLVSVGMYPWYRNLKRGSHWGGGKFPRCKTMLRELPPYPNFHRMYMKVLGVLDTPLLIDHVTGRMLPRILTRGHEVYTHSSLNACITDDKQIKCLCPKRRDDAFVVASWPGLMGGELPGEVSNLRVDRAAGVVLCITLSAEARDKVPAQSLYFRYHKTHNVMCVPVPNDMLVDCAGRNPDEYALCPCELTSGPRGCLYAAKSYHAGALSRRTVDHNLRTPPTNTYLRSTDRHTYSRQHHFAARHQHRIVGCYTPINRLRTQC

SEQ ID NO: 946436 - protein, 122 aa, Homo sapiens
MKRTTPKEHAIVGKKENNGQRPEVARKGETHPYGGKERGGLFARPNKRNKSRLGERELPQRQNKRDTDPGGGGTKNPVKKRKNLDSPQGPPTLVPGKRKRDRKDTLHLTLGPAPMGKQHGNG

SEQ ID NO: 946437 - protein, 120 aa, Homo sapiens
PPCWNYAREENFVCPLDLMNIVLYARNAEYNPKRLAAGIMRIREPRTTALIFRSGKKVCTGAKSEEQSRLAARKYARGVQKLGFSAKVLDFKIQNMVGSCDVKVPIRLEGLVLTHQQFSR

SEQ ID NO: 946438 - protein, 173 aa, Homo sapiens
AEFNFFSIARVPELRGDCGSQRSGILWMGTARRGNYITYDRLLQVTRVERSKCWNDMDHGQKANHGGAGPHKFLQILHKRLAADSIYMTSKGVYKEEPHRMLAHGGSPKKASAHMSHAEDRDQQLFMTPTPCGLAHNADGLSGYRLVNNGGKVTAHSWNYPANHGRGDLGIVG

SEQ ID NO: 946439 - protein, 51 aa, Homo sapiens
MTARNGEYCLSATQAPAACLCVCVVVCAVRGGVFVLLLLVAVVCVCVVVSV

SEQ ID NO: 946440 - protein, 120 aa, Homo sapiens
SLLLTPGAGAALAAPGLAECSAPEGQCLRSVRGPAPRVGGEAAAQVAARYTAGAVVSRPASGHRGRHFVRAEAPREGGNPSGRAAGFAGAAMPSSPLWVAVVCFSNHNRSMEAHNILSKR

SEQ ID NO: 946441 - protein, 148 aa, Homo sapiens
MSSREARGLLDFHIDGLTIECNLPILILYTLISIPDRYSFHLLVPPWRRGSDKPRVIRIWRAKKALIHLLVGEFMYPIPAMTRTNGDMTAGSEIVERPAEDYVIQVSTVTVVIIKNRHRWSFISLVTTYTLLGIFSHPPVCACIRGRT

SEQ ID NO: 946442 - protein, 56 aa, Homo sapiens
MASRMALSLFHFIRKFSGYTSCIIKPHTKGLAKTLQDSQAMITHIGGASVVSWSLR

SEQ ID NO: 946443 - protein, 130 aa, Homo sapiens
LISGISLQQSTKNTNTNFKQEKSFIFPPASAINWHHHHPADNCIDRIFPASFIICGNQAMAHMHTFIPPPHWCSVQQHTIIQEGCFFQQPTQAHTKHHNTPTTSFNTSRPSSHIILILPSIPSVFRQRHC

SEQ ID NO: 946444 - protein, 286 aa, Homo sapiens
MVAVYLSTRSTSNGRLGGKVCAHAVSEYGAEALDEDVPVSFPTIKIYFPHFDLSHGSDQVKGQGKKVDDAAEPNAVCARGRRCSNIAVRTLSDLARAHSYRCGTTVIHQGSVKPLSMLDDHWVGPASSARSSNPHVGGMALPWHECSLELLLRHTMAGLVTEIPCFEARKLSGGPCNRSHLERGYPRRLHRGDAGWREWGTPPTRAGIITMRDAYGQSSENENSTQRKTPSNSQNINGCVSYIVTGRDIGPGVEHVSVAFVPVRAIFTDTCVVLFYTRLDSLYTLR

SEQ ID NO: 946445 - protein, 200 aa, Homo sapiens
HPRSHELIVNEYLMRLSKRNCAYAEEETLSREARERSRRERADIRDRHLLDAPKVSAAGGPPGEAQPAWKMPRSSCSRSGALMLALLLQAYMEVRGWCLQSSQSQDLTTESNLLECIRACKPELSGETPMFPGKWRRAASDREHPGSTLWANFQLRPNRPPEQQQEQEQRAQGTPEDVLRGEDWGPLPEEGPEPPQGLRP

SEQ ID NO: 946446 - protein, 173 aa, Homo sapiens
AGFGTSLTFKREGVAENVGDFLIKAAHAPLATRVMPKLSHCAVGTNTLRDCGCPDSKKTYRLCMWIVLTHTLPLKTACRMPTTVGHCGMPHPQVYTLHLLRRELTGNNFAGRAQAKTPETHGKQKNKNSGAARYPTLLNAVVLHFTRPLFTPLNWPFNTHLTASSPFPPAASP

SEQ ID NO: 946447 - protein, 176 aa, Homo sapiens
AAGTRHELGSGGGWRNARTKGRSKKSRPHLERQGGETGEAAEAEGTQAPTDEQQENVTSPMDAHKRGRHHAKQTTRAHNQYGTNTPDGARACRAATHPTDPKTHGTETNAGPLHISPGKNRRGRPAKRKPRKTERRTTRNRTHGQRRQNTTAEELDARPRPHANPGGREDPAGRAT

SEQ ID NO: 946448 - protein, 185 aa, Homo sapiens
DVGLTKLPFFGSSPGLQGLNPQAFGSKLGLPGKAIPGGTWAFWGLSTTPLAQEPLPLQLAVFSKFPGSPTSPCWCLHLLPSILQCLLLWAWPQGYGQTSVPYQRPLVIVPWHVGPGPGWFAEELRMEAAEEGPDGAHHGPKSSSCGPLYFLGWAEAITWMPTWEGTSNVGPQPLFSSSFTDTGTP

SEQ ID NO: 946449 - protein, 103 aa, Homo sapiens
CAICGSQRTLFLDHTPTIVGSMEGVVGASDEQLIIGWYILPVLVWVFRYSLQRLEYTEWRPDEECEGSHTESPQLRTQLPALCGRIIGAPVHVGQTGAQAAQE

SEQ ID NO: 946450 - protein, 48 aa, Homo sapiens
TTARLQAPGRPCSWLLACLCLALFEGQCLPNHSPYPLFDRYGSAPIVC

SEQ ID NO: 946451 - protein, 120 aa, Homo sapiens
MCGINVIPWVFDFSERIKQVRTSHWELDLVAPKSERTSTVFWGGLVVAEGDITGNKEEVGQGNSWVLEGALAGSQRQQLTGGGTLYACSFGVTGLKLRNRYQGGDSQILQNGGSQSWATE

SEQ ID NO: 946452 - protein, 104 aa, Homo sapiens
AVLLVVRRTCRDGACSSSRHCRRALCLVPVSMTGGIVVWVSAAALWGLRVTSCRDTPSPASVAICVVPACCGRRWARGGVVVCGWERLAKGFYIVPLLVPGIAL

SEQ ID NO: 946453 - protein, 103 aa, Homo sapiens
KSLLPHGFSQDILQMTALKIGSLGAICQSFGSTLVPVISGSEDYLKITELCTIIEVSQNQATVLPYYWTIQYNGHCHAPSRRCVYNLSLTTFTYHILRLVQHI

SEQ ID NO: 946454 - protein, 121 aa, Homo sapiens
FPATTHTLTSKDRHGKGPSCCCWCQTVRPDVPCHRPGGADAGLQTLTPASSIIHTLLKSQDRYVTRRGHYKPQQCNFSCTRRQTATDNRFDQYRYGLNGSYIVLESVAEAGVSSSVREQGL

SEQ ID NO: 946455 - protein, 75 aa, Homo sapiens
HPNPLEASTGAVILIIAHGTYILITILANKLKLRTHSQSHHNPLSRDFKLYLPTNSFLMTSKQASANLRLNPPTN

SEQ ID NO: 946456 - protein, 162 aa, Homo sapiens
MNTDLVLCTENSASVRVLHPQFLGLVGGSCFKLVCNYTATISRYAIKTESDSKQVTRCVTATHHDWRLLWTLSGVLCILVYGLAVLRGVGLDSELPSCVTYKGYFTYTKTEMFVPPSRLMLRRVPTIAENYNIWVYFSNGSVDFRYRHTVSDTFYPSQGPGD

SEQ ID NO: 946457 - protein, 170 aa, Homo sapiens
QAPDVLLRLLAVCCLASRGSASNIPYQAFETYVRAIAGQLALRLQELKKLQPKDRRLILVNPRLPLFSELFDTSNRRDTQKSTKLSASPAGISRGGGRAVSECICTAGFGPLQKVITPKDYDEASYAMVEVWMESRTVRSLSSYRSRYNSPTMSLLRTTGGHWFRRRCQV

SEQ ID NO: 946458 - protein, 208 aa, Homo sapiens
MRNVVALDKTLNQLYGSSTERHMYPSLNLSQRKDTYITVIGEIAVREGECPPGINIHTLNTSQYTKGRPILVGLSKVPIVHRLGKHNQGVLSKQWKTEFPVVPAYTLSRKGCHTLGGRKKIPWPFVSATNYDGLREAEYPCVRAHTHDHRLCDQSTAITPRLNSATETVANARGRENITLARQHHRVAQSADNGAWCANTYLSHPGGD

SEQ ID NO: 946459 - protein, 126 aa, Homo sapiens
MASKLVSSQFPIRFGIVGGGVITALGPSVVIVREILCCTWEATEDVVATHTENTVDDQYGATIKRGNHLLHSTSISRCYTLSLDPFWAVPSVVISQDSCDSWIRKSGCFRYFDVRANPGKRVPVAL

SEQ ID NO: 946460 - protein, 121 aa, Homo sapiens
MQTALGNIVCNRVSNCLHRVVATSVWSRLESNREYLSRSTTPGNAPGTQFVRIYSTGNGHIRFRDQELSVPTVVSEDIPWVNPFQPPTVPISASRYPYEELSKPSVLRTLHDFGPSHSVSG

SEQ ID NO: 946461 - protein, 31 aa, Homo sapiens
MRCANHVILMGVIHTDDERAEQSRPRMYASA

SEQ ID NO: 946462 - protein, 254 aa, Homo sapiens
LNSLSLAGEFGSLVTLELIRGLGTGGSRLVTPSTLARVREGRLVLELQAEHQTLGPPLDQKPPSPIQTLPQIGPSLGGYPAGPQTTVGSTWKAGSNLLVGPGQGGRVEQCNPEHLRPNGTSQSPWAWTSRLKTPGLLKNNNNKQQTTLEGGGRPGYPQILGPNEMEVRQFTKFHMWPGTVFNPTGLVDMGGTKPLWRVKHQTFNSGPCAEHIPPILANHGRVNISEKKAPRYTQIWALFHNKDVRQALKMWANG

SEQ ID NO: 946463 - protein, 192 aa, Homo sapiens
QLDSGCPPSRGVVVVLFKYRSEWDHTADMSPPVGGLLFVRENEQGTARTILLIVANSMGGLNMRHTDVCLPPRGGQIFFVARIRIRDGGEMSRYSIKCQNITRYKRMGRRRGSRAARLDGGRGRGVVREVGERAAEAEGEGGAVSVARGWTAAPTGAAGEAGDERPEGGAVVGERVRRSAVCGGGGGGRAPE

SEQ ID NO: 946464 - protein, 226 aa, Homo sapiens
MTARAHIKRLFLFAVPGTNYSPYGPGRDSIQDLWYGTASVEGLDQYLTVSYKCLWIYMGPTESTVKTAAEKAKYSFTDAVAVDKLRAARDRRITIDISLWKSDISQYYLTIIDAPGHRDFIKNTTTGTSQADCADLIAAAGSGAIEVGIKNGQTREHALLAYTLVKQLIVGVNKMDFTEPPYSQKRYEEIVKDVSTYIVGYNPDTGAFVPNSGLNGDNMLEPSALA

SEQ ID NO: 946465 - protein, 109 aa, Homo sapiens
RLLQEKRSNLRGRGCSELRLSHCTSAWVTERDPVVRKKKMSMVMGEAGKEFSSNMNVCAIQNMYLSQPCPLAPSLETIISRVVWTIFCHPLRKNMLGIFICKMELLLSS

SEQ ID NO: 946466 - protein, 117 aa, Homo sapiens
MVTRTTVGWASQETVPPPGSDWRKLVVFSPVDSLSWTHWLLQLTGIPWVKPGFGPGIRLAQVPPTSSLHSSEPLTAPASAWRHRGRHLTDVFRGSHIGWVGAWARPTVRDTPPCPFP

SEQ ID NO: 946467 - protein, 74 aa, Homo sapiens
RQQLMQAHIDRPYRLIIDPVVSPTYEAADDMEAYERIPLANTDLALILSLLMRDDRDTLADDNMNDTCVSNQLK

SEQ ID NO: 946468 - protein, 110 aa, Homo sapiens
WRNRHEGIFNFFGHFDQQALDECLVFLPNRVVYWVPVYSQGTRVNTTWVTLVRSGSSSFNSSFPGCAKAWTLNLGTQTQASPGRPFIPGGSRVNSFVSTDPPTGKLCLAR

SEQ ID NO: 946469 - protein, 182 aa, Homo sapiens
MPMLMYSGSILVFSSSPYYLVCDLTRYALKLIRMTVTKGSHGSESGQCTPRKSASRVREEWRSSLGESNALLRKKLDVSGARSSRCIHSAPHCVTVSVIPVRRSHEIVPLGRLDLSVIECKVLFMSRARSQSLLYALLIGGAKEQGSLRNVRGITFDLRAPYNTKIIVYLATWAQYYSTRGM

SEQ ID NO: 946470 - protein, 192 aa, Homo sapiens
CLLPLIIALTGKHSDCWTHSVRYFRLCVLDPMHGVPEVISVGYVDSHPITTYDSVTRQKEPRAPWMAENLAPDHWERYTQLLRGWQHMFKVELKRLQRHYNHLGSHTYQRMIGCELLEDGSTTGFLQYAYDGQDFLILIKTPSSGWMSNVAHTIQAWEGNPHEVLDEKDMLAEQCIAWTKRILEYRDPTIDM

SEQ ID NO: 946471 - protein, 133 aa, Homo sapiens
MTRARSDNKNDDEIRIQRCQCKLIDYSPPVDSTIVCVSNVHGIDLVSPALLTLPADHFPDLLSCFNYNYTTCILGPSYMFSLLPSVRAYRLRDIKLCNVILMTKSSSDAYPPYALVLSVELCNHIEARWDEYL

SEQ ID NO: 946472 - protein, 105 aa, Homo sapiens
RRGRRRRLRSQRASQYKRPHPFPPSSPVAGTRKPHFLAHTLEHKQQPWRAGGKPKADFGNPTRNTPVLSSKGLAGPGAIQLEAPRKGRRRVWGMNVAGLNLVTFK

SEQ ID NO: 946473 - protein, 227 aa, Homo sapiens
KLFDHAMVRRPIGLEQAGLCTTNKSLKEAYIPKGTEVFIPGRNPKNSLWFLRSLIPSNTSNRGGEHNTENLKLRSCVRNLPCDVSIQGRWAGGAVASSLTGGGHSAKQAWVVTGGPLYHGKRSNETFLERNLRETRALHKRLNEGRAGKNGQGPGNWGRISQRQNLTGKVRTPKLTSQRMNATNSKKLTGLALTGFTGSLEPVRRTPGAFAGSWPVLVEGQAVGLLS

SEQ ID NO: 946474 - protein, 102 aa, Homo sapiens
LNLFPCMFGSSQAGNRRVPLRTSSGAGFQGLGGGAKGKRSWARRGGGLGDRGLVARRGAVVLVPHSKRVPVLRTERNEGGPDNSPLDDIDENAGQGGHAWCE

SEQ ID NO: 946475 - protein, 160 aa, Homo sapiens
RKQANWRTPWTLTIEVDSRIEAPIRIIITSQDVLDSGTGPTLGLKNRCNSRDGLNQNTFNGYTNGGYTTGQWLLKSGGANHRFHGPSVLEINSPKKSLEIGAGIYPYRHQKGISKGNLERNWYKSKGGLVDTGSNSCALEDRKQKTPTGWQKKTDRETNK

SEQ ID NO: 946476 - protein, 38 aa, Homo sapiens
MLMARTVICLCGPFWHLAALASVIKVTLVLVFHSSWPS

SEQ ID NO: 946477 - protein, 229 aa, Homo sapiens
MGKVKVGVNGFGRIGRLVNRGWFELWVKWDIGWHQWNPFIGTFNYMGLHGSKYVFPNHGPKFHGPPVQGLEKRGKAGHSNGEIPIQSFQGRRRIPSQKSKVGANAWAPVGTVGGRSNWAVFQPTNGKKGLGGSLWQGGEATKGVNQSLAPLWLERPHWFGHGLVKPMENGMNKQAFKEFIKEMASLEPNLAVSKPMGQGGHSMEQRLGNRGGRGSMEHKVQRAINGAQG

SEQ ID NO: 946478 - protein, 220 aa, Homo sapiens
RGSEQAIITLRGGAGNWPASGPFLGHRGLKVVGGWSTIIFNLTKKAAGKARRDGPWNECNERPRLCNPLERRQGGAGNHEETKGQRNGLGHEGKLPSLEQVGPEGNGVSLCSRAVLASRTGPGGLNSPRWAWAQEFHGSSTHPYKEKPNPRYGIPKSNINVPFHLLLTRLGVIRLNSRDIPGSLKDIFYRSWKVVSTKKAREAVCACAGPVWCAFKASGV

SEQ ID NO: 946479 - protein, 158 aa, Homo sapiens
RSLGFRGPGTLVEPLSYQVAKGRVQGRVAPGWRKVARSYGVGPGMNRFGLRSDFPIRCFGPGGEITTVKNTPIWREHWGPSPFPLGGVGRPSQPNPWAINKVELIGNPPVRRQGGPVSVAPSAQVALRFPQPPGSPKRPTLGGVPGGEGPRVGVPRGP

SEQ ID NO: 946480 - protein, 172 aa, Homo sapiens
KTHVTHHPILTMSATLSVLVPWCFYPAGDHTVPWQLGMAMDNSVTLDACDDQTEHGRLEALSRRWACLCVCALPVRQSMRLPCTCTSMMGAAESPVTAADGEPLPMSHQSPICVDIVCVALCLSLDMFVGPSGRLLVRRTGDCCSDGKQLPGVNNGRDCYSSVLAVQATSAQ

SEQ ID NO: 946481 - protein, 265 aa, Homo sapiens
VAVELRSVARATDPGSGRKRLAARRPSSFERHGLQPGGPGSGRVTGCSSGLHFVFLVNRGALVLGRGDEPCTDMFACVDCNNAPYHLSLIDPLITNLYPQCLGSPIPTMLTIVVLDVHTEYVDFYTPGHTLSRTNVLGDLGLLTCQVCDIGNAPAALALFAITKTFGNKHWCVESWCKCVLQVPSEPSIVTQGRGSMVGLWEVYTLTHLLHDTLWAWPGCDRRSWDKASHGRFGRLFPPDCITIGVALAQGFPGYTEVELESPVV

SEQ ID NO: 946482 - protein, 204 aa, Homo sapiens
MRVPKQGEGLAPSGKRQGVREIPFPNLKKGGDRRVPGKIGVTPHRNIAPFLTGLNKTGTPRRIIFPEPGLRRGPTAPRESPPELVNTSSPEKSNWQGKAAEGCGGKGRPGHLAQGFPERINKSEAKKTWDLVVKTQQQGHKGGLAVAPGRGHPLGGGRGPKRKRTVNPCVNYKGPGQTDLKTARVFQYDTGDFVTGEGPPVGPA

SEQ ID NO: 946483 - protein, 191 aa, Homo sapiens
FPSFFIYLTCDIASRALTMVYLVFFEHGPSYKCSVNRPKEGFQLVAPINIVLGKLTFPLLEGYNTTKGTHIRSHKHNHNIHINTTMAWPFGKARTHTHTLHMAHIISTHNTIYSHLLVVCTHSQISMDRHTGHTKTLFTLDYFQRKLLFFLKVKPSSFLEVSILVFGVVELKWLELIFAGGFLIWGVLVPK

SEQ ID NO: 946484 - protein, 111 aa, Homo sapiens
MLIIVLSARRNCVRRSHVYYNTNLKSIRPSHSSPHYRHKSMCVTLAPRHIIELSLQLSKSILSVSTFRLIFPLDKQRDHRDNWTNSVDLERGGLYRQFQTFGRLSISTYGS

SEQ ID NO: 946485 - protein, 111 aa, Homo sapiens
QEGLEGWQTRISQKELEQQQQQVVQLEGVENGTGRNLLGQLINILLGWHGQSFWVFGLHWLANWWWSLYVNRPTEDGYRPHFNSLGRVILYAPLSPGKTTGGQAPPSRLMV

SEQ ID NO: 946486 - protein, 157 aa, Homo sapiens
MEGAGCVVGSHMRAKCTLCSSADGQLPKTGGRSEKLGELQQRHRGLGAGGVWNTDFMPREPRTDPTHDLKVTQSYTLYACVARDKHLQISPHWDLARRLEQKGLSLGWCTPPRHWDAVLPSSRKVGWRAHYGTGVKELYICISYSPDSNSHVTVCKA

SEQ ID NO: 946487 - protein, 316 aa, Homo sapiens
RGLGWATWTPKPINQKLGRQKVGNFWVCHTFLGPRADMEILTDRHTTNTVGATWVLEGQQMVWFQVQRGMFGDSLGRVTRGIHSPTRGVVSHLTHVLHPTHPEWRTHTFRHTGRRTISHRQSITLWRGPQTHTHSADVESVAEGNARVIRRAEAPVTEWRRGTLILAELRIPSQRCHTYYPFTEHIYRRSGTHTLFVVTHGVYTIYVGGWSRHTIVGYAGGVTHLQADVGPRFPGTLCSHMSATEGSAVGYVSRHIYKTLCEPNVGADVNPAIWKSGAAPDIRRRLWQQIWTRWFNPPGHMVGVPHMGPHPGSQGG

SEQ ID NO: 946488 - protein, 281 aa, Homo sapiens
MRSGTGGACVKKRQASRVLNEAVTLGNCALSSKLAGEEYRGKYVSRTLKSCDASQVATKRSGVRRATKVICGTYATFRLGSRYPSVCSLTLLLVQSHARYQDIMPACGPEWYIHHALDVRTVNYRWQNRSCMTLAIERRQGSELIATDFSAHVRSFVDCETKRCPGDNTLCWWHPFEGWVNREICVMFIECSTVCRHCLCHSFTESQSLALYIATVLRGTVHMAVRNKVHYGVHPVTFPRVTLVRKRDWIGRASVMMQLEGTDLVNSSETDVRSWGVRCEA

SEQ ID NO: 946489 - protein, 48 aa, Homo sapiens
MGRSRSRSSSVQATSKTRRRPDPTEWSVIRIGRGEWRRYGGREDGRLP

SEQ ID NO: 946490 - protein, 137 aa, Homo sapiens
KFNGWRKRRGQLARRDVRTIVAVMCHVVNVLNYTPGSYREEGLDSEPWHNTRRPPCEQNHIYGSRTLGLIKQNQEKLSLVTHTNHGRDRPKALGIVLTALVYTPSQHLAQGPHMGEHICVEGPRPTAERIKAFEAHA

SEQ ID NO: 946491 - protein, 103 aa, Homo sapiens
MASHSYLLQLPLTSDTNRSVLLSSHKKSDGVTGFSLLSLMFPFLAPSLLGTLAHPPEGQHRAITPAGLNPYSRTNDPDRHKGENATPPPEPNTPPLRTKTHTQ

SEQ ID NO: 946492 - protein, 270 aa, Homo sapiens
MRHMVIVVPLVSHVAIRTSVRICGGSEFCFVGGAPMRNVLCQYGSHTLPQSVRVDKTYTNYFMNNSDSHTPHVVAHRLRLPQILGVLSTHTMSANLCAHGCDESYVGAYMSEILGLADFHHVRVPSAMLVRDTMWSCWETSSRCKVHCAHLVTEPRSVYVVIHWFNGSIPTIYESCRDALPGSSTLVVRDPGHLPEIGCRTVASSWANYRCEACGCDYPRITYGYSRVGTGTLTQRNHRHIDALVTSTSPTGVGRRTLAVVSHAGTCHNR

SEQ ID NO: 946493 - protein, 158 aa, Homo sapiens
TVDGAELCGGQVSPVFPAAPEWLSRESAQAPSGSALTLSSVSSLPRIERSTDQVIKPVNLEALSKWTGHIPGDVVRDMAQIAPMLAQLGYDPYANPPNYGNPDPFVINNTQRVSVHLYLWKCTLGDMGLLQMWKLQPPEEMVRLSIPGHLSWFCLMTQ

SEQ ID NO: 946494 - protein, 120 aa, Homo sapiens
MSYGEIEGKFLGPREEVTSEPRCKKLKSTTESYVFHNHSNADFHRIQEKTGNDWVPVTIIDVRGHSYLPENKIKTTDLHRPLHDEMPGNRPDVIGSIDSQVLQEARSSLIFADHEIYCTK

SEQ ID NO: 946495 - protein, 121 aa, Homo sapiens
GIRHERHETRVDLTFYTLSPAGPFCLLESGQAPVTSWEASARLLVVAIFRGGPTTIETQNPWAPSPFREQLIPDPHPQGDPAQDPDGVEHAGATTVCMATRNSSQRKPREAPLYVSEHGFT

SEQ ID NO: 946496 - protein, 425 aa, Homo sapiens
RRTDDDDDDDDDDDDDDDDDDDDDDDDDDDDDDDDDDDDDDDDDDDDDDDDDDDDVTDDDDDDDGLHRLLLTEAETDGSSEEQCDTTWGGSKQTRLRFRAYSPVNKCIHIRREVSSNKHAIVQYVNRGYLIPPNAPVHTCSGDDNGRMADTALSVRGEGIVYKSALLTVVHVIITTVCSVVREITLAVTYPSVSMSGHGDSPPTASHVHLYFYYRVCFSQLVDTYNYIMIQYLVASATITITTYDHTPISITHLPQYSHSSSFLLIRIHTLIYRTLSTNRSTTYSSPILYLNIYITITPYITYQPTRLHETHTTYTPQHISHILSHPYYIQLPIPNLTHTINMLTSHNYSSHYPLISLSLNYTYIRHRPYRSTYRMQQIVIIYTSLHQHKYPYITSQLPHTQLTHKRPHIMTTNTPSTQLTYPLE

SEQ ID NO: 946497 - protein, 328 aa, Homo sapiens
RAAIVSGIIYRGPHRQCVFMGPPVLIHIAEMPLKHSCSPRAHSVDFTGSHLSQFAFSKSVIPFGPKTKHTNNKNNKHKQKQTTQTNNKTNTHTTKQTTNKHNTNKKTSSGGGPRIPNIRPYIREVALNNFTWALRYNNSSHDLGNNPLGRIIPPHEIRPLTGNNPPLFRTGVGRLAEERTRTPNSAAFHQHVVREALYLENSGDTMISRSNNIGSNTYSSLEIIGVKLKRYILFHPTLGAEHSAITFPFIRITQALRTRGTGSVPIVLPPCGNHPRAPLSYATRWSPPTVTAGGQRAVLIRGAGRPIRGGHTRRIHRHLAVSEVAVQA

SEQ ID NO: 946498 - protein, 137 aa, Homo sapiens
MAVTLFLRFLGLYGTWQPSLTNTWTQALVRVGTGHKGAEPKTGQAGAPEPKGTADGRPKDAGDKDSGNLKPIHGTTQNRGPELTLGIPGESPGTPFMPGILTGPPVARKANPDGRKDPAPRDRAHRGPTGGPEDPTG

SEQ ID NO: 946499 - protein, 410 aa, Homo sapiens
EWPVRSPHGVVLAKRLVVGGSDNHGYYFLKELKRRDSNAYIGKVEIMAAPGHWVRIFKPDTYKANSDNQLITPTIDAHYSQEHTGRWSYMGSMNGPWDPKSDDNSLWPSRCAVAASCVTGAAVGCPQPCPGLGYPLCEPLSPSLPASLGPWKVCDIPSCPPKPFALITTFNCLDPTKQQTPKHTTTPQRHHPPTTDITNHTLRTLLHVPIHNYSTDSDALTSPGGVPRDTDITRPPNRDGRIITNSSWARVILHSFAHRRNTLLRFPNQYSALEYSSSLLASLVLLTDIVRLLIALPNMFVPPLNGNWPLVRVTIGNHPVRSALCTIPNGESAAVNLENRTVQVSSCQPFNGTPGTHGTSTPGVTSAIEERGPFIFLPAYDTLSMMLILTLHDHQIILMMCSTSYSRRTH

SEQ ID NO: 946500 - protein, 127 aa, Homo sapiens
NSGMVRIRDRVPNGTKARDKTSFTCSLTGFFLDQNHKGRIGILMVRSGSEAYLYGGSGKLLTMRINSGSGHCHLDAPHITNPFLVTTESYNSSWAPLVTPNSLLGKLGLRTSGDRPGRNSGGFRLCS

SEQ ID NO: 946501 - protein, 79 aa, Homo sapiens
GVPHNLRTKRTIGWANWLKKGGAQLEGLIQGGSKEQLLDLDAKVQTGQRLANWLYSLNPSFFGFCKGKPKMGKLGKALG

SEQ ID NO: 946502 - protein, 270 aa, Homo sapiens
FPWHKNGPAKATGKPAPVYKNTELGRRPPGEEPGSRRHDILSTVIDIYVTQETLDSNQRISQPQSANHNQTKAPDVWRAQPDVDIRMHSNTRVQVKDAKPADLAGGHTARGTGTERYALQVGGPFRGKWLSRERLTYRRSTKSPENILYDTILLLLVYFTPTTKTWSYTKKAPCITEYPYTMGFLGGEKRKVICTAILISPDPRLPYVRPDVGLEATFPKGYPQGCEDLVVPKPISKQKTTNQYVPKRGFPGKQQMDSKERKVGCTTPVV

SEQ ID NO: 946503 - protein, 233 aa, Homo sapiens
AEVGQNWELDCSNGNLLSGKPGRGSWFRATQGSGSSSSEAKALDNRFLGPLWGPRDRWWVDGIIGVWTLWAFNGDPSMALGRHPFWAPPKRPQGDGWAPGKPPLVAGRACGGWGLCGWEHWVGAWSGAGDSLKLRVARRAQAHTGALGFSGLSKAGENEWLNELNFFTGGAEGEPQAPSLGLWFPLVFWAANNLLVKPFDELTGWKEELLLDHPEGILTRSRERRLGGGAERM

SEQ ID NO: 946504 - protein, 66 aa, Homo sapiens
ILWPTDDDDDNDDDDDDDDDDDTTTTRHTTTNTTGDHNHDKHQITRRDTDITRESTSNTATHDNRT

SEQ ID NO: 946505 - protein, 222 aa, Homo sapiens
KISRGAGGGGWNPRLLGRVREENSLNSEGRGWSEPRVGATGTPGLGRTEVGTPVSIKQKRRWRNSEVDILAIGFWLLPWGSSWVPEAPLPIPASIGLWLLVLFWYWTWIFGIKGLKGPLHWASLGKLGNLPKQGPSGEFLSFHLVLVPLSPFGNFDIFSRFPWIPLDTSHSGHSGPPFKLAELFPLQHFSHFNIKGPWPKGTPNSGPAYDEHSYTQLEGGPV

SEQ ID NO: 946506 - protein, 114 aa, Homo sapiens
AEDESGEGFPLEFKKELTGQRLREGDGPDGPGDDGAGGPGRTGAQAGGGGREEGRGALQGWSTSAGAGRPRDKRYGGFMNSEKRQTPLVKLFKTRHHQERLTEGRMKAQRGPRG

SEQ ID NO: 946507 - protein, 172 aa, Homo sapiens
KGSVRDPPVMALSKEKGFQEITPPGVGMSKYGNIILSLHMDLCEDVWRELGSLYLHTDLDGYLSLWRFHWEGKMPNNRTALSANVTYIIMGDFIGLCAIVGNVLDICEVKLNPSLQTTTFYFIVSLDLADNAVGVLVMPYALCQPVHHPLLQLAFYGPTAYLYPQLLHVLVG

SEQ ID NO: 946508 - protein, 153 aa, Homo sapiens
LTFSLCPEPESIWQVGEVGPHTPTGSPISAHACAYTHFVLTPCYHWPEEAHTGKRIAASLSDSLVCTSHEEPTPVLPITLLSLRTVDHALVSEAVPSAPADCISEYPILEVRMENVTVLGEDVIVNDELYLNGASVLSHMYIDETVPEPRIIM

SEQ ID NO: 946509 - protein, 74 aa, Homo sapiens
INILTVPGSTEYTERESLREVRPAYGPLTAWGGSDTYRVDRAMMTGLRNRTPVTGFEHELVGTWRATLYPCPDP

SEQ ID NO: 946510 - protein, 142 aa, Homo sapiens
HIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKVGPEWLGDTLRLSDCPVTTGHTSPPCCLSSCICIGNAGHS

SEQ ID NO: 946511 - protein, 179 aa, Homo sapiens
TLGGNQGNGFGRNGPVNSKERWGLWVVSCHSPGLGEEPQLLNRWNNGQGPAKGTKGATPANKGPGHEVGAPTSCENPVLGHRLAKAHSETTRKVENHNWGTKERGNFVPIGPPQGKTSRPDQETPRNGAAPEASLLQYCGPQRCYTKPVNLQTGCGPMGLYGNTRVSCETRGGKKGVPL

SEQ ID NO: 946512 - protein, 84 aa, Homo sapiens
GRGICTAPGPGACARAAPERSGAPRRSVAQCKRFVVTLHTCNLKNLFFWAFMFNGFRKLSVFSKELLFPVLKIQKGILALFDYI

SEQ ID NO: 946513 - protein, 172 aa, Homo sapiens
MVGPRHEPRTRTWWCPVMANNVSWGNWKDNLGGFPLKGRTVIGLPQAFNPKGGGLASERCKKDGQRENLEILQEQLYPEAIETEPGGGPGKFTGHPQVTNVGPRRRMQKGGHRSLGFAMTLGNNTTPGGAPPRQGRNKRGTRGNRGTTTPCETQHPTGNIFRPRRPLRAHEP

SEQ ID NO: 946514 - protein, 214 aa, Homo sapiens
SHVRKQKKGGAGKVTWAKGVLTGFRLSTGVTKLGCVNWCPHELGGRHCGVRLVVVFWCGRGDIGGTNRTTVLYSGSTNVAQRERSGSCAEEFLVWLNGTVSHNPQPSPLSGADKTTHGTFVQFGRNTCVCEIVRLQGRNTRGLDTVFWRASASGWDNLKANMGAHLMCDWVVKIAGGAAASPRVVHGILRAVSGKRLVEQTHTVSQEAPQGSKK

SEQ ID NO: 946515 - protein, 325 aa, Homo sapiens
LWWRSTTKWIPRGLDGNSGHEGWDSSYTSEYLPTESWCQTARDEDWTVTTRHSNATLAGDKNFSGQAPVTHLWKRVTHGITLTPELNSSVNTWYPLYPQGDTTCCWRRHIVTWGQTRPQEISRFHLGRNTTTNSSGSWFTTHLSNMATYTLLLSLRSVINQAHLGPELCLATSSLELGGKQRMGRYTPHILNRPNVQRPIHHHIAPTCGGSISGNERSRHTEFVPFPQPGLSPDLEHGRNAAHWLGRLQHMFDKFRGKNFRVKYTDYFFNPRCDHPASPYLSPRHYNRDTVVELVVPALGTRVLPLRTVDSQVTGGHRAIRGSAH

SEQ ID NO: 946516 - protein, 73 aa, Homo sapiens
LAGCPGSAVPGMVVSRILDDVRRMNKRELYYQVLNFGMIGSSALMIWKGVNGITGSESPIGVVLSGSMEPGIS

SEQ ID NO: 946517 - protein, 199 aa, Homo sapiens
MNIPKWFHWGNRPWGLPAECSRIGWPLRGKGGVVMGKNNMKRKGIRRRPGKQPNSGRKWWLHISGGMWALGFTREDSLSIRDMLLGQEGWPAGVPVLGGIGPMVKSLVAGPEHWSRGRRRTLFFQALSIYTKISRGHIEILNDVQLIQTGDQVGASENTLVNMLKFSPSPLGWSSSGGPHGSISGIVIYRGLDSASGVS

SEQ ID NO: 946518 - protein, 305 aa, Homo sapiens
FLDVKFERVYFLNYRPGFKEGDYLAQNPQSWESVEQGQGENKGALGVELLGGGVTLGAPAGGLNRPFLEGGSWMMGVFETASPRGVWALLGGSCKPCVDAWSLGAGRGPSWKVGPILGRWRLRSFITLGWQPSKCVVRPSVCGLWRPCAPVNLARWQCVGSSPPRKSAVASQALLLETPRVERALGELCSLARGEGTTFNWCARFIGQTVLAQAESGPNGSKKRLASARARVGNIGAGVGGGLKEGAESSAGEKSRASGWGVVPGGVVRGRFGQRIGHGTPGSRRGVAFRNWESGKVVDAVPGVR

SEQ ID NO: 946519 - protein, 141 aa, Homo sapiens
MLLSELSLNASCCALHVRLISWRIALLRPASYNCRQHKRYTLAQVYLRARMRAMTEKATTESSGRSYAECEIINISPSNSSIHRHYTAEGGMVGKADVDRSALLEIPMHRLRRHTNASMCPHRHERSAGLHKETVTTYGLR

SEQ ID NO: 946520 - protein, 100 aa, Homo sapiens
FDQVISENYRDGAAGVSPVQDGYVLILCTKVVPDVVTVCNSRSQSCAVKCDADAYCTRFDCKHDLHAGPTRLVLDCKDKSYRVTSVKFYIPLEQDRKYIA

SEQ ID NO: 946521 - protein, 185 aa, Homo sapiens
TLNVGPNPAWAGWLEAFWLVSLAPGRVRARRTGGHREVEDGLAWVGISGTIYEYGALNIDGEEYIPFKQYAGKYVLFVNVGSYWRLTGQYIELNALQEETCTNGLVILGFPWQQFGRNQERTQRYLPNLKYVRTSGGFGPYFQLFEKGDVHGEKEQKFYTFLKNSWFFQLGAPGDLLTALRARGP

SEQ ID NO: 946522 - protein, 53 aa, Homo sapiens
DYWLTKLPNAEGAPRFNPCVCATPLSLILSLGVNFHLLLRCRERSLEIHTPVF

SEQ ID NO: 946523 - protein, 276 aa, Homo sapiens
AASVPPSESSLPRQSLSLPGRCLRSVLQPLWGPCLLVPCLLQCLWTVLCAVCLDDAAMCHGPSPREMQPLLDVHPGPCNAPTLSGLMTPCSLCELLRDEHALLTLRPPYVMVPTSCWGPDSCRLQHACSSWQQAAQVQKRELTSQLGERLAALLPVAPEPLSADGAKPGPREGKRSYSMEHFRWGKPVGKKRRPVKVYPNGADDESGEGFPLEFQRELTGSIREGNAPRACDKGRGQPTEQAAVRQKERPQMASWGRQKTGRTHDPSAQAQPGRRA

SEQ ID NO: 946524 - protein, 111 aa, Homo sapiens
YSPDFEKLKPEYLEELSTMMQHFSQILGKRPWFVGDKITFVDFLAYDVLDLHRIFEPNCLDAFPNLKDFISRFEGLEKISAYMKSSRFLPLCTQGWLSGATSNALKATRWE

SEQ ID NO: 946525 - protein, 69 aa, Homo sapiens
QALCAYDKKSPCRRKSSLDHIMDVAVIPTSVPLTFLLKELGRFEDNPYPSPPKAGEAFYRGLPLRDSFR

SEQ ID NO: 946526 - protein, 205 aa, Homo sapiens
SQNSTGPRLGWEWKPRTRRGGGYQAGEESAPPPVRRWLAPGKVGERQRRATLGGQQTDGPLTWTRVPLIGQGYNQGPDGRGTSNSWVHPLPSFMVVLAIPLDTTGKSWEHGTFNIIFNSNTLESKPLIATRRGPGSGLTMCRFRTATQGTTKISIQQHSLIKEFRKVAFNNNARKQSKAHFLQSRFPGSQGNSISFRRALTRHIA

SEQ ID NO: 946527 - protein, 96 aa, Homo sapiens
LTGVRRVFGTQLGGRRSAKGRCGAVRCLRAGSQPVGSTEVHERVLILASWIMKLKNMILAKKYICTYINGAREGSPSSQISGVFFMNLEENTEKAG

SEQ ID NO: 946528 - protein, 147 aa, Homo sapiens
RGAGSGGRLEHSSSLWQLLFYLEDEAPSDWLRNPGEGPGIELWLESPRLKPLGTKWCLAGTSLWARTEWGTKGSWKLTRMVLTWAEAAPACAGWVQWAVFLATAGGPGRVSQTFATLGPLRERAVEGLPQSTGGWFPGRYEAFGPTF

SEQ ID NO: 946529 - protein, 106 aa, Homo sapiens
NGSRKYETGLGTNPGPAINPSPSSALPSLRILNITDEVKDSLPLPIKINGPPRVMEPTSTPDKGGLIFNSYILPPIIPKNQATWRFLEGGQIVVLPDKAPIPVLIN

SEQ ID NO: 946530 - protein, 116 aa, Homo sapiens
AKEDSTGELHLLQRLDSSVDAQPCSCLSATTGAGTDTTVDNTAEQAAALFDGYKMFHGPYEPSDLTYCSAYGKDTGTALQERSWDIARRLGQANMSAIWNTTMLVTSELCIGGQWA

SEQ ID NO: 946531 - protein, 78 aa, Homo sapiens
IKLRSVTSSEEVDVRREDLVEEIGEQASPSASAELNKLSRGTGQWWLGDFFEGVKGRRAFIVTEDLAYLATFIPVYTR

SEQ ID NO: 946532 - protein, 133 aa, Homo sapiens
LQRDLVSHTIIMGDFNTPLSTVDRSTRQKVNKDIQDLNSALHQADLIDIYRTLHPKSTEYTFFSAPHRIYSKIDHIVGSKALLSKCKRTAIITNCLSDHSAIKLELRIKKLTQNRSTTWKLNNLLLNDYWVHN

SEQ ID NO: 946533 - protein, 125 aa, Homo sapiens
MGPRETANLVLPKAVTDTGVLPPQSLYHSVDPLAHTVGPTKTLYPGDTSPLSATVKKQIVLVDPTWKLALKSGKNGKLKSLEAQVHPHQALKKAMPPGPQGLKIRGNQKLGLTTLETIGDEFHSA

SEQ ID NO: 946534 - protein, 278 aa, Homo sapiens
ADSDTKNAQGWGSQGNEPKVGRQAATSGWREEPTNITALLGKVEAPDECAESNEHFSLLQELHLAGERKKVMCKGNLDLNKWPGTGNVRAQTAFPAKGSQWSPLGVKAALTLELSMECNVNGGRQTQRGKRQGITCNHGVRQHLVSAHVALFAKKSHITRAVRLTRWRKEKPHLWTVVSWGCKTGAHHISNTGGGSPRGDKETSQTHGQILGGRAGTAGKHGCTDTDTRGRVCGHRLVSAACEGTVGVKTTGTYCGLGLVAPRGGPGRKGWAFPRGTI

SEQ ID NO: 946535 - protein, 151 aa, Homo sapiens
MRVWGQVWRPQTPSEHPCGRHTHIWVLLMFGLSPVAHVSPHLRSHLQGTISLLKEGRGRHVGASNNVIWGVQRDTKTSGGTLWAPTRGVQATDKLAWNYIGAKAMVVACKVSHCGISNEGEGSSGNHPNTGVWRRTVWEHPVFGTPCGRLV

SEQ ID NO: 946536 - protein, 116 aa, Homo sapiens
KVGFRQRITNMNIKGIRHGKGSLLCWLAGCNLAPGVQRRVAPWPNLVPGGGWPNGRVNPSKNWFERAGRSGPLHPQQQLVSPHPFHLFLRRALMDPVPLARLLLVGISFGIHGLGW

SEQ ID NO: 946537 - protein, 111 aa, Homo sapiens
LWSLPSKSPAHTSSWSPRPLGGSISGGRHLPQIFNLLGLLSGPGGELEVSLEKHLAKGAPGPTPGGRRDPEALAAQRPPLVLSGGGHPLPGGPWWAPQQNWIRSRRNNFLI

SEQ ID NO: 946538 - protein, 159 aa, Homo sapiens
MGFGVNIKQCQLPAHGRIWAKGRPLDLSGFPNVGTMGPVDPDWDRGNQGSGQMGKSLNRGLHPWHLVAVPFGAQPVSNRGMYTQGLHVSQKGKHSTPHPQGVPRNTTPLNCDQGNRALGLKGLGPGDKRELRENYTGPRPFPVTAGELTAIHDGHVDSR

SEQ ID NO: 946539 - protein, 92 aa, Homo sapiens
SGSPTRKGPHSLCGNSLGNVGFHPRNWGALCVNQLLDPKDSKFPCASWDKVCSLERKAKVFVVSPEERQWFRWLVIFVLGSNVVCRVPSKAW

SEQ ID NO: 946540 - protein, 70 aa, Homo sapiens
REPGGFKRRLSIIVTVRLVVMILRMILAICLHNCIKAGVGLCMKRQIPTDCVILEVLGLFTQAAMLHCYT

SEQ ID NO: 946541 - protein, 121 aa, Homo sapiens
TGQGNTTDYGVAALRLTLGFLSRHCRMAVVKNSGSQTYITGLTCIFLGHSPRGQWTPGTRGLKKGIIPPGWSCLFTHLSYLKKKTECIESLVLKAELFKKVLSKPSYLGPGYMKTYCLGGS

SEQ ID NO: 946542 - protein, 193 aa, Homo sapiens
MSRPVHITHQSPTSWSSFKSGYKVFQHIISSSQCSTQLSISSLGPHPSGFPFTATLHPFKLRVPHYRGPALSSPSPFLCYYIVWSKGRVSASLVRPNAGKYPTGGRSSGDTWALLRAFLGVPTWTLPSAASPKVALGINSEGLRNQWPRATYRVYHGQQWGVTRGLAQTGPEIPEQNESARAHPPRGGNGEAR

SEQ ID NO: 946543 - protein, 103 aa, Homo sapiens
MGQPAEESPQSKGWVFPKRVFGKVTLRQVGHGFTRGLLSLTTQANRRNWLVPTNIPGSKQFRTGYFSLFSSNLEGGFTRLPHGSDLRQGTVWGPVRDVWYTIP

SEQ ID NO: 946544 - protein, 124 aa, Homo sapiens
MNKLDTGTSLEYLGWLKPGGLKIWGLEYGQGTRLEHLAATYTQQGVGPRVSRPGSLVQLAPYSRVTSRAPHHGPDTPNEGQGKPPTPRMVPPMGGRDTGHAHQFAGPHSGDGLRGDGAAGRPPR

SEQ ID NO: 946545 - protein, 239 aa, Homo sapiens
KTWLQSSFTNITDSLGVMEQVSHEVFYLLVKGPPEKEVSRPAEVVEPPSGSRALSVCVMIQQGTKLLSPTKTTAGGTFFAEPGGETFKEERHWLGLCVVSFEKTGFSPTKKSGLYYPNFISSKQVLDIFVEISPVQKIHNGVDTKKRVDFACEQVFGMFTRKYFPVLVLLFLVAALRALLLLLHERGVAQGGVADVVPRLVHLIGTLGPVPDLDLGTEDQIEGGGPMGNTRLVNPDTAG

SEQ ID NO: 946546 - protein, 222 aa, Homo sapiens
QRVRGITTDISVWRFATSTYYVTIIEAPGHKDFIKNMITGTSQADCALLSVAVSVGEFEDCISNNGHTLEHALMAYTLSGNNYIGGVNKTGVTEPPYSPERYEELANGVSSYIEDGYNPDTVACVPISGWNDDNMLEASAYMPWLKEMVTREDGNVSGTTLFEALDLDTPPTLTVKPLRLPLQDSYRSEGLGQPLLGRERTVFYTRPGGAYASINGQRKVYF

SEQ ID NO: 946547 - protein, 104 aa, Homo sapiens
HNVTGNVPNKTLHQALNFKNWESFPTFLGITFGAILGIYIVVELLRRGYTPKFRWRPPSFNRTTQPLESINRKHLLTTGLVTYIHIFPIRVGGLTGACVPILAH

SEQ ID NO: 946548 - protein, 231 aa, Homo sapiens
IDEYIGNGGERFWKSYRLPADPKPLVVLGKTGPGWYTAWIGNSTGSTWIRLIQQTPREWAGPPSHGGVVGDSRPGGWWWGEFIYTWSPPESGKTTNKNNKNKTNKNKQNNKQKQKTNNKTNNNKQKTLGGGGRGVNPNFGPLIVWRSGYSPNSTWGRSRISPTVGGTWGQHRVLPPTCKSAIGRQQSPLISARTGEVNTPNEGARHPELRPIPKKGWGPTPEKGGKLARTW

SEQ ID NO: 946549 - protein, 96 aa, Homo sapiens
MGWLGCEHFEKAGVNLSKGGGTEPRKESNVPFLGLYHHLGGGVTHQTLIWVGVGSTQQWGISPIVKPNTLNRAQHNRHNVEGLGFQGDKSRAFSHF

SEQ ID NO: 946550 - protein, 228 aa, Homo sapiens
MALELDWLLQWAQGDALCGRKLWLQVLGWNFEGLTQGEGWASVPTELVQLVVAKNELAVANELGLLRGRGHLEAGEERGSHEEVEGLVEKNRFPMMVPEELFELEFNLVLVLEPLKAWFQKKNLEGLEFHTGAFQLLGRYKGLLNEDTYQARIYNSANWSGFVTDRSWSGRESQLVYQAQRGALVQYSLDDFQAPSDYRYNPTSPSRIHPKFSFRTEGSGPGYSPHSV

SEQ ID NO: 946551 - protein, 284 aa, Homo sapiens
PCLERVQKGAQDARGPQNILWTLKPQNQAHPPQTKPQQKGGQVVTWNWEGPAMGAMGQIQGKMVSQPWVHCRDTSDCKPGGLTIFQMVVHTDNWPHPRGQTLHSPLPGSIYWLANIGAWGIPDETVGGAIGGSIHPTRYRDGPQVPGLMGVKVANPIFHPTNNQHGRGHGLTLEPSNFPGHWWNIDPVGKILPEHAMVRPFPYRKGGVDLSWTFPRFPGTRFPEPLMGHGARRLGPPPVDANLGGDKRQGATVGSYGASPLYTKWNKIGNTGGPFPFPSNLLGS

SEQ ID NO: 946552 - protein, 189 aa, Homo sapiens
MVWWTSMFVTWYLGSRLQLAISRLGIHRSQVPLSNHFKTLIGQSHFQTLSWPTLVIKHIKRFSTFNQIFIFGYQPGGTSFLVHGIYGGLEVPLLIFIAPWLISHTGKQINGQEHSIFPALDYCFTADLHFGSLLPFCWNELPFGFSLFLVPGWERLCRETLSSRRFNPSHFVGWLGGPFHAASVGPGFA

SEQ ID NO: 946553 - protein, 36 aa, Homo sapiens
MGAIQPVNPRLFKGGPKVAGNSDIKSGKPLRESPGL

SEQ ID NO: 946554 - protein, 177 aa, Homo sapiens
YETSASFTDRWGSRRGTPFAHMGTCAISRQVFFGQHRAALLYREKGLLQARTGPTRGGWESKDRTVWTEYLRRAKWGETILFVEPTGPVGGNRRRSFSPLNQAHPKKRAREAQHHPERLGGTAQKQHPLRGVWGKICKESHLGGPKKKIFVRNPEREPNPNGKKGGGGTGPSVSGGG

SEQ ID NO: 946555 - protein, 181 aa, Homo sapiens
VVEQMDKMQFNEKDDEVTQTVEELLETWTYSAWQLNEEELNAISNRKFISDKKKFKTLKAKQNESGFFGLSELKELKKVIHEKDGEIKSVEELLEGELLKVANKEKTVQDLKQEIKALKEEIGDVQLEKAQELSITSKGSGAAELIARKRGTDEYHEGCVGRERERTSQYREVVTGSSRRN

SEQ ID NO: 946556 - protein, 59 aa, Homo sapiens
GTEGIIFLRPPNSSVSESIDLNRRKHNSQPRAAPHLPAAHPSRGLEPVQFLRSVFARLV

SEQ ID NO: 946557 - protein, 94 aa, Homo sapiens
VEITCTPEPDYTVANDKPTPVSLIALAHHCDACMCCVPTLLGTVSTPRSLTYRAQLSESLDDTLDADVRLRFVYVSRASLHSALARSVCRSAYR

SEQ ID NO: 946558 - protein, 56 aa, Homo sapiens
MALYKGGGHTAEQTEDKQPTRETNRRGEDMESGLVYAAPGETTQGNNNAGHPGAHR

SEQ ID NO: 946559 - protein, 133 aa, Homo sapiens
MNRKKLQKLTDTLTKNCKHCKKNVVLDRPRLLDRAWVPPRAKVRCVPASRLLGLCGLPTAPPPRPLKQKSERESRGASSLRLILGTQASASGATYTLTHAYTCFFQPSFFYLIETCDVSLTEVYHKCYSHVVS

SEQ ID NO: 946560 - protein, 268 aa, Homo sapiens
MYWCCVEQCTRRSALPVILATVHLWIAVLEQDSLKQRHMDSFCMAAARLMPHETYTLISGETPAALLRVPRPQAPEGRLVNHYRSNQMTQEKLTRFRKGHPTLTPQRACHTSSLSRDARTCRHVYRWYPRPCSDIATSIEQVYHIENTRTCLINEMTSQRGIVSHDMACINRCGHMETQSSLKNVGFAKPAGRVFGGIQNILCTSTFKPYSPGTQHRSQKYSAFNCKIALHVITIVRDVIGSPIPYRQQVVAMFSIPIERGVNLGVTQ

SEQ ID NO: 946561 - protein, 131 aa, Homo sapiens
GHPAFIAQLSDVVCHNFGGSGSVDILLIRRMYHTTLFGKSLRAFVAYCWWEIMWVYVWAFVLSIKDVPKICLMYVPTCNVVFYASLYYAFPFLFPMLPTRDWFPVFGYSRTRGLFLPTHVVYQFTKAYVLP

SEQ ID NO: 946562 - protein, 101 aa, Homo sapiens
MSYLFNDFEHTHLIDTEILFEHFYNTKQTQCFLYNIYNALVVSREHMWTPSHTPLMREHKERFHSPFSWPRDKEFYLTKTIPFYGIACIFYQLLYFYRDSA

SEQ ID NO: 946563 - protein, 90 aa, Homo sapiens
ATITNMNIKGSPWGSLLRAGYAQCPDAGGDFTAALVLYLIVIGHAVYARHLPAQTGAQFSLTLLASPSSSVRPVIGMAQVCIPPTMFRCS

SEQ ID NO: 946564 - protein, 66 aa, Homo sapiens
QGLRQAVSIGCNVSTTTRVPRPDREHKQAHTRTGAWLQQQHAEQEHTQPEEQKREAGAGRTYRIAR

SEQ ID NO: 946565 - protein, 134 aa, Homo sapiens
MTGFHGLCSAIYGDPDECWYLSQRLVTAYDVQNTALMCQRNAKTLTELIKDVYSTYSKIPAHRKGHMPCYGLKPDLDDDEHDYVRILAQFQHLSAGVTTLNCCFSGDTAPVNHFSLYEDLGKFTAELQTGVACG

SEQ ID NO: 946566 - protein, 145 aa, Homo sapiens
MEPFAQQLQLAASLTANLSNLCQGSEMPTTSRPALDVKGGTSPAKEDANHEMSSAAYSNLAVKDRKAQAILHYPGVASYGTKASGASTKISGSPIGSSTTTPVTKPPYFNLDPRPLLCWLGCPCRNIMQAQGMGGATSGPRVGSP

SEQ ID NO: 946567 - protein, 69 aa, Homo sapiens
KRRTSHNRSLLTEMNRLSINSCLLDGGSCNTENAISLQNDYRKDSDSGQDLCLMEGTHALWIPRGNNGL

SEQ ID NO: 946568 - protein, 105 aa, Homo sapiens
MHELHLSSNTQDVHSESHKALGCTCGMYAEYGLCPHGFPANSMGLGWAPMATHADVLDGLSMDDLPLKAWSNHGLCPQWTECVLELSRCPLLWTRIWLMATIELP

SEQ ID NO: 946569 - protein, 61 aa, Homo sapiens
MVLMSHRKSQRCYSAHVSIDLTHYVNGIEVDWRTVACNIYLKALPMTFLSYTKLESLSGIG

SEQ ID NO: 946570 - protein, 146 aa, Homo sapiens
APSPHKMSEDLAQQLASYKAQLQHGEAALSGNGENEDLLKLKKDLQEVIELTKDLLSTQPFETLARSDRFASTQPTHSWKVRDKCMAVWSEDGQCYEARIEAIDEEQGTAAITFAGYGNAEVTPLVNLKPVQQGTKAKEDSGYQPM

SEQ ID NO: 946571 - protein, 68 aa, Homo sapiens
MRPGPGGIDHTPGQSAHSQGCEPVHTQGARHQQPGYQSKQTPDRQDISPNEHWVPMDRYNPSAPTTWG

SEQ ID NO: 946572 - protein, 71 aa, Homo sapiens
LSQPVAYFPFSRVCKRALDWLMPTISSNRQPLSPSYSSPTPGAGDSRCVLVRSIHVSYGWGADFTGMQVCI

SEQ ID NO: 946573 - protein, 71 aa, Homo sapiens
RGGEDQAVMGKAPIKSAIRRDRSQPWRNVHPRYGQLLALYLLHNDMNNARYLWKRIPPAILQILNLGEFGQ

SEQ ID NO: 946574 - protein, 517 aa, Homo sapiens
IIVYPGHSYRNTSHHSELHEMRACKTRDHLLNHRFTPIICLHIQQLTGLRAIGLPFTHLESRPCSTNRVYGKGTHGPGTRVSHTSCHSFNVTPITQRSDQLLMQACMYMTIRCEHPIVLHSVVIPRGRRLIAGHTAFSHSLSMYHHNTTVCEPSIASHQRWLSSLVALAKDQEFLLQGSVFAPIHKTIGYGPDCMSLLVATCTLFHVSASLPDVSNRHRFADLLGTIMGALDRVGVTFLGRYVDDMIGVLKDLVTTHYTIKTMRFLWDTGVDPPLDKFLARRMTAPWIPDVTEKQTNLREAIETSCSPVSELGETPLVCQTRLEPRHRHHIHDGQHATQWQLVAPFSTCGPVVLRRPSYINVHTPMARELHTRHFFHTALPFSHQTHLRLQAPTYSPHKHTTLINHAHTHNSYNHTRRQSQHLPFHNSDNVLTNLSFLSFFLLIPLILLPVRSMHTYSHLTRTPKPSIDVHHTDEPATSLTHDSHHTYNIHHYPPISADHRTSSHLTTHPNTHSLLT

SEQ ID NO: 946575 - protein, 208 aa, Homo sapiens
MLLGPTRLIDKLLILTKSLPLSRVPDLVITRMYLNESSTARILLLSCAPNLGAHCPYVEPLTRALNIERLNYGQVLHEELYRSTCWWPADSETSGGHAMSSCTCTYASYAFSLSPYVLDSVNRREQLALQSSTRKSYIATCYDVTVLYPHVTNPPGTLDSAHEFLLFTAVKRFSYCHCQYTGKRVRDSKQDLLVGPKRALRVSINAVR

SEQ ID NO: 946576 - protein, 92 aa, Homo sapiens
MLDEWIRGPGKMDSEEDMMVNWPFYISNHSNTGVCISRSHGSSVVPPVDITTVAYTNGECEYYYARFKGKGSCVARCEPTVGSPHRKGILIL

SEQ ID NO: 946577 - protein, 58 aa, Homo sapiens
MQEQSTDTEGSSRSSLKDVQGYTFTLHSRQQAHNAEPVHQGLHDYSPRSSILGPQASR

SEQ ID NO: 946578 - protein, 193 aa, Homo sapiens
MEVLTGIGSLLSSPQEELERRVNRTNNEGEQSFTGTHQGTVHQIFIKRTISTVPLSSRQWMTKSNSRMHNWFRYRDQGILQKVVARDTEDERITDRQGGTASGVDCIRFRLENVLFSPHCLKGNIDSTMDDRKNSQPGDTGKEGCLVSVHRCDQRMHAQYYKEHIKYTNAQEKCSMQRQSTRTPHQNNILRHV

SEQ ID NO: 946579 - protein, 147 aa, Homo sapiens
HEEREREGGGKGDNLEEQHTAGATAILMSLIACRWCGSGWHQNSPMRRNEQTMEIYVEESEHGHRYNCQEELLRKLYRDPLPLLPVHHLTLTDHLMSITECYDGHVPMILGPNIMAGRDTEIDHRPLPSDATITYITEGPTPSLHKP

SEQ ID NO: 946580 - protein, 102 aa, Homo sapiens
MDHSTPTAYLAIASTTDLGPEGYPSVDSTSDVVHPITDRPEHRERLKCYTYGTRTSRNYSSLLLPSPPDRGHSACSSMPNGLGVRGTVRPPRTYYSGRPILR

SEQ ID NO: 946581 - protein, 67 aa, Homo sapiens
ALQQQQQQQQQQQQQQQQQQQQQQQHTAAAATAAAAADSSKTKQAEKTHTKETTKHETQKNQNRKHP

SEQ ID NO: 946582 - protein, 115 aa, Homo sapiens
AVRLPICAIQSTTTLDWPHVDSYMTGESLLLPNIPRVRYNTTSAADWNIMMAHTGRYLLQMGTTMPNEEVERAHDRQMLCQIVVAQIMVEPIGRASQASLLTKRIDLDSLACSSR

SEQ ID NO: 946583 - protein, 151 aa, Homo sapiens
LADKGDCRNCIQTVFEGVGCSADVAVVGVSVCEENYKPVRFGSRSNPVDNGFILRDSEGSYLGKSLDGEGILAEEYNQAFKQASQSIALAHLVGKGNHRWRCLIVKQRMGCKHIESASIHDGHTAQLAPVMQGTSYIVYAPLHLDSINGFQ

SEQ ID NO: 946584 - protein, 37 aa, Homo sapiens
PEKRAPKKKEEDKTKEEKKRHKKDKSDKGKQTTGKQK

SEQ ID NO: 946585 - protein, 206 aa, Homo sapiens
EFGTSLGGRCWRQLGTAAARGVLPSTRPQPIKKQRAIGAAGGPNRQRRANTGSPAQARRNEHRATSGDDSGEARTGIHGKPGEKTQAINANTNSRGGPRALFEALALVATTMGQTHYLKRILKAGESCKKPPPDGPNQEVTGTKHPWQRSPRQKENAGKKPLLGKLQGKTCPGGGPQPSSQGAPHLIGPPRNPTPGAKAATDRDLG

SEQ ID NO: 946586 - protein, 106 aa, Homo sapiens
MTPKIVMVTIDIGEAPKGQDMETEAHQNKLEEMINELAVAMTAVKHEQEYMEVRERIHRAINDNTNSRVGLWSFFEALVLGAMTLGQIYYPERFFEAREMFKKPLS

SEQ ID NO: 946587 - protein, 33 aa, Homo sapiens
MDLSRDLTRADSLLKRITLVVALPVLDIKRPEA

SEQ ID NO: 946588 - protein, 233 aa, Homo sapiens
NNGGTSVSKKERPKKERGGIKKKKRPPNTTKKERGERGGNERTIHRQTRKREQRQRRKEKGTTKKGNANTEKHEKGSGGNRKRREQKRKGENQAAAKGGGKKKPKGAKAKQGGENDNTERETAKKHKGEDKKKSEDQETGEKQKPRNARQEKGENDKTEKQRGAKTKREKRGKKGQGTKGQQRNARKGDKGNRNADERRDKETEQSNREGEKKAKRGEGDGDGETGAHDKENH

SEQ ID NO: 946589 - protein, 166 aa, Homo sapiens
MQKTAIIQWPLGMLTPSTCVCHFHLRLVFPATTTLRTCRKTGYKQHMFLTFQLISSSHISIASNALVPTSLHFRLPCHRARSTKGGHTFSSGGKMQSKSTFGKTTLITHWARYLTHTFPTDKRFRPDSYIMGQDFHTRLLNRRTRYILPPNPPPLSPHRADWSNAL

SEQ ID NO: 946590 - protein, 87 aa, Homo sapiens
MSSADYSKLAVKEMKHEILHYPCVASNGPRPVGHPLGTRDLQYVVVQPRLLLTAIINADPANTFCEHAPCKHNSRSRDSLPSRPGER

SEQ ID NO: 946591 - protein, 39 aa, Homo sapiens
PPAAAGVPAPVPERGPLPICPGGAARCQVTLRPVCPRRL

SEQ ID NO: 946592 - protein, 79 aa, Homo sapiens
PMAFCHLVNVHLAAYGGRGESNFGCTKVRHKSGEASASSSFGIRMTLASENELGRIPSLSIDWNKFQKEWVPSYSLYLW

SEQ ID NO: 946593 - protein, 64 aa, Homo sapiens
RDDKRYRIGRVDYGCEKPQKGILLYTQTCFKKNQGSKKAAARRQAKPGLGLPGLNPVVKNQLIT

SEQ ID NO: 946594 - protein, 73 aa, Homo sapiens
SPKDETPETLWDPERGPPRMFPQNSYWFPQTCKIERLVSKVILSALKIEKSTSKEPVDNNGLKKIWYQRAASK

SEQ ID NO: 946595 - protein, 51 aa, Homo sapiens
RVATAMLNRSRCHADPLQSYKPLKGTGIASGSSVFGDVSPLMLPAVPFPST

SEQ ID NO: 946596 - protein, 50 aa, Homo sapiens
CFIDLEMLGRAQRLMPVILALREAEAGGSPEVRNSRPPWTNTFRVCWCMP

SEQ ID NO: 946597 - protein, 77 aa, Homo sapiens
MGHTLDSHPFLFTLLVFMSVRSCWDSAVVLTNLAALLGVKYGRPLTQPNTSCDFCQPEVCLRRAFQDDDARPGFFRC

SEQ ID NO: 946598 - protein, 96 aa, Homo sapiens
GFPGVTTYADQNMPVVKDLVHASPEEETRKHKKKHLVQSPNSYFMDEDCPGCYEITTGFSHAQTVVMCVGCCTVQCQTTGRKARLTEGCFFRRKLD

SEQ ID NO: 946599 - protein, 99 aa, Homo sapiens
MGSLIQATAGGGAIHTPTISVGKKTETYCRIPVSSGLYYSNVVDSSGRISVKNTSPFCLFEQLEDLAFQPTNFCIRVLTIFKCYCGFKEAIDSEVVGFD

SEQ ID NO: 946600 - protein, 113 aa, Homo sapiens
MHLNPAEGGRILISLQFAHGSPSVVKPSRLRTFAKIKTELHPCERVQLLSLDIRYLHNLEEGATPKSVPWDAQMISQILKDLRDSDSELIVLYDKFESGLQSEAVIVDDAPFY

SEQ ID NO: 946601 - protein, 140 aa, Homo sapiens
GGLRCRHPVGGCGRRSHSFQNKRLKLLRMARRMSCIHFDTVRPTTEMIQAYGERTLECGLRVTPYRSHVTRQDTGKGSHIHYEDDDMALPNWLYVLLHDKAALTGTGPTLGYAFSTDYTHRLICEHYLNDDSNTLGATGQ

SEQ ID NO: 946602 - protein, 69 aa, Homo sapiens
GLIDKKGVEEEPTLHMKSFCDHVIDLEGTAGSSSSSGGSKTLETRRSHYDEGPGKTFPSTGRKHVARLS

SEQ ID NO: 946603 - protein, 93 aa, Homo sapiens
REEPPGVLDLFKICMEELFHYQFLLAEGRGNLFIMPCFMQVFWFLTCTNNCTNSLVPFRPQRVLEPQSFLLCIVGEGLSARDYVAFLSYRERS

SEQ ID NO: 946604 - protein, 66 aa, Homo sapiens
RSPFGTFNACADPPEFGSYGRHISLILGFLTLYHPLWLETTVTVCKGIALNDKTNCLVQCQNIYCI

SEQ ID NO: 946605 - protein, 129 aa, Homo sapiens
MAGKSGPAATGVRAVGSGKLRLGGLWEARERDFNRGNYGGHRARFGHKFRELEFQPTGRSKYATTSISRMEARTRKEAKVHKTGREDLKRLIAAGEIPKEDDAWGPPPDRGARQKLEIAIEDNHISLTS

SEQ ID NO: 946606 - protein, 104 aa, Homo sapiens
MDIHLFVTTAAEAISIHAQDSNSYTVPFYNDDEGGASSPTIFFSGSMDIPLSSFSIKACFEKYSYKIREVTKNGLIVTAVFKTDAELKPIPTWLITLNWQIMTS

SEQ ID NO: 946607 - protein, 76 aa, Homo sapiens
GRKTLSKALRSFGPHAPAPDSPVKTLAEEQVEQEAHAQQPRLLRIPEKHPRSRWWHFTEFEGGNKPHRKILEKGVC

SEQ ID NO: 946608 - protein, 145 aa, Homo sapiens
MCDFTDDQTVAGSKLNGHQSSGGRRWINPQILSWHSFESLQFKEAFQLFDRTEMNVKEQDFEHFLPMLKTVATNMDQGTYEDYVEGLWVFDKEGNGTVMGAEIRHDLVTLGEMMTYEEVQMLEVRHDDSNGCVNSEELVRMVLNG

SEQ ID NO: 946609 - protein, 103 aa, Homo sapiens
GALYFINPSGGEITNNHFTLTPPLKLYLCVIPGDQIRHYRRSGTTMTSGQRDTILIRFNNKVERVSDKLRGPVQSHAITATILLENKLFEETMDMRLRGVLYE

SEQ ID NO: 946610 - protein, 99 aa, Homo sapiens
ASVHVRLWILVVMALRYPMAECLNKGHYMSKNESKLMHKPRQGLVTKHTKIWSDMNKEVCGYDPYERFTMELLKEFNDKRASEIDHGVATHIRSMKKQH

SEQ ID NO: 946611 - protein, 87 aa, Homo sapiens
MAKQQLIWERTTCFPKVSWLMYTPMIIWMGSLDQASLTTILDTPVKPMNDEQYDQQVVTMWWYRDTLDEGSEFHWNHSRGPRGRISC

SEQ ID NO: 946612 - protein, 98 aa, Homo sapiens
GISEADSIRAERSRSVALAVLMLLSLYGLEAIHRTPKIQAYSRHPPQNGQSKTLNGYVSGLHTSDIAVDLLHNGERIEKLEHSWSFRQGLVYLSLVLH

SEQ ID NO: 946613 - protein, 125 aa, Homo sapiens
MDRTLLLLTTARRSHRGTSRSGRPRAAAMAVKDTGKTPGEPEETRDRIGIALTSRNVKAMKKVCADSRRGAIDASLIGGPVRDAYQDFENHYKTPRGEGSKTWDLFQMRIHKRLIDLHRPAEIVP

SEQ ID NO: 946614 - protein, 75 aa, Homo sapiens
GECMYQHRFRQRQPYTRTRNDLCNRADMNYSALIMIDDEVTVTEEKIKNVIKAVEENVDNNLASFECKSHEKRIQ

SEQ ID NO: 946615 - protein, 35 aa, Homo sapiens
FKARKPKWNLKGSPFKLTGKPERAEKEGSQGALAL

SEQ ID NO: 946616 - protein, 140 aa, Homo sapiens
MSWMFCLAPGVSKLTKLLAARASSATCDVGARVYPSGQQKDDSDFRPRSLHREVGSAEHDAPVSPADDIYDDLRKRIAYAMIIAAVHDQFIIMSHAHTVSSDGARIDGAVAFMHKLMVLRPDDQLNCKHHSVAEVPHVES

SEQ ID NO: 946617 - protein, 82 aa, Homo sapiens
GLLCCVYCKNEDYGDQSDWRHPRKCRHYSEGTRRFRERPQSNPAEGLKSHNGLKLIGKSYKKAPDCQMTEKHNGTDYRTDYL

SEQ ID NO: 946618 - protein, 215 aa, Homo sapiens
MAHRSPMDAGLNKGHKLTNNVRKPRSSRRRGRLTKHTTLERYMIPKVRGYVPTYERPPMESLKDSKDKRAPKLIKKRVGKAHTSQEETEEPDHVPGRHDEKLMPHMTEPLPRPLPGIKKARNHTLLDQLHHRSPYLSNLPLTRGRLINLAKTRAYLPYLSYTGPSTITGPGLTPPQRENLEFPNTKPFILNRFLPMVLSQRASPNRHTVGQPIAA

SEQ ID NO: 946619 - protein, 187 aa, Homo sapiens
IDPHVLILIAARHCANSPMGAHMAGLPTFTRPFQIETNVGNFEGTFPNNRDNDQTKNPIITLKDHWNANFFAINLPTTVSNTIMKKPPTTSHCINEFKTTLLHLTDSTHSNSAITHPPHGPNFCLRHFNRSQHYLKFVPPLSVYLLGSDNLLDTHPYSYPDAVYSSYSLSSLSFSPLLGQILQFGYP

SEQ ID NO: 946620 - protein, 171 aa, Homo sapiens
GEYLFSMRGMKYWSCCRRKTSDLIHSSAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDDTTDWVGDGRKAITLFPNFNTV

SEQ ID NO: 946621 - protein, 32 aa, Homo sapiens
KGLLPEKAELAGLPFPRLGYLGPPYSCTNSKL

SEQ ID NO: 946622 - protein, 148 aa, Homo sapiens
GGLVLFIKFYNKLFNKTAANNAHIISYSHISLSLQPLYLYSSSFSSLLFIPSRFFRLFFLLSGPPLPLLSSSFGPFFLSGPIFVSVALFLLLGGPPPSLAAAFPPAVVGTPGGSPSLFPPAVSPPLPPLVPPPWCPLLLLLFPPGPFP

SEQ ID NO: 946623 - protein, 166 aa, Homo sapiens
IYFFYRARHVLVHGIPGIYGPGPFSRIRGHMGPINPPKRASTRVLPIIEKKAPPIGGKRHPSPTRGGGVFFNTGGQEGAPPLSTKQRGGGPKKKIKGGVWKNTNLCWRAANLKIFIFFWGGGGGAALFFTPPHNKKKRKTRGRCLPLLGKKKKKKKKAAPPPPFIK

SEQ ID NO: 946624 - protein, 159 aa, Homo sapiens
LDPLKGPRAILIPRNSAIMAGGGIRDADSIRSEMSSSGDLAVLVLISVAGLEDIQPSPKSQDYLRYAAKSARLNCLNRYVYDLHPSDIAGDLLNKGERIEKSGSLLLGLNKDRVIRSLRPPWSYRHCDENPLTLDHVNFLQPKIVKRDRVVRFLEGWSS

SEQ ID NO: 946625 - protein, 218 aa, Homo sapiens
VGRPIDIIRKSFSKPAAWAIAPPDRRAVGNPYERTTIFNLYAQGHRHKGNGVQRGLVGYIIKRFEQKGFRLVAMKFLRAFEEHLKQHYIDLKDRPFFPGLVKYMNSGPLAAMVWEEQNAEKTGRVIAWGDQSSISKPGTIRGDFCIQVGRNIIHGSDSVKSAEKSAYWLSLKNWLTTSLVLMTGSINEDVDTTAGSFSTVVECPWTQLFIPLTYWQQD

SEQ ID NO: 946626 - protein, 52 aa, Homo sapiens
IRGRVDTVREDDRRGLLRRLRQENCVNLGGGGCSELRSSHCTPAWATEQDSI

SEQ ID NO: 946627 - protein, 192 aa, Homo sapiens
GLGSAPLGPTGFGHYGRGGLLSIGRRESGQLSHINCTYKATPAHVQPLDPEQYHFLRVNATTKKRTGRKTLRKRLCYLKRRAGPTSSQEKAFVDAGACPEGMRHNTLCNPEKRSQQTLRKYGERHGNNLEGARPTGGGTMARRISEREKDDCIHKNYKPGPPVIPKRRNSSTRARQVLSLQRVSQFGGGQGK

SEQ ID NO: 946628 - protein, 71 aa, Homo sapiens
GDKNATKGGAALTEKRKHIKSLIEKIPTAKPELFVYPLDWAIVDSILVDRRIRPWINKKTKVYRRRRSYIS

SEQ ID NO: 946629 - protein, 166 aa, Homo sapiens
GREDSFLILGRATLITAHNERRKDYRLASRISIVPDLAEEPLVKIITVGAAQRRMSTCRYYDDEDELVLSVLRSHIGLLENIHMEQLPLRLAARLQGSSWRLAYSSLEHGTRSKTLYRKSVSLDSSVLLVMKDMVNQILVAYATHALKLTDHYWHMRSLALHIQPS

SEQ ID NO: 946630 - protein, 33 aa, Homo sapiens
MAFPKSGSTLKGKGKLEAEKFGKNPGKILVKKG

SEQ ID NO: 946631 - protein, 63 aa, Homo sapiens
WPWIEHYRSARHVDTPEFGHYGRGFLLLTAFLAEMSRSGALAGLALLSLSGLEAIQRTSKDSG

SEQ ID NO: 946632 - protein, 117 aa, Homo sapiens
MENGYTYEDYKNTAEWLLSHTKHRTSSCNNLWFWIRSLTDEINSGPDFDYMKSPTFLEYSARFMLAELVFGFLNGRACVMQGFHMYEYPLLGDIPVRSTFVVWTPGSSPMQQRVPNL

SEQ ID NO: 946633 - protein, 65 aa, Homo sapiens
IDFGGTVRNCVGPGKLGHKGRPGINALKAFLNLSDREEAKLTKTELENMVETDTCSKTQPISRTC

SEQ ID NO: 946634 - protein, 168 aa, Homo sapiens
GKDGNARGTTLLEVLDCILPPTGPTDRPLRLPFQDVYKMGGIGTVPVGRVETGVLKPGMGVTFVPVNVTTEVKSVEMHHEALSEAFPGDNGALNVKNVFVKDVRRGNVVVDSKNDPPMEAVGLTVKGIILNHPGQIGAGYAPVWNCHTVNMACRFVELKERIDRRFVS

SEQ ID NO: 946635 - protein, 103 aa, Homo sapiens
FSAGPGVRIAYAGLCYAVWTWLSRGKPCRYPKEGGGRNLFGPGARENGAPRGGQGGGLPEGSKRKNPPGGPLEPLLKNRGAPAGEKEIGGIGGGNKKNPRGWG

SEQ ID NO: 946636 - protein, 58 aa, Homo sapiens
MQGPGVYNGWNGKTLGVPNLNPLEENPLFPSGGIPKKAPPERPFRCPTLMGNGNGAFF

SEQ ID NO: 946637 - protein, 103 aa, Homo sapiens
MASAYELACIYSALILYTMKETAMEDKIKALIKAAGANVFFEGGSAKALQKETSGAPYAMQGRTMLKKKCFQAERPDPFIDYGSTEENIANLKSQDGVSGEDQ

SEQ ID NO: 946638 - protein, 74 aa, Homo sapiens
GIPESDSMRAEMYRSVALPVLALLSLSGLEAIHRTPEIQAYSRNPSKNGKSDFLTGYVSGWHPSNIEGDLLTNG

SEQ ID NO: 946639 - protein, 108 aa, Homo sapiens
LNNRIGSRAIALRPRNSAIMAGGSKRNLNISTLDTGCQKLIEQAKKRNLRTFNEKRMVTNEAELSYGRKMQGICGTKQMDATTDTVSALNKDVLTHGSERLILNEGKL

SEQ ID NO: 946640 - protein, 75 aa, Homo sapiens
MDNTLSHPTFLPAPKTPFPRRSLSKKAPLKKHNAEKAHFGVGKILGPKIEGKFLGKTLEKTTFNNGLVPPPLFRL

SEQ ID NO: 946641 - protein, 86 aa, Homo sapiens
GLKLISGQGAGYHKHPNGTSLTTRHHQKQAKQTFYEPNDAHETTTYRSPSSDLLDMLRLYSENQGGAKNVMKKDITRTRGLSLGQS

SEQ ID NO: 946642 - protein, 67 aa, Homo sapiens
RFCSAPPVGTTEFGHYGRGGKFYFERKRRVNIKSQNPLGSNTDSQEIYDNHKIPGDYHPKPPKSEPH

SEQ ID NO: 946643 - protein, 187 aa, Homo sapiens
GSVLSSERNSSLVLCRKVEIKTLFQNWQSVSEFLKQALFIENEEQEYVQTVKSPNGGFGSAVFSYPTFNPSSDVPALYKAIVVKGVDEATIIDILTKRNNAQRQQINAAYLQETGKPLHETLKKALTGHLEERSVVALLKTPAQFDADELRAAMKGLGTDEDTLIRDFVHQELTKNSYPLTGSTERN

SEQ ID NO: 946644 - protein, 261 aa, Homo sapiens
TQREGPLHTPLTLNTYSNSNWGKTPEGGKKGGKTKRRTGSRTKRRGKKEGENLRKKGGTQKKKRKEKPQEKRKTKKTEQTRKKEKKNKKEEQKTKRKRKTGEKKTKSEKDKKRTKQKKTKEADKSRKNQDKTAKKERNHNKRKKKENNTKGKTQPEPNYSAKKKNPQKANRQKREKDPNEGQDQPGEKARTRKEKWHATKKKEKRRQKRKRKAKKRENPKGTETEQNADWGKKAKTENAVKHRTNKETKRTTKKETGQTGH

SEQ ID NO: 946645 - protein, 82 aa, Homo sapiens
GAFFSKYARGEGLSTLISTSPPTYTSRIEHAIGVSEHNGPAPHPLTLDAYGTKRPSLLREVQRVSNATGYFLKIYEKVPPYS

SEQ ID NO: 946646 - protein, 98 aa, Homo sapiens
PLGSLAVRDMSQTLRWSSSSGQKAAGAGRSPVCPKLRGMILSYPPPVVENLRTGFNWPFKFSSKRLVNDNNAIVKPSEGKENGGPLWFSFLRVAVLSY

SEQ ID NO: 946647 - protein, 231 aa, Homo sapiens
GEYTVDCVRVLGKHAGYYTDTHGCIANRMLVIYLMQALRLRERGDACKEYIDTGMKSGVVYTMGLFELLEYVGLHTAKFIEDGWIEMDAVNPLHKPSQYLNELMADNTFGMKTGYGFNKFIDEQLSPALRRTPESAFQPMLLVPAGMLCAQTFAHTVQPNKCALVIVIYLSDYYASYSSDRFFIQNYYRLQSVAFWVFAKQIYTIGCQSTHVVRTLVIVTSGLHSSVITVV

SEQ ID NO: 946648 - protein, 69 aa, Homo sapiens
TRTCLSLVPAGKDGAPECVYPYFLPENGTAILNVSSPQFLPGKWSRHLETCLVPSSCPEDGAILNVSSR

SEQ ID NO: 946649 - protein, 166 aa, Homo sapiens
MAGEKETGELTSPQDMSRQETSGRNQGSVSTTGKRKREAPESSSEPQRSRAKAQPRQGELKNRQARRVTTNAKPGHAKQIKERTASDRGPQRANTEASAKQADGRELCTEPKENGPQRDAKTTRQRADSPKEHACHSRRQEPVKTTPTHQAPDEHKHERGHKKAQP

SEQ ID NO: 946650 - protein, 103 aa, Homo sapiens
MTLRNRRYGVVPRKFGHEGRGLSSTAVAESQVLLARQNVRVNVDCGGYRQPWDRDDVSSLLTYYRLQEVALRLCSLELRLVIHGRADYAARFLSYTLEEKLYS

SEQ ID NO: 946651 - protein, 104 aa, Homo sapiens
IDLPLTMSWMYCLAPGIMQPDETAVVARSDTTCYVVARINPSGEQMDDSYFGQRSLHCEEAEPNMTPQCAQLMISMRTSGTRIAYASIMEPAADQFIIIAYAIL

SEQ ID NO: 946652 - protein, 142 aa, Homo sapiens
MPNGWPERYYGLPKAQANCRSPIAECQFPVPRVHRHLTPRTSNDQPWTSTPDCHCAHIMHSVTPDLLGPSTDASCVLRLKGITDYHLQLATRYDEEWRTVIKDTGSNGCGRPHIPHSLIANRGHGQLTTGCLEPGIPDDSRL

SEQ ID NO: 946653 - protein, 66 aa, Homo sapiens
IEAPAPFALINGLSPFSSNPANWPIMAGTTFYVVVIVHTKLRWDSCAYVGLYFVSMSDKPDMADIE

SEQ ID NO: 946654 - protein, 83 aa, Homo sapiens
FAAASTRRQKGTPIRKINPLIKLINHSFIDLPTPSNIIRMMKLRLTPWRLPDPPNHHRTIPSHALLTRRLNRLFINRPHHFET

SEQ ID NO: 946655 - protein, 40 aa, Homo sapiens
TLVKEPGIKGPEPIETQPLRELLSNSLTVAHDPRREGPIC

SEQ ID NO: 946656 - protein, 152 aa, Homo sapiens
MPVDRTFRSDSLVVCEVHPQLTEKLRKSRFRNETDTAAIIMKADIDRHMVVLTVECSEHLPKELKMADPVRHAKFEDYSYKCPHDKRYNDLPFESSNIQSCGLDATTNHDECRVYKQASAYSRAYKSVLRTTYDLTEDWLQETPSFMRRSTI

SEQ ID NO: 946657 - protein, 69 aa, Homo sapiens
GAPEISIRKGGRSIWPSDYNRDFRYTFCIRNSLEDLCKESKLDPGTGRATYEQLIDHTPVVYQDRREDP

SEQ ID NO: 946658 - protein, 132 aa, Homo sapiens
MVQVKKYLNFLVHEATSLMATIIHLGKSSLPNKPLTGDNVDRIYLCLKVLSACSPLMPDILNKVCRQSVPHMLSAKLEERTYPKEIIGKRNVTVRLRPHLLQQLPLKCKDCPAIYAELLAPWATPVEEGGNP

SEQ ID NO: 946659 - protein, 54 aa, Homo sapiens
MYFKFLRDLKVWTSKACFTKRLPAYKIASQLTLIPRPTQQEGLLKQYNSRLLVD

SEQ ID NO: 946660 - protein, 140 aa, Homo sapiens
GAQKREKRWVLTSPSWATLGTLGNLAVLSCLKDIAIYCRPEPLPLKTWKGWKNINTAWNIQGGLISKLHNEQGTTWTYVRAMIKLDLNLNERIMHAQPVTNTKEVKWHKVSYERQPFPDNYVDRRFTEELRTSMLGTYWA

SEQ ID NO: 946661 - protein, 138 aa, Homo sapiens
MAGGPIETSVFQKETNGSNGEIIGENARDPQEAKNNTTTLEATGNANEFATNLPTTEVNAIRGLHRTTAHGSCERGTGERRPADLTDENSEYTQGLDGPCCRDAARDAPNIPRSSSDIRLVDYAAVLRIKGKAHGQPH

SEQ ID NO: 946662 - protein, 182 aa, Homo sapiens
MAKFVIRPATDDDCSDILRLIKELAKSEYVEDQVILTEKDLLDDGFGEHLFYHCLVAQAPKEHWTSEGHSIVGLAMYYGTYDPRIGKLLYLDDYFETSDYRGYDIGSELLRNLGSFNDVTLQQLHLVAECNDHASTTIDEEDAYDLYNDDDRLIKIAKSTRFGTRMKTAADDDTYILFEFPL

SEQ ID NO: 946663 - protein, 214 aa, Homo sapiens
GDTQVWIHFKRATHKETTMSLLPVPYTEAACLPTGSTGTIKGRPLACFLNEPYLQVDFHTAMNEESDIDLHFQVCFGRRVDINSREYWACKQHVESNNMPFHDGQEFELSISLLPDEYQVMVNGQSCYTFDHRIKPEAVNTVHVWRDMILTKFNSSYLKKITRLHVVKEYLTVRELGIPKPANSMIFSHFNPYSCSFLIACGRILSLRVARLGQ

SEQ ID NO: 946664 - protein, 150 aa, Homo sapiens
MLFKLGQFLARGQNWAQMGKMPQRGGGKKKRGRVLKTVKREKPGGPQNKTPGKKTPFPQGGKNEKGPTKWAFKKGGPPKGERENGTEKIWKKTRKKCGKNTQFLTKGGKMGKNPYKQKKIPQKGLRVPPCGKKAPLKKTGPPNLRGKTRI

SEQ ID NO: 946665 - protein, 72 aa, Homo sapiens
GPAVFDAFFPFTWVHADRSGTAARYHGESDLELVLLIRKPCTLHVINVVIDGCLATLSGTCTCEQTFVSLPL

SEQ ID NO: 946666 - protein, 151 aa, Homo sapiens
MTKLKLFQASAGTVADGGYANEYKRLRRNSLTTRTTERAKTTHKPEDADCSENNDNMTERQQRADENTEAAKRSATRDYNPLAVHMRHCSRGHHASASYRTAQQTKNCKKLLHHRTTVSYALKERKAPVNVPTPMTTGDEHHNASDSLSPT

SEQ ID NO: 946667 - protein, 70 aa, Homo sapiens
GRRGHLNLLRTAPVSWPLRVFTIDAWDHSGYSLVTPTCVRDENMHKAVDDDVGMEMNMMIIMQQYMDDGH

SEQ ID NO: 946668 - protein, 115 aa, Homo sapiens
MHNAVDEVYWMHNALSNMLNFRYTEIDMHLDTAGCIHADSDQCNTFFRSFGDMISDTMGLRYQANNLENARLTQVVQVYRIPLKFADVVPVELPMSTIDAAAATQCRDFDRRTYG

SEQ ID NO: 946669 - protein, 66 aa, Homo sapiens
RDLVTEAFAFYRRYHALSGPLFLMLSLTVDVDLVCRTLIADSLCTMRHPRITVSEMHWTILTEPFT

SEQ ID NO: 946670 - protein, 156 aa, Homo sapiens
SQVLFTFRLMCIRNSPRLVWVTVPAVLTRGLSRETNEETIYYYCSSTGAWSERARKAYDENWLTFEIRPATDAECRDILGMIKELAHYAWTNKEYYLLTICWKTVLESTGFTSVWLQKCRKSTGLRKVTPSPLQKPERPSAMLEDAVGCAATDDTA

SEQ ID NO: 946671 - protein, 103 aa, Homo sapiens
APEGREDKGRKGGRKRKEEKGKEGRERKEGRGGEGGGKEEREGEEGGEKRGKEGRREEGKKRKEEREGERRKEKGGKEERGGGEEEEGRDRGKGGREKRGRGE

SEQ ID NO: 946672 - protein, 275 aa, Homo sapiens
TSDPLHPLTAVASRAMCRHPQRRPLWPGTTEANPDFTHAPTRKQTNRRTSPHPIKSRHQTTQQKTSKPNPGTQNRNRIPKNQNYKATTAETTEHADRANRNQTMDSTLKTTANVQRDANSSTRTPIQIRHLKHAATTNTRTHTHPPNPRRPCPRNRPPAHKAHNTRPHTKQEPQHPRDHRPPQTHGNPQRYLPRTPDALSPRHPEHSKPHPPAEQPRPQPPTRLGQAPTPTNPPPPSSRHQGPRTHGTTARRPHRAPRPHQAKVPPNYPADPPRS

SEQ ID NO: 946673 - protein, 105 aa, Homo sapiens
MPPRKGFTTLPRLTDSPGTNRTRSMLVYMLRCSLHHGISGHYHQERLSSVLYKTLKMAQVVSCNFTNLSTGDFRLLIPLPPLFTSLVDLERSSALRRAPRAVPPL

SEQ ID NO: 946674 - protein, 117 aa, Homo sapiens
MHKEEHEVAVLGAPCSTILARSTVINMHSETSVPDHVDWHLCNTLFLNWCCLVFIAYAYSVKSTDRKTVGDATGVQAYACTRKCLNIWALSGHAHDHWIQPDTGIGLCDSLPYYDTV

SEQ ID NO: 946675 - protein, 46 aa, Homo sapiens
MHTLSQAIVIDPWYLSADLTVPLAEVRIPSISHDQDLEVVTCCIGL

SEQ ID NO: 946676 - protein, 160 aa, Homo sapiens
WLLLLTTIRSAMPEALPKLSACYSLFLPWRLFCVLTSCSCLPRSSVLSYVNGPGFNVIHGHTSHITLALSDESPTVYLFLSLPHSASGMNQFTLLQAFQRDPATVGPAFHTSSNECDSSKVHALLRPSPFILYLNARPKAYLFVSELYLSAFITGASYAA

SEQ ID NO: 946677 - protein, 171 aa, Homo sapiens
EEKRKKRAHRIAEAKREGVRETGRKKKGGNRKKRRKKGKEGEKKKGKRRERERRRKKREKEKKKEREEEGKKKKKKREKKRKKKKKKEKEEKKERKKRKEERRERRRKERKKKEKREKRREKERRRRRKVEEEKKKKREKEEEEKEKGKGEKKRKREEERKKEKKKKERGK

SEQ ID NO: 946678 - protein, 182 aa, Homo sapiens
ERRWKGREEGADNGVARLGEREGGEEKGGEEERGRKGKREKEKEGKGGKREEKGEEKGEREEREKKKGRGEKKGRGKGRGRERREKEEKGRRGEKEKEEKGRRERRRRRGGRGEGGEEKGEERKGEEEEKRKRGGGEGEEQEEEKEKRRGERERKREGEKEGGGGGKEERREGRGEGEGRER

SEQ ID NO: 946679 - protein, 148 aa, Homo sapiens
TETQGFLEEGGDSKEYGHPRFEGEDGRKEGADACRANCHLRDRTVYQRRTRPQAGFRITSLKATASKIPRYNGSLTISRVGLPSTKSQFQAYMRHLGDHSDVTGGKPAASQCGLEARYKRHDVRMANVLQSDVYNQCARVPDRELSRA

SEQ ID NO: 946680 - protein, 211 aa, Homo sapiens
MSRGRYGAQASRRARFKTSSGDAKERWDLPAQRREDTPTAPPLLQSESSRCPCPGRRLSIFLGPQSSKTFLRMTTRRSGCSGGARGSLICSSALTHLAHWPPAPAGVLTFQLLFPSLQTRSLRNITAPDETVHWYITTKNAFGEHLHDMMSETHQQKDTEPTNCVAAATMDASYQIYAARVDARHADEYRVLDGLVRAAPVFVRSLAHVAC

SEQ ID NO: 946681 - protein, 185 aa, Homo sapiens
MASKRALVILAKGAEEWPTHIPADDMRRAVIKDTDSDLLEETQYSVTVMWTFVLMPAFMMQTKEVPYDVQGLPGGNLGAQNLSESGAAKDTLKEQEHRKDLIAAICAAATDMMTHEKGYGSKATTHPLAQELNDGVLYSYSEKCVDKDALILTGQEPEDQIEFALAIVEALNEHEVPPQGMLHLS

SEQ ID NO: 946682 - protein, 101 aa, Homo sapiens
DELMGSFLTGVHHEARDTPDLQKSTDAIEANLETRNMMRWELYQSSKGLYSDMPGEGVRLNRPLNTVSSDTILYALEMHKSYILLIDTSLGQLLINRNSPN

SEQ ID NO: 946683 - protein, 211 aa, Homo sapiens
SLSLQGFTGRGCEASLCKSFSDIIEGEATHAIDAGMTEQMTFRGTLKGHNEWVTQMATTEQFQDMILCDYRDKIMSMGQLTRDATNYGVPQCALRGHSDFASEVGMCWDDQLGLSGCCDRTLRLCDVTSGTNTRRYEEHTKDALRVCFYCDNRQIESGSRDRTMKLWHTVIECDTVQDESHIKWPLRVRFSRNSSNHMIDSCDWDKLLKEL

SEQ ID NO: 946684 - protein, 187 aa, Homo sapiens
EKKEEERGGKNREGKERTKTWESESKEREGRDEKREERKEEEGRKEEEKGEKGGEKKEEGKKKRRREEEGKEKGGGKKEKRREEKGEKEKGRGERKGKKEKEEERREEKKEREGERREKERKEGRKRREKEKKGRRRGRERGKERGREKRERKREGEEGEEKKKGRRKREREKKKGEKGGERRREGR

SEQ ID NO: 946685 - protein, 182 aa, Homo sapiens
TYLAGLILLSNEGGFSQGEAYPLCSGCADLCDFPKRGLDCIICVSAGLRSRCPLELLRCEEEMSRKCFWNSVFVLVFSGCDLPGQVHRTAPRRPQVGLYSKLQHFTCHSFCCLSNLILLAWTRYSLQPILSLARVSFTAALPSLPLALIFLLVTLLISLLSIRRFTPSPPFLHRYTPSPFLL

SEQ ID NO: 946686 - protein, 199 aa, Homo sapiens
ALARLSCESDIVFKPCVAIPDAPSRCPGTTVRSGSPSTSLRSSYYPLITSRVLSESSRHVSLQADAPSCDRAFTRWQICIGTFTSDAQAHTRAPEDQTRHLLIGVSSERGLCLAIHSSIAKQVQCQVAPLTAAGKEPIPAPTRDQIRGIPLSASLLPISWLPLKHSSRKPPTFCTRFYSFSSDILSSLLLLSNSPSHLN

SEQ ID NO: 946687 - protein, 149 aa, Homo sapiens
QPGHYGRGGRGLTRLILAPRETEGERGGMRSRDSPPTYGGRVAPNKQEGAAGPWLNTQKQTAARGTAAPSPGQEFENRHTHKGKPRCEERNQTPAGRGGTPTETHSPGRLRQEDHQTPKPEAAPSPDPTNDPQPGPEHDSRANMPGGGS

SEQ ID NO: 946688 - protein, 176 aa, Homo sapiens
MLWLNHALPSRQWRLKIRYLPLPTHRTRPILRIISLLRNLKHRHYPPACNYSNSLHRLCPPVRPNIILRGHSNYKLTMRHPIHCDRPRSMNLKRLLSRQSHPHTILYLSYLTLQYCSPSSTSPSILAPNGMQRPPKDQRPIPINHLSTLLHIQRRPRLTLLPGLLMDYNHYLTWTS

SEQ ID NO: 946689 - protein, 135 aa, Homo sapiens
VRHTMLTVSVKRDLLFQALCRTYTDQEFDELGFEFGLELDEITVDKEIISKEQGNVKAAGASDVAIYKIDVSANRYDLLCLEGWCTGLQVFKERIKAPVYKRVMPDGSNIDYTGETGQIRTFAVAVNLRICLLDR

SEQ ID NO: 946690 - protein, 112 aa, Homo sapiens
MGEIASSDKAKLNKTATLEKNTLVAKETIEQEKRLKFQDPGGFPTPVLFSDPSRNVGEEPPARWTRATSCTVNLGTSAPMPPACGALKGSLPNRTAKILGLPRDIIDYQSEL

SEQ ID NO: 946691 - protein, 187 aa, Homo sapiens
EKRRKESEREEGKETDRMESEGRGKREGGEEEEEKRKGERGGKGEKRRERKGERERKKGKRKGKKRKKRRGRRKEKRKGKKRREKGKKEKERERGKRGKKRERRRGERKGGREKREERKEGRREERERRRGRGKERKRGKKGERRGREKGEEKRRERKEKKERKGERERGKRREERGGKEAKGGRGG

SEQ ID NO: 946692 - protein, 83 aa, Homo sapiens
HWTFRPARVCLALFPSSWDTDAQRHTKIIVGRGERPGSTALGQPYLDLRTSGDEPDLASKSSVIQVVANVPGLIKIVNHRMEP

SEQ ID NO: 946693 - protein, 129 aa, Homo sapiens
NLKRQGKGGLSGHRPSIADTTAALRSTQKTTLLKPSLNTILTQSQKMHMEEHEVAELEAPTSTILPRSTVINIHRETSVPDHDVWTLVNTMFLNWCCLGFIGYAYYGTSRDRMMAGDVTVAQAYASTAK

SEQ ID NO: 946694 - protein, 171 aa, Homo sapiens
FKELISSMREMPDHNTIIKQLIIQMGRSLINAAFTMITRANPVNVIIMIKRREPGSTLNNKPASILIKNIAPAVLNTMIMAYTGTKLATTIATKESKNRYITPAMAAFILLISLLKPYIQSNNNPMATYIGGESYLVAVISIYLAPQASPAVATKPKAVMSHIPFNILASC

SEQ ID NO: 946695 - protein, 191 aa, Homo sapiens
RHGTSGDAETRTTKRARATIEHPWDTPQSSKDDPTGPRAIDAGHANSGIRVGGGTDKDIFYGEAAFNITRQHHPGKEHDGGDEQHATRTAPEAADTRPPTEAPHPTGRRATVRRGAHPRPATRPKTNASAPEGAPPRAPTRTRHGGTPPRTQRGRAGARSARQRAQPNYGNPDEKKPETKDEGKNNRARPG

SEQ ID NO: 946696 - protein, 142 aa, Homo sapiens
TVFDGRGFNAYHREILRGAARYSEGATYSSKALVSLLSAYCRDSQVTTTVFMVVTWVTLVRTYWWNRLKRNYFSIRGTLQLSHNLSLLGYVDYSPRALVTSVSLSQDAPITTRSQLLILTHDPAYSSVVPCRLFEYSILLNW

SEQ ID NO: 946697 - protein, 119 aa, Homo sapiens
NNNESFLYRIVMCAKRWILYDNLAMTSSVAGLKEAPKHFPKPNLLQKMVMVIVWWFAASLIHYSFLNPGETITSDKYAQQINEMHQKLQCLQPALATRKGPILFTTTLGRTLHNQRFEN

SEQ ID NO: 946698 - protein, 99 aa, Homo sapiens
VFKVKTVFVMHVRRVYSVGDSKLDPPMDACVLTAQVIILNHPFLLTAGYAHGSDCHTINIACKFAELMDKIERRSGPMLKEGLKLLTPSEAAIGLLGPG

SEQ ID NO: 946699 - protein, 300 aa, Homo sapiens
EEGERERGGPGRSHAHGKTGKEQEKKGEENTGKEEEKGKREGKEEEVGEKEGRRKGGKKEREKRGTKKAKEEGRKEARGEKDEGGTKESREAREEEKGEKKGGRGRKEKEQEEGEKRGREEKKGERKGEESGGRKEEEGGKGKGKEKGEEREKGERGRERREKGREGQEEGEEQREKERRKGGERGGKKEERQGGRREGGKRKGGRKKGEGREEREEEEEKKEGKRGKGGKRERKEEEEGKRKKKERRERAGEKGKKRGRKRGEREREKKGKGGEKEGKRGGGEEGEGKREEKRKRGKEE

SEQ ID NO: 946700 - protein, 252 aa, Homo sapiens
GHYGRARWFMPVIPALWEAEVGGSPEVRSSRPAWPTLVKPRLYQYISWAWWRTPVIPATPEAEEELLEPGGWRLHAAVIMPVHSSPWSQARTSGSHLYSSIRYALLLVLHWYPSNTHVLTPASTGLSSFYYMSSYHYLPTSSLSPFSSQFYPFSLLLLRTDLPIFNLSLPSFLSASLLSFTTPSSTSPLSTCLAFIPFLSFALSPSHHPPSPLPHFHASTPLPTYPLSLSFHPTPALYSRPHPSSSFTPPPP

SEQ ID NO: 946701 - protein, 214 aa, Homo sapiens
MYAEARNGLCVAALLLYITPKGRVSDSYDCGVLRRRENYHGRSAGREEALCTLLTDSGALCTYNKFTLAKLRRSICLQCIALLPQCTYTVTLSLDLDHVCRPRSLASFFDAMRGISLQLLVPLDSRALARDRTYERHCDCVSCILLLGINHDPKTIMHRLSRSRYGTHKALPQSTHVPLVHERPQYATIVGNVQRAYRSYDLQPGRGLIIAFHP

SEQ ID NO: 946702 - protein, 288 aa, Homo sapiens
MNRSCLDHVRDERTETSSYYYGTPLSLYRMEESHHLQRSTHLTHRDAHAAITCSATSDRRQAQRDVISYLTHDILMILYDTTSRAIDIELSDAYATCTQTANQPIMTDRPHLDNMTMDTRQASDITTHSLTYPHIVSHKYSDRTYHYFITQLHRLMIDVYRDNGISMSARDTLGPSTVYEIETQALIRLHAVLTRMHIRPRRSELDIGTASTSIATNVSTLISGVRPASELPYIRALSPDINLTIDDTLTSSARVPTIRTNTKVVIALRAYSDINAYSLFTALSHVTK

SEQ ID NO: 946703 - protein, 144 aa, Homo sapiens
LSHQILDRASSDRGAGYDYMAPGHATHPAVPMALGGGYHASPSGGGKALSESAVIPVMSYGEALKEGVAVTARADSCLYSEHFESLSGAESRCQELGTILDSTAKPYLSYNHCRLVCRGDERLQCQTRASREPRNRFNLCGEAS

SEQ ID NO: 946704 - protein, 126 aa, Homo sapiens
MDRKYIRNYIVYYSCQGFHGVTTDYAQRAYRHQVACTPFSGLYTFSRRIHLSSSWRLQPGSALVRFPTFRIVPKSYFIQFADLNAIFSRLGLFHNTAVRRIAPFSIMAQSLDLMYGGFYSSYFAKR

SEQ ID NO: 946705 - protein, 70 aa, Homo sapiens
CVELGVSRLRYVAVARNQAMPFAHGHDDQDHEGELCVVSAHDGLRPHRCFRVTVCHVSPFDDYVCTDYEA

SEQ ID NO: 946706 - protein, 76 aa, Homo sapiens
HNESTLWRQDVASAGDMTGLSQGVLDRQKNLGREDLHKVQRLDDDISADVRTQRYSRIMQQMKEEEDEKTRLPKML

SEQ ID NO: 946707 - protein, 248 aa, Homo sapiens
RLMTRGPYTFRGYYKSPQHNASAFDANGFYCSGDLISIDPEGYITVQGREKDQINRGGEKIAAEEIENLLLRHPAVIYAALVSMEDELMGEKSCAYLVVKEPLRAVQVRRFLREQGIAEFKLPDRVECVDSLPLTAVGKVDKKQLRQWLAVTRISLKERTDGYSLQAYALAESHDIPQNKVDWAFEPQRAALLIHDMQDYFVSFWEKLPDDGQVIANIAALREYLKQDNIPVITPANSKNRTMSAAVC

SEQ ID NO: 946708 - protein, 218 aa, Homo sapiens
TFAEVTTYAHENMTVEQDILHTSPEEENRNHKTKRLEHSSKFYFMDAKCPQCCTSTTCSSHAQTDDSCEGCCTEHGQPTLGKARFTEGCAYKRKQDCTLSKEEWETISMNTFRMMDGDVTGAQAYAYTDKCLNISCRTLGTIMIRVVLLPGCRNASYYANMPRESRITSHCTRLYKSGLLELSVNRCNCTVGHAAFGSLCKPEMHQTYALPRSVTCER

SEQ ID NO: 946709 - protein, 77 aa, Homo sapiens
EHNQNYYTKTNNINKGETQDINGNPHKTTKGTNTLKKPTPQNKTKKTKPKIEINTITKKPPTTHNTKNERKTIKPPQ

SEQ ID NO: 946710 - protein, 137 aa, Homo sapiens
MARDPKKHLKRLAATKHGMLYKETVAFAPRPFTVPHKLRERQPFMIYLRYRLTYALTEDEVRMICMQRFIKIDGTVRTDITYPAVFMDGISIDKTAENCRMTYDTKSRFAGHRITPDECTDRLCTVRIFVGPGPSFA

SEQ ID NO: 946711 - protein, 251 aa, Homo sapiens
IGHKAGDSGRQPEVQHKPRRAQAQEESQKAPRDEERKETRTPTQRRRGKAESDSNQSHRDSENKQEKEPKRTENNRDHRKDEEDEPTREPTDGKQEDTQTTHERPTEQTTGPTNHGDPNEKKAQDSAQEQRKRPKPMTERAKTRQGGTTTKAISDNSRQHPKDRTGAARTREKTDTEGRLNKAQNAADGERQTKTPRKDESWQIKTKRRPRKINKGQHKKANPGKKAEKPQNKQDDKRCPQATRRNKASGR

SEQ ID NO: 946712 - protein, 94 aa, Homo sapiens
ELSRLPKTEKGQRGRGTCKEDSPTRIDNATQRKLEERQTKEKNTKTGPRKTKKEEKKRKQNDRNKEAKGERKTKQSNGVKTEEKEKNLTEKKDR

SEQ ID NO: 946713 - protein, 140 aa, Homo sapiens
SSNVVHCDPTMASRIRDLITQREVTRALLGGLNECDTLELTLESRRLEVAKPNSKDSYNANGLCLPVGSTVRYLYLRGGAEDASMTKIYGGRQERSYAQPLQLSFQERDPVGSCTHCGVLYPFCLLPKLADLSATRRFTL

SEQ ID NO: 946714 - protein, 136 aa, Homo sapiens
MAGSEAADVIEGEAWDNQRIRATMMNRLLKDMRIKLLMSSYLWSVPMNKSTCIAFMLLTSVNDARVTIVRVQEQTRCCQWTRFMSSGAIRYKNVTRVSSYTRATRYKDIDMSMDSDLRKRYIDLVARYTGGSRAMV

SEQ ID NO: 946715 - protein, 144 aa, Homo sapiens
GRARCRIPDLTEICFTKASMANKMEQIANAQDDPFDRDIINIKSMPMNEPQTTCYDSNTLYALTRYSRLVQCSRRTRSSEMTRYQALRGYQLQQPYTGYLKHTGSEDMELRIPQYTSMAKRIIDYVAYTRVSRAIRRRLSPYEV

SEQ ID NO: 946716 - protein, 177 aa, Homo sapiens
MAEDMECMPVTKLIRLLKHMRIKALAEKYLCLLPITESEIIECFCDALSRMRLRRLSQSARAVTDRDMTFTAFAAIELYNVQVELDDTESMQVHHDLGDQNIVIAPVHQLGLHELLFVTSANADLLIVSASADAVADIVMHTSTMTSAFNVALPDIVNELSIITTASTLACITQVVD

SEQ ID NO: 946717 - protein, 115 aa, Homo sapiens
YDSYLIYSAIWEIMARMVYKFERLLTAWTTHLIEVISIKSMPCDHLMFIAMILIDSITDSVVIIVTVQLEEQTSVLTHYQSRLCNSISTLLALPDYNGRMDLDVDISTYMSMVMT

SEQ ID NO: 946718 - protein, 200 aa, Homo sapiens
TRTHIPTQRYHTHSTPHCNSTTHDHHRPMQRTEPNTTQQDANNSHMTTNNNMKYHGDNPIPNATTTNDPNLITAALLLLSLPVLAAGITILLTDRNLNTTHTQPHQPTNQHKTQKPNPHTTTPHHQPHTTHLTHTKPTTHQPPPPQQHPTTTPPNKPTNTTQQQQTQHPQTNPNKPHNPNRPLPPPKYTPITHTPRPNNY

SEQ ID NO: 946719 - protein, 77 aa, Homo sapiens
GRARCLMPDLSAICFTMARMAYKTQRLLMVLADPLAIVITSLKSMHWTQSRAHTQYYPYSLCTDSEVTISPVKVVDQ

SEQ ID NO: 946720 - protein, 78 aa, Homo sapiens
HYGRARWLTPVIPALREAEAGGSRGQEIETILANMVKLRLYYGKRKKIGWALVAGAFGPSYSEAEAGEWREPRRRNLQ

SEQ ID NO: 946721 - protein, 226 aa, Homo sapiens
LPLRFFAVMADRKFSAPRHGCLGFLSRRRTSRHCGKVKSLPMDDPPKPLHLTDFLGYMAALTHIVREDNRPRSKVNKKVVLEPATIVQTPPMLIVGIVDYEETPRGLRTFKTVFAEHISEECKSRSYLNCHISKKTTFTTYCKICHDVDVPKPLLDDSKGMKMDCQAILVLAHNQSPCFFTAQRKANLFEYPVDRLHCVQLYCSPLHGSTGPYEPRVWTGEMFHGL

SEQ ID NO: 946722 - protein, 105 aa, Homo sapiens
MSDHGDVSLTSKDRMRPLSQMSRAVDVNEDIPTRDTFSSGVEIIPMGYIYSDEGNIEHAFMLYNKYMTLSIEKLPKHRDYKSAGIPGKTQSEKLKDIAFSKAEEL

SEQ ID NO: 946723 - protein, 226 aa, Homo sapiens
ALCPHSSITRVYHPPLLTLPRVTPQALDSMHMPLFFCGHLRRQRLAPKPRLDHTHAIERMHSSKKGNPRRTEASVTKGSPIIEPYFSQEETKGGNQQRYPTCAKEKAQQRGRTQPTGEKRIVDTAKNPRYPHKTLNNCRHMQNPIRSPTPFQEGGLRKHNAHKKSGGKTTDTLLADNLPREPPTGGEKGEDLSIGSTPISGNADKAQTTQMNQKNPPHTKLTKDPG

SEQ ID NO: 946724 - protein, 114 aa, Homo sapiens
MSVETISGHVLDGLISHLLRSHFEDSLTLEYHITLMSDNALLNRCTIAIGTSHVTYSNNDSSSKVACIHQLHQSTLHVDDLRSAVFRPHYEAKYFIRIDAMHLSERTKWRIHTR

SEQ ID NO: 946725 - protein, 175 aa, Homo sapiens
GAGERGGGARKSVGKRPWRAMATGRERRRGPGRGAGGRGAEEDAELGERGGRRREGGDEARREGPKRGTRGNPGGREGAKKGSGRSGGRAEDERGGRERQEKGENPGGGGEEGAEKGEKGGRQGDRAREGGGREEEKREARERGRGGKRKAKKGEREDERRAKRARGGERERRRE

SEQ ID NO: 946726 - protein, 72 aa, Homo sapiens
MSNHHQSSALDPYFAYRIVTTSQYVAFTTQYASPLTYCQNTLGYDPRLTGQIMTRLLTGPCLLCTGPIALRF

SEQ ID NO: 946727 - protein, 169 aa, Homo sapiens
MPKTISVRVTTMDAELEFAIQPNTTGKQLFDQVVLIGLRQVWLFGLQYQDTKGFSTCVKLTKKVTAQDVRKESPLLFKFRAKFTLRMCPGNDQAITKRCSSAGEEGILMDDITARLNRCPAAPHAGQSKKATSIRSAKARLLGRNQVVPERGLDRLLQDHWEERTQVAL

SEQ ID NO: 946728 - protein, 139 aa, Homo sapiens
MHDIDDQPYSAAPRLPTQPYLFHTTSQLLAPSTGPLHPHPPTPAFASPLISHHSLPPHHPITIPPPPPLHSPPPPLLPSPLLPPPPSSPPPLDPTLRLSPPPLSPPPFHHPLFPYHLTLLFHPPRSLSLSHPLPSPPSA

SEQ ID NO: 946729 - protein, 189 aa, Homo sapiens
QDSLSVRYAGLPDRAEMPKVEETLKRLRSQKGVQGIIGANTEGIPIRSAMDNGSRTQYDSLMHSLILKARITVRDIELENDLTFLRIRSKKHELMDAPDKDYVLNVIQNPYRVATLWLHESLLNLMCRKNDNVNDVSELMTWKMVGPTHSHPVTVCGLAAFYLTTEPLRDSTFPEIRSPYLTPELEHEL

SEQ ID NO: 946730 - protein, 217 aa, Homo sapiens
DTDLHRLGSSAMSPSRKVFADGNWKMNDRQQRLEELIGTLNALKKPASTEMNSFPPNELHRLDRRKLDPTIAEDAQPWYNVRPEAVNWGKNHWHDQHLPQDALETGALSANATVSCVTEGTPPPMCPPISPVCPVSPSNLVRLISRKVPPPHGHGPPPPSIAYPLSGPLSPIPYPLSPPPPPLLLSSSSPRHPRPIRSIVLTPYHRLSPPSPRAPPL

SEQ ID NO: 946731 - protein, 238 aa, Homo sapiens
RAKRPGSLKRRTQFKTRPKGHSKRGTTPTPRSTNKQKTTRQQNTQTKTQTQTTTQRQTHPKKRRRPNEANNRQHQNRATPAHRANKAKQTTRSELNETPTQQTNAATQQHEQNTHQLKEEQQTQTRQAENNKKADNQRAPTGHQQGTNPTTTKRPQEARTPRTTSLTPSTESPTTQRHYLPPTTTQTKDPKHPQPSKQPKQAQDNTKSTEAKPTPHKSKHPKAEPAANQTQTHPTHRR

SEQ ID NO: 946732 - protein, 140 aa, Homo sapiens
MPLHSSLGNRARLHLKKETLEKSNRYQLRKNVGINSFSFHNSLDPVAMPHVLTPNTLVGRGGCITCRQQLTTGPYHMSKLPSLINIPPIPHMLPDACHPSSFGTHGRLTRRTQDPTAPRVPLLPYTFQPVPYGLAPPTLR

SEQ ID NO: 946733 - protein, 72 aa, Homo sapiens
RADVGILLIAITHRERHPRDLTALLLMPTNPTCVLPDVGPDYIFLKVRLEQTIPPAWHLVRIPDGRIGVETL

SEQ ID NO: 946734 - protein, 96 aa, Homo sapiens
VIDIVIILAFTITLLGVLVYGSHLISSLLCLEGVILSLFIIATVITLNTHSLLANIVPIAILAFDACEAGIGLALLVSISNTYGLDYDHNLNLLHC

SEQ ID NO: 946735 - protein, 241 aa, Homo sapiens
GVADVDGAGAEAAELRGGKAEDKERMPVSKMSRLVKDMKIRSLEEIYLFYLAIKESEIIDLFLWAYLKDEVFEDYASAQTRAVQRTRFKALGAIGDYKVHVGLNVKCCKEVFTDIRGAIILDKLYIVPVRRGYWVNKIGKPHTDPCWATGRCGSELVRLMPVPSGTGIVCPEPYKLIMMAGIDDRYTLIRGSTVTLGLRHGHFWMPYEDLQLPDTGSMQAGLVNQDSYQELTATSVSSPVC

SEQ ID NO: 946736 - protein, 267 aa, Homo sapiens
MAKERPCTLRGPKKHLKRAERSKPSLLRKITAGSGPTPCTGPYNLREGLSMMRFLRIKLKCAATGDDDWNILMQGYIKIDGDARVNVTYPVLSMCVMRMENTGDHYPLTYHTQDQLKKAHNHNPGGPVQVGLRQGDYWGSEGNSTPVDFMTLEPSNTHNRTLSANHRGTHWFTDLAILSTVMQIGCRPFTCLRKRRNQPLFGETCYHSQGKDFAGLLNGGPCKRMPVRTRSTLRFTKNMVLEGAKYVEFAQWGKGVPLSFLRRISGP

SEQ ID NO: 946737 - protein, 113 aa, Homo sapiens
MRLLGYCLAASHKRDSNTAQSVRETMKTYKTPDEGKDRRLLIMTAVEMKLYMESNLYLTENWKIGLHSPECNTTRMALLVDENEGDYTAHSIDQKLQVITIDGRPSFTKRLDA

SEQ ID NO: 946738 - protein, 141 aa, Homo sapiens
MTNAFNRRIEKAEVCEPQGQESKTILTSMAKLWLYQNYRRWTYWSMHDSPDTHKTVLDTAFEPKSSGMDGAEIEAIAHKPGRKSIDSAYDRTKSWLEEFCQACFLQSNTCNASSMKGRGRHATCVHRLRTRPTTMETACLF

SEQ ID NO: 946739 - protein, 68 aa, Homo sapiens
EVSDLFSLAAPLGSRCIFPLRGSHWRLILVQPVPAKQKAKALPTGKSAMASVTDSMSLVHFHGERYLQ

SEQ ID NO: 946740 - protein, 148 aa, Homo sapiens
SQSDERRWSWLYTSNQTDPFFSPVKSGEALIYDMPMEEQEVAVMWYRNNPDPQTWNVSHIHSETLEAEHATGALLRPSYEPVMHVSIDYGYSAMTMHRMTDGDETVAQSYVFNAMRLNIQDPDFAKRIYILRICHSSADVPGYWIGGL

SEQ ID NO: 946741 - protein, 176 aa, Homo sapiens
MAAGTLYTYPAGGAFKALIAAQYSGAQVRVLSEPPHFHFGQTNRTPEFLRKFPDVKVPAFEGDDGFCVYESIAIAYYVSNEELRRSTPEAVAQVAQCLSFADSEISGPASTLRGPTIVIMHHITQPTVNAPLEARRTPLLVGYLETRAFSAELTQIRPPVTTRCPPLCGRIVWECA

SEQ ID NO: 946742 - protein, 45 aa, Homo sapiens
MCHSVASRPYRLPQYPGLIIQPVPHIHLDAQFLRKAGFVLVPILA

SEQ ID NO: 946743 - protein, 106 aa, Homo sapiens
LRVREHVTDGICDGSQMMHALLGATTLVLVDVAPWVLSVVAGGKNLKSPQKVEVDIIDDNFILRRNRRDESGGNVTFSFEYQKTAMDNWIKTSGRQNITSTKCNFV

SEQ ID NO: 946744 - protein, 132 aa, Homo sapiens
LSFRLNSAMRKANTDAYKCIHESMGKEAVGCHALSSEGTLVGVSDSCMLSTDLNVLTGLNKRANCWYKAKIGYVIHRICVLRGKGAQFLMEQLTGSLNIMAVNRYMATLNLEIVDEERGARHMGTMTVRKFY

SEQ ID NO: 946745 - protein, 141 aa, Homo sapiens
DTDLQFLECRAMAPYRTAFADGWQMNARTRTSEAAHRDSDKRSRCRPTPSRYAPLYCPSRLRRTSPTSQDRRRSAPRQPSHQRNRPQGTERTASASTVPPTTARPRTLRAPDGPYPVPAPHTGPMAHAPAPPLAPHTTTPP

SEQ ID NO: 946746 - protein, 161 aa, Homo sapiens
MPGPPVSSRAISYPARLLLLLVVYTITPPLSLPLVSYLFSHPLSVLLTLLSLRCSLPYTHTVLRHIPPYPISLARLSSLLLTLRVAIALPRFSLSSRRSLIMSLAALSCTLTRSSPLLFLSLSLSSLSCTYTLVALQLSVRLFSVMSVLTRLPLPAVPLSL

SEQ ID NO: 946747 - protein, 141 aa, Homo sapiens
MADLSLLRRVLVTAAAALSGRPLGTSPRIWGLPNYAAFRRLLLLFDTVETMLKDYLPSDLLDSMTGVFRSYVGFYIALTGIPGATFITVAKVFIAQAELAEISDRYGPEHWDNYQHPISGRLARTLASPRTLHITTRRPSP

SEQ ID NO: 946748 - protein, 137 aa, Homo sapiens
HQQQLKRFSFFIKKKWNQLSSSKNSSPNELPTDFGEEQREAPAVPDWQHKLSSSKKNLDASENGAGQICELPDALAEGHMRWCSHPELLTSEDHEVASANALLHEHEPYGNAYRNVQTAHHSARTPPSRPPSPLTSL

SEQ ID NO: 946749 - protein, 176 aa, Homo sapiens
LDERRTPEHAYRKGIIFIPLEKRTRGNHMMKRLGHSPNSYFMAGKCPECYKFTTFVSHAQTVILGEAAPLDSASLQEEKHGLQNDVPSGRSSTKSTLSQYEWETMSIHTFCVNLKGNLCCSLVPASANSKIESILLMHGAKIQIFLARFALLGGSLDLFGRSFTTDAIGKTLASPN

SEQ ID NO: 946750 - protein, 116 aa, Homo sapiens
ALAYGYLFPEYSLALGPEISPGILSHELRVQSKVGHTTHQPAPASTLNQPSVPELSAFVDYAQQSSPGPIKPAILGGPVERLTEAASARAVGAAAVECPGPGARGDGVNNYHCLVY

SEQ ID NO: 946751 - protein, 108 aa, Homo sapiens
GFPAVTTYEHRTRLLEREVLNPFPEEERRNPRRKRLVQSPNLHSGMKSAQWVINSPGFLPVHKRNLCVWCATVACETLGGEKQGLQRDAFEEEPLKSFLGQEEWDTIY

SEQ ID NO: 946752 - protein, 233 aa, Homo sapiens
RCRIPHLGKAWDTKWRPVTKMDRLITDMTIQSLEVIYLLSMPMNESEIIAFILLDSVNDAVLTIVPVQKPTQTASVTRFQSFRCISYYNEHGYLHAKCCEDLAIGIRKDITMAKALDRSRRDILRNKIANSHTEPLQDDSPLSFHAAPTQPCTHGTATAFRHCTNIFTHMLTPTSRRPITSLHCHPWHLVNATLLALPLTLLDPYTLNATRSHPLASYHDNLTTPFDPTVLLF

SEQ ID NO: 946753 - protein, 138 aa, Homo sapiens
DFSEIFSLPLTHMRIQGMHLILQMSLVDKKLYFEWLSMEHASSPASSWKGVSTITWPTTNRSPPIIPAIHWTPVRGFIFSNTALKNALLRTNTQYPASTVFPPSPTFLSQFLPVSRFVSDLSLQLGVPSAILSYYACC

SEQ ID NO: 946754 - protein, 232 aa, Homo sapiens
VDTYFKRIWFTMARMADKTERLLMDRTSHLIVVIKIKSMPMTELTSTRCSPIHSINDSRFMIDPEQQSTRTSVVTRFHAADASVTALFQLTCSQWQRDTALAIAKYTSMVKLSTDYAGDSCGHNLFPCLPSTMNVSATSLSTLYSPPSHQLHQNRYHLSYYALPTPLPLLLSLFPSLPLPPCAPLTPTFAIFPRLPLFIPYFSFSLSQPPLPSSLPPLPQPASALSVYPTPS

SEQ ID NO: 946755 - protein, 141 aa, Homo sapiens
VSLEALYFEAVMANGLDKWITGIDETAVLHREASKLNTLQLEPQLALLARQLAQTEHYLNNLMAHLDLLFVRVTTLAGAQQELLNMKLWTIHELLQDSKPDKDMEASEPAEGSIGESAGGGDIVSAGIPCLCRHRGQQTFP

SEQ ID NO: 946756 - protein, 134 aa, Homo sapiens
MAAATLYTYPGNWRAFKALIAAQYSGAQVRGLSEPPHLHFGQTNRTPEFVRKFPAGKVPPSEGDDRFCAVDSNAIAYYVSNEELGGSTAEAGAHVALEASFADSDIAPPASTWVLPTLGMRHHSRQATENAEGA

SEQ ID NO: 946757 - protein, 138 aa, Homo sapiens
RLLKDAVFTFTLADRANPVELGILGNTPCTRRGHESDFHEQGARPVHAGNRHLYSEAVGDQNMENFGVSNIAWSCLDWIAAGTIDAGSATMGYLAYDFMLKISESSMRSRPIQNDNPKKHAFEMEVMDTAGYRRRLWA

SEQ ID NO: 946758 - protein, 251 aa, Homo sapiens
MAATGIKMLILDYVEILSTFKSKDLHLIKLLNYYPHFTDGKLNINGSDSNLHNLDEKFQNNIATDLLKSQLKEKPVRNKAINYCTVFSFGYVNSEIPIRPPRYWEKFARDMATGDTNARARYLKPLDLTEENTQGVATNKDAAGLTEPCEPSNIYRQGRHGRLALTAKASDGPRPDIQYEDTNGPAPVLANMRNPALIKPHITGLARLPAPFLHPSPTTVNPAKRLSVARSALACLATRHASSHTPPVPGA

SEQ ID NO: 946759 - protein, 79 aa, Homo sapiens
MKKGREEKRKEERREGKKVGRKERGKEKKVKERKEEMKEKKRKREEEEREREEREKKRKRREREREGYREREEREKERE

SEQ ID NO: 946760 - protein, 142 aa, Homo sapiens
GGYCEYGGVKGEAGHASGGGLWAHRLHNVRCRAGGLPRYRMLAIGIGTLVYGHWSIMKWNRERRRLQSEDFEARIGLLPVCQSETGRRTLQMLRESLEEAAIIMKDVPDWKAQSAHQTSHVTATPRSLAPHDGAHYAGLYSI

SEQ ID NO: 946761 - protein, 144 aa, Homo sapiens
MTLGGQCELVLQKHMKKHSDSDMGKRRDDDLSAAARKQRDLEIMHHKQKKANENNEEPKSLCSYAFNPLPFACVPGASPTTLALASVVITGTSTDSIAFALSLHRYPFALTSPQVASVPLCHSRGRGSYPFPELFIPERLTPMH

SEQ ID NO: 946762 - protein, 93 aa, Homo sapiens
MAGPTYAESKPGYPVDSEEVLTMEEAKNALGMAFTSGHTCVIRGLKGNFGTDLKRVIGNRLYLLQTKTFNQTGKCKVMQPDKIREWGLTGRFG

SEQ ID NO: 946763 - protein, 118 aa, Homo sapiens
MRGALNADALEDESRNKTRTYDMNSGKRNFAFYEFWPFWFTLLECCGDMTTTLENYSYEVNTWEDPVAKQLAVTAYDKPVLLLDLETVNLYKVKSQSSANQTCLYERPPRILHMLAVF

SEQ ID NO: 946764 - protein, 150 aa, Homo sapiens
MASQDYGTTRHVDHLISAERDQPDKHTALALLTFTELAQCGEVRLLIKLLRTMLQDNLSDLEGRSSSELRPIHCTDRQRAGLCLTAVFTDVFSLMLAVNFRLIYDTEGRSADSLLHLRSHVHLCKVRMIFEDTYGVSDVTHDARMRSRSP

SEQ ID NO: 946765 - protein, 186 aa, Homo sapiens
RRTTEEQGPNRMAKAKRPGGGKPEEKEEGGRMEKREEKKETKGGKKKEKGEKKGDKEETGKSKKTGKKKGKEKKKERKKRRREKKGKREEGEKREKGRKERGKGVEGEEEEREEKEKRREGGEGTKRGEGEEKGRQKRESEKREEEGEEGKEGGKERERKGKRTGEEGEKGEERERGEGMRGGGDR

SEQ ID NO: 946766 - protein, 262 aa, Homo sapiens
KQGSPMPWKERERKGEEDGNMKAKRREEEEGGRGRRGRERGERKGGKEEGGEEKEGKREEEGGKKRKEREGEKEGKGGGGEKRRGGRKEEGEGKGKGEEEKKRERKKGRRERKGRREGEKRGREGEDKKRRKGEEREGEEEEKGRREGDEEEEEKKGEKEEEGGEEEGRRRRREEGRGKEKRGRRKREKKGRKEEEEGEAEGKGERKGAKREGEEEEGEREKGEGERTKKEGEEKGKEKRRKGRREGKERERGEGKEREGGE

SEQ ID NO: 946767 - protein, 207 aa, Homo sapiens
RANRRPPPNRMGMSEKAREHGVTTGTKGNGAEERIRETEDKRDTRRDDSGEAEERKDEQEERGKTREREGEDTREEQRRKEDEQAENGGEKERRQQREAMNRRQKKEKRERETKNREEERRRRTARRKQKTEGRHEQEKRRGETKRKRKREERHESNAEEGGRRRRKENRREKRKKKRQKGEENGEGRARHSGEERERNKDERRKRR

SEQ ID NO: 946768 - protein, 120 aa, Homo sapiens
MLRSQNKAADVLRMDAGFTMSNSIPAIRIPFEQAQKVITMLEQRQELAENKDEIALAPLGTEGTDNPLSGEEQHQNHTGHRHLMLPDFDPLQHIGHNQPRYQQADFLRAQQCASTPHHPP

SEQ ID NO: 946769 - protein, 129 aa, Homo sapiens
MPKRLDHFVARSSGTALSMWEARGFAPTANDPPVLVLTCPLIQSVLWLKHMKYPLLVRTGRGNTIAGSRNALLNAGLGAHSDMISDCRIRIWKMHIHADATIRKSTGDRRQASGSWNITGPCRQGVGCP

SEQ ID NO: 946770 - protein, 199 aa, Homo sapiens
MAPSRKIFDGGNWKMNGRKQRLGELIGTLNAAKEPADTEEERAPPTAYIDFARQKLDPKNAEDAQNCYKETNGAITGEISPGMIKDCGAKWEVLGHSERRHVIGESDELIGQKEAQAQAEGLGRNDCIGEKLDEREAGITEKVDIEQTKAIADNGEGLEQGDQAKEPERTIGTGKTATPRTRKNTRSSEEGGNPFIDGG

SEQ ID NO: 946771 - protein, 54 aa, Homo sapiens
MKLVNNYSMNQNPIAKTGKGALGKRGNLYRNGAKIKGISSAGNAHPGGQTSGSL

SEQ ID NO: 946772 - protein, 235 aa, Homo sapiens
FCRRPHLGENCENQSMTATKMYRLLKDMRITLLMDNNLFSLPMNESTCIANMLLTSINHARLMIMPVHKSSRSYQQTRTKSSSAIRYNNVTRDTTYTWAARYRTSTFLYTMILAKCYIDHARIDIYSLHDVSPATSPCMIASHYSYYAATYQPSIHCNRNSSPNLPTLLSNSPILNGFTYPSIYCHYCNLSMAYLVIFHPTATPPLDLPINLDFIISHYYLSTRTPFTSSRPFLP

SEQ ID NO: 946773 - protein, 289 aa, Homo sapiens
RYTRTQNRAHANTHEHPHHRAPGTRDDQREETPRRRMKTRGRERGRRKWRQERRQHDGEQDHAKDVTEERQHGTKKKDKKQSRRRRNGKRRRRQTDIKRSKTRKKEETQEEEGEQESKKEGQEEEDREETAEMRKKSTREPNPRRAKKDKSKPRKRQKTTHSMRRKTRKQRGKQGDQAIRKEKPRRNRERRNEGKKTRGHARREEEAQQKQKWNPEKTKGEKKIQRRKTKKGESKNKETTKKKREEQKKDKAKRGEKKKRAEEREDTSRKKRPGGTNTERGKQRQAQKE

SEQ ID NO: 946774 - protein, 204 aa, Homo sapiens
LCRIRVLSAICEIMASMAYDKERLPMTKSCRLIEVIKIKSMTVIYLLSMPISEIDFIDDFVCPFVTDKLRISIPVLTHSQSGQGTSFRAFVALADYNVHVDTGLNRSKEHDIVMRVNRYAWQDIKGHNRRIYCLSMIMQCDTIPSRVTRRCDYVIVRIIAAAKCTRMLIVPLPKELVMMNAIEDWFNSVRICIATLGKIRQGQL

SEQ ID NO: 946775 - protein, 90 aa, Homo sapiens
AGDKHWKLFLGIGILLLLFIEILGEPWIRLTIKANSKPCRDGLRSEMERRNGTHLLQQELTEAQKGYQDVEDQADTCNHTEMDLTGYLDA

SEQ ID NO: 946776 - protein, 240 aa, Homo sapiens
KAARQEHELDWKDEKKPHPHDTEGRRKRCTREDGQYGREVRRRNVWMKHQKGACGEEEEADQERPDPSSRTQQTMALETEREMRQIPLQTDDLENGSGYQPRDQPTQPNPEDAYRAQNYLQLDPKPLCKAAEPRWKAEEEEAAMDRRNEAQKRSRSEDGAKGSLTEKPTTKGHWLRKNQNYSKNLYTGGDRKEGGGKPRKQQAQKKSENRTERKRNQGFIEEGRPKRAGQGAAKRTRQYT

SEQ ID NO: 946777 - protein, 110 aa, Homo sapiens
MLRVYVNGYVVMLAGIELRVFSEDGGDNNLVEFIMLRLGAKIGPGRSIRWVGGVSCPGTTAVYRLFFEAGFRGRTRRPPAPLLRCGLSNSWKVDMLIVGEGGGLAIRFLL

SEQ ID NO: 946778 - protein, 218 aa, Homo sapiens
VDTRECGHYGRVRGHMPDMGAVREAKGGRALDDEEPETHQDNKAKPERYEKDTKLARHGGTHLEAEVLRRLRQDNDLNLGGTGCSEPKPCHCTPGWETERSETPSQKEIARTRQARKVNGLHIELNTESEDYQNREDSDNLTARNYRTRSRQDAAKKAPRGRPLANDHHNKRQLKRSANQAWANGRHSGRQTARTQAEGAEDQAHKRQPRNQAGRATR

SEQ ID NO: 946779 - protein, 270 aa, Homo sapiens
GKEEGDEPRETLDNSVETVERAEEPKGRKRRKGKGGKKGGTEGNQREKQGEKRGQKRGQRRNKEEERDKRKEKERKEERKGREKKRREGKHGGKTEKGQREKREGNEERESNGTKRGRTGERQKASKGTKTGDGKERERKRGKKPENRRQRKRATRKRETDEKRRSKEEAMEGRGTARKRRATGRERKRGEQKARRRRRGEKQGGRNQRKGGGKREQKRDRDNRNGEQENRRMKEANNERRGEGGKAKESQRAQSDTNATEKHEGRGGTD

SEQ ID NO: 946780 - protein, 233 aa, Homo sapiens
GDEDTCLFSSESDMEGISQRRDDELATGHEEIVNPDRYIKTLAEKDLEPLDLMVRYYVNCALMMTMTEQNQNLVSQNHHTKVQVGSEVYLRPESQDYNGLGKPEVTLIRKMNHRADIVRTRSDRIGPVSRHKLKSQSDDSRGYIARGDMQELVTTSYRMLCTRSPLRITHANLHPSYTLTRGQTCQANLLTNRPQEEPLPKTSALSTKRLYSFSNPLTPCHHFTSTALLPHTA

SEQ ID NO: 946781 - protein, 219 aa, Homo sapiens
AAAVRVPAYPALGSTVFGRHRFVNSVPVCDRPPISSPLATSGTIFSAICCFWDLPGPFLTIARSCQPTMSSQIRQHYSTDVQSDASSLGNLDLQASYTYLALSCYFDRDDMHLQGVSHFFRKLHEKQRRGYERLLQMQNQRVVRALLQHIKKPAADELHKIADAMKAAMALQQLNQALLHPDALNSDRTDLHLCDYLETQLLAEEVFIKKKADYLLPPR

SEQ ID NO: 946782 - protein, 265 aa, Homo sapiens
EHRQRLDTSDRTVEKAEGPEGSKRGKGRDGSKRVPKLDQREKKGEQGGQKRGQRRKKEEDDDTRKENERKEDRKGTEKQRKEGQHGGSTEKAQREKREEKEERECNGTKSSEQGKDTSPAREQKRGRAQGREGQQREKTGRAKTNQNEEKEESSGQKGRQQKRAEQGKRPDTQKDAHGGERKRGTHEERPRRTERKKSGENEKNRGEALKRESNKSNRTRSRRKNASNRQTAKGEKNPDEDKEQQRERHQEQLEEQWRKNGARGR

SEQ ID NO: 946783 - protein, 250 aa, Homo sapiens
MDAGSVYSSILHKSRYEYTLKGATGYPRSPQTDNRVHVLHAYETPNKTRQMHYQNWIIARQEAYCVSVATVSSISTPVLHSNSFLSCTRQSLRELHHAVHSLIAPTNHNHDYSYLQRYITRPTILHSIIPTTEIILTICFVPDCLNWILLSLYANSIFGLLRRTSGYRVYPLHYSDLYCSTLALSDFNLYYPIPLTVFTSSALVTFHASLILHAQPVAATIRSSTYSLTWTFYTAYLSRFLIVRYTDLLA

SEQ ID NO: 946784 - protein, 272 aa, Homo sapiens
PTAPEAGRITTAPPLDDLGRTPWKEPEAPRGTTRGRGTNGKTGGPKGNQGDKEGEKRGQRGGQRGSREEHRDTRNERDRKRRGKETKKKREQGHQGGTTESAQRPKGEQEAETPSRGRNRGERGKDGEPGGGQHPRRGRSAGPTGRRARKADRHQREQQRGTRERGAGAKKAQSGAESPGTQQGAQRTQKKGRATKRNDDGQEAEERRTTDKEDTTPHAGKRHTDAKPRPEEGAKGAGATPGAGKKRRSPKQTDGRSRKGQQTTTGHRGNPA

SEQ ID NO: 946785 - protein, 103 aa, Homo sapiens
MSPRLIQFLALSLAPRLRLLRPVPLRPHTDLLPAYVSAFAPPPPRPLPPSTPRSLSPQPPSRPPLPLHSALLTPRLSSPLLHAISPFLPSSPPPLSLLPPRPL

SEQ ID NO: 946786 - protein, 134 aa, Homo sapiens
GSQQLSMTSLHNSCYRKDTVVTDYTYDWIKAKLKASIAGSIDLAAALLKLGECGLRRLRLMVNPLTTIAYPFLELSLWGITMTCWICLRQTDLRTIIAYSRMSHIALEVTAILIQTPWRFTEANIVIIEHGLTC

SEQ ID NO: 946787 - protein, 183 aa, Homo sapiens
ARGERLSVTTIAVMSDLGKQGGKARAKAKSRSCHSGLQTPVRQVHRLLLIGNCSLRVRALTPVYMDRGLEYLTVYILDLADNADRDNKKTLIIHRHLQLVIRNDQELIRLLVRVTIIHSGVLPNIQAVLISKKTESYHKAKGQVRMTYGPIEPNPNRYKKGTCKLKRLFSEPPTFSYKRVVNG

SEQ ID NO: 946788 - protein, 226 aa, Homo sapiens
ALKAKGEAPAPGEAHPKAKAPKAKKAELKGVHSHKTMKNRTYTHLPAVEDTATPETAQRSPEERSQVKQARPYATIKFPLTTRAAMKKIEDNNALVYIEDAEANKDKTKQALKKLHDNEEAKVNTLIRPDGETKAEARLAHDDHAQHEANMSRDHPELITKLPKSRKQTHIYYALTTRSRPALAIIHGRPGFDKNFRPRATRNAVRPATTESHVVTSTALIVHIRL

SEQ ID NO: 946789 - protein, 162 aa, Homo sapiens
MVTKPAIRETQQRQATTEPKRPREQKAHRQISALESNPLDTPTEERAQDRATPERIRNIRKPNKNTGEERNKKSSTDDEKNPKNLCTEAEQTAKPNKRQTTPKARRTKGNSNHVTHMKTAATAAKAQKHERKRKPKRTADRNPTHRSQSSSTHQHTVTALCA

SEQ ID NO: 946790 - protein, 113 aa, Homo sapiens
MNNLVTLPIQEAEAIEWFLINSLKRELMGTIPPQKQTLAGQRHMIMVQVFEREYTYTISRIHIALNGTEHCNAGGPDSCALPRPRRIVYVLHHTAAYTGHDCRQSATAICARP

SEQ ID NO: 946791 - protein, 188 aa, Homo sapiens
EKREHEEPPWESQSAKGSPMDSRDEGKEREERKGSRRGEGREGEKREEEGGEGGKEKGKRGGRRGQRGRKEEHKKKRREKERKEKGKEEEKERKEGKKGRRKEKEEGEERKREGEKTRRGRKRRERKKKERRRKEEREERRKEGGPKEGKDGKEEKKEREGKGERRGGEGRRRRRRGKAGRGEERGKT

SEQ ID NO: 946792 - protein, 202 aa, Homo sapiens
MADQGEPQVQFKLVLLADDCTGKTTFVKRHLTAEYVKKYVATLSAEVNTLEVHTKEDLSKCNVWDTAGQKKYIGLRDGYYIQAQCAIIMFDVTSRVTYKNEPNWHRDLVRVLCIHIVECGNKVDIKDRKVKAKSIAFHRKKNLQYYDISGGTTTMRCRYYDQLGSTLETLTLFDAMHALAPADIVIDPAFAAQYEHYLEAAQ

SEQ ID NO: 946793 - protein, 252 aa, Homo sapiens
RESTEETGIERMKPHELEEEEDRTPMTPERRTNRHEQEEKETTGEERVRQERPTEETAGQEGHRKTEKRRRKEDEKRTGKDEDRREKRSRAEKQRREEGERGRHERGERRERRTERSNGRARGTRKEEKEEKDRREEQDRGEGGARQREERETREREGGRKQRRHGKERRRGRTEGQEGKDKTKTKRRRQKKERQKRKKARSRRQERRRREKKRKQDRGREKGREQTREEERRTSETEEQERDRRGARRAES

SEQ ID NO: 946794 - protein, 66 aa, Homo sapiens
DDKYFFMSDIDMLRQATLADMESLLKTMINHEIQNVKIMSLAENDLDETCLDCTRVSKFCTEDDYK

SEQ ID NO: 946795 - protein, 227 aa, Homo sapiens
KHWGGLYTVSLTLATVVPRGGDRALYRAYVLLVVLAMLSLDCSDYARCMNWHQISYQVLTFAVNVTSELTIMEGVHDEQLELKELIVELLTGCKEPALHPGDLVYLARVEDSIPVSEIVASTYAGGEIAIVHPCLMIHEVHSGPIKLLTTGDNNANDDPGLYIMDDIRYICRTMQESHEILVIMTYWDDPMTEYLQYAMQSPVAGSLSLTSRECCLMFWQIQTFLLV

SEQ ID NO: 946796 - protein, 95 aa, Homo sapiens
RGRGYQALLVHYIHTESTFNTKQLRLIKTSNYYPHSTDDNLTLTRNDSDLHTLYETPYINTATSLDNPPKEPPVRNNSITYCTAFSPVYPSEIPL

SEQ ID NO: 946797 - protein, 119 aa, Homo sapiens
MGTEKTEKGQYKSDEETRRRRHEKHKETKGGQNTEHTKKLKDETQREGQAKQSKRRGTKQEQEDTGKQEPKQEKKGTEREDRKKGAQRSTRRRGERKRRDKDAIRSQSGDEPAERGTKK

SEQ ID NO: 946798 - protein, 158 aa, Homo sapiens
MVLTNQTVQKPTGEEARPYTVEHESRQLKRSLYPQREQDYQLQARIRGATTDSYLSEVNPTAHTKTALTEESDLDGAGFQNRADDKHIMDIDTLEDTPVAHLLHMTADSKLFDIHAKSDRMMPKDVKLARPILLETCPYNTVSQRDSEPYWSFGLVQH

SEQ ID NO: 946799 - protein, 239 aa, Homo sapiens
REQERRKQKAPTPWKTHGKAKKRNTGTRMRTKLQASKPSKGGRGRRKERVQENKTRQGNKAKHRNNGKKKKKKGKRQEKAKEDERKRRKRSKEARNRGKGQKKQHKGRRRREKTEKPGGRDRREKRKRQRNPDRERERHPTKNKEKKKKTRKNKRKRRKQKKKRREKERAKAKKRTKKARGKRKGKKKANEKEREEERQGQEKKEQRGKKGERKGKNGKNGKKKKGEGQDKGKKRNRGG

SEQ ID NO: 946800 - protein, 150 aa, Homo sapiens
MTSYTSHSIVSCTTDTRKIERTATIDTPRIKRISTPSLSVRDDRQLKPSSHARVTHEQPPQSTRSSMRSSILLTLMRITFTSHDLYQRTACHYRYFYRVVLERHDNNRVRPSTRRPDSSSRIISPTICIRTVLWTYHPMPDLVSLYTPGG

SEQ ID NO: 946801 - protein, 205 aa, Homo sapiens
PLTEPTRLFERRRPLVRDMAMLRVQPEAQAKVDVVREDLCTKTDNLLGSYIPKKISELDAFVKEPALNEANLSNMKDPLDMPLPDPVKVKEKDERKKQHEKEDKDGIRGRMKTKVLHAARCTAMKMIVVLLDRYKPEINDVIEQINLVTTCQQLQIPGIEDGNNFREAEQEKVFELMTSLYTMLEGLHTQICKYISERGEAWTGA

SEQ ID NO: 946802 - protein, 79 aa, Homo sapiens
MVCRGFSSICTGSRPALNAQRAGHTDGGYRVQASLFVESCVSYASLSSYIGLLVIAVSSPMSQPNPLPLCRTSLPPLVS

SEQ ID NO: 946803 - protein, 120 aa, Homo sapiens
PITLHRGPGTRSRYVWKKMILNKAVVLGALTLTSETQPLWRIRHCGCPHGLLQCKLVPLLTGRMANEHMNLVDTTSSICTWKGPTLSEKRLCPTYLDTDPDCALTRCVCSNISLTILTKR

SEQ ID NO: 946804 - protein, 200 aa, Homo sapiens
ARIRLDDKGTSPLESVPLDTYQCGRCGYKPTTFRSRTCGKRGYHVKRKRKYNCNGNAKSRTTTGTGRTSHLKIANRNSGMDIVKDNTYTQEGSCCSIQFILRMSTIIHAINVLLSKNISGSTDKFVWAAYSQSTLNSRMLNHRAAIGAHLANSPISESNTLQWPELYTLANGKIIAGYPTLIASQVSTSVHMPNEGAPHL

SEQ ID NO: 946805 - protein, 140 aa, Homo sapiens
MWLRRRLLYTAIGRDLIFGSLSNGFLASSSRILRGYRWVACSGRVRDCRTAVRWPSQANPVSREMRGDSPGYYAEQSIPLRAQLPSTVAFARPRASAYISRSPLELDVATFLIRPTLAPSAYNSALPCSNRFYARRTFSR

SEQ ID NO: 946806 - protein, 106 aa, Homo sapiens
QYFLRERGVWNTGDFFQVYVSTQGDEEQVVRYHQSNAWVSHRIDCCGVTSKAIYSKAVCLMVPDHMSKEYVLQGLEQTVVMHAESTLNILEADNRLVQVSVSMAHI

SEQ ID NO: 946807 - protein, 145 aa, Homo sapiens
RGREARLVKDEDKEWMPDTKLVRLIKDMKIKSLEEIYLLSLPIKESEIIDLFLLAYLKDEVLKIMPEQKQTRAGQRTMFKGSVAIEDYNGHDSLIVKCCKEPATVIRGAITLSTLCIVPVRRGYVPHDTLRRHCPLQPDRPAVLC

SEQ ID NO: 946808 - protein, 135 aa, Homo sapiens
MAPLPFLIALVNSRPRLSRWFAQPYYLRSALLSAAFLLARKLPPLCHDLPTQCDDGNPCDFDCRDVATLMLLSAIVTMKNRRSITVEQHIGTIFMFSKVPNTILFFRLHIRMALLYITLCIAPLMTPKPPLYTLP

SEQ ID NO: 946809 - protein, 145 aa, Homo sapiens
RFWKVGRILTVLGGLICDSDRVNSGTVERATEPQGLEIGEMRIEQRSEFDGYMVTMIDEGGYHGDLMRTRGDVRYGGILTMGEWKLLLGTEVISEEEMIRACKRIRTYEGGHDIWQSCEHMFEVLGEWDGGREMKGADCYVGNWG

SEQ ID NO: 946810 - protein, 73 aa, Homo sapiens
LSSAETMEGVEEKNKEAPAGPETALEKANELSRADNQAPEKEVRPNDAVEGTEEAYVSRSKALSQGIKADVQN

SEQ ID NO: 946811 - protein, 60 aa, Homo sapiens
MGGRLTINWPRFNNVGTGPWGYQSNSLWRKSPFRQCRNTEGARTDGLSQQVANPEGHCLG

SEQ ID NO: 946812 - protein, 93 aa, Homo sapiens
MELPRRRFSVPDGRMNAGSSHRPTKSTFMDEEVQSILTKMTTLNLQKTMKPAIHELQPPTYKLMTQAQLEEATRQAVEADVRLSHQFWKSEYH

SEQ ID NO: 946813 - protein, 134 aa, Homo sapiens
MEDIRRFDKDRMKITMTLVKNSLPSNETIEHEKQISILLTSMKDLVRSTFEDLNLDAEQEAHDEMDTCSRDNCEPGHFRPLPQACGFLNGDFYNRTGRYIHISHRILMKFMRLINDYTTTRYIQTGRPSKFHFA

SEQ ID NO: 946814 - protein, 186 aa, Homo sapiens
MNRRVTLLKAEDPVQGRIKSEEKERHGTSEGLISIKGLTEGLQALHVHEFADNTGACTTARPYFRPLSSTVGQRMKRGMLQTRQRDSVDQDGAPARPIADSPIPLSGDHRIIGRTLLRHRQRDASLPSLPAHATSPLSAEAPRPRPAPSSPYLLLSNAPDIPSPTPYTLVSSRPPTIIPLSIRGSP

SEQ ID NO: 946815 - protein, 242 aa, Homo sapiens
ARGRRRRKELEQRGSAMNIGRTREKGERRGKGGKGERLRKEKRDWKGEGKGGKEGKKEEKEGEREKERKRKERRKEKGKEKERERKERKREEKGKREEGKRREKRKKGRGRKREREKDKEKRREREGKGGKERMREREEKEERKGGRGRGKRRVEGGRRKERRRGESGERKKGGKKGKEKGKKKEERGGKREEEGERGEGEEKKKEEKEGKGEKRERRRGREGERKKGERGGGRKRREDRKG

SEQ ID NO: 946816 - protein, 224 aa, Homo sapiens
MPVKFMSELSICEYGIEDKTSITSSRTHCLLRPLLSEVHSCDKQLRTVDGLRLPVRGPLRVPNMPVLNHRMLIKRDDAIHGLTGSYTPSHSFDIIEVEDIANFPMPLNNLLAATLLQERPSINQVGTVRPTHPTFNHLDAPHVLLSHGPFSVCPHMFQERPAEAANMLNSGPATDEAKAICMNTLYKSRPFFFIGHFNFDDRLKIVGGNNLVVSRISNYAGGGP

SEQ ID NO: 946817 - protein, 153 aa, Homo sapiens
MRITLLIDNQIWSESINRFTCSGNFLVNSVKLARVMIMPLHVLTRYYEEPGPWHHVAIRYNNFRVKVGNIGKLQVDVYMWLEIKLRTLYHSQGRICNYSLQNVDADAMPCSMQSYYWLLGATNPPHAEKRNWVTEFDQCPTNPSPTEQGLTDH

SEQ ID NO: 946818 - protein, 148 aa, Homo sapiens
ADLILAHTARISVSPLSELDRLHNVMRIKLLMANYIWSEAMNGPACSGKFVLDSVKLARMLIMREHDQSRDDELTSIIVHVISATECSRGSGNNGHGCVRHHFLERTCAAAYIMVAGYISYRALARAGLEHDGFTALLLRSAFIHEQN

SEQ ID NO: 946819 - protein, 203 aa, Homo sapiens
NDAGLILARFARISRSPHSELDRLHNVMKIKILLDQLDLVRVYEKSTCIGIFLVPSVKHSRLVIMREHEQTRVHERTRILLSVGISYNSVHVNEGNNGNLQVDTSSARTVTLACCTTSVRMVYLSQQIVHADARPCRETGHYGSGVRGFSSSIKGSCNRFTEFRLICFIRLSRIEDAVNLSNGMILEGKCWHGSSLEELDQGH

SEQ ID NO: 946820 - protein, 102 aa, Homo sapiens
MERLLNDMKITVLMDIYIYSLSMKELACIGIIVLDSIDLSLLVIMPEQNLTRMYERTKIMASDDISVNEFHVIVGNNGYLDVGRQHAVDSDLGQALLSSMCA

SEQ ID NO: 946821 - protein, 274 aa, Homo sapiens
TQPRRPPLKTNGRLLRRDPGIRPLRAGGMHKTISAHDSSNITTRGHNPYSKATGRTQEVQRTEQNALSQHRPPRKITEATITAKDSQQNSAEQTRLISSTKAHSEGYHREEQPNKTKSPHAAGQAHAARRTESRRNTGSGEDGLTIEDTKTERIRGQHRPKPARYKKTQNWLETKERRQQTQATKEGDGRTNTWNQGNQENKAKAKNTLTGPADQTHRATNIKNDKNPHDPQHKRLRNTHQGKRTPSKAANSKQGGTKLYAQTGTNTPRDDSDA

SEQ ID NO: 946822 - protein, 110 aa, Homo sapiens
MRQHKYDTLYERTSFLSNADIRLLSLSRDMNETVADCTSYDNILLTDELAHDWQHLAQNGHLMYQILILTRCLVSSEPHWIRLTRHARLMKLKHKWIADSDYSSHQARKY

SEQ ID NO: 946823 - protein, 127 aa, Homo sapiens
MEIINHSLIDLTDRMHNVRMMKLLLTPWRLSEPTNDHRTIASHALLTIRLNRLLINRPHDSRRILWLNHTLPSRHSRLNIVYLPRATHGTRPIVRIISLLRNLGHGHYRPARNDSNSLHRLCPPARP

SEQ ID NO: 946824 - protein, 137 aa, Homo sapiens
GDSRFSDGSHWSNFSGLTSDCPGHPVSSEQHYHTRIDMDRKYIGNCLDDYSCHRYHGLTPYCVPRAYRHQVGYTPISGLNTFARSIHVGLSRAQSPRSAIDRRPTQRNSPKSYFYQFEDSSACSGRLRMYPRERALP

SEQ ID NO: 946825 - protein, 287 aa, Homo sapiens
TSQRRNISEHNHAISLETTFSAIPCTGGDLERAHLHHGDGRPRRHQKNRTGQRANTDKRPNGDITNRRTAPEARRLTDRKNGSSSDHPVTIARATREHTRNPATSQPKAHGAIQQHQQETQESTYHPTATPERGQTSTSTGCATRNTQHGQSNKPRGPRKERCQLRKSIDMAHLDPTDHTTTLDTEPPQTTNAGAPSHHQTTPHTHSQMIHTMPHYPHNSYYHTHANNNYSSHKGERRQLHFSRTRNPHVHTHHTPLTTTKATQHAPSIHRRHNKHTDALNYAHRHR

SEQ ID NO: 946826 - protein, 175 aa, Homo sapiens
RCRMPGLGKIGDNQAITCIKMDRLVKDMKIKILEEIYILSLTMKELATIASIIVDSIKLEGLKIMPVQTQTRVVKLNKIIVLVDIGVNIVHVILGDKGCTEEFVVIYLDMIMVKVYYCLGRKDYFGYKIGVPHTSPCKETGRYGSVVHDLACIQSISIVPANGLCYYAVCTDTVN

SEQ ID NO: 946827 - protein, 128 aa, Homo sapiens
NLPSAAAGARCSSRWLVFQPSSLRSVENQSTYSLAQYIPCGELTQQHLTMRPRVHIQAVQRANDIGATSRAALSAHPAILAPASYDPFCALRCSDPPVPTRPPPPLFSVPDSLSLVSPPSRGPPSFVV

SEQ ID NO: 946828 - protein, 95 aa, Homo sapiens
MTLRGTLKGHNGCVIQIATSLQFSAMTLCASRDQTTTMCRLPPLRPSAPPQRAPAPPLPLCRCRGTTPPLRPPPPPPPLAPGPAPPPRPPPPPSP

SEQ ID NO: 946829 - protein, 145 aa, Homo sapiens
GLTPVIPAIWGPRWADHLRSGVQNQPCQHDETPFVPKNTLAGHRSGCLSSQLLRRLRQENHLNPGDRGCSEPSLCHCTPTWGDRVRLHLKYYPSSHPNKPNNTLDAFEASQQFSNDGRIGIQETHLTLSDHPLPCNLICQSSLRG

SEQ ID NO: 946830 - protein, 135 aa, Homo sapiens
EVLALVLDFRGHLLGRLSAIVPKQALLRRTAPVVRCEGINIPCQLLQKHVEVPGFSSVKLMNTNTSRGPYHFRTPSRIFWRSAPGIAAHPSEARSFTVSQPARIPPALRHGRPLVAPPPPHSRALLTLLPSSAPP

SEQ ID NO: 946831 - protein, 147 aa, Homo sapiens
MKMGPQILQAHKKGIMTREGNSIQEHQAQKKHAQQTTKTAQRHNNRHEATTPSNKRTERLTTEGRITMRLNTDRNPAQSTEVAQSGPRAEDTQTPKDNTTTETQQNAPRPKRKAGKRAQTKPIGTKRKRATHRHNNTQGNNTKNDGS

SEQ ID NO: 946832 - protein, 136 aa, Homo sapiens
FLEDGRVAAILREEEALDLQRCFSCLDSRNYSALHSPQHTQRNGENRDPPAGTRHCPDRMLSDDFDTAIEAMPVSSLISTSMSNTAKTPNKDHPSTTHQAHHHPALPRPALRSTILFRHGRRNRTLSPPHAPSARP

SEQ ID NO: 946833 - protein, 226 aa, Homo sapiens
SGFTLLLLVTILVNRGFVPRKAEYPIPETSPEFESSTSSPLLELYIIFALMAPLTPPNITSPYAHAPFAHPPVTIPLFLFPNSPLPPPPLPLPYLPLSDPAPLLIPPPSPLFPYPCLLPIPHPSRSITHPSSPPLLPQLSPTSLFYTSSSPPPPPPPLPLFPFSFLLFYTLFPPLLASPFPSIPPLIPSLLPPCHPRLTPLSSFPPPPLLYYSTTQPLSSLFSLPP

SEQ ID NO: 946834 - protein, 109 aa, Homo sapiens
ERHGEGGKRLRKGGRGRGERGRRGGERKKAGKEGEKKGRGERGERRERGERERGRGEEERGRRGGERRKRGSEGAPEEEKKEEGDRKRGEQRAERRDKRQTEERKGGRA

SEQ ID NO: 946835 - protein, 160 aa, Homo sapiens
PLTHRTPGRWAPAGGPHGRRAPPRLAVAIREAKMGASGTSRIYGERSSLTPGALQGGSAAGSTGSSLLSTGLPAPPGLTKRADRATRPSKVTIYIGTAFAEAAENAQILRAHLTPSPAIMGLTSYSSLEAFSPPHRNELDATEALREARTTGPAKPTSPP

SEQ ID NO: 946836 - protein, 70 aa, Homo sapiens
SPLSSRPYDTNSPTFHYIILLVVITQAVTTSFTVRRLTPVIPALGEGEMGGSQGQEMETILANMVKPRLY

SEQ ID NO: 946837 - protein, 219 aa, Homo sapiens
VGALLEPPAVVALTVPNPDPARSPHYGSPAAAKGSARSVNALLRKRRYHAAMPGLTGTREIAGTGAAERAPNAQCMTVLYRDGSLQEKLWAILQATYIHSWNLARVVFTYKGLRALQAYIQGKTYPAHAFLADFLGGIQVFGAITSTEQINMYLLSRVLFALSRLAGEKGYIPGPRWDPFPVITAELWWLYFRLFEYHRTTLKPWLSPPDLPYEASGGR

SEQ ID NO: 946838 - protein, 124 aa, Homo sapiens
CRRPHFGKACENQPITASKRDRLHKVMWITLLFANWIWCVPINESTCIGIFVLTLCTSLADVGSCQSMSRARYDGRTSFMAHVDIRFNSVHVDPGTNGTYAVYVYISLIHDLGHAVYYPARIGY

SEQ ID NO: 946839 - protein, 174 aa, Homo sapiens
DDADLIFGAICDNQLITASKLDRLHKDMMIKLLSAIYILSVSIKEIASIGIFVVPSVKLSRVMIVREHTQTRDYECTRTIVLVDIGYNNVHVTQYTLDNPMCTPNSVYDIILGTGYIVMLATVSGGPQILRSRREAIDACRASPVFTLLRSAIHPWRRTGYHNMANMLIKQCPT

SEQ ID NO: 946840 - protein, 195 aa, Homo sapiens
RCRRPDLGAICDNEQITASKLDRLLKVMKIKLLLDNYIWSVSIKESASIGIFLVVSVKLSRLMIMREHTQTRVDERTKILSSVDISVNSVHVIRGNKGMLQVDVIIYIDSDLGTRYISHARIGYYSIQIVYPDTSAQNEMSRYGICVLRISHAINCSRSCSALPNMLIMLSVTDVVIYEHCSETDIMAKFASPPL

SEQ ID NO: 946841 - protein, 110 aa, Homo sapiens
MDRLHKDMKIKILLDNCIWSVTMKEFASIASFLVDSIKLDALLIMREQTQTRVDEWNKIILLLDISVNSVHVIIGDKGSTQVGVNMLLDSNLAMRDMICSHSLHSHRSAS

SEQ ID NO: 946842 - protein, 106 aa, Homo sapiens
MKLVTPLADTGFTKAPVMYQNMLLSAYCVHGIILSAGNITMSKPCSSPETERTNGLKDREESHIYLEMCQFRASHERCSHACMCDIERVCVLVAENALASESILCY

SEQ ID NO: 946843 - protein, 121 aa, Homo sapiens
RCRRPGLGKIGDNQGITGTKMDRLVKDMKIKILLEIYILSLPIKELATIASFLVASIKVEGLKILPVQNQTRAVELNKIMALVDIGVNIVHVLLVDKGMSEVYVLIYVDIILAMLCIVLDA

SEQ ID NO: 946844 - protein, 103 aa, Homo sapiens
MTLPDLGKIGHNLPITGTKMECLGKDMKIKILLEHLYLISDKKELATIASIIVDSIKLSRLLILPEQTQTRVFTLNKIILLVDSGVNIVHVILGRQRLKHKYE

SEQ ID NO: 946845 - protein, 170 aa, Homo sapiens
KKHKGEERHLQHPLKAVEKPRDIEQVPGNTTIMTVGKNDLQCLRSSAMAPSRKLFAGGNRKMNGRKAEELRELIATLNAVKGPADTEAARAPPTAYIDSDREKLDPKTAEAGQKRYKATKGASTGETSPGMNRLRSHAGGSWGTKREGKSSGSQKSRWGRRPMHWKRDPG

SEQ ID NO: 946846 - protein, 100 aa, Homo sapiens
GAAMFAMISMPRAIRAAVTAMSGQHPRTLAIGFERLVSLETYTKAAAPVRHSVDHEDYFVMRPYRVYDRRSLKLLRLYIALTGIPVESYITLENVFIGQR

SEQ ID NO: 946847 - protein, 134 aa, Homo sapiens
MVDPFASDGQGFAYDLGSRVQDQGDQHGRSPDPILRIHITVRSQWHMPVVRGTPEVTAAESLKPEEAHVAGEPRSATDSTLQLHIETPSLMRLHLYSARIMRSVGNLSLWEIDHNSLARDIQLADVEHPSRCLW

SEQ ID NO: 946848 - protein, 79 aa, Homo sapiens
NEIWHWFVADSYRFVQTLKNLGYNMKRKRRRSMEAVAIMTKFHYPMLSLHVKYLLIGPFNLLESSSTITWTTLKNFQIG

SEQ ID NO: 946849 - protein, 170 aa, Homo sapiens
VRVPRYSCTKSLHHSSQRYSDSFGNNHLRYSPSGRSELTFSVIGSSAMAPSRKLFAAGNWKMNGRKQSLGELIGTLNAAKEPADTEVVRAPPTAYIDFARPKLDPKIAVAAQNCYKVTNGAFTGEITPGMIKDCGATCLALGHSREKDVFGESDELIAQVAHALAEGLGL

SEQ ID NO: 946850 - protein, 120 aa, Homo sapiens
NDADLITARIADNQRITVSKLYRLHNVIRIKLLMDNWIWSVSINEHTSIGNILVDSVHSRLMIMPEHDQTRYYERTRIMSSVAIRYNNVHVTRGNNGSLHVDVIICLDSDLRTLYIIMLA

SEQ ID NO: 946851 - protein, 69 aa, Homo sapiens
RWRMPELGEIGHNLAITGIKMDCLVKDMMSKILLELCSWSLTKKELATIASIIEDSIKLARLLILREQT

SEQ ID NO: 946852 - protein, 221 aa, Homo sapiens
HCICANSGDPRMVDRDSTNHFRCSRRTVFALWNGYLIGRKGSMHCSIEDAIVGDKSGYFPCAVLVQPRQSYSVKLIMNGLELSEDMTDLLNTRMGRLICELENYTIVSNMKTLSYDKPAQINQANLAPYFDRACRPNRSGALDSCMLKPAQLIRSVLGQSTLDRVASHALLAVNSPVSVKIPDGPEYASGKPLVATRLIRLALTDGLPKGPSTMATPCSLF

SEQ ID NO: 946853 - protein, 192 aa, Homo sapiens
AFSGLVREGQGYGRRRRDEPNAMTITPAKINTTKKRPHRSLSNAFTLYDQSQIEEFTEDCCTIEQNTCGLIDEVELHDMLASLVKNATHAYLDALMNEGPWSIICIMPLTMLAYKLNGADPEDVIRIDFACCDDKVTGTIQEDYLSELLTTMVDRFTDEDAYELDREAPIGTLANLTLIEVTCNLNDGSKTK

SEQ ID NO: 946854 - protein, 102 aa, Homo sapiens
AGHRGTCRLASTVAGTEQIRGLYYSLRPTSDFLSVRSLRYHVLGHILLLRPASTGFVVSDFLPTNHELPDSDRVIQPPWRETTTHWAICSLQVLYNYSLSWY

SEQ ID NO: 946855 - protein, 112 aa, Homo sapiens
SEEEGGDFVGDCAEPGDRMAGHRLVLVLGDLHIPHQSTSLPAKFKKLLLPGFSTFSAQETFATKESYDYLKTLPVDAHIARGDFHDNLNYPDQKVATVGQFLGLIHVHQDIP

SEQ ID NO: 946856 - protein, 98 aa, Homo sapiens
RWRRPVLGKIGHNLAVTGIEMECLGKDMKSKILLDICSWSLTKKGLATIASKIVDSIELARVEIMPGQTQTRVIRLNEIINYVLRGVNVVHVLIGDKG

SEQ ID NO: 946857 - protein, 132 aa, Homo sapiens
MALAEVGKIGHNLLIACIEMGCLGHDMMSAIISYFCSIITDLVTISDHRQRDRRISMTRTRMINRGQTLTRVFRLNLIILLVLRGVKVVHVLLLDKVLTNEFVLIYLHMNMVKVYYDYARIDIVGLLICFPP

SEQ ID NO: 946858 - protein, 152 aa, Homo sapiens
RQSSPVSQQRIRPRQMEQPRGKIPDPTGKPRGTRAPCKQNQQQGRLKQDKGPNHRGGEGSEQRTHHGAEAGARRENPTDREARDTARAAQTEEKNPPPNSDEQAVTNMGQRRESPQKNDEKRALGPRNDNRANQTAQNPTRPQGDDSAPSGA

SEQ ID NO: 946859 - protein, 119 aa, Homo sapiens
MALPFPPLPSRASSSHFTRSSPTLTLRSSSYSLLSDLRLSYLSQAPAYHVSQCSCLSLHPPLLPPPTTQLSFTLSQLALPPPSHIFSTISIHTPPYHLRISSPSLTLLLYHIYRSLAFL

SEQ ID NO: 946860 - protein, 226 aa, Homo sapiens
MLTTRSTTFPSGATKTRKGDHNNHTPADHHPPRHQNHDRPKHTKRTTAHNRPTEKTKRTQRDRHAARKRNTSRQNNDTHSNHTRKGTTRKKQTPDRHTPTAHTRKKRTSKKKSRHRRSPSRHRSTRHTTRPARNSPSANATEPKKTTTHEPTKRKDLEKTTNDTQKPKPHRHEPGTTKKPTQRGKISAKTGNPPPPHNETTKEEGRTRPHDNTPSNRTQQQAEYKT

SEQ ID NO: 946861 - protein, 102 aa, Homo sapiens
MTTEVPLRARTVPVRSGKLTYRSARDAQACDTLLEETCRDCISCRAGAQTDGRSNEALVQAAQMTRMMTDCDHDGAGLRAISDSQKVAHSPYTGTRVRESAD

SEQ ID NO: 946862 - protein, 59 aa, Homo sapiens
YTPKPTQKRLRKHNTKSHRTIKPTQYKTLPNKPRHPRPPKSINTQTHETLPSSISTRTP

SEQ ID NO: 946863 - protein, 119 aa, Homo sapiens
DTRRKFFELMSFALSEYRIRGDDDEWSEAENKAGPNASIIMLKSDKKRKLQAKQEPKQSKNVKNRETENTNDMKLSRKKYEEKLRHLCLIMGRYLHNVNSLWLYCCNERTRHTWKLAES

SEQ ID NO: 946864 - protein, 142 aa, Homo sapiens
GYCRRTLFPQRTASPKSLGELNRCSWDDQRLKRLRYYLAHRFNMSTLIVRRTAPRFSERCLTHPPDHIMFIIINFPSVLKMAAVCYNMCVFTGLLIKLQAYKGDHDISPYQTLSHNSSFYLFCVLGKACAYDLSGPRISLFA

SEQ ID NO: 946865 - protein, 38 aa, Homo sapiens
MAWKQYPFSPVGVIPGPEPMAFSQLPSLIGDWNLVRVF

SEQ ID NO: 946866 - protein, 149 aa, Homo sapiens
MVDELTVMKFGAKFMIMLSRLWPYTSETLYSQQAAQALPVLESPRATREYMHKLSRLLSAECSRQHSCHNTYASARDVHDIDALQAHRRLRISIIHCTNVSHLHHRPITDACNVSVRPMINPHANTNYLTLYYSQSFEENASYPANHDH

SEQ ID NO: 946867 - protein, 78 aa, Homo sapiens
ALYQPALLQPEFLQSARDFSDEDILSIGQIPMTQELEKSRPQDTNILITGELSNVITVAEDFKRTYQDLKNSPEEGNG

SEQ ID NO: 946868 - protein, 142 aa, Homo sapiens
GRGTDFVGTRFTGISPGVRLPGRVLHPPLPVLGDETQRLEVTMSILKIHAREIFDYRGNPTVEVDLFTSKGLFRAGEPSGASTGIYEALELRGNDETRYIGKGDSKAEEHMKTTIAPALGSKKLNLTEREKIDTLMIEMDGV

SEQ ID NO: 946869 - protein, 112 aa, Homo sapiens
SKRTRMIPGHWQGAIRNEEELNKLLGRLTIAQGGDLPNIQAELVPKKTVSDHMATGKVIGQESELPEALSPEGSLQGPITGSEDEPTSLMVRRRGIGTEVARASHDRATPGS

SEQ ID NO: 946870 - protein, 136 aa, Homo sapiens
IEGTNRRMMGAVDAAMTGLNQRELAYQSNVLGASRLRGAEMTDLSVADSRLSVLADQCSTLQRFGMTRAKEEPRDTRGYVNNPYEPFGCAPEASDNMFELTTVALTGPRTDGRTLALSVARFRLVLLQSGRLSASG

SEQ ID NO: 946871 - protein, 137 aa, Homo sapiens
CLLSLQGGGRRGGGARSCTSCSAILGAAVTHAVAVGMTDHMTLRGTLKGHNVWVTQIATTREVRDTILCDSRDKTIIMWLTSDETHYGIAQRALRGHFHFVSDVSISSDGQFALSSYWDGTLRLWDLTTGTTTGVAG

SEQ ID NO: 946872 - protein, 216 aa, Homo sapiens
FSCPRCYRLRLGMLHLSERNMKVLLAAALIFWSDLLLMLPGPSAADEKKKGPKVTDKVHFDLLIADEDLCRVIFGLFGKTAPKTVDNLVALATGKKGFGYKNSKFHRVINDFMNHGGDFTRGYGTGGKSMYCESFPDENLKLKDYRPGWVSQANARKDTNGVTSPSSRQPRQTCIDAKHVRFGFLEGMAARAQGAEHHDRQPDPLKDETIPTGASV

SEQ ID NO: 946873 - protein, 67 aa, Homo sapiens
ACSAKPQRLEGKVLGTAASLHSGQVLIQAKHADPDKRGEVSMEHPGVAWAREPRLDLDVCGHCDQRF

SEQ ID NO: 946874 - protein, 153 aa, Homo sapiens
TLSPDSGTDPKWPMDGAILEGSKKKRTPEPRKLKPKRTLKNAKKAGVKGDHSPYEKKIRAGPTYRRPKTQGLRRQPKEARKSAPRRNKLEHYGIIKLPVTTEPAMKKIEDNNTLEPIEDVKAHKHQMKQAVKKLEDIDVAVNTLIRPDGGALF

SEQ ID NO: 946875 - protein, 106 aa, Homo sapiens
MAGCFVPVFPALCQTEGGRNRCQDFMTILVSTAIPCVYAYRTLSSRVAAACTPTVPDCCAVDLPTPRRLPLLQHDSARLTAGCSTVQTVLYVEFYTYLSLGCYLDH

SEQ ID NO: 946876 - protein, 114 aa, Homo sapiens
AVSYACDPSTLGGRGKWITKSGVRDQPGQYGETPSLLKIQKLARCGGGRLQSQLLGRLRQKNRLNPGGGGCSELRSHHCTPAWETEQDSISKNNNNNKIKIKLKNKASYRTVCI

SEQ ID NO: 946877 - protein, 67 aa, Homo sapiens
VALVRARGITTSSPAGTREHAGMVLTLAASVQTSTDCFGNMVKIYPDSVHVSARRITVNQAALNALP

SEQ ID NO: 946878 - protein, 72 aa, Homo sapiens
GATIRLERTGLASFFGIGGGRPTVFVDLQKGGASGKKGTFAGGFKGSISPNIWDFVHNNLRKNNRQAYAVSD

SEQ ID NO: 946879 - protein, 110 aa, Homo sapiens
MGQVFGSKKTSTAVAHLIRGYGLIKANGRPLEMIEPCTLQYKLLEPDLLFGKELICWLDIAVPVMGGGHDTQIYVIHHAISKAWRPLPELFEVSRWGEYSFGSGPYASCP

SEQ ID NO: 946880 - protein, 103 aa, Homo sapiens
MAVNAPAKYYRMAHHNYRHTPYTIPHDPTQQYYTQTSTYLAHQSPETYLIITHPENQYERRIATFIARAILGLPVTVLIILCAPLLIATSKYLMNIRLITTQH

SEQ ID NO: 946881 - protein, 180 aa, Homo sapiens
CVGYPAEIRPHYGPDVMILCGSSGKAHGDGAVREVLDAVGSYDDPTAALERLSETSHHSPWKRCSSQVLMRSVLCDRYAEDITPSPPMDTNTLFPDLREIEKLDRFPSAHRSPPTIQCFASSGGPIFYHYLDGSSYCLPGTTVKPGHFSQQPAQGFHFGPFDQDQAGHFNASIGPVLGGF

SEQ ID NO: 946882 - protein, 272 aa, Homo sapiens
EEETAAHPLNPIDRATLEMSGEPGREHKGKGEKRKRGRQRMRTTEEKGGKKGRKRGTKRKQGRGRRHEKRKGRKRKEKGKREKERTRERGEKEGKQTKGKKKEGGEKREKGKKQKSRENARKGEEGARNGRRTRQGGQQTEKPEKKKRRRERSKGGEAKEGAGAKRERTGIKGTKAKWQKEENRKTGGRQEVRRGGKRRLKSGGKQEKGGRWRIQGEIERQQRHPEQGEKAKEDSQARKEENKRIERGRGQNDKDEGKGMQKRREKQRETGP

SEQ ID NO: 946883 - protein, 370 aa, Homo sapiens
MHSSTVYRHPALTVTFRSSGLKHDSARLSVHHKAVWMRIIIAAYRSTITGPHYYVMNSLKSHIDYHLGGICIRFYRPMRDLYKSALLVENYVYLQTAASGGHNNCAINQNHLAKRHLSNGGSFPSNQRLNPYNMFTNLSLPGSLIKHRRFPQPIYHSLGEISPLTRAPPSFQSCCRTHSTDTQENNRVTPDNIGPYSSTYIGTFYLVLSTARILLLGPRDSLTRVTVKAFQLQLRPLTLFVLNRVSHSTHGQSVPQSYDTYYTLSRPTSAPKRIPIPISALSHPLPPTLLHRISPLFLNLRMSHLHITLNSITMRACRYLYNTHYVIIVTSLTSYHALTRALCEHSYLLSPTLLHRLLYPITQCPHLPSV

SEQ ID NO: 946884 - protein, 74 aa, Homo sapiens
WVVTRQLDHYDRYYSSNQQSSTKHGSSVLTSYRYLLTTVEDHLTVLGRSYFLADSACDRTYVCDSDYLLRLCES

SEQ ID NO: 946885 - protein, 77 aa, Homo sapiens
HITRRGITRGCITRGSITRGGLARGGITRGGITRGQCSGGWISGIQITRGWIARNWFSRQFRDWFWSYIMGRQRFTI

SEQ ID NO: 946886 - protein, 140 aa, Homo sapiens
MICIGHDYFCNSAAHDTDMESRGISNIVLRLDSNYLLSVVTLSGTSVYYYADESESHMMCVMKDMYYQHRRIVCAQHSQTVVASGIWMYCQDSVIYYDTVASRSLTTECASCISDDASALARVRYRAWKYTIHRYSSHIA

SEQ ID NO: 946887 - protein, 147 aa, Homo sapiens
VWWSTLFWIPVDVDVMMGTFTESFAASAGYIAGNKEPTDYLRTHSHSAVHAASLPPSVAQQIITSMYSIHAYDGTSLAIECFHQLAALTPPFSTLLAHMPSITYSDHSLALPMMLYIPASCPLRTSRCFIVPLLSTLILSLPPPLSS

SEQ ID NO: 946888 - protein, 75 aa, Homo sapiens
AVYGFGRFRAARAGKAEDKEWMPVTKLSRLVKDMKIKSLEEIYLFSLAIKESEIIDSFLRASLKDEVLKIMPVLL

SEQ ID NO: 946889 - protein, 146 aa, Homo sapiens
LFPFGVPLKILVSPWSAALPVVYRNCKNKPYPKSHLCRGVPDAKIHIFDLERKKAEVDDYPLCGHMVSDEYKQLSSEALEDARICANKYMVAVAKMAIIIRWRLHPLHVMRINKMLNCAGADRRQTGMRGAYVSQGTSDRVHIGRY

SEQ ID NO: 946890 - protein, 217 aa, Homo sapiens
IRPLWSSDVSTTSLRHLRPDGSAGLTRMNRLDRQRYRYMPKRSMSVPPGAAHKNEEDEHPEYGRTLIANRDKAVKCISSISSRHIQYYSHNEDQKRELTISVLEHDRTEYTQALVINIQLGAYVTLIQVSVHLEAAFTIFDGIYGLTLIVATESHALNDNASIFVSIVLITEVILHLTFTDLAGVITSRLILAFRRSALTEPPKNSSIGEGLCRPAW

SEQ ID NO: 946891 - protein, 120 aa, Homo sapiens
MPHAIAIITPLPSLHRPFPIILYFRPGPPQRSRHPSCFPSSTTSPPSRASLITHAPQRSSCSRPPRTPPCPHRMTFALPPPLLLIPLAFPLPPSFTPLTSFLVTPLPSFLLPPLPPCLLS

SEQ ID NO: 946892 - protein, 55 aa, Homo sapiens
MTGGTHRKAHLITMLRNKSWMSVILTSTLVDTYLEKFLVPGSLDCRANCYACLDC

SEQ ID NO: 946893 - protein, 103 aa, Homo sapiens
MPKHEFSVDMTCEGCAEAVSRLLNKLEGVKYDIDLANKKACIESDHSMNTLLAPLKKTAKTASYLDLVQQAPDDPQSTVRTNACSTLILPLTFQTDLFLATPP

SEQ ID NO: 946894 - protein, 106 aa, Homo sapiens
RGRRPDYCAPCENQYITASMLYRLHKDMRITLLIEYQLWSVAMNEYTCIGMFLVPSVKHSRLMIMPEHDQRRVYERTSFMASVDISYNNVHVHVVTRALACGRYIR

SEQ ID NO: 946895 - protein, 125 aa, Homo sapiens
NAAGLIKARTAIISQSRISKLDRLHNVMMIKLLMDNWILSVPINEITSIGNFVLVSVKLTRLMIMESMSRDVSDGGPTPCHHVISVSTIFTVPLANKGSRQYRTSTFLYTVTLGMRYYTHARIGY

SEQ ID NO: 946896 - protein, 109 aa, Homo sapiens
MDRLHSVMKITVVMDIQIYSVSKNELMCIAIMVLASINFVLLVIMPEQDLTRMSERTKTLAGDRISFKAFHVIMGIQWPLGSGRNISMEVTIGMRYNILLRKVYIVPRS

SEQ ID NO: 946897 - protein, 226 aa, Homo sapiens
RGPRYGKAGDNEWMPVTKLDRLLKDMKIKFLEEIYLFSLPIKESASIGFFLDASVKDEVLKIMPVQKQTRADQRTRFMALFDIGDYNVHVVWVDKGYKEVASDIRVDINLAKLYIVPVRRVYQRNKIVKPHTVPCKVTGRCGSELLRIIPSLSGTCSRSAVPNKLIMKSVTEDVLNLALRCTCTLANFARPPLYHCYDYIYQTLTSEGDCITSLPIAVTATRDLPG

SEQ ID NO: 946898 - protein, 130 aa, Homo sapiens
WGFYRDVGCQGVFISRPILFLRAPVLPRLTYSARTGLSLSAQKFPGAMREYSYGKSTKLVLKGTKTKSKKKKSKDKKRETKMTKPSLILLESAGREQTLVKFQETIAIETEKGTYLHALENGLFTLGSST

SEQ ID NO: 946899 - protein, 236 aa, Homo sapiens
RRRPDFGEICETEFFSRKRDGEIAQGHDRPRYSRLIKIKSLPMTESSTMASNVRASIDYALVVIVHQQDQTLMRELTQTLLKMISESTVFLVTVGDNGSIDMERDCCIVVNMGTRYTILVRKVYSRPKSLMPRTITMKGAGRYSSALQGPSGSPIEAAIGSPSWPNMLFKLFSHRPVVHLKNSGNLQPRQVWHSTLGILPRPHLSHLRLLRNGLNFMIRDNDNSLRAYCRPARPVL

SEQ ID NO: 946900 - protein, 183 aa, Homo sapiens
RQNKNFLKKKVETKKTKKKKTTQEKKKNQNNNQIVWAPCPQGFSPVPCFVWGPYYGPLGKTAFLGGLFPFTGGPFPHVSCGKTRGFPQLLPWEISPFCPGGIYGRGPPPGPFSKRSPPSLGLGKCAGQFFGKNPRKIFFNRPVFSTQGPVPGTLLFIKSFPPYGGGCFHCCHGAPFLSRGFPL

SEQ ID NO: 946901 - protein, 131 aa, Homo sapiens
MKIQLLKDIYIKSLAENYLSSMAIKELDTIDFFLVAILPDQDLTRMPVQKQTLAGQRIRFKAFHVIEDYNGHVDLDVKCCKEVTIAMRGTIIAGKVYIGTSAAGTRVTLIMNARHLPFYGAKPLRFIQWYA

SEQ ID NO: 946902 - protein, 113 aa, Homo sapiens
MAGIRRLVLQRPSGRLQTVTNGVEDLICADRIRYKCTRSRIPVKGFQASPEDHEKYHGDPQNPYKLHIDTSIKKYKKTAILTERATKDARIIQSTYPSCSQEYPYSECRIESR

SEQ ID NO: 946903 - protein, 147 aa, Homo sapiens
MTRAWFGKIADSKGLSCIKIRRLGKVQDDPDRVGDLYQVSDYESISAHRFHAGRLYKTCGAIDTARARSDTCHGVYLDDVKVDVRVNGVHRLLGGKGSTEAAYTVVRNDRGHELYHYARKAYLDSRSVCPHCALKVDRPYPDCGART

SEQ ID NO: 946904 - protein, 114 aa, Homo sapiens
RLGPEFGPIQQIQVFTSIQSNNVLQALLTPMMLLLGRMTLTYCRERHMDFVIADSLQGPQVDTLSADTVTRARTLHQIIAKVHRPVDAVDGVLTYTAYKRAPALMGLQVHVAIA

SEQ ID NO: 946905 - protein, 102 aa, Homo sapiens
MTSDFVLRSLDVNMVNAYFYYTRKDILGSMLLRSTHNTFKVEGHDLFGSAVTLYSNQSIRHSCYRRPEVGSECCNVFSTTQTIAVHGFNRPGHQKPSITNVG

SEQ ID NO: 946906 - protein, 165 aa, Homo sapiens
MQLLRHRQRSTRSTSRQSSYKRYLLCYPDSIMVKACYCFTRKDTVRLLRCLHSHRPIHSKKCMISSVEAMTYYMNTHDYTFLLQGGLTSGLISTCKVLRPILGILGQCTGLRTTHAHPMKHYHEAQCANFGLVPAALRPDMYGLLAVCLLLTAPVAFQYGPHSRF

SEQ ID NO: 946907 - protein, 67 aa, Homo sapiens
SLSHQILDSSCSDRGAAYDYMAPGHATHPAVRMALGGGYHAYPSGAGKALSESRCRMCDKLLNANQP

SEQ ID NO: 946908 - protein, 140 aa, Homo sapiens
SKRNLTISTLDTGCQKLIEHAEYRKLRTFNEKRMATDEAADALGRTWKGYVALRQGGNYRRGFRTKHGLLTHGSEQPVTEIEANCDTTIEHWTQNIRMARECTSKAEPTELNLIIVDRRVFLDWLILHCLTVLYPDEFAV

SEQ ID NO: 946909 - protein, 142 aa, Homo sapiens
LCEEDTAFRAEDVWSERFCSMTNCCSLYAYGTRRPGSPRTCSKALKDTGKTPVEPDVAIHRIRITLTSRNCKYLEKESADLIRGAEGILKRKDQFNCLPRLRESLRLRRVEKVLIRGIDSRVELTRLIGLHSPYEIVQHISS

SEQ ID NO: 946910 - protein, 141 aa, Homo sapiens
FSVVTTYADEMMPLVKDFFHASPNEERRMHTKKHLVQSPNSYFMDDNCQGCYKITTAFSQAQTAVLSVGCSTVMCQLSEGKGWLTEGSLFRRNRTKSTLSQDDWETESVIDTLGKINFIDKKKRFRPPITLALDLGFWCVR

SEQ ID NO: 946911 - protein, 122 aa, Homo sapiens
LVFEAVMALPRGLRLSAQARKQGEVFRQNLFQEAVESLYSILATVIYLNQLLQEDSLNAADLTSIRTSLDMLIPDPSPKDDEMETDKQETNRSPYSVDFSLRMRKALALLALRKPRSLDSQS

SEQ ID NO: 946912 - protein, 170 aa, Homo sapiens
STHTPTFETIRAGLRVDTRGRGQYGRGQTLNLFCPGSSAMVPSRKFFVAGNSKMNGRKQSLGEPIGTLNAPKVHEDTEAARAPPTAYIDLARQKLDPKTAGAAQNCYKVTNGALYWRDKPWQDQRPRCHEREPRALRENRRCFAQTREPDCATAAPALGTTTRRFTRLGG

SEQ ID NO: 946913 - protein, 102 aa, Homo sapiens
MYRWQVGAAAVAMTRVNQCLAQPEDLSTQRVSFKGQRLYNTLSVAGRKQIYTLILQYQHNTPTDLSGFPSFLLVWRSIPLPSAFAPGPKMINGGQISSTPPL

SEQ ID NO: 946914 - protein, 181 aa, Homo sapiens
GRVRGRRPDEGKAWDNQRMTVTKLDRLHKDMMIKLLMSNYLLSVPMNESTSIGNFLLTSVKDAGLMIMPVHKQSRGWQRTRFKAYVAISYYNVHVNLVHKGCMHVDIVISSDMILGKLYIILLAQYTRGYRAYSLTLPIDDFGLLQLLRCYVSAMPYIVTESVHRMCLDTYYTARHDECLT

SEQ ID NO: 946915 - protein, 167 aa, Homo sapiens
MTATKMDRLLKVMRITVTEDNYLLSLPIKESTSIAIMLLDSIKDDRLTIMPVQKQSRACQLTRFMASVAISYNNVHVPLVHKGCYDVDICIPKDMILPKLYIVMRAEDILEQQSVKSDTSPCKMTGYYRIYAAKISHAINCNSNWLPQIALRYLSNSLTLKTDSTYH

SEQ ID NO: 946916 - protein, 241 aa, Homo sapiens
TREFGHYGRGLCLRPVLRALWETKTMTANKMDRLITVMKIHVLADNYLYSLPMNELTCIAMILLDSINDAVINISPEQQSTRISELTRFQSLHGTSYKNLHVNADNKGNMDLDDDICKDISLAKRYNDLCAKTTRATRASSPTLTHECSLTISLLTVRRLMHSDKVPAIASAKWANMLVDLGYRARVNRALKCTVILATIGPTLFAKSHFNTPLDPLTIRLNQLTFTSYQHPVRASSALCA

SEQ ID NO: 946917 - protein, 173 aa, Homo sapiens
RCRRPGLSQIWYNKSRTATKMDRLLKDMTIKFLEDIYIISLPMKQSAIIAIILQDSIKDAVVKIIPEQNLTRTAQLTRFQAYHAIRFKHDHGYWITSATWILGVDIRKDMIMVKLCIIIVAKTTGVTRSASPTTSTLMESDHYTFKVRRLIDVPICNSIASETVTTMLLMTVG

SEQ ID NO: 946918 - protein, 108 aa, Homo sapiens
MGYTQFFETGPYTNLGGGFVPFHYPIQTTQNTLTPLIPTPKLTFVPHMAHLLQALIAAHLLFKTGTAGYLPLPPFPYLATRRPGFTFHNFITSNQILPNVNTIPKWAS

SEQ ID NO: 946919 - protein, 96 aa, Homo sapiens
MLFSEHDLALLYSFAVRRVFLLILQPFPPSANLTPRPGLSPVEHGLLKIPPLSHSPTSYDSSLHQLLNLHSFHYSVIDPFRLNPHILLQSPPSPFC

SEQ ID NO: 946920 - protein, 137 aa, Homo sapiens
LRCFTEDPGVSMGRRPVRCYRYCKNKPYPKSRFCRGVPDAKIRIFDLWRKKAYVDDFPLCVHMAPDEYEQLTSEALLAARLCTQFVHIRCVPPAFHISTRLYHFKPCASTRPFPSLLLTASKHARNVLPSLITFPFS

SEQ ID NO: 946921 - protein, 109 aa, Homo sapiens
MPCSASSPFLFRNYKLCVLFACSSSFLRRSSTLDAHAVVQWLDLGSLHPPACNDAILPAYAFLSRCDFSSVAPMPRVIQHFCNRRIPSLHARVRLASDFGVIPLSGFPG

SEQ ID NO: 946922 - protein, 39 aa, Homo sapiens
MWPTWPFPRLCVGPNSLAPCFDAELAPSRVLPVTSVLTD

SEQ ID NO: 946923 - protein, 119 aa, Homo sapiens
MAFLQDAELRAQKYLVSLEYLLLNGQTGMQSVQVFLTLPGTYFQSPGLVVSICLINDEVGEELEWGGWEVSDLTSGLNLEVHLEIDINIAQGKYHQCGFSYLSRLLSCHDFVITLFWPF

SEQ ID NO: 946924 - protein, 118 aa, Homo sapiens
MAHKPDMGDIPSFYKAKLRTTDTHEKNTLPPKRGGSKISRMKFTKILHDSLPPSSPRPYSCCAGRPTYKMDTSHKLHWEPGHSALMPPACESLKGPPPNRTAKFSGLPRDIIDNFSYE

SEQ ID NO: 946925 - protein, 233 aa, Homo sapiens
MDRGGYVGEKTRRPSTPPQYTAETRPPQVVYIRTVHRLISSPCYAWPSSLDADDASTTDHLCIYRHHAVLRSTYRFCLPLKHLCVSLVFTISSTIFLHPRPSFTIPYHLLPTLSRLASHSALLSTLFSPSFLPCIILLLSLPLPFSSSLITPLSPPPISSSPPPSLLYSFSLLLSPLFFSPPPPHLSPLIMPTSTSLPPFLSHTPYFFSLPPSPHSCYFLLSSSSSLFPPLSP

SEQ ID NO: 946926 - protein, 144 aa, Homo sapiens
MVVAREVTRVRAVRILTCGVAKGLRMHGSQHGKQTLEYLRYEDTLILEDQSTGENDMVIMRPVNRYEYKFGFELPQGPLWTSFKGKYGCVDYWVKAFLDRPSQSTQETKKNFEVMDLVDVNTHELMAPVTANGVSCMFIPDGRE

SEQ ID NO: 946927 - protein, 110 aa, Homo sapiens
FGTAAIMAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIR

SEQ ID NO: 946928 - protein, 123 aa, Homo sapiens
VAGVNLALLQVINSQYAADSSKTILVNTVKPRLYYKIQKNEPGKAATACIPSYSERLTLENKVNLGRARCNETKCATALQHYSLGDSETLSQNKNKKYKKLTMLAVLAQFTLNPTKYNHAAAI

SEQ ID NO: 946929 - protein, 144 aa, Homo sapiens
LLHKTAPIANKEAAATPKAEAKAMALKANRATLNGVHRHYGMNIRTERTFRCPKTLRLLRQPKYPWTERYQGETSYDHYALIKFSVTTVYVMKNIEDNNTLVFIVDVKANKHHIQAVKKHDDIDEASGILIRDGETMACVRLDT

SEQ ID NO: 946930 - protein, 109 aa, Homo sapiens
IPEVDSIFAERSRSVALAVLVLLSLYGLQAIHRTPKIQAYSRHPPENGLTKTLNGYVSGLHTSDIEVDLLKNGERIEKVEHSWSFSKDWAFYLLYYTEFTPTEMSLPAV

SEQ ID NO: 946931 - protein, 128 aa, Homo sapiens
MDRTILLLTHRYDALAEEHDGEEARAQQPWVLRIPAKTPGEPEEAMYRNGITLTSRNAKAKKKEYADSRRGAKEETLKGGPGRMPTKTLRITTRLQVVKVLGQWDRCQRRIHKRLTDLHSPAEMVADY

SEQ ID NO: 946932 - protein, 138 aa, Homo sapiens
LLFRNTLHERLTIYGPHAPAPDQPIDALAEEQVGQDARAQQPWVLRIPAKTPVEPQEAMYRIGITLTSRNVKSLKKVCADLIRGAIEKSLKWGPVTNAYQDFENHYMTPSGEGSKTWDRFQMRIHMRLIDLHRPYEIV

SEQ ID NO: 946933 - protein, 139 aa, Homo sapiens
MIAPLHSSLSNNRATLSSILPAVYSELSPFTGTTPASHLRPTVSSTQLALRLPDAPTARPIVPPPCFYPPPSFPPPHYPPSSPAPPPRIPSSHPPPLPPLPPVPSPDRTSTPPPPPARFYPLVSSRVPTVCAPLLSPSF

SEQ ID NO: 946934 - protein, 169 aa, Homo sapiens
ERRRERREEVESHGGEIGEKNGKMRKKGGGEEKGRVGRGGGRERKRGEEGGGKRGKRGREGGKGGGRGRGEGGVGGRGGEKGEGGERRGKERGGGGEREGERGGRRKERGEGEKKREEEEGERERRKEEGGRGEEGKEGGREGERRKRGRRRERKKGGGGRREGGGGGG

SEQ ID NO: 946935 - protein, 135 aa, Homo sapiens
PHRALSLGRPCIRKGPKLVLIHTIVTTFNSQAFSNQGATFSSYPGPCKLYSRILARNPGPPDTLTFLSSFLNAAASFLGVRKQVPEGGEVSDAKLTGDVGEFLSCPEAGDVREASSHGPLEQQPLILSACRVLAE

SEQ ID NO: 946936 - protein, 99 aa, Homo sapiens
MQSIMRTLWYPICETVSPFQVKMQEDDTIKLLQLKTQRSLLVWEPASISQKHCVLETNVAGFTEKSVGSTETDYSRIAASILKLPVTTPYFTIRHCVCP

SEQ ID NO: 946937 - protein, 70 aa, Homo sapiens
MTPVRNMNRLIHLLNHSGWSEDKEYAIYGMRKRSLTACGLPDPASYDCDVPSRALVTRPVRKLVINRPHD

SEQ ID NO: 946938 - protein, 224 aa, Homo sapiens
KGSYPNSHSRQHDPYNPTTNPQPPRPPIPPNTDRIQHLPPHPHHYTHNPPPPPHPPPPPHSPTTQPPPPQPPHTPNPHPHPPTPPPQPTPPPPPPPPPPPPNTPPHTHPPPPPHPPPPPPHTHHHPPPPPPPPPNPLPHHPPPPYTPPPPPPPTPPPPPPPNPPNPTIPPPTPYQTTTQPPTSHSILPTTPHTLPPPHHHTTPRTPPPPPPPPPPPPPHHLPPP

SEQ ID NO: 946939 - protein, 181 aa, Homo sapiens
LRAAWRFDERLCLLDCRLRIFLGLLDASSWSPMCAKTVKLGRENVSLSNQTAVSPPRVNTAAYSWTRTPARYALTSTCGDIKPHRYRLGTVALTEILACQKSTELLILKLPVQRFVRDIALDSKTDLECLSASILALDEAIYSYLVGLLILSNLCGITLRERPSCPKTSHCAWRYGERELT

SEQ ID NO: 946940 - protein, 125 aa, Homo sapiens
ANRGSPWAIGTRGLWFVGLVFEIHEEKWLQRTYWAKHCDTLHKGPPAAPRRISAFLRADMDWLCVPTLSSRIAIPMCQRKALVGGDCIMGADFLLAALAIVSEFSRDLIIGVRDIPRYPPTAPSW

SEQ ID NO: 946941 - protein, 178 aa, Homo sapiens
FGEFRGWPTHDQEFNGGSEWVRKAPGDTRPYAKNGRFESNIDRSLLKTRAGVGEPELKGSSWWIKVQGRFLGTSRSLDAVGDSGHIRGAVNMPFMDFLTEDGFEKGPKELRALFQTKKVDFLQPFIATCRKGVPACHVALGAYLCGKPNVAVYNGSWSEWFCRAPPKNRVSQGKFKKA

SEQ ID NO: 946942 - protein, 114 aa, Homo sapiens
ILAASQRTHSTATTYDMLGIYSIHYSTLPSGPEFGIGRQQLQHPNQAQEVHEKLRAWLKSNVSDAVAQSTRIIYGGSVTWPTCKELASQPNVDGFLVGGASLKPEFVDIINAKQ

SEQ ID NO: 946943 - protein, 206 aa, Homo sapiens
RIAIAFSGGLDSTVLLDAAVRVAGASRCVALHVHHGLSANADAWVAHAEAEAARLGVAFESMRVDVPRDSGLGIEATARERRYAALDAMCERHGAATLWLRNMRTIRPSPVLLQLLRGAGIAGLAAMAPRYRPDGVSVERVRPLLRLLRAQLERYAEQHALAWIDDESNGDTRYARNALRIDVLPALAVHFPGFRDALGRAAQHAA

SEQ ID NO: 946944 - protein, 115 aa, Homo sapiens
MKQALLPRQLAGITCIHLLHRFLDLTDAIEERTLDGLGPFDFQDTDIPFGGPFQLNSMFRRLKKKRFELGAYSFHGPTGGTGFSSGLAWGLPGLPNGNEHWCLSPALPYYRIPPF

SEQ ID NO: 946945 - protein, 120 aa, Homo sapiens
WLEIDEFLFLKNANKGGTRWLMPVIPGLWEAEAGGSLKARSSSPAWPAWREFVCAKKIKIGQGWLCAPVIPVTQEVEGGNCLSPVGGGCIEPSSCPCPPAWVTEPEFVSNSPSKPTRICP

SEQ ID NO: 946946 - protein, 116 aa, Homo sapiens
VPGIVCTGPFVVWAIQPLCLFLECTRSHEDFTVGHGVYVLPINSPADMVFSINGVQDPGPPRAYILQREGGWISGFQGMTLPPEFGGVWVLGDVFIRQDFSVFDRGNNQGGVAPVG

SEQ ID NO: 946947 - protein, 116 aa, Homo sapiens
LVPMHLAPERPQCLLTMARVLPTSCQSFPKETHSKYFFFPVESEKENGIVVHSVVPCNLRSLMCSLSDLKDPGVNILGIVIIPLNPWILNPVIFQYKGWLFLFMSLIWFPSCNSAP

SEQ ID NO: 946948 - protein, 42 aa, Homo sapiens
GQSLVIPPEIGNIGFNPINSVCVAAVMSLTSFEQMKITFNSF

SEQ ID NO: 946949 - protein, 68 aa, Homo sapiens
VLRAGFPAVALGLQAQVQVPGPRSLDLWPEQGNPRARYWRNCPEPLARGSITKFKPIKQYEYLCFSAL

SEQ ID NO: 946950 - protein, 35 aa, Homo sapiens
GHVRAPRGAGKELPPDPGDPPIDARGHHNKEPSTL

SEQ ID NO: 946951 - protein, 147 aa, Homo sapiens
HLHTFSAHPWCVAGALESVRILKSAEGRVLPRQPQRNVKLMRQMLMDAGLPVVPCPSHIIPVGVADAAKNPEVCDELMSRHTISGQAINYPWVPRGKKFLGIAPPPPPPPQMMYFLENLLVPWKQVGLELNPPSSGECNFCRGPLPF

SEQ ID NO: 946952 - protein, 70 aa, Homo sapiens
MVSLFKSKDLEEKKEEKILYVTDPQKGAHESELFASSTICTYKRSMTVRLMPENSENISKKCYLLTAKRN

SEQ ID NO: 946953 - protein, 65 aa, Homo sapiens
ARRGPFFAFFNPSSGRGVQNLPQNLFTFFRIGLKPFNKGKEQFPQNFFKEVEQFPQVAKAYQGRY

SEQ ID NO: 946954 - protein, 113 aa, Homo sapiens
KSQPRGPFFEPPLGKRGLGNTQTGLSGGGGPPPPLGKVPVFVGQAKTKPGWGYGKVKNFFVPPKFKMVRKTILKKTFQNSRWGKNFKNPFFLYTLKRPFPRVLSKKPKKVGFF

SEQ ID NO: 946955 - protein, 72 aa, Homo sapiens
ICAGEGSYGRIRLEEQGSPSFPGLKGSLELGFEGSGKSSEQWSSGEMEDGGEGVPSGDIQHLSLETFEVATT

SEQ ID NO: 946956 - protein, 45 aa, Homo sapiens
HWARDVIGATVCDVCGKVFSQRSNLLRHQKIHTGERPLRVQRVRP

SEQ ID NO: 946957 - protein, 76 aa, Homo sapiens
MEFHVNRTQVFLEIRLLSLSIWSLEFTHAVAESSSLFLFIAGMHYSLSICSVVLIYYEYSCYNEIKHILKHPKKTK

SEQ ID NO: 946958 - protein, 64 aa, Homo sapiens
VFKPNQASQHDMCRFHSEYIDFLQRVSPPNMQGFPKSFNAFNVGDDCPVFPGLFKFCSGYPGML

SEQ ID NO: 946959 - protein, 108 aa, Homo sapiens
MSYQQCEVHFGAKPFKYPPSMEFSPFNGYAFLTAEEKILLPRPRRLALFKPVRIPENCCSLCCDEVADPPLKPCGPSDLCMDCALQLETCPLCRKKIGFRIRPIFHIS

SEQ ID NO: 946960 - protein, 72 aa, Homo sapiens
IANLSFDITGRFLASCGDRAVRLFHNTPGPRAMVEEMQGPLKGASNESTRQRLQQQLTQAQKTLKSLGALKK

SEQ ID NO: 946961 - protein, 183 aa, Homo sapiens
TRRKNVEEENGSDESEIDISSTDSENEEEQNGEEEIVNIDFDFFGGNPEVDFHALKNLLRQLFGPQESTRIQLSSLADLILGSPTTTIKTDGKESDPYCFLSFVDFKANHLSDYVKYLQKVDMRLSTFFKTMIDSGNKNCALVLSERLINMPPEVVPPLYKITLEDVATALGDDKHYDFYIIV

SEQ ID NO: 946962 - protein, 129 aa, Homo sapiens
ARGSLSPLVPSPLYSPEQLGPGRGDSAYLVPPWPPGSPWLFIRVCLPRGIDPFPPGWLGGGAQGPCDPSFFPPVPRLGLAAKLASPWPPVVSWGGRGVSPPLCLPLPSSPLFRILMSFLFLPNKMMETH

SEQ ID NO: 946963 - protein, 80 aa, Homo sapiens
QTFMSCHLIPGMFQRLAQLRKNAFASVILFGTHNSSSLFGVWVFRGQELAFPLSPDWQVGFESYPWRKLDSGNEETPTLV

SEQ ID NO: 946964 - protein, 87 aa, Homo sapiens
ARAHTYNPTIGATKRKSEYTVNSHKNTFIHYNGFEANFDASLKILPLVTLLECGKVMIRFSSELLASLIERQTPKNLLATPKHQLDG

SEQ ID NO: 946965 - protein, 123 aa, Homo sapiens
FYFLGTGKMIPINLFRRMGSEGNMWGGILLTGEGKQRLPFLFSLRQTGGDLKGGGSQGEGVGGTPFSKAKTGGLFLFFRGVFSGGRGAQLVGGGGNQHSLVGKPRGLKTTFNPTGLGGGGNFF

SEQ ID NO: 946966 - protein, 104 aa, Homo sapiens
SPPQPWLDAGPRPSFFGGQMTVSWTFDAPPALPVANVMLPGAVEKLGDWAKQKAATNPEALPQKAGEMIGECMGPGALGSLPNPFQKQRGMKKQAGSSGLMPFL

SEQ ID NO: 946967 - protein, 69 aa, Homo sapiens
RHELANPFQEIYNHITIMVYHLPFRKQAFEGFSQYQSDARQFPALQVIDQLRKEWPSCNELGAIGMLNQ

SEQ ID NO: 946968 - protein, 107 aa, Homo sapiens
HEANTKDNSNSDDEEHSSKKRKTKKKSITDFFKKQKKNEDTTTQNGAPDDAAIKQPRLLKNCILKPYQLEGLNWLITLYENGLNGILADEMGLGKTVQSIALLAFIY

SEQ ID NO: 946969 - protein, 41 aa, Homo sapiens
MQRSYDSYYYPAAGPGPRRGTCALGGSLGSLHASPFRIPED

SEQ ID NO: 946970 - protein, 133 aa, Homo sapiens
ARAKLKCRGKGLIQNLNVKRQIFRIVMTVLGLTLATAFQNSDFDIGNEEFVNTDRETIFSKCIIGFHIDYIENGQRQNNNDTHSPYRYRSTVAMTGMIRNLMLLYLHQTRVVTGIAMLINTIKVSTSYYLKYA

SEQ ID NO: 946971 - protein, 92 aa, Homo sapiens
ARECSLKSKDRVRPYEKSNKTFRMAVDFQRNWVDIRGVYRFYVKELVDGKLPKTYGKMGVREFGDKKVQVELDENEKTINIFWPTTEKEDRT

SEQ ID NO: 946972 - protein, 71 aa, Homo sapiens
HEEVYQSITSQAAAAYALVLNGKCVDSAKASLSFPVCETLTSLHGNTGPLHLELMFPDGYPQTLCSNKLYN

SEQ ID NO: 946973 - protein, 89 aa, Homo sapiens
TRNNYIIDCYVQYASSALATKVFLRSAGGAAFPLFTIQMYHKLNLHWGSWLLAFISTAMIALPFAFSYWGKGLRHKLSKKDYSIDSVEM

SEQ ID NO: 946974 - protein, 118 aa, Homo sapiens
TRESMGGTTLAPERVAQTVKFIYDMPQTVNIREIDIAATNQNAVIFNILAKKDTSYSLVSFLAIYFIFYLGDKLCLQKLLFRKYFLKKIRSFRFFGCFNNISCHKFWSYVITIVKFFF

SEQ ID NO: 946975 - protein, 43 aa, Homo sapiens
PQQNLMVSHPLRQRSVSLDSQMGYLPAPGASRSCEIERCAFVL

SEQ ID NO: 946976 - protein, 63 aa, Homo sapiens
EKRAQANARQTLKEHVQDFAMQFEQQHGLRGCWTDRGGAQQDCSLFLPQIPPDPPGAIIKRIL

SEQ ID NO: 946977 - protein, 118 aa, Homo sapiens
FGWNTEILCSGEVQVRFGWNTEIPCSGEVQVRFGWNTEILCSGEVQVRFGWNTEILCSGEVQVRFGWNTEILCSGEVQVRFGWNTEILCSGEVQVRFGWNTEILCSGEVQVRFGWNTE

SEQ ID NO: 946978 - protein, 184 aa, Homo sapiens
LGHDLCGIVFIDPGEDFKLGTIKGQLTFVQVISPGGDYECNLVSLQWRKDMEGFVDTSVAKFVFDRNLPFVGRQMALHANMASQVHYSGSNPPDIYPSKWIARVRHIKGFRQRIWEEAAYSTPGHPLVHPPSHSKAPAQTPAEPTPGYEVGQRKGLFSSVEDFTEFVEAGALPPALALEGIACQ

SEQ ID NO: 946979 - protein, 51 aa, Homo sapiens
MLIVFSKDEFPEVYVTNSYENYVADIEMDGMQVELALGDTAEQEDNDRLRP

SEQ ID NO: 946980 - protein, 98 aa, Homo sapiens
VHTPVPARTVDASVPPAGGAPYRAESESLESRLFISLQLLSCSRCSDRLCVLRRRHSRLCRNDFLAFSSSMGDTPSSSTSWISSKVTGCVLKRDWRGR

SEQ ID NO: 946981 - protein, 99 aa, Homo sapiens
PHPILELVKATRDLLPVPSQTGLWGLRCLLCFCTSVQPLAWLRSEELPVATEPLERGQFHSQTAVSAKLMLDFEDLIAGQAWWLTPVIPALGGQGKRIA

SEQ ID NO: 946982 - protein, 37 aa, Homo sapiens
MPHADPSFPPMASGPTRSGIVVAANFAIKTLCQSLKK

SEQ ID NO: 946983 - protein, 171 aa, Homo sapiens
SRASGDVPAVAPARLRHGDVGVDLGALPHQDVAEGAGALDQFQAPGREGVRVVDVLRQERVGQGLGEGVDPDHAHQKARQRRFGIPVLGEEPGIELHVVGGGIENGELLGDRGIARDLRERRRPRHAEMLAIGVVAGEPVGAGLLDGEPFETEDRLTGVADAQGAGGLGGR

SEQ ID NO: 946984 - protein, 130 aa, Homo sapiens
GGPPGFPLGKGAGGPPPLIGVGPPFGPPRVSPFGSRVVFWGELGGGTLFPPGPGLPGFRFLNPPPRGIGPPGPKIGRGGGSPPRGGEGEGVFGGGDPGVLSKGNPGGWAPQDSFFFKFLSQKPGKKKSFS

SEQ ID NO: 946985 - protein, 119 aa, Homo sapiens
CKSKDIVLVAYSALGSQRDKQWVDPNSPVLLEDPVLCALAKKHKRTPALIALGYQLQGGVVVLAKSYNEQGIRQNGQVFEFQLTAEDMKAINGLDRNFPYFNRESFWEPPPNYPNSDEY

SEQ ID NO: 946986 - protein, 103 aa, Homo sapiens
RDRKMVGNVTGAQAYASPPKGLNIWALILGILMPILVIVIPGVFFQAYDRSGGIPEARGFAHALYPPDSNFHSSPRPRSRVLYQPFILPRFFQWHSIKGTGFW

SEQ ID NO: 946987 - protein, 67 aa, Homo sapiens
YPAVSAVWGQCQVRIRYLGERRGEPHSLLPLSRLCVRPNLGDTRVGQVFALPLPPAIKGYLFYQGAL

SEQ ID NO: 946988 - protein, 98 aa, Homo sapiens
RASLKGYQWLKDKILSEEGRRQQAKLKELQAIAERLGCTLPQLAIAWCLRNEGVSSVFLGASNADQFMENIGAIQVLPKLLFSIIHEIDSILGNKPSS

SEQ ID NO: 946989 - protein, 125 aa, Homo sapiens
KENFSPPPKKFLAPPPPRGFFKNLVGGKGPKNPNPPPPLFGPPPPFGGGFKPPPGGRVFPPPKGFVFGPPPPVVFVFYKNFGGGVFPPPAGPPPPPPREGFFFGGGAPPPPGGFFVFGGKNFFWG

SEQ ID NO: 946990 - protein, 102 aa, Homo sapiens
AGPPSGSGTGAPGPILEPLSFREGAGVSPPLASLRLPYTRLHLQSPRKLALKLQGFFFLQILDQSLIFVFCLPLMLGPGRRALLLFFLCSFYRPRVLSRGLS

SEQ ID NO: 946991 - protein, 135 aa, Homo sapiens
PPRPEIDEESPAPLEGFNRTASGGAFVGFTVPSLSLPGPYPPRQIPGLDAPGYEGKIFFSWAAPGDNFYGGKGPRFFLRIRARIFGFKGRFGDAFPGKTGLAPKGGPSQGRFGFFPRKFFRRKCPPPFFCPLKDR

SEQ ID NO: 946992 - protein, 123 aa, Homo sapiens
KTPPPKIKGGFFGPPPPPPGEPFRGIKMAPPPPRFFPGGGGGFFPFKRPPPPRPFGQKGGGPLKKKGKGKGNPVPLFHCPGGGAPGEGFPVPPGPAPASFLARGDFSGGVSVGGLGGGFFFFF

SEQ ID NO: 946993 - protein, 111 aa, Homo sapiens
EIPGLGFEAPEAVGEVVYPQEMFSQPWITAGCFILPGLQVILYINEEEYNPFLVSSTGAKVIIHRQDEYPFVEDVGTEIETAMVTSIGMHLVREYSHFHRLGENRSFFFKG

SEQ ID NO: 946994 - protein, 89 aa, Homo sapiens
ESEIGGAHNPGFGLLCISLITFVSFSLRKSDGHYPVSLLTSSIRFRRSSGPDDQSLEEVFCYANRSVQLLEAILTPFMGIVPPQFLLPP

SEQ ID NO: 946995 - protein, 43 aa, Homo sapiens
VQDIICVYYLEPELQVPSLASRVDTHNPGAVRALRGEVRGGAA

SEQ ID NO: 946996 - protein, 111 aa, Homo sapiens
RGPKTPIFPDAKESSPVFEIKGIVEGILKRPPDEQRLYKDDQLLDDGKTLGECGFPSQTARPQAPAPVGVAFRANDPFEALCIEPFSSPPKLPDVMKPQDSGSRANEQTGQ

SEQ ID NO: 946997 - protein, 103 aa, Homo sapiens
IAQDRTVHRKVAKGRKSFERLSSCSPASAPAPPALRPSTFSPAAVDPAGLRSEGGGQSGLVIFEREVVAQKVGAGELNLEAERGDEGKEDDGVGPRTAGRGKV

SEQ ID NO: 946998 - protein, 85 aa, Homo sapiens
NAWGRLPVDLAEELGHSDVARDLGAAAGGPRGSNHARINAPEGPSDIPDFKEPKRVLENLRKLRSSVPEGPTGPQLPPPQPPPLL

SEQ ID NO: 946999 - protein, 191 aa, Homo sapiens
ITTADLGFQHQPRTLLQEDLGHFAPIVTTKRGVGVTMLPPPGCTVPDTLHGAKRRKQLQHRALVPPGRRHDPATRVSPDTSTAPSRRVPLPPHGDIGRGRSRRRDSQPYPTAGFPQHLLIAKEAETRGLGGVQGGTAKGSGITDQYGPSGQPDPKKAEELRLHAPSLKRPESTRGRPPPTPPRPQQARARP

SEQ ID NO: 947000 - protein, 129 aa, Homo sapiens
PSPSTVSSAQRYGSPSQQRLSPQGQQPLSPQSGFPQQQRSPGFPQLFRASSGSSPNQASKPGATLASQPRPPVQGRSTSQQGEESKKPAPPHPHFKKFQFLTYNPQHNRTPPRVGPQVKTRPRLKPSAT

SEQ ID NO: 947001 - protein, 135 aa, Homo sapiens
ARGIWGGLWGANGPPGIRRFFKGKRPFWGTRGAGLLGPQDQRGWPPKGGGRGPPQPRAFPGRPRGLALGGGFFPFSPILKGGFGPIPLFPPGGEALKPPLAPFFRPLTPAPGGGGGVFWAPGFFLTRPGTPRGPG

SEQ ID NO: 947002 - protein, 32 aa, Homo sapiens
GPPGFGGWLAGGAPSHPPPPPPDVPLKLLGRG

SEQ ID NO: 947003 - protein, 137 aa, Homo sapiens
RAGGKGGVERRDAREQKAAPRRDAREEKAPKEDLWKKRDSVQYTMYHREAGYNLIKTFKKKRQVETPGDGIGRQTKSKTTKDKETPGKTKSCTINVTNMMQSKTYHDYKKLTVKKKKKQARKKPGLHATDNLTKMLR

SEQ ID NO: 947004 - protein, 70 aa, Homo sapiens
KTPPADPCCEPYGPTAKWPNGSPRKNRVCGIGKFALTGEEFLSHIYMRNQCPQVFERGVGISPSLLSLIF

SEQ ID NO: 947005 - protein, 185 aa, Homo sapiens
TALSRAKGGEGFLKVARPFPHKFFPGEYTPRGVGFGIQKGMGPSPSFGTLGVPRPGPLNRGGFEFFGASSLFFRTTPVGAQAQVFKGGVLTSPGPEKIGFPLSPFPGGGGGGFGGKFTPGGRGNPVPGGSFFLGKVCSPWPPPHFPRGPKAWGRGFLSPPPPLARGVVGPVFFFLGGGPAPPPPP

SEQ ID NO: 947006 - protein, 100 aa, Homo sapiens
SQPPAARPAQLPPRPLAAVPLLVPSRLVRGCAGGRAGAQGKLEGRAREGSFVDFTAANIWAQRGPPLAVSPPRRLGDPRGLSPKDGDFDSGPAPRDAVAA

SEQ ID NO: 947007 - protein, 127 aa, Homo sapiens
PQTPGLNPSPSPLGWAPGVGGGVSPGGGWAPPPFGVPREGGPGPPWGAKPKGSFLGVPLGPFESPFLFSPGIEKDGVPLFPWWAPPGRGAGPLFSPLLLFFPLLGGPPPFGGGGGGPGKKKGFWRFL

SEQ ID NO: 947008 - protein, 165 aa, Homo sapiens
EEPGLSMREISDGVSELPVAKPPKRTCQPFLGSLALPAMSLPCKPARANCPAARKISGQAVKSHNLRWTFKGPAVGRNDASMSPKALGRRAAQHSGLIPGRHWVWVGHPVLLLTQGASSALNFVNTSTYLLVPLSKPSCYCRGMTLTHTLPAWSSSEWTQRSLSE

SEQ ID NO: 947009 - protein, 102 aa, Homo sapiens
LHFLRCPGHWDGFPGKAIGQSAFQPFQGAVFHQEFCFPGTAPMGGGRRATLFFLKKKQKNSLVFLVPSWVNKEARKKGFFKNWGFNFVFFAPAKKKFFDGPP

SEQ ID NO: 947010 - protein, 102 aa, Homo sapiens
LGHHPRFWATPPPVFQAGGPSLIQQVGIDPGTEIDPQARFPGKGRNGLGPKDPLHLGHNGLVMAQVRKKLFQFLRVEPHNSLAKAVGRFSLMLHGLVTPSLP

SEQ ID NO: 947011 - protein, 74 aa, Homo sapiens
ACEVQGEQFAVSIEPLTGFVTSDFGMELEAVILSTLTQEQKTKHCMFPLISEELNEQNTFTYVTNLDILHMYPG

SEQ ID NO: 947012 - protein, 176 aa, Homo sapiens
DAVVEGVFTVPGDGCVDYKALLAVLRDGGYSGWLVVEAEQDPKKAHPLTYGRMGFAHMSRLLADLRMYRRGEAPRGDTGPPSPAPRGQRGGPAKLLGRALVGQPLLHDCDLVGLVRLVDIGGLGLLELDRDLADLTGEPERYLVGLADRGALIRAHIRAFVRRVEAALGLLDPCGR

SEQ ID NO: 947013 - protein, 118 aa, Homo sapiens
NVIASINSRIDQAEERISELTGNISELSQTKIRIKKNEQNLREIWDYVETKSMIIGILEREEEKASNLENLFQDIIYEDFPNIAMENNIQNPGNAENPCEILYKKTIHEPHGRQILQG

SEQ ID NO: 947014 - protein, 113 aa, Homo sapiens
GGECGGGWAFPPGFLGPFPKLEKGASPLLRGGGGGFWANPKTMGIGGGGGHKGKPPPPLSLKGGSPNWGGWGGEWPPPRGPCWVYGGQGQPGGGGFWGWFPGGGGGFLEFFSL

SEQ ID NO: 947015 - protein, 50 aa, Homo sapiens
DVHNEPGTTPEVAPYTRELVNRVERSQLPPRGPEVIGVWPPGSRHAARGR

SEQ ID NO: 947016 - protein, 83 aa, Homo sapiens
GDLPTVTCPCPDPAKLRTGWRLHPPSCLTHAESTVAERQRMQERGSPLMPVLAGVPMGTGDVDVCGLRGYASLGYKTKQGEET

SEQ ID NO: 947017 - protein, 100 aa, Homo sapiens
PGFFFPRPRVFAAGGAPWFQVSPFRPQGGGVRAAAHRPFRQVLSLFPGGQAPEAPRRGAFLSGGSLSRGFSPCVLICGRPGGGGKPGIPQLPPGTLTPPL

SEQ ID NO: 947018 - protein, 88 aa, Homo sapiens
MDRALVPLVPLLGLVKFWGVFGAPGLGGFWRLFGFLGVFSFLGFGVRGGWGVGVLAFPLGAGGPGGRGPPPFPAPGPSPFSPSGFFFN

SEQ ID NO: 947019 - protein, 103 aa, Homo sapiens
LGRWFRPKIVLVCWLKGLQELPREKYFFWDSGGGPSRGPPPFVLTSILGVAAGDWKKGDPFFCLVGQGALRLAFTKKTFAGLGGKPPLVIVFFFLGGVGGPCF

SEQ ID NO: 947020 - protein, 75 aa, Homo sapiens
PGLEESTSLVCQGSEGAVGHGGGPLPGLRPRADRVQHHRARDRAMEARKTARRRDSASGDAAKAEAKKETEPAAA

SEQ ID NO: 947021 - protein, 123 aa, Homo sapiens
QPIRYEALRLRVATVHSTSIAFLFNFFELFDFVRCKEVGSSFNDCAAPFTSKNYCDEGRACLSHLSIYLAGRAAPPLHVGFARSGVEAPRWPPRALSRVPPPARGVLQAPPSLFRVPFFFLFK

SEQ ID NO: 947022 - protein, 73 aa, Homo sapiens
NEVSGNAAIGKPDSGRSGFSCAQVDYVHINPMKHGLVKRVADWPHSTFHHLVEQGVYPKDWAGGDETALDYSD

SEQ ID NO: 947023 - protein, 129 aa, Homo sapiens
EVLALGSKKGWPESGSTAGVEQAVHAQREGPRARERRRDSLRVPAESWTSGGPLPILTHAARNTMPHLGEPHSHTRSLVQTPACTCTPRFTGQRPDCTPKRCGFSRLPAALGSLIPAPAESSPGGEEDA

SEQ ID NO: 947024 - protein, 128 aa, Homo sapiens
SGAGALCKNLTSLQPTEMAAASRALRWGSPEGVSPGGGRGPSAKPTRHSPMSPGGIATSLGGRRPAAGAGPDPGERESHEPGPGAAETSPGRPSAAPARARCGENGPGRERPLSGRPWEALGSLLCGR

SEQ ID NO: 947025 - protein, 155 aa, Homo sapiens
DLPKKESRRTHPQRRSKEKGEIWGSAPSFRKAEVQGESPSERSLVELAERGGSRRPCDETPTLTPAAPRDLREDSSGGRASERGLFGFQAAPGPAPRDPAGLSLPARQQKRITEAGAGLTVGPEPAPSRISAKTSPRTPARRVEARGTRTGPEAA

SEQ ID NO: 947026 - protein, 129 aa, Homo sapiens
GTRIGLPGTPRENVLRLAVLVKQSGLDGVVCSSLEVADLRQNQGADFCLVTPGIRPQGALCDDQKRIMTPYDAIRAGSDYLVIGRPITASEDPKGVLLAIEAEIEAALCCLTSCKVMLRCPRSKKAMAA

SEQ ID NO: 947027 - protein, 47 aa, Homo sapiens
GGPRVPCWGGIFQFFLRFPGAAFFIKTLVIEFKAPPKSRMTLQDPLF

SEQ ID NO: 947028 - protein, 79 aa, Homo sapiens
KKFTLMEIKLRNAERANDVAEKRNDMVQKEMEQFFSTFGELAVVTQENRGRKHNLDSVSLLLPALFDGFGKDSRDFDGI

SEQ ID NO: 947029 - protein, 50 aa, Homo sapiens
ARRPGLGTDDRSVKDFADCAAFSKRTRAMLRFLKDAAVEALNLTIIWFAT

SEQ ID NO: 947030 - protein, 37 aa, Homo sapiens
MRFPGASIHCKYQIAQVTNPRLYDVKPYAFQFKLKEN

SEQ ID NO: 947031 - protein, 60 aa, Homo sapiens
LAVGGEVPGKSPSTVSARKLILHHGEAHGVYRHVSALGQRRENQRQEAGDARHLAQHAQR

SEQ ID NO: 947032 - protein, 200 aa, Homo sapiens
PSSCRGGGGVLPVLNFPRGRPPGVGGNSWGGGGPPIFPLLFLPRVLGGAPKEGAPPPPPPRGGVFFVWCWGEAPSHTTPPGFFREFFPPKGGGAPPLFFLWVKKKRGWAPPPPPPPEGVFFMGGGGVFFPRPFFFFGPPPLFFFFLKGGEKLFWARGGGGEKNFFFFPPRGGGPGAPPPPGGFFFSPPPGGFFFFFPGPP

SEQ ID NO: 947033 - protein, 72 aa, Homo sapiens
PYTGIVMTPVRVTHTVPIYDGYALPHAILRLELAGRDLTDYLMMILTECGYSFTTTDEDKKSCVTLIRSCNT

SEQ ID NO: 947034 - protein, 82 aa, Homo sapiens
RRKVLHEIGAHNRRPKVGNKDVGSVPNHMFWGSHETEVDMRPRKLPRQDFIKSYGPKVWAEEKRCRRKNSWVTPQGECLVVS

SEQ ID NO: 947035 - protein, 114 aa, Homo sapiens
ILENRDSAYLTPDLLNSESSRDGARQSAELMRSLTNASDAVEVGDHGAWARSARAASYMLGYRHVEMGRRMQPQKQAKTFGSNAKACYIYGPQKTIPERCELIDTFRVWEYKDS

SEQ ID NO: 947036 - protein, 88 aa, Homo sapiens
VRYYQITLQDLYGGPQLTAASWSTSGSRSSTTTTLCPGSRASFWIPSSAFPYSREEEPTECGLAASPAFGLAAAQSKLLGQVGAKEEA

SEQ ID NO: 947037 - protein, 114 aa, Homo sapiens
TGCTQEYPSSHLLTLGCVNRLQSNPNHTLLPRFLNDNVKGRYDLASSCPMHGWAPAKDPPSSTPILATILHANVSLRAQKTLKGLCLRYRALKFFALRVLLTNSGHQPCSRNYP

SEQ ID NO: 947038 - protein, 54 aa, Homo sapiens
MAHWVLASLPSSQAVSLLSHLDPWLQVAPQSGLYHLGLQIYWYVLVGQDISGSY

SEQ ID NO: 947039 - protein, 75 aa, Homo sapiens
LEQKKTNTQTKTTNKANQTDNRKQNEGGTGDNTDQQTKPKSSEEGKAGRRGRCESKGHGAEGGPAPRGGQARGAG

SEQ ID NO: 947040 - protein, 59 aa, Homo sapiens
MPKWAAVVVLLEGARYPACQHGGLPKPLTLRWEPSSQPNIPIVGIIAGLVLFAAVIAGA

SEQ ID NO: 947041 - protein, 65 aa, Homo sapiens
MAGQEPALSTSQPDYDVARHGLLHVAGHDRFARPVVTFSCCRNATLPRAAPTAAAGLIRRTHCTN

SEQ ID NO: 947042 - protein, 191 aa, Homo sapiens
TDKNDKSCNDHKELSISQVLNAELLESHQEEKNQLLKKIAAKDDDLKPTAKSYAEILDAREEEMTAKVRDLHTQLEELQKKYQQKLEQEENPGNYHVTLMELQTQLAQKTPLISASKLNEQEFRAQHHNLDDRLKKYEKNVYATTVGTPYKGGTLYHTDVSLFGEPTEFEYMRKVLFEYMMGRETKNMAKL

SEQ ID NO: 947043 - protein, 59 aa, Homo sapiens
MAGRRTCGGPETGRDSGDKGQDRNDDEGQERVQVRSKESTCVPGQAVVALPWGTEHVTS

SEQ ID NO: 947044 - protein, 45 aa, Homo sapiens
GAGESGKSTIVKHDEESCMLMDLMEMRSHTKVQDIKNNLKEAMGT

SEQ ID NO: 947045 - protein, 40 aa, Homo sapiens
ISAAGQENFFKERRLMSGQYPGVSENSRTWCWGCCKSPGR

SEQ ID NO: 947046 - protein, 37 aa, Homo sapiens
MRYHRKTPGERDQKRVIQEGRGELPDFQDGTKATFPY

SEQ ID NO: 947047 - protein, 66 aa, Homo sapiens
VSDHQDPVRLSSSALKRKTMMSDLREVRVTRAGRCRRHPDMHLMRTFTTKSPRAPARPNIIVAKHR

SEQ ID NO: 947048 - protein, 73 aa, Homo sapiens
RLHKDAWKLKCGLIDLVVGPVCPPKEYDDELTLLLKFQKGKPNSPLGNSELRPPPREHKASDQPGERPHYTHQ

SEQ ID NO: 947049 - protein, 144 aa, Homo sapiens
MGHFARLDRIASSSFVTATQPVHALAHFTGFGRWKGLSQTLTPGYTTVLANGQIKHAGRNRVHNPQHRNSSVLECSRQDVLSVVAAHTLRLVPKALFRSLIDLTNQRIPCKRDQYTLDVAIQNRSTVVPCLRQNRSRSTAANTG

SEQ ID NO: 947050 - protein, 68 aa, Homo sapiens
LPKQLSTNEKTYARLRKSRWPECVDINVTRMAVRATGWYKELIGPQVKGKTLWSSPLQQIIVMVYYPV

SEQ ID NO: 947051 - protein, 92 aa, Homo sapiens
GIYESSSVIARKLFQYVRLCTTLIYWTYEVHLNEPRKSHANAAKFQGQVRSIMLCSVRKCRYIPKFIYKHDHTMFVAVDEWIDTFHVVLLSS

SEQ ID NO: 947052 - protein, 100 aa, Homo sapiens
KHKLGDSALLLHSFNSLYRAQKIKTNPKNVAEACPHTGVQNLVGAEMFPHRLKEYSSEERGEGSSFGHPENMLQLFKGFPLLVDCYKLLTYSVLHKLMLT

SEQ ID NO: 947053 - protein, 105 aa, Homo sapiens
MNELVQSMVLAGRWTGSTENVEVPDDISAGEKEKRIGSYGLLYYSQQFYSCPTLLQATDPSRRLIIKILHPLKTEVHEGVSDDASDGIKSSCFKTSQACWWENIH

SEQ ID NO: 947054 - protein, 196 aa, Homo sapiens
GLRSDTTHLCWVNNQNSRSAQASSCPMTTGPSIYSVSQGMSEDPMSEEIQTKLGVDQGDPIILNVLYTQTTPPFTPHTPINVQEMNLSLSCHTASKPPAEYTRLIDGNIQQHTQELFISNITEKNSGLYNCQANNSASGHSRTTVKTITVSTELPKPFIFHKNFKPVEYKDAVAFTCEPEPQKQSFLWWVNGQNLP

SEQ ID NO: 947055 - protein, 105 aa, Homo sapiens
MVKAKSNSKFSEPKFEILRPVQDVGPDNGICLHEKPLQSPETLNQTECMHLRKSPLTSKEFNLYKLVGYSEKGSTDSDTIARIQRKLQGNTFCLFMYALQSMKIK

SEQ ID NO: 947056 - protein, 110 aa, Homo sapiens
MISHLSEVQMWCIHSKESSGTFISQPPHRRAGLGTVCPCTPDTVTCRYRLMKPQSLCDLLDRTHINPYFSGFFRPSCSIFHRGGPEWAPKALRLSCAAFTLAPACGRTLQ

SEQ ID NO: 947057 - protein, 189 aa, Homo sapiens
RVISQYMQYPDLTRSQRENAGSVKILGDSFLEKFFSYPSRTGSAKGGEQAEQERERFLVLGRGGSFGTALEQGVLDSLGVWQKRARFGEPQWWSFSTRASLRSPVNKVSDQAFANNLKSSRTGSSPEEQFGRTQWATPQEYDQLAAKTGLVRTEIVRWFEENRWLLKTGTVKWMGQYSTSHWRFIDLSR

SEQ ID NO: 947058 - protein, 37 aa, Homo sapiens
METNTWRTQAYTPVMPMYGSREIESRGGYLLVGYGAI

SEQ ID NO: 947059 - protein, 107 aa, Homo sapiens
YARPGVTSDEMKGLDLVLDLHKPAQGPIHDGGEVEQPQGVARGLPVLNTNRPSKFMPIHHASSYLVKYIHGLDRTARIDRPHRPGRRFAGALLSKSPSWQCHSLGCA

SEQ ID NO: 947060 - protein, 70 aa, Homo sapiens
RHNPGHVEVGQSVTTIPTVVFNGGDGDLQRMSRSTYGMWAARTTIRPLWRHYYTGTQGLIFVGGLRRPRT

SEQ ID NO: 947061 - protein, 129 aa, Homo sapiens
MVSWAELMTARMSVIRSTGIESAGGGPPREFTAGLIEGIIVKELPQRSQFCNWRLLDRNNGVQNGGTTVFITSGKSSLMKHGGAGNFPPLITARDTDRAVNFPGCFIRQLWLMKAIEFRYRARGDFREC

SEQ ID NO: 947062 - protein, 41 aa, Homo sapiens
AAAALIIPCKNVQRHCSQVPSAPVACIHHRALRISGGRIRF

SEQ ID NO: 947063 - protein, 93 aa, Homo sapiens
GPPRGKIPNFPLAGGGGLGPPPPPPFLGGGPPFPPPGVVFNKGVPPPPPFFFFGGPRGRAKTPGGGAPLGFPSLGEFSRGPRGGALSPPGGFF

SEQ ID NO: 947064 - protein, 88 aa, Homo sapiens
PPPGGGGGPPPNLGPCPGPFLGGGGGGEVLVPPPPGMGWGPPKGFFGAQGFFGGPPPPPKGIFRGLGGPPPWFPPQGPPPGERAFLGF

SEQ ID NO: 947065 - protein, 70 aa, Homo sapiens
GLAGKPNGAKFSKGAAFVSKQEGSEVVKKPRGYLYQWVGAPVPYPDPLEPRREVCELNPDCDELGDHIGF

SEQ ID NO: 947066 - protein, 106 aa, Homo sapiens
TKRGRDLGAYLRQRVAQAFWEGKNTQVAKPEACDQMYESLGGLHSKYYKHKDPCPKNTSFSGLLLEKDKVILSPDPLEKVKEINKGMWKKLQEKFAPKGPEEDYKA

SEQ ID NO: 947067 - protein, 99 aa, Homo sapiens
IADYESGRAIPNNQVFGKIERAIGLKLRGKDIGKPIEKGPRGKCTQSLEISGLQLILFRRFPLAASSVFLTGRTEQGVQLGGDPPQPIPVVKQTKPCKG

SEQ ID NO: 947068 - protein, 112 aa, Homo sapiens
PPPQGPLWGGFSPPLWGGGGAPVGPMFFFPPPGPSRGPGGGGFFPGFFGPPPPGGLFFPPGGKKGGRGAPFFGGVFLGPPPPPPGFFFFFAGGGGGGLSLFFFLRGDIGPRG

SEQ ID NO: 947069 - protein, 78 aa, Homo sapiens
GHYTALCRCQTGWHVYNDSRVSPVSENQVASSEGYVLFYQLMQEPPRLPVTPSFGTCEATLNTLKPQAPPSPIKKTQK

SEQ ID NO: 947070 - protein, 209 aa, Homo sapiens
MFGPVLLCERVAAALSWWREGLLGPRGGVPLSIIRHALVALGHLALGRGRLPKVDILPLQGGVFRGSFPPPSGVRAPPGVFFLGAPGGGPTTSVGLTKGPGAGPQVGFFSLGGGGAFKGGKRFSFPRGGGGGVPSYPFSPPFLAPPNPRFWDLGGGGPPPFFGGPGGKGKRGPLFPLFWGGGPPSPWGGGGGPRAPGVWGGGFFGGFFF

SEQ ID NO: 947071 - protein, 45 aa, Homo sapiens
GKKVFAGPGIWFQPPGPPLFGGLGFPFGGAQGFPFPHQKRNPFRP

SEQ ID NO: 947072 - protein, 119 aa, Homo sapiens
SQGAPLFSLAFPPKFKRDFRPWPPPPLNLNFFPPRGAKIFFGGGGPFGPFCPPSPKFGSPTRNKMKPALPFSPPKGFKTLSRSFLFLAPPGEFPGELAPRFFSHSFLPQVFPLSPFFFF

SEQ ID NO: 947073 - protein, 83 aa, Homo sapiens
GDPATFTQPVKVARKGFLDTLGVLPRAGGGLKGAKSWGLLPGDLAEEWGLSDLAGDRGGVGGGPKGGNQARINAGEGPPKIPD

SEQ ID NO: 947074 - protein, 99 aa, Homo sapiens
KGCPEGPGGTNKRGEDGDRQERKCPFLAQTERASVWPFTRPVSASERSWALWEGCVQLRNIQRVDVPPLPPCPPHRLPFFPVFLKVSLLNKTSLCLKKK

SEQ ID NO: 947075 - protein, 182 aa, Homo sapiens
QSSRHSKLEKADILEMTVRHLRSLRRVQVTAALSADPAVLGKYRAGFHECLAEVNRFLAGCEGVPADVRSRLLGHLAACLRQLGPSRRPASLSPAAPSHAPARKVYGGLPIAAIARRALSIVLGATCSCRVSPHRASRQPPPGGGGRCPEWRPGVSGCFDVVALRMHWRGCPVKGPWPLPRM

SEQ ID NO: 947076 - protein, 179 aa, Homo sapiens
MSMARHVSRAISDLVELFEKRGLQAVHSPNPYGGVSVGPSPEFGAKYRKITEDIVLMISRQRLWVVPPPNLERPVSIPVSSHNSLVYSNPVSSLGNPNLLPWVPLFLKRNSMFFGVKNRPPRAGNTGGLMGGALSFGAGPSAGKGYGNPRNSPGLGVSPGNLNKKRQANFPPPFPPLEP

SEQ ID NO: 947077 - protein, 46 aa, Homo sapiens
MGGADCWCSSTCLIVPIKDATFCWNDASQNKDCGYDPSTDGSPMTT

SEQ ID NO: 947078 - protein, 99 aa, Homo sapiens
FTPPPTLLFTRLVWDNEVCLLTPSRAPPRPHGCTQPLGYITMAGCPVFHSSWFCCPPGLSMMRQPTPALPYFFLLALIYCRSAHGIGSRPLLSSIKFLK

SEQ ID NO: 947079 - protein, 76 aa, Homo sapiens
KKKKAGGGNPMARVVLDQVTLQNPSWCPRALGILYEHSPPTLTGPQFFLPFRGPQKKKDVEWDVEPSFKSEDNFLS

SEQ ID NO: 947080 - protein, 65 aa, Homo sapiens
SYGPPKGPRFGGPFGKENFLAPFPPPPQEWFIKGVRATKALIDKPRVPPPPTGHFGVNIPPNVRL

SEQ ID NO: 947081 - protein, 127 aa, Homo sapiens
PFLAQPSLLSFAGKAGTHSGCLPPGGKEREGGWVEGGLPPGNVTFPGPRIVSGPKPKAQPGTRLRGSAGRRIFFPSRLWVPPPVLSLTDSPPSPRPWSHSCPRPTSAPPHHLWTLEFGINAVCHINT

SEQ ID NO: 947082 - protein, 138 aa, Homo sapiens
MNSLVFWQLLFLCATHFGEPLKKVAFVGNFRPTGQQVESLGLLAPGEQSLPCTERKPAGPVRPPQPPDPRTPGGGVGATGEGPAELQELLRPAVRQAGGGTREPRQKRWAGLRGQVRGSELQTPKESKHVGRGRGGAT

SEQ ID NO: 947083 - protein, 51 aa, Homo sapiens
SLLFFLKTGDKNAQVKDAFPVEESFFARYREARHSQQNSDTDIKVIKVIPV

SEQ ID NO: 947084 - protein, 43 aa, Homo sapiens
TTKLKIKQRDKVSYKNTLEYYAFNMKATVEDKKLQGKINDEDK

SEQ ID NO: 947085 - protein, 90 aa, Homo sapiens
DSQDFHRRPTTTASVTTIEHKAQDGIVKIFSNSKKEDCVWLTPKKPPADNYTGHSCTPAPGKSYCNLGSYHNPETIAFLVVDYQVKAQTH

SEQ ID NO: 947086 - protein, 148 aa, Homo sapiens
RRVSTCGTPRFVVGGRCVQLHTGTMSFRMCRNSIRLRHRLTFNSQRCSCWPYLHRTWLHRGCSNRLLMHICTCYRSRLNRCMMLLHFRVLNSVHMPAEMRVWPDRAAASASVDSSESSATGCILIVWNLGAVSHPYPTTTTPTTTNSI

SEQ ID NO: 947087 - protein, 85 aa, Homo sapiens
IPTFVVGGLRVQHSYFGLAYYTLFVYHASFGEYLIKVVHHYPVTALSHKGKAAVPVETSAKSKTVLPATAYYTQVECGSPTRHPI

SEQ ID NO: 947088 - protein, 83 aa, Homo sapiens
MWYPWWEAATRTTNTTKPTSKVQTATECHQLHPTHHGSSWGCHFPGVSSRGTLCLCLNWVKFHTWGPPWAHWCPCPAPLSSHH

SEQ ID NO: 947089 - protein, 53 aa, Homo sapiens
NLWYPPGEWSKAQEGVNPQAEHEYKSVRKRVQEEILRAAHSNNTTTEQTSTTT

SEQ ID NO: 947090 - protein, 74 aa, Homo sapiens
VPTLCGGRLDRAYGDESSEGEYGTTEPSIYRTLHICFPVYNTFPRRARRSKQTQITAGEHTTIQGRGLFTVLQC

SEQ ID NO: 947091 - protein, 72 aa, Homo sapiens
IHVVPTFVVGGRRSGDLLDSQHGEFLTPNTLDFLMKNNRSQQENRLKIKPSHIKATENLLGEEAKTKKIEIW

SEQ ID NO: 947092 - protein, 140 aa, Homo sapiens
MLQLNYTHHKGIRARYRLLDYDINLQPYFGGHYFPTDLQVVDFYQLQVPTQGLPDTGLAETHVVIHLMSPTGIIYRTTCKVEGSLNSLYPEADCTPTKYEAHIEGYAEGRERCPLILRLLLHQQQQPWVGRLLSCLVVAG

SEQ ID NO: 947093 - protein, 152 aa, Homo sapiens
IDTSLSLWAIDVVVNAVNDDIVVVLCDGVGSVPPGWKVGYYHCASPKPGLMVWFAAWADTTLWPLYLYKSNYPSRLSVNHQDNLESLTVLSSFSYQSLLAERLEFTSVKPQHYGPQQPDADNLYEVPADYPDLTVALLELWVVAEHCLLLFD

SEQ ID NO: 947094 - protein, 108 aa, Homo sapiens
VHRLWWEDGARFRGLENYSCPWLSQEPRACNISSVCEHPQSGAQRAHILEGLVVCWANCCCSLGQGRSLMQNCLPCTAFKALLFLGVPITHSRSTPDVQLCLVCLDAP

SEQ ID NO: 947095 - protein, 72 aa, Homo sapiens
NPWTSNHERQIDLNISKLSVDFDKILNLIILEIFEIQTIILQPFWNSYFFKLEIMSFNPSVYISCVCSKVYL

SEQ ID NO: 947096 - protein, 94 aa, Homo sapiens
TTHLNRTQRSRARLQKQLPFPNPRLFLVSHPHNRVQESAKGQTDPLRPWVTPTVTCIVLGPGQVRKQSLVAAAQQGCARPRPSTTNVGSVHVND

SEQ ID NO: 947097 - protein, 62 aa, Homo sapiens
MSVQCSLLDQHGCQLLTEEYGGSVHLVAPGAVGQAFVEPYLRDAAQSHAHCGVLLPSHHKRG

SEQ ID NO: 947098 - protein, 32 aa, Homo sapiens
MSMHAIKRRKQGVKQQHSSRETHEEKQKQNYN

SEQ ID NO: 947099 - protein, 57 aa, Homo sapiens
FRGMDDATLEDRRRRADPPLQGGVASHTTTLAHELEAGGHDVTLVSWSHLYPSFFYP

SEQ ID NO: 947100 - protein, 52 aa, Homo sapiens
SPPGRPKQCMIRLLQRSHMASSVGYKFKIGNNEYVKKKGLKKKNNRASCNPR

SEQ ID NO: 947101 - protein, 59 aa, Homo sapiens
LDTSGSPVLVVLASFIMVAHLAIYVSRARKKYKGEYPIMYSTDPENGHIFNCIQRAPPI

SEQ ID NO: 947102 - protein, 55 aa, Homo sapiens
SEPLYRGCLLNAVEDVPILMVRVYMIGYSGVFFLRALQILMARRATIIKLTAPPI

SEQ ID NO: 947103 - protein, 71 aa, Homo sapiens
DPSTVSHVLPVLAGRWQWVEEVGDLAAEEQLRAEGADPGRSKHVLYNIERARRDYVYDRPGRDLERRRQQY

SEQ ID NO: 947104 - protein, 53 aa, Homo sapiens
LIPGARRMQLKMCPFSGSLLYMLGYSTLYFLRARGSIDGYVGHHYKADSTTNT

SEQ ID NO: 947105 - protein, 97 aa, Homo sapiens
LIRVVVPQSGNRDINSRDQLSAGVTAQAHMLQAWASTDKEVLLQQYTSKISEHPLLARNLIKRYTYIVSLNLCALANLKAQTCRDNLIDHIGRKWQR

SEQ ID NO: 947106 - protein, 94 aa, Homo sapiens
TSFNITDNLETYPRDPEKAVVWAKHVAKTNGYLGQAIRKGLNAYLEGTWHAGLLNNVIAAETGIGVSQTNIAHICEERAELARRYLGVTSVRRY

SEQ ID NO: 947107 - protein, 113 aa, Homo sapiens
MPICTALATDSPARDPAVLAGVSGMLWSALLSSIDGRLLYCVVGEFPLGKQGLVSAIRDQRIECVGHSLLQRLFLDRQRDTRELRRERVTDRRVGAGLEVHHIRQRLVTLHGG

SEQ ID NO: 947108 - protein, 46 aa, Homo sapiens
MDRITRGVEIEVRAEHGVVLTEAVGQRGFATGLTPRVDAPGCAEDV

SEQ ID NO: 947109 - protein, 73 aa, Homo sapiens
MRIVANLCFFQLLHDMTLKRKSVAYGLETESVLVHSRDEGKVGLVAASKDEIIVIDCGTAAIVGLVLYGARIK

SEQ ID NO: 947110 - protein, 94 aa, Homo sapiens
HRGSVEDSHAHRSDRSVRLSDYQPYPFRLDSVDLEFQLDLVATRVKARLAFTRTGESGAALRLDGERLKLLSIAIDGAPLSSNAYQLDDESLTI

SEQ ID NO: 947111 - protein, 74 aa, Homo sapiens
RSQCSPRTGPATATFTFFRNGSPRSLSQAYAFPDLPGTRSSSLARVFPLSRLRSTMPVSSFGPRLLVVDVMPDV

SEQ ID NO: 947112 - protein, 166 aa, Homo sapiens
SHPGDCDKLAEVGALLHTETITHSYMHCWRHKTPLIYRATAQWFIGMDKEPTSGETLRKRAIKAIEDTKFVPAWGQARLHSMIANRPDWCISRQRNWGVPIPFFLNKESGELHPRTVELMEVVAQRVEQEGIEAWFKLDAAELLGDEAPLYDKISDTLDVWFDSGT

SEQ ID NO: 947113 - protein, 147 aa, Homo sapiens
DLAALPAPMQALADLYQRRIAPQVHHFWEPLLPDTGIFPSDNLAMQQPELLDNLEVLAKGGSSAGEWGRAATNDLVRSKIKIKSLNFMRGRTFLNKFVIIDEAQNLTPKQMKTLITRAGPGTKIVCLGNLAQIDTPYLTEGSSGLTF

SEQ ID NO: 947114 - protein, 103 aa, Homo sapiens
MAPIFVALLATLFFRYMRPMVEAGRVFSAVPPLHRFELINPKRGMDKYLYTYTDAEYQRTAAQLAKKGVRFKEPQRYKGLGEMDASQLKETTMDPRHRTLRRI

SEQ ID NO: 947115 - protein, 162 aa, Homo sapiens
TATRSGTRLWPAWLAPDLFVVVPAALRRALPAYSNEMILMLHATSLAFTATVADILKVARDANAETFLTFQAFGIAALLYMLLSFALVGLFRLAERRWMRFLVPTRGYPMNQSAQALATYPVDVPATRTATAAVKLQVEGIHKRYGEHELKGVSLNARNGDV

SEQ ID NO: 947116 - protein, 166 aa, Homo sapiens
EPTAPDCCLARILGILLDGRGESSMEDAVCSSELACSSVREDRSMLPAAISREALANGIGAIAHLAYQVRQAVAHFAQRMQHAGLVAGLCVDGNGQIACCDAIGQFHRVGRFAAQLASRLRVIRKAAATLITRAMPASASIRLRVLPYSLAESKPNMMLCLLTSLA

SEQ ID NO: 947117 - protein, 105 aa, Homo sapiens
RRHGAVVHDELRRALRLLRHRPSHLHASLVLGGSAGRAPLVLHVREEAEERHAQALLDVLRGLDRAVRLIAQEHEHEARDEADERAHARDRQHLRANRRLRLRRP

SEQ ID NO: 947118 - protein, 156 aa, Homo sapiens
VAPGAFAFTRATAVVKLTQLCDPSSFLRDTLDQKLRCATGEHEVGLHGCCLRAGSEAVGKQMLLQLLDHPRSRFMAVVGCNQGVALNTCFTVGLVYFPTPKAASSQSVTLPLTERASNVASIALPSAVPLSELIKLLINCRGFSCSCAEIDLPLSR

SEQ ID NO: 947119 - protein, 122 aa, Homo sapiens
QRLHEALMGQAQQGEHQRHQDIDQHDRSRRLPRIRAQLRTAQLGVVKQGIAQGDAVHWRHELRGEVSRSHAKPAIVMPRGQDRLHQRGSMHEVVLFHGGMDLDETVGLLQQAHAQGQQMAQL

SEQ ID NO: 947120 - protein, 139 aa, Homo sapiens
DERATGGLISERRKASRGRNSELHGSITHARRFPSAVEIVLVGPSLVHATEQAERPHSVESTTGERSEDGESIRLKPAPDTSAITEQRQLRAAAGEERENGSAMSGRKLVDQLLQPWMRGQVIDTRPKADQVVVTDRVD

SEQ ID NO: 947121 - protein, 119 aa, Homo sapiens
GIAIVQHATLKAEEVDQHRDRIDRPVRIGHVTLAALDRDPGVDAAAPADLDHVAQHARAGRLADDAVVEDLALGGQGLDDLDGAVIGHALLVAGDQEADRASMLGDLRHGGDEGGDGRF

SEQ ID NO: 947122 - protein, 128 aa, Homo sapiens
IPDREDRAGRAKTMGMTGQRMTPQGSVHHATEAELAALDVDRDHIIRAEAPLQDELGQRVLDALLDGALQRASAEDGVEADLGQFVQGRLADVQLHLHLVQARLELAQLDAGDGLDGVGAQGMEDDGL

SEQ ID NO: 947123 - protein, 90 aa, Homo sapiens
LNLIRAFTQGGFADLREVHSWNKGFAQNPANQRYEGLAAEIDRAIKFMEAAGADFDELRRVEFYTGHEGLLMDYERRMTRIDFRTGTPYS

SEQ ID NO: 947124 - protein, 108 aa, Homo sapiens
AGPHRRLDLRGAPRLLGESVDHRQAEARALALLLGGEERVHHPGEHGGRDAGAGVLDGDADVAAVAQRPDLATARGDLAVLGGDPDGAALRHRVAGVDQDVQDRDLGL

SEQ ID NO: 947125 - protein, 128 aa, Homo sapiens
KGAYCSRRQCLIPSFICNGLMHGYHACLVVRRYLLLTLLELLKDGRFHSGEALGAALGVSRSAVWKQLQHLESELNLPIHKVRGRGYQLASPLVFLSAKEIEANAASLVWPVYISDSIDSTNAEALRL

SEQ ID NO: 947126 - protein, 90 aa, Homo sapiens
RVGDQIGRLHQLAPMLIMRRQKMREKGHARAHGVEAAEHQGLDQRACIVIGNGLAVDLRRQDGADEVATLRRRAAFGHVGPHIGDHSLAS

SEQ ID NO: 947127 - protein, 103 aa, Homo sapiens
PRRVADETTHMAARKTSVLPTRIWKFPARVAQAGEPRVRDLLLACSRYYNRLVAIEAERVAQFNEIRRRHVPELAEAESRRAALQAQIDAVYRKIRQQRQERF

SEQ ID NO: 947128 - protein, 70 aa, Homo sapiens
DVPIQEVPRCTEPRSRDQEPHVEVRRLPHDRRGTGRLRQIHRQRARGDAMPRAELRPERVEHVLAARDER

SEQ ID NO: 947129 - protein, 77 aa, Homo sapiens
ELVNANTVGLAVLWIDLDALKEVNDRLGHSFGDIVLATIATRLQHTARQYDVVGRLGGDEFAMLVTRVKDLDGNAGL

SEQ ID NO: 947130 - protein, 102 aa, Homo sapiens
FGRGARSQLGSDLRHLHPGETEQDLGAFAQPSKPSTHKMNGSFISNIYPLSLLGIYPKDYKSCCYKDTCTCMFIAALFTIAKTWNQPKYPSVIDWIKKMWRV

SEQ ID NO: 947131 - protein, 58 aa, Homo sapiens
MSHLFEEDDDVGHTHLTRQQDVLAGLRHGAVGGRHDQDGAVHLGGTRDHVLDVVSVAG

SEQ ID NO: 947132 - protein, 66 aa, Homo sapiens
KLDCCALVRLRDFELLRRNRVVISVIRIPSLAGMDTKYLSESSSVPIAYRPSSEKSRSLNLTSVSG

SEQ ID NO: 947133 - protein, 46 aa, Homo sapiens
LRGGGDRGEDREREERDRRLAPEAVAEQGRRDGRGDRRIRLHAEAD

SEQ ID NO: 947134 - protein, 98 aa, Homo sapiens
VITSPHKIVGPESNDLVLQLRKRGVTQVILAGMAANLCVEGHLRELLEQGFEVAVVKDATAGPRLPEGDGYLAALVNFRYLASAVWSTVQAVAIIGGS

SEQ ID NO: 947135 - protein, 96 aa, Homo sapiens
GTGSVAVTDMGGAFGADTIPQAAVAGEVMVAGQQPPGTGKRCIRDTACTITLVFRSLSIEHIASDQHMRDIMLRSCFADRVNRIEPRLAKRSAHVA

SEQ ID NO: 947136 - protein, 56 aa, Homo sapiens
RGVNVSLTLSNTGAVPGTINAIEATFNTYDNGWTPEEVAQAFQKLAAKHPESHPHH

SEQ ID NO: 947137 - protein, 44 aa, Homo sapiens
LHPVATRHRGVGAGPARDEVDARDLLRELRRDADLLRGDVTVLE

SEQ ID NO: 947138 - protein, 55 aa, Homo sapiens
ARARRRGRSPDSLLIMPGVMPFVAESADEAKRKLDRLQALVEPRQALRLLSTFLG

SEQ ID NO: 947139 - protein, 124 aa, Homo sapiens
RVDPPGQTEEVQAIFCITDTGADPVMLETLDVKKTQFRGLIELDEDDYDEDVSDQYNELEPVMTPDRYALIQRIAANYLAQVGQDDEEDCMNPREELVAHQAAVEAKYASVRQRHLDGLAREAG

SEQ ID NO: 947140 - protein, 62 aa, Homo sapiens
ATEAPPSPNAAVSGKADVEGGIIQIASRTAGIVREVIAQEGDTVTKGQVLARLEDDQPKLAV

SEQ ID NO: 947141 - protein, 36 aa, Homo sapiens
MLAAFIERITHQPDAEARELRPAVLKTVACILHVSI

SEQ ID NO: 947142 - protein, 58 aa, Homo sapiens
MADIGDAQVAAGCDRHDGVFVIALDDLGQHGPGRDRLVAARLAQEHAFLAAGRQVVVK

SEQ ID NO: 947143 - protein, 53 aa, Homo sapiens
CGAGALRRIFDRMVEMVMALLIGKSPARALTPQGRLIYGRCAVWRRRTALSAY

SEQ ID NO: 947144 - protein, 127 aa, Homo sapiens
ADLLLQHDEVLQDLHGLHGAVVFGSIHSAASNSAGGERSRQAKKAVRGFIAFSGGCPVLALLRIFSSDLSNNPPAYVADPTKSGGLFQRTSAVFYRKPILGPLPEVIRELTMFALMHSTRLESLHLS

SEQ ID NO: 947145 - protein, 32 aa, Homo sapiens
AASTAGPPRVDIVRDRGTLARVVDEGFVEDVY

SEQ ID NO: 947146 - protein, 77 aa, Homo sapiens
NTLDRTLYGGRMPAHSATRQHGVMIGFALGRNAIAAYLHQKQQQRKTSLNTPQGKIYPQASHIQLTPHTDHASITIT

SEQ ID NO: 947147 - protein, 100 aa, Homo sapiens
GRADKDTIEADETVPAEADRSFHRNLDRSLADQRALVVFALLFEEFKAGHGNDAGRMTILFQLRTGRQSNFDFRAGRENRHRSLAAGRSQFIGTVGALVL

SEQ ID NO: 947148 - protein, 41 aa, Homo sapiens
ESKRGGSDQANGGAGVEDEFYRSLHCFSGDGEELQTGEIGA

SEQ ID NO: 947149 - protein, 97 aa, Homo sapiens
GQAQLVHRALAAGAVAVDVADVGLLHLVVGDAGVGQGLLPGFARHLEYSALAPGLANLVMPTPITFTRFFIIALLVISIRSDQLAEHGQPVRQAHIA

SEQ ID NO: 947150 - protein, 94 aa, Homo sapiens
IIHPVRFVLPHENALRPWWMVRLGLYLYDFLGGKMTLARSRGLRRSDTAFTAPLKGAGKGFVYSDAFVDDSRLTVLNAVDAAANGAEIAVGTAL

SEQ ID NO: 947151 - protein, 60 aa, Homo sapiens
VGIHIVSVQKTNDITRCKLQAFIECIVDAIVWLATQHSDVIHVTMQYVHRAICRRSVYDD

SEQ ID NO: 947152 - protein, 102 aa, Homo sapiens
EGSQAAIAGRAWAVAAGDDGEHSRSIHLLHAAGERLCDVDAPVRTDGEILQTVERIGRQRRARHARTVAGERRDDPVWSDATDHVRRRSTRDVRCDVDVACG

SEQ ID NO: 947153 - protein, 112 aa, Homo sapiens
QIGLQRIVLQVAGHIGKILPVLLQRQQEFLRPWIEIVGIDALQHELVLRARRRAADAQVLDGDGIAVDAGRLGQRLAQVRQQRVERQALGFGFELNEETALVEARGIEAAAD

SEQ ID NO: 947154 - protein, 34 aa, Homo sapiens
GHGLLLVVGHHDEGDSQMLLDVDQLELGMLAQLA

SEQ ID NO: 947155 - protein, 137 aa, Homo sapiens
YFNVLYDRDAQGGELFHVYTEPFGDRFFFEILQRKKGYVGYGAAKVAVRLAAMAKSRRGAARQAQALNETSFRETLSPYIGRLQRGREPRMTNFADAGAPQPLEARHKGRKNSPEQTRKDILQAAIVEFVSLGLSGA

SEQ ID NO: 947156 - protein, 124 aa, Homo sapiens
DDLQQIHTGIMLSTRLLNDVNQPEEALRKKKGLIMSEKSIVQEARDIQLAMELITLGARLQMLESETQLSRGRLIKLYKELRGSPPPKGMLPFSTDWFMTWEQNVHASMFCNAWQFLLKTGLCS

SEQ ID NO: 947157 - protein, 88 aa, Homo sapiens
MANGVCSFCILRSTSTSPCVSGTKSTSRRSVTRLGSFTFRASLEKILPVEIPDDLVELFALRERHARVLVRAQELERRGAGDVDRHVE

SEQ ID NO: 947158 - protein, 46 aa, Homo sapiens
MASALPVSTFDTFYVYKTIPGGDDFDALTAERYGWLNRALPDVELD

SEQ ID NO: 947159 - protein, 118 aa, Homo sapiens
ARGGHGFEIILSKVELPEVTGAQLYETEKRKCPHLASQMIFVSSHGSAPEVRPLLRKPINRDSLLRTIGMSKRIAEVHQKKRFWAKKLVSVRQLHTAEIGKLVEAFSPGATWSEIATP

SEQ ID NO: 947160 - protein, 92 aa, Homo sapiens
LAGTTGTEHKLHWMIGGNYQHDRVSDVQHVENQGSNSGVGPFRFLKFDNDASRQHIETKAIFGSVDFELIDTLALQASTRYTEQDRNLHGCL

SEQ ID NO: 947161 - protein, 71 aa, Homo sapiens
MVTRSADLRGHVISYNRLGNRSICHCRLPYEQLPLTKERGVHQERDEMGCPVVVKRSDWRRKVRESRTSTL

SEQ ID NO: 947162 - protein, 148 aa, Homo sapiens
RKKKNIFQRCCICMRNIWNIWFMMVFLRLLGPSAALGLARGAFGSRRKGTNRLVALADQAIDGALFGFPPVVHVEVREPGVLGKLVSGLGQGGFEGQVDQVRLLQADAVRANRIADESRVLRVDVEVVHGLFHQLVLRFLQREDAVVE

SEQ ID NO: 947163 - protein, 83 aa, Homo sapiens
SAPGVAGTTDTHRHDVSPPSSRDHGHAPPRRQPPEYAGTTDTHRHDVSPPSSRDHGHAPPRRQPPEYAGTTDTHRHDVSPPSS

SEQ ID NO: 947164 - protein, 103 aa, Homo sapiens
RIGRVRDRQRLFHVVDVEGRYAVIVLSRMVEQLTNVIRAMCLSLRLGLRRGRCLLFLPTKLFGAKHLDAGQGLAFHPFKKCATGGRDIGELTGHMGLVERRDG

SEQ ID NO: 947165 - protein, 127 aa, Homo sapiens
MRARNPRTREECVGSGAVKIMYAQAASTGQITKQSNGGVDSAPKSPSASTTQMRYRGAIVTGAQPKSASMILSENHAQLSLVPLHEAGKESVSSEIKRDAGGEEAAARRVGRLAGAVRELGVVRGVP

SEQ ID NO: 947166 - protein, 114 aa, Homo sapiens
PEIPDIGHLGDGGFQSRMVDRQSERSGLRNLNGFGFITTLASISTRAPLDTLAIDRNSVLAGGSPGKDFEAGVSCTSRIEAPSIADTETRKTNDICELTAFVLDDLLDVRDGGG

SEQ ID NO: 947167 - protein, 89 aa, Homo sapiens
TDGVVQRGRRVGVVVDVKLASLKVPPLAGRNLTVNGDCFCPAARVVAGHDAIRAGVAGETPGRVPGVTVGSAGGIGGFDDLVELVVSIG

SEQ ID NO: 947168 - protein, 137 aa, Homo sapiens
AVDVPGVLGVVIDRQLHTLVGLLGHPVAGRLDGDERHDRRLGDETRGAAAVLDGVGHLVARRDRRLVGHGGHRDVGLDEVGVLAQAVELHRGDIAQLGHPLLGRQAVFTAPGPVGQQAVARHAQDRRDLQIVHEGPV

SEQ ID NO: 947169 - protein, 105 aa, Homo sapiens
ALADRFGQTTEVLPLSRRDELGGFLAQHKARAIARGEIEFLGDCVDHDHDDDVEQVRHRLETLELEHDEFVVADVEGRGAVEIMAIGAARPEIAQVEGELTRGRH

SEQ ID NO: 947170 - protein, 71 aa, Homo sapiens
MNPNQNSSRTAFDVIIVGGGTNGLSAGCYLGLEGKKVLVLEALDKVGGMASSGYLIPEAPEHLVHPCALDM

SEQ ID NO: 947171 - protein, 88 aa, Homo sapiens
HSIVAGVSATGDADGWLILPADMPLVQPATIMAVAAGLERYPVCYAQYRGIQGHPVGFGTELYSELMALQGDEGARRIVARYAAQPIA

SEQ ID NO: 947172 - protein, 65 aa, Homo sapiens
NQVARLHRCQAALTQIQRRDDSIGFLVEARQAGAQPGADFDVLLHPLAQGAVQIRLVESHELGVP

SEQ ID NO: 947173 - protein, 97 aa, Homo sapiens
GFSVMETASSLFGLMLCGEMLCRPCVMGSFSEVVEGQHDAYVGAAHQLDGFLQVVLVLPGHADLRLLDARLHLDLRVLDHLDDLLRRLLGDASLDLQ

SEQ ID NO: 947174 - protein, 76 aa, Homo sapiens
GRQGVVEVDGVRPERHQARARLVRIERVELAGQTELLHQAAGVLLDIARRRDTPATQVLLGIGAGLHHGRRAVVSP

SEQ ID NO: 947175 - protein, 137 aa, Homo sapiens
DPVAEASDLAGMPAVFRIGEPIGSALIGHMGEGTHEATARELGTPEHPGHQRKSMPRHCRLAFACLRVLRIPPRLASSMSSTPALRNHIGHHRSCGLILRMSRASRTSSGKGRPSSSAGLHIGVKDTMARCSAFRPG

SEQ ID NO: 947176 - protein, 109 aa, Homo sapiens
DLAVLETHRNVVDQRALVGQRLRTHDMAIDPPPMRRGEDLFGRDVGVAADAVLGGRGPTFPLVAVRKPDGEVGAGTRILQRAGTQAVEPVGALAQDRIVARPIRNRIPA

SEQ ID NO: 947177 - protein, 93 aa, Homo sapiens
EAFEADQETGVVVDGGGRCNQQARQRAVKAAIVKVCAPAESPEMPISRAPVRLTDVARSALPVSVRSKKTYMAASKAIEAPMISVWPVRLSGP

SEQ ID NO: 947178 - protein, 30 aa, Homo sapiens
MACPGQYVLARSVAIDRTKKSLSWDCSFPR

SEQ ID NO: 947179 - protein, 106 aa, Homo sapiens
MEALPRARALVHPRGLRHMVDPKALWLGALAVYGEEEMQRSYGKLIPVPAERAQATHDEQIVHLAGRPLRFIDSPGHAKHHHAIWDEKSRSWFTGDTFGLSYRAFG

SEQ ID NO: 947180 - protein, 97 aa, Homo sapiens
VQCASPYEGTDGNQFYDQVDMFNGALDRYNWKLVGKKEFYLPYNSDKIAGNTVKYKDIIRPKHLNQDLPRYELHRYWVVEADLKPGTNHTFKTRRLN

SEQ ID NO: 947181 - protein, 101 aa, Homo sapiens
MSTFDDNDPDKMERGYVVVDTRYAEWRTRWPKVVTECDTQAAAGLVKEYYSTMPSGRQKYSGSQFEAIAARNPDLNSIDTADIVAVSMLSVDVPGPAALRL

SEQ ID NO: 947182 - protein, 43 aa, Homo sapiens
MTPPTGRDPLTIDKVAIRGGDVYVNPRTEVRLPVYGALETALF

SEQ ID NO: 947183 - protein, 61 aa, Homo sapiens
ELPERDVTEGAFVKVLPPCDSNGRQNGSTVLFIDAAEDASFASALNAGAIGAYEVEMASLL

SEQ ID NO: 947184 - protein, 116 aa, Homo sapiens
KRQKLEVAIPKGVDNGNRIRLQGKGEAGPNGSPAGDLYIFLHIKRHAVFDRESTTLLTRAPISFTTAALGGQIEIPGMDGVRHVIDIPAGIQTGKQLRKRGAGMPVLNGRGMGDMV

SEQ ID NO: 947185 - protein, 47 aa, Homo sapiens
MMDKVGRPRGLIRFDTLANQACRAKGEPATHKFIRKRTMIYAGVLAL

SEQ ID NO: 947186 - protein, 126 aa, Homo sapiens
VLWKKVAPKLSAGRVQSSRPGSLQRERERMAFRSAGYWDVTAELDASVSDPEASPPKFTAKLSTVDGRRVATGRDFDSLGAVKKPDEVLVLDEVAAGALAAGLRGESLTVSSVEQKPYTRKPYAPF

SEQ ID NO: 947187 - protein, 31 aa, Homo sapiens
MAIQKHIIISIRYHNRMPLRVIPENVARVLV

SEQ ID NO: 947188 - protein, 57 aa, Homo sapiens
QAGRGLVEDEHARRDAQRAGDGHHLDGQRVARQRRGDVDVEVHLREDAPGFGVDGGP

SEQ ID NO: 947189 - protein, 86 aa, Homo sapiens
GSQSLEGYEGGQRQRDHGTSGLGKVKKGSEKPVKPEGAGNCCPEATEVIQRAGAENAPNNDEFIRGIRSRRGCFPTIRCYPEGGRF

SEQ ID NO: 947190 - protein, 115 aa, Homo sapiens
RHAQADEIAVRLCGIALEVAVQQALALGDGQRVVGQREMVHADVGIALAEQRADRTGQHGQLVAGRRQQLGHDAALRLEALRQMGVGIHRDAVGPQLGHLADGAGEAGGRLQRQA

SEQ ID NO: 947191 - protein, 65 aa, Homo sapiens
LPLRIGCGEEDRLHGAHMREIRGADHGAKCTNERHCSHHAPPSACDVPPGASHDLRVLRVVALTM

SEQ ID NO: 947192 - protein, 91 aa, Homo sapiens
MDCSSEAAAISCTRSEVLAIRRHNLIQQVARPFSQGHAVLGHFTDFLCGNLAALGQFAHFCRHHREPFAVLTGPRGFDRGIERQQIGLVSD

SEQ ID NO: 947193 - protein, 59 aa, Homo sapiens
AALVARRRAIGAVANADGRGVAGRAGRDALHAGVVAELAQRGAIAAAVAGIAHHVVVAI

SEQ ID NO: 947194 - protein, 47 aa, Homo sapiens
HFLDDAVAAAGPGDLVILRIGRIALDTFTLGENHTIVKVPGNGLDGL

SEQ ID NO: 947195 - protein, 113 aa, Homo sapiens
PGQPVQVVPQPAAGAVLQRVDAGLSRRHPAIPEGEQLHDPAVVPVDGAVRTVLVPAAAAAGLAEVPVLHHGDVVVHPLLVMGRTDRPQERLGDVAEPAPVVVRIAHRAAGCEP

SEQ ID NO: 947196 - protein, 79 aa, Homo sapiens
DLAGDTETLMVDKSRNRGQVADPFAGPGGDRLGDRMLRSILQRPGHLQHLRLGHPGGGVHADQAHLAGGDCAGLVQHDR

SEQ ID NO: 947197 - protein, 84 aa, Homo sapiens
EIIQERLSREFNLNLIATAPSVIYKMHLNTGTEIEIHNPIDMPDVTQIKEIEEPWIEATILTPDEYLGSVLKLCQERRGNQKEL

SEQ ID NO: 947198 - protein, 66 aa, Homo sapiens
IGFYLLGARGCEAEGGVGALVDGVEGLAAGEDVDLEALFGAAGEVDEVAHFALGGDVGDEAVHRLR

SEQ ID NO: 947199 - protein, 99 aa, Homo sapiens
FDTASLAARRQDSATIDVQAAGDVIRVLATEKAVTVSKGLAMGSVCRCVDLLAEEFAIVDCAPGRVRRFLRPYCLICSSTVRGLPVRADVMGLSSRTEV

SEQ ID NO: 947200 - protein, 34 aa, Homo sapiens
MIQAEECLETLFNLDDGRVKCGLDVAVCAFYIGR

SEQ ID NO: 947201 - protein, 74 aa, Homo sapiens
GGEHPVHRCDLLVSASNAVGSGQRESPAHSEIQRPEGGHVKGHGVRGVVDLRDGRGRSRSLNVHSPGTFGITHR

SEQ ID NO: 947202 - protein, 124 aa, Homo sapiens
PGSVHRQPFCSVASSRANQKVVTVMGSLSKKLGVLVPAHLAADAGLLEDEHGLPDLRLLEAQAGRHAAQGLALGEGAEDRVEVMHGMANLVDGEFLGHAQLALFIEGLLLEEAAHLVAAVEEVV

SEQ ID NO: 947203 - protein, 141 aa, Homo sapiens
FEKWQQIIDVTFNGVFHCIQAALPDMLEAGWGRIVNISSSSTHSGQPFMSPYVAAKSAVNGLTKSLALELGPSGITVNAVPPGFIDTPMLRKAEGKGFLGDTDKQIEQTPVRRMGKPEDIAAACAFFVCRGSRLHHRPDSR

SEQ ID NO: 947204 - protein, 109 aa, Homo sapiens
TFPLGKLIPGWETMLLLMHPGDEWELYIPPEYAYGEKGVGPVPPNATLIFKVELVSVKPPPKAEASQAPAPALISARKRRECVDGIDLGALNVEFRAAGARRIDDELIG

SEQ ID NO: 947205 - protein, 106 aa, Homo sapiens
ADLPLDVRRSEVLDAIDLDRHYTVRMYRLHVVTIVSLVADRVQPISHRRLASSMVTHCHVMTPRGGTQLLTTASWLAPPPAANQRPKLDHRARAEAPRGQLVFAET

SEQ ID NO: 947206 - protein, 112 aa, Homo sapiens
EITQVVAIAVKMKATKADFDHGCAASDRGRGTRDDAHPDGAPRAAGGGVGRPRSLTPGWFVVGCQGRRLVHRDESPSHRDVLLGADLRIVVGPALAGIVEKDDPQQVELRSV

SEQ ID NO: 947207 - protein, 134 aa, Homo sapiens
LADDEPCHQNRLVAWGCAMLGAQLPPLQTLDEAGLSPAARALRRKPPRRERPGETITGLDAALSEFSRGSGRLPLEQHVDRVDQHANQPANQRSVDADILQVVADRIFQPVGDRLGIPAADRVRHQFECSLAMA

SEQ ID NO: 947208 - protein, 147 aa, Homo sapiens
GNSRKAGSSPNVLGPMEQGQAPIFIVLNAAPQEIVFRMPRMAEYKSWQQVLNTTKSEQTGDQIAAGAEYHRTAAFGAGICRLRMSAQHFGPELTADGARFRLWAPAAKRVDLLLDKPHALTRDAAGWYVAEIPGTRDGTRYKFRIDE

SEQ ID NO: 947209 - protein, 120 aa, Homo sapiens
AAAVGSGTLGLCLSLKVLGIGPGDEVTAAYAWHQIAHAITIVGATPILVDIDYWSGCIDPVKAAEKATPRTKAILASNINGHPADWKALRELADRYQLKLIEDSTEAVGSRYQGRLTGSF

SEQ ID NO: 947210 - protein, 119 aa, Homo sapiens
MATPFPRPRLASAGPRLAAFARSLPKSISLNPSPPFIESRSFSNLLSFKSDTIAHGAQQLSPRPWFRASAGAALDTVHGRSQVLINIAASFIGKDRPYDPSTHVFQNPYNRIQPARNRH

SEQ ID NO: 947211 - protein, 98 aa, Homo sapiens
SFGRQVETVLLLGGSPAGPANFFSGVVRTRAFFECLSPTLVVKLKGNRFSAPGFLGHFANIDFRFFIERLLNQARFSQELADTAFDHVFNDVFRLAGD

SEQ ID NO: 947212 - protein, 62 aa, Homo sapiens
IRDRVDEGLIELSREQVDQRRFEERPGTEHFTERHRVPAQQVQRALQLLFTVVEDAQYAIAL

SEQ ID NO: 947213 - protein, 73 aa, Homo sapiens
SGAASERPLRRAHIDPDAVLTPSSQAAVLASLPRRCMVSFAACNVESNTALAPFYNGAEHMVREPVARDAADL

SEQ ID NO: 947214 - protein, 74 aa, Homo sapiens
ISFNLPPGESLSQATEAISQAMNKLGVPVSVRGSFQGTASAFQQSLSSQPMLIGAAIVAIYLVLGMLYESLIHP

SEQ ID NO: 947215 - protein, 30 aa, Homo sapiens
LPLLEQIAGELPLGPEGGNEGDQGDEAGIH

SEQ ID NO: 947216 - protein, 113 aa, Homo sapiens
ARGDRITAQALTEAEAQGGKGKAITPFQLARIRATGGRSLATNIALVKHNAVVRCANGPRDAALARRRCFTVPAICEQNSADKLACFSRQSPLLLAGPAVMRVTFPLNLCGLL

SEQ ID NO: 947217 - protein, 128 aa, Homo sapiens
WLNWLRQQRLAVWDAGWLMVHAGVLPQWDAARTVALAGEIEAILRSPDLGDFLTQMYGNEPARWDDTLTGVSRWRCVVNALTRMRFCTPEGEMEFATKEGAGGAPQGFVPWFEVPARATQGTPVAFGR

SEQ ID NO: 947218 - protein, 99 aa, Homo sapiens
DQAGGVRVLWMGPHVVLAAVFTEAPGIHHRDRVTGLRHDAEVVGDHDHRQATLVAQVQQQAQDLRLHGHIQRGGRLVGNQHFRVAAKGHFYHCPLTHAA

SEQ ID NO: 947219 - protein, 142 aa, Homo sapiens
DRWSRSLRLVRSPPADSPQPGRILLRCGRSIRKLAHMFGHVGIGAGGAKVHDASVPDAIIHFARVEAESALGRFAAIADLVALRDDDQGDRQWWACDGWDAAVAEVGAALGIGRREASGQQSVAVALRDREPRVSAVFGDGK

SEQ ID NO: 947220 - protein, 45 aa, Homo sapiens
TLFSAQVKERRRKLPALRGMSFSSAFLDRAHNPRGLRAQRGVQPG

SEQ ID NO: 947221 - protein, 116 aa, Homo sapiens
AAGGTILVGTVEGKAHDLLGRCQAFPEEAAGAFKREVEDSIRSLCRPPPRVDVIPLVVDAGFVVAINVHPYPGQLVGLQVKAAATSSQGYAGDAFVFPRRLGSQCEYIPADIVPLF

SEQ ID NO: 947222 - protein, 96 aa, Homo sapiens
GGLAADRLRREVVEVEVVALCAVLLLHVRGGDTEVEQLVRALREDDVRRLHVAVRDARFVGSGERGGGVDAHLDGEGDPLCMARRQIDDGLLRELP

SEQ ID NO: 947223 - protein, 74 aa, Homo sapiens
HTQVDALGAGLVVQGGRVGASVEGQGVEEMVLLDLHAQGGQALGQDRGQLVNALSDLGQSFGTVVHGIHAGDVG

SEQ ID NO: 947224 - protein, 72 aa, Homo sapiens
MATCEGGFMSGYKMDPAGVQKVLQAVGDRASELGTALDDVESATADVVQGSGGDGIVGQALATFLTDQKSAL

SEQ ID NO: 947225 - protein, 130 aa, Homo sapiens
DLHNRKAVCPEKASEYVGEFRSKGGVLADEMGLGKTVEGTYTYQIELICCAHCLAFSYGLIASNPAPKDLPELRDDYEPKLYNSRATLVTCPNHVAQQWIDEIAKYSDKKMKTVLLSTSNDLRSTSYQEV

SEQ ID NO: 947226 - protein, 79 aa, Homo sapiens
EKFDVTTVRSRSDEEELAGIRRRQFLLYFPVKRQRHLRFAADRKIDATGRTCQTRWRRWIFVAQPDECRSRGSSRHPAL

SEQ ID NO: 947227 - protein, 78 aa, Homo sapiens
KAGDVFSEMDSNSDGSISLDEMSKALKSGCHGHHAQGASGSGDGSDSLLSSSGGWTSTTTTAADGSTTTTVTYADGFK

SEQ ID NO: 947228 - protein, 78 aa, Homo sapiens
ATAAIAVASFQPGHSAGSGAATVTSNAELLAPLRAIEQRAAVEEAAARVEPGLAHRIVVGVDLVFQRQRATAGDAEAA

SEQ ID NO: 947229 - protein, 118 aa, Homo sapiens
MTALPAVRAVISRPSRIGTPELNSVDSVRQNAPPRILRIIIPSTGIFSMMAVNPVLPSHRPVVRLERIAHREDADDDEWHEGDEEVAEEDDDARRQRQLRAKAGEQGRESRNDLPEND

SEQ ID NO: 947230 - protein, 100 aa, Homo sapiens
GFEALETPFVEYTESLGKFLPDLDRPNAGVFSFQDDDESWLSLRYDLTAPLARFVAEHYDTLPKPYRSFRAGYVFRNEKPGPGRFRQFMQFDADIVGASS

SEQ ID NO: 947231 - protein, 118 aa, Homo sapiens
PIGTCVGVRGSRVNAVTTELAGERVDIVLWSEDPAQFVIGALAPANVQSIVVDEERHAMDVVVDEENLAIAIGRGGQNVRLASELTGWRINIMSAEESAAKHELEAESVRKLFVDKLD

SEQ ID NO: 947232 - protein, 112 aa, Homo sapiens
MLEDGVMAERLVGIFESGERRALDDRDGVAREFVLREQLADFELDELEQLRIVDHVALVQGHDQRGNADLAGEQDVLAGLRHRAVSSRHDQDRTVHLGGAGDHVLHVVGVAG

SEQ ID NO: 947233 - protein, 72 aa, Homo sapiens
RLAGLDTRLDHARQCKAEGGCNADRHRRALRDEGAGVVEQFLDVLVLDRTRQRGHGVGRRAGILTILITQLF

SEQ ID NO: 947234 - protein, 68 aa, Homo sapiens
MAGGTAVVTCVPDHRICLNHVRAARLVRCLRWLNPQQSKSTLNLHPHRPRIWQAQSFRRGVREIDNSA

SEQ ID NO: 947235 - protein, 31 aa, Homo sapiens
MTQVQRFLVKLKPGASHATTSLALDSGKIRF

SEQ ID NO: 947236 - protein, 122 aa, Homo sapiens
QVLNEDQVISETAMTNGWAPEADLPLDCLSDFDLDDEDSIDEELEGLVVVEQDPERVYYGHEVKVQAKLDVARLGYRLFGEVQVRVIHAKLKWGGADDDEDTPPPVPMNQALADLLGFSVEE

SEQ ID NO: 947237 - protein, 104 aa, Homo sapiens
HHIGAHVLGTHHAVRAAVGLAGDDGDLGDRGLAVGVEQLGAAPDDAVVLLVGTGQEAGDVDQQHDRDVEAVAGPDEPGGLLRGVDVEAAGELGGLVGHDAHRAP

SEQ ID NO: 947238 - protein, 95 aa, Homo sapiens
LYSSSLPPALSASGHCARPAGIAPIGSCSCSISCLRPSFFISVALSSTRISSPLLITPIRSAIFLGFLDIVRGQDDGHATLAQAAHQRPHVAAQL

SEQ ID NO: 947239 - protein, 78 aa, Homo sapiens
MNNRTNGGARRQADIADRLADHFARLCITMGNRLDGFRRAPAQGVHADDIATAHVGQQGADGGQLRADGDVDVAALAQ

SEQ ID NO: 947240 - protein, 118 aa, Homo sapiens
MTLGSGWRLSNASGSTVVGTSSRSVTSFLEMRAGSALTCSASRRLGCLISPARANSVSRSPYSASNCAAVLMPIPGTPGTLSVESPASACTSITLSGVTPNFSITASGPIFTFLIGSY

SEQ ID NO: 947241 - protein, 84 aa, Homo sapiens
LSSMMPCKMVRRPIGITVLPATRLYRSTCTLHVSQKNGLHREPLFTVSAPQPRHSSIARLYSYAFHRGSSGSHAHRCVRSIRLK

SEQ ID NO: 947242 - protein, 69 aa, Homo sapiens
VVNGNIFRNQGDEHGQNSPLFAIVYTIAIEPLPVRPSLVERIDSAPRTMQSCAGNVLAFSGFRTVEKLD

SEQ ID NO: 947243 - protein, 111 aa, Homo sapiens
LGRGATLSGCQISTGRSVIQAAFLLAIRAPYPARSLRSGPFGPPLTRLGRESARAGIEPALALLTHPKAILQHARRNAARAQHQGAGIIAGEERERVDAVSTKEVEMTITF

SEQ ID NO: 947244 - protein, 133 aa, Homo sapiens
GRRSRGRSCDAGAEDVVGVEWRGRALREPLFLLVLEDERRHLARRLVNAPVGEFVAPGERLSVEIEQITKPPAGPETLAHEADSALDVGLSGGARRATRGDREAAYRGVLDEAWMEHRGCPVLEDDGLHVVEH

SEQ ID NO: 947245 - protein, 30 aa, Homo sapiens
VVAEFRDEAIRADGSERHDERADFLEAEHF

SEQ ID NO: 947246 - protein, 102 aa, Homo sapiens
QSFTLVLLSPRLECNGTTKAHCNLCLPGSSDSPASASRGAGITGMRQLAYPIFVFLVEVRIHHVGQDGLELPTSGDSPASASQSAGITGVSHCAQSTVHLKS

SEQ ID NO: 947247 - protein, 37 aa, Homo sapiens
KTIPAVNSKTGTLTVSLVNTKTRWFADEMPCFAKSLR

SEQ ID NO: 947248 - protein, 106 aa, Homo sapiens
DPDRIEYDREQLRKFYRNRGYFDFRVVSSVAELAPDKNGFAITYTLDEGPKYKFGKVTVETELKKLDGNLLAQILPIRQGQLYEDQRIEQATDALTFAAGAAGFAF

SEQ ID NO: 947249 - protein, 110 aa, Homo sapiens
RRLISVGNLVNANNTILTTIVSLDPIDFYFDVDERNLLSYAKTARENGSNLQEGGGGLEVTVRLTDSNQPPFKGKLDFAENRLDDATGTMRVRARFNNPDFVLQPGLFGR

SEQ ID NO: 947250 - protein, 89 aa, Homo sapiens
MGVQYRDGAQQLRRELAQQQAFELYLAAVAHLAAVGDDDTIGAAGGQCVDRLDRRDFQRLPFQRGIEPGDSFTHQTGEQPALLRVLLHG

SEQ ID NO: 947251 - protein, 106 aa, Homo sapiens
DSLGALTRGQRQTGGQNLFDPADNLESDYAREALNQWYHLLHDGKLASTTLEAFVELTGLKLVNADDGSLLEHLPPIQRWLNRILALRIATQNAIFEEYLGPIQAR

SEQ ID NO: 947252 - protein, 58 aa, Homo sapiens
SLAENTAAPGLAPYNASKAAVEHFANAMRLEVGYRGVDVGSAHMSWIDTAMVRDTKSD

SEQ ID NO: 947253 - protein, 60 aa, Homo sapiens
MIGNGVDPRGHLAGRRTDAVTATRQMARDQQLDRALGIVVDEDQHVAGIDTGADDLGDPP

SEQ ID NO: 947254 - protein, 39 aa, Homo sapiens
EQHRLVPHRHAGTVGPQVNDEMVHTDSPDVAVPGTVDAG

SEQ ID NO: 947255 - protein, 111 aa, Homo sapiens
EGVGCAGAGVLQVGPAPEFVSREALDERSAQATHGGRFDGRPATLEPMKRQQVVVAGLFRGPSQVDYAARDAEGAVLLAVRQQFLQDHAQRRGLGGGDADARPLDGDPARH

SEQ ID NO: 947256 - protein, 109 aa, Homo sapiens
DNGPARFPASVPVEGSGHRCGVNRVDRGTQSLIELLLRLCDVKPLGQSTRGARDESPVAGQLLVGLLTGVPTRQGDNAQDLRIRNEVGIQVFGTRDRQLQHDFGIERRR

SEQ ID NO: 947257 - protein, 137 aa, Homo sapiens
VGAGVLSGGVVDEFARADRVPRGQERQDRDVDLLAGGSRVKGDDAAVAGGSRLADEVNARRRHQRSVSIEGACVIVIACHRNHFRASVFQLDQCVYDETLCLRCRCRRLVQVARDEHCIDVLAGGDVDDLLEHQSLF

SEQ ID NO: 947258 - protein, 47 aa, Homo sapiens
IPIVKDVGRRVPSYLDVFGRTAAAYTLKVEFSLVLVAAGSLMGTRVA

SEQ ID NO: 947259 - protein, 91 aa, Homo sapiens
QLPAKRSAIVFPAKAWYDLGWPLGPSAGTGSAQPDSSIDLHGHTFHTAYQVLDAGLARAIARGDRILLLITGKPPRPESERPHQRGRIRDS

SEQ ID NO: 947260 - protein, 73 aa, Homo sapiens
PTYISTKDEPVVMNIEASASPAESARQEGLAGARRADEENAVRQLGVVPVEDVGFAQPFADLAQAVYGRRLTG

SEQ ID NO: 947261 - protein, 109 aa, Homo sapiens
FGQGHQGLRPGHEVLAPTHRQQMLPVVVGRQIELAGAARDADAAADAHQPVVRGQGGAGLAAQRIEPLVGAVDAPDHLVQARFVEAGAATVGVVLGLVLFELLEQVALQ

SEQ ID NO: 947262 - protein, 76 aa, Homo sapiens
LRGVIHSDQLTVLAQVVDVVFEAVDAGGNAPHALREAALQVAHGEVDQGSETLCGVRSWGDGGTSMPPRDSLTTAR

SEQ ID NO: 947263 - protein, 121 aa, Homo sapiens
MADSSKTMVGFRYRIARSRLALMCFKPMKSSVLAQVVARKTKPDNLPALCTAQQGGFAQRLSMLAPSPPGHRQEHREGHHHAHANHGKRVGSQAVHQLGHDGLAGKRHSPGHSEQQTVVTL

SEQ ID NO: 947264 - protein, 87 aa, Homo sapiens
MPDELSGGMKRRVALARAIALDPQILMYDEPFVGQDPIAMGVLVRLIRLLNDALGITSIVVSHDLAETASIADYLYVVGDGQVLGQG

SEQ ID NO: 947265 - protein, 67 aa, Homo sapiens
PGTGPADLSWGATAAPAGPTAYRSEQRNEYAITTPPQLAARTPPHMGDTLPLPVLPGGVWLSSDGAG

SEQ ID NO: 947266 - protein, 64 aa, Homo sapiens
ETVTVRDMLYGDASVQPTRALADSLHQSGTVSNLVARFPGASPLVESEVATQTDGFFRWVCSIW

SEQ ID NO: 947267 - protein, 96 aa, Homo sapiens
AGQSATEGGQGVHIADDKESRPGLTQGAPGLDHDLGPDAGGIAEADGEGSWRSRSQGRDRLLSLDGRGVAQIPQEALGEHRNLFAAQAILDGLARR

SEQ ID NO: 947268 - protein, 81 aa, Homo sapiens
QSKPKDPVKDTSWIETLNNTGRFWLLFLGIMATLVGGTMVAWDEWKAEDEPEKSSNLVGAGGRGGSGTTSVETRAEDRKTF

SEQ ID NO: 947269 - protein, 80 aa, Homo sapiens
HHRPGRQQGEVFDHTQQIAEGLAFFPELPSRESVIDLHDHLHRRRRQDDLTDYRHERYSQRQQAQTGFAVGVQTRLAHPG

SEQ ID NO: 947270 - protein, 88 aa, Homo sapiens
NATCALCGPTVKKALSRVEGVKSVLFKEADAGSGAVATVTFDDATADVPKLIAAATNAGYPARLKKLRRRLMASEPDASAEAAFDLLN

SEQ ID NO: 947271 - protein, 95 aa, Homo sapiens
QYRQAIGMVVGTYQVVARRLARRVRAVRLVLMSFGERRVFLGQGAIDFISRHMQEAERLLCISVQSFPVGAHRLQQAEGTDDVSLDKIFRAMNGA

SEQ ID NO: 947272 - protein, 122 aa, Homo sapiens
AIEAPFNRWDWALLPLAFAVLILLALAASQMAKPFHLGEQLPLSLDVAYLPYYLLRTTLRMFIALAASVVFACVFAVLAAKVRAAEKVLVPLLDILQSIPILGFQAIAVAPFIALFPGNLFG

SEQ ID NO: 947273 - protein, 156 aa, Homo sapiens
ADAEQAPQAPGQHDQLGVDVRTIEVEHLEADLVELAITAFLRALVAEHRADVPQLLRLATTGEAMLEHGTHASGGTFRTQGQGVAVTVFKGVHLFFDDVGHFTDGALEQLGEFDDRHADLLVTVVIQQARDRVLEVAPQWRLLRQDVVHATNGLQR

SEQ ID NO: 947274 - protein, 75 aa, Homo sapiens
GTPRSFAKPTARSVASGSGSPGPPRIRYAEMTSAAAESNTDGGTLSGRRWFILPALMANVRSPSGVMSAKQRPIG

SEQ ID NO: 947275 - protein, 108 aa, Homo sapiens
EEVLPLHQLHAHLLGQEGMLEVGRVVHARRHDDDGRVGHARGRDAAQRVQQQVRVVGHRGDAVVDEQLGEEPHHHLAVLEHVAHAAGHAQVVFHVVVAAAIGVAGAHD

SEQ ID NO: 947276 - protein, 77 aa, Homo sapiens
WSGVHLGCDSTSDREADDAATKRLARPSPGVRKCNVAVTALFGLGVAAAIPLSFVNLFEAVIAASVLRLIQIPERPL

SEQ ID NO: 947277 - protein, 48 aa, Homo sapiens
MIGLVIVTHGRLAEEFVAAMEHVVGPQPGVRAICIGPEDDMEQRRADI

SEQ ID NO: 947278 - protein, 50 aa, Homo sapiens
NEQVELLFFSVELLLIVLLVLDGHGVIDHLEVVGDFIGLGVGSGDVVESA

SEQ ID NO: 947279 - protein, 73 aa, Homo sapiens
HLRRTDHRYVRSARNRMHPKADARMVDGPERLDAEGVQGRGLGARVHLGADGRQAELGEGEPFLPAEHDRAGR

SEQ ID NO: 947280 - protein, 34 aa, Homo sapiens
FVQILPFTDRPLPFEAFTFCSGPLLAEQLHWTLS

SEQ ID NO: 947281 - protein, 98 aa, Homo sapiens
GPADGQSGITGVVLLAESHLAVHTWPELGAVTLDFYVCNYGGDNRDRARTLLDALVRVFEPAEVSRQQLLKAEPGRCLDPGRVGLLEDRICRQVAVRA

SEQ ID NO: 947282 - protein, 55 aa, Homo sapiens
CTGVLLILRVEAYPALDGLSAGRLLCGNHRIDPQVAVGRGGASTLDGFAYHLHMQ

SEQ ID NO: 947283 - protein, 94 aa, Homo sapiens
GLDKQLLELLNQRARVAEQVGEIKRTEGTAFFRPIASPQVIDKIRAANRGPLKAEHVSAIWREIMSACLALESPQRVAVLGPMGTFCEQAALEY

SEQ ID NO: 947284 - protein, 101 aa, Homo sapiens
AVKAKISTAQAALPKGVELKAIYDRTEIVAKALKTAESALVEGSVLVAIVLFLFLGEVRSAVVVIVTLPLAMLIAFLLMNQFGLSANLMSLAGLAIGTGMM

SEQ ID NO: 947285 - protein, 80 aa, Homo sapiens
ELFTQAENVRVDRSLHHAHAPALHFADQLIAGEHAALVLGEGHKELEFIGRELHGLAVDAGFVGRFVDLERPHRKSCFLA

SEQ ID NO: 947286 - protein, 60 aa, Homo sapiens
RVLGGHAIPRIAFKLLHAEADALRVLVDADDLDPHRITDRDHFRRVVDALVAHVRHVEQA

SEQ ID NO: 947287 - protein, 72 aa, Homo sapiens
MPSMKSTSRSAQCLRIAARYSARVEERSYLTCTNDLAGTSLNFTRVSTPRVPNEPCIMWKRSDSSLSGVARR

SEQ ID NO: 947288 - protein, 134 aa, Homo sapiens
MRAGPCSGPIGIAAPKGVVPHPGALADARQPELEEPRLLQAGGIAYSVDDHRGAQGPERLGDQEQLHRRHGVQHEIVEGHARRHLRARQGAKDRITVEFAHQSEDPEAADLMPATMAAAPKTMKLPMITVMPRR

SEQ ID NO: 947289 - protein, 40 aa, Homo sapiens
MARMPPSRSATTVAACVRVIVAAELAQLVLDRVLGGLLHV

SEQ ID NO: 947290 - protein, 109 aa, Homo sapiens
GKVGHGRDRTLRLFLRFTTCVAHEMCNLPMWTMYNRVPNGALAEAEPCDGKLACTALRGLDAGNRVRLPDNQIRPWALGRKNWLFAGSLRSGKRGAAIMSLIQSARLNG

SEQ ID NO: 947291 - protein, 35 aa, Homo sapiens
MAIAPEIARMKRSVGFSARNVEVHVDVVVVHRVAD

SEQ ID NO: 947292 - protein, 71 aa, Homo sapiens
MTFTLRGRPLSRGRRAMQGNSKYPKSMRIPEIKGSSGITRRGAQADSRESKRKFLSVIGAGWCEPSAAWES

SEQ ID NO: 947293 - protein, 98 aa, Homo sapiens
WPTREATVTVWPSCNWREAASRGWIHRVQRGLPDTRRALQCIHELLLRTSRRPISLRVGRAAGSLASVASSVLAGVVGTSAGKTLIRLGSSWRMASGS

SEQ ID NO: 947294 - protein, 36 aa, Homo sapiens
LSGGFELTSISAWREWRNKQIRGGDFHSTNSNYANS

SEQ ID NO: 947295 - protein, 113 aa, Homo sapiens
MHARDVGGLEQLVDGLVPGLAGDGLDHGAQQHIAGVVVGPFLAGREVHRQVLELLDQLGRAEVAPHRVAHIAGDAGVALDARGVVEQLEQRDLAAVGIVGQEFRYGVIQLRLA

SEQ ID NO: 947296 - protein, 82 aa, Homo sapiens
EHLKREPQLVEGAIEESLRFDPPVLGHFRTSLQPTSLHGEALPNRAKLMFSMVGANRDPDLFPDPDVFKVDRPANEARKHLS

SEQ ID NO: 947297 - protein, 91 aa, Homo sapiens
AQHQAVAIEQHAAVRPDIEMAQPDLFVDERHDLEDRALLVIGHANIGQAENLQNVVLGAPDRTNLVIGPAALDLAQYLVVRNEFERPAARL

SEQ ID NO: 947298 - protein, 72 aa, Homo sapiens
TLRTEWPCRIWSLRTAVSNPSMELIERGDHGLRAFPVGEDRPPLLEFCHEVVDAAFGELVHLDLAQFGDGCR

SEQ ID NO: 947299 - protein, 67 aa, Homo sapiens
MSLFCQRCDTYAPYSAVVLSALRRRFRVSSSLYCSAANVMVRTSTEGSTSTMCVGFVVVPDSGPMAL

SEQ ID NO: 947300 - protein, 52 aa, Homo sapiens
AGPHQRLRGLIDKQIASSPQHSFRRRPEGAFPVAGYHDRLLEGQKGLHQVLT

SEQ ID NO: 947301 - protein, 55 aa, Homo sapiens
ADFTGHDREASTLFTRASGLDRGVERQDVGLEGDAVDDADDVEIFFDDWLITSIV

SEQ ID NO: 947302 - protein, 38 aa, Homo sapiens
MKSQVGLSRHLQAGLVEQVGAVHHHRALAVERRGVELA

SEQ ID NO: 947303 - protein, 89 aa, Homo sapiens
HAGAREGGHFHVAVVSDRFTGLQRLARHRLVYHCLSDLMQRGIHALAIEARAPGEPSDRSSMIEPRAQQRARFFEPDSHHPMKKLALAA

SEQ ID NO: 947304 - protein, 83 aa, Homo sapiens
RVDLVGCDPVRRLALQPGADHRVVPAERLQRLADVVLALPGQALHLGRIILQLVGRLAGVHALGVVEQAQLGVGVVLLVSAEA

SEQ ID NO: 947305 - protein, 73 aa, Homo sapiens
PHQAQATQQPDDGQRDPAREARVQRPVLTEGDQRADPPDQGGQDQKEEDPERDRVEQDGQEFLHGQRSCTISV

SEQ ID NO: 947306 - protein, 57 aa, Homo sapiens
SPRSQMIADDHRVLHFFGQAQHTGHGATGRHAAEDAFFTCQAAGGVFGFTLGHVDDA

SEQ ID NO: 947307 - protein, 77 aa, Homo sapiens
VAVVVAHPLHRVAQARLVASPGRQVDEVVGPHHHFDAATEGRVGVEDLAGLVPAEDADAGRLLAREGRHVEVVEHLA

SEQ ID NO: 947308 - protein, 36 aa, Homo sapiens
PLQPEQRRHGEIDEASLDESAHVTEQQRQQQRRDVL

SEQ ID NO: 947309 - protein, 63 aa, Homo sapiens
ELRAQGMSIDAAITELLRRRGHTVMKAISLIPALVQSLLTLIVVSAALLLYDRTVVRPALRIG

SEQ ID NO: 947310 - protein, 64 aa, Homo sapiens
ACLNTEGGSLATRPPKRTPKEHDGPCNAQPPKVDRAANVVINHFGRIAELVREGKHNVFHHSDD

SEQ ID NO: 947311 - protein, 66 aa, Homo sapiens
VNQTPGFSARALALVERGGVWVSSVLRGGGELGEAWHRAGMLERKQNVFDDFYACAELLIQEKLTR

SEQ ID NO: 947312 - protein, 54 aa, Homo sapiens
TDYSDVIRELKKTQITGSAILPFYKKRLADIEAIMRREHEITVPERHAVIRLAT

SEQ ID NO: 947313 - protein, 89 aa, Homo sapiens
VVLGGLAGGRTECALTDDVQPDLAVRRLAGFAAFDADGLAQFLGDVDGAAVVEVEAQRHDVGFAGLRLGLRGIGHDLDVGDAGRDASQL

SEQ ID NO: 947314 - protein, 90 aa, Homo sapiens
LSASYQSNQVELDNYVKTIKEAVGIANVKSDKIDQILRDAVSGRYGDSRQNLDGSAPVKNGQGGSFISAIVEAYPDIKGQLNVYDHIIAK

SEQ ID NO: 947315 - protein, 33 aa, Homo sapiens
EAAIAVGSDRGVRAVLYVAGDLLEHVPDAGPAP

SEQ ID NO: 947316 - protein, 90 aa, Homo sapiens
HVHTAFVEVQLFHVAGTARGGYRRERRCQNAFDPGVPGHPAGVQRSVAAVGQHCEILWKVAAHTQFLTDTDGHLLVDAVLDHPGDVDGVH

SEQ ID NO: 947317 - protein, 30 aa, Homo sapiens
MCNTRPRLCGTRRVLRVSHGTDLARMRDQQ

SEQ ID NO: 947318 - protein, 58 aa, Homo sapiens
MVEALAPRPRPFEELDVAVDGGTLLVPGDEEAEGSGEGGAGGVEIVEGGGEHEGDATL

SEQ ID NO: 947319 - protein, 104 aa, Homo sapiens
TRGHPAEKPRRKPDSWPGRERLVAAPLLTRLEGILDIAALELDPVGGFIGVSASTDEVVQTLDSIAQMLGLFRPQDLGQGVLSRRNQRPLHQLARLLALPALQF

SEQ ID NO: 947320 - protein, 113 aa, Homo sapiens
EGVPDGLSTAGPHRSECKRDRLGTMTWGEQNSEAEAFAQIERAKSAGINFLDTAEMYPVPPKADTYATTERYIGNYFKSRGDRADWILASKIAGPGNTIDYIRDGHLRHNRKR

SEQ ID NO: 947321 - protein, 51 aa, Homo sapiens
MAGNDATLELGDGYVTSMRTLSTEAMDEGSLYTCSLTLRSLYANDPRSIEL

SEQ ID NO: 947322 - protein, 99 aa, Homo sapiens
PSRDSADGSLRSPGTPDGRQLFLQVSANYSCRWSPGSSFSRVVVVHAMYLSSVQCVVVAGPARSCRHGAASTAGGLARCSASSARLGRPENSRMTGIVD

SEQ ID NO: 947323 - protein, 88 aa, Homo sapiens
VRRIADVKMVDPRGITHLRLRICRVVDATEANIGCGQAYCAVWCIGRGGTDAAGQVQAARQAEINIAVKDEKIARVERKRSKAALLAL

SEQ ID NO: 947324 - protein, 69 aa, Homo sapiens
MCVQHFLMRSTSNVFTSMNAWMNTVFTRLSPMWRRSSSASALSSGYMRKIALRSAAGIFFASGTCPALV

SEQ ID NO: 947325 - protein, 83 aa, Homo sapiens
WQVEVRHQCIDHFVLEARIDKDLGIVEERFNEIVFRCLSRAFQRTYCSGANRNHPVTARFRRQYRVYHILGYFSVFRVHDVIF

SEQ ID NO: 947326 - protein, 105 aa, Homo sapiens
YDAMVRLAQDFSLRTPLVDGQGNFGNIDGDNAAAMRYTEARLTQAAADLMSGLDEGTVDFRPTYNGEDEEPEVFPGLFPNLLANGATGIAVGMATSVPPNNVSDL

SEQ ID NO: 947327 - protein, 139 aa, Homo sapiens
HDGLRGGAAVGLGVDGSRRDRVDADVAPPQLTGQLLRQTVDPDLRQTVEVGVNPCCRRRLVDDRPAAALLHVRKNRAGTHQRTVEVDAHELAVVAPVHGQQAVEFHAAEDRGVVHQVADAAELGHGLRCHVIGRIDVGG

SEQ ID NO: 947328 - protein, 108 aa, Homo sapiens
QRLAQREHADAVAVLFAQRHRAGLDGLLRGHFLGLGRDVLADDFVDLGLDAVEFVGRQRAAVAEVEAHALAIDHLPLLSDVRAQHMVQSSVHNFRRRVVRARGVATVG

SEQ ID NO: 947329 - protein, 98 aa, Homo sapiens
DRGDLGLLEGDAEVAVGREDRAFPLNLRRRILHHRLVGRGDPVEPVGDVAAGDLHDHQRDALGKIDPAVGEMLGEHLEIVDDGIEVARDPAEPLADSL

SEQ ID NO: 947330 - protein, 82 aa, Homo sapiens
GPRVESEVIRAMMTMRLKTMASGHTGVRPKVVTAYADLLNSGLVPVVGEYGSLGCSGDLAPLAHCALVLTGEGTVLTPDGDE

SEQ ID NO: 947331 - protein, 61 aa, Homo sapiens
YDQWRQMGLSGWSYEEVLPYLKRAETLHGEPSPYHGFEGPLHVRWGGLDQHPLNAGVIKAG

SEQ ID NO: 947332 - protein, 108 aa, Homo sapiens
MGVTLCAVEHEHPLATVAAKSKPEVAAFIEECKAGGTTEAELAMQDKKGVPTGLFVTHPITGAQVEVWVGNYVLMRYGDGAVMGVPAHDERDLGFANKYGLPIKQVFA

SEQ ID NO: 947333 - protein, 50 aa, Homo sapiens
QAAAQGTDAGKAMQDGFNRGVKQASVDWSKTSKADPRADFWAGVGGFFGN

SEQ ID NO: 947334 - protein, 127 aa, Homo sapiens
TNSDIRVLFRKAQLGNSGSVAYMFDRVGLVEATHAEARDPEEAAIEAGAQNVEPMKELDKDAKSGAIFYTEISDLNAVSNALTAAGWKVTTSELGFKAKNPVELSGDQLKETAEFLQSIDDNDDVTP

SEQ ID NO: 947335 - protein, 98 aa, Homo sapiens
RPGQQGIADLDSGSNANLKPETAKTWTVGLVNSPEFVPGMDVSLDWWKIRINNAIVGESATDILNQCYVQGVDSACARFTRSTGAQTLGQVTALDRSL

SEQ ID NO: 947336 - protein, 98 aa, Homo sapiens
ALLALFGQGDEHPALVFGGFAPAHDAVTLQPAQYAGHARLEDAREVRQLVTFEFTLLTQDADHPPLLFGQVMFIEQWPEERHGRFAGLEQGERKGRSG

SEQ ID NO: 947337 - protein, 55 aa, Homo sapiens
MSACAAAPDARIPLRGAVGQNVRLFDTRTAYGQFLAGQAALRDGKSKEAASLFEA

SEQ ID NO: 947338 - protein, 132 aa, Homo sapiens
VIVTSFSAAWAVDPQPSNRASSAERATVMMGASVIRQVHIEAGAEGARAQRGRSALGADVVGQPTIARRYEPGRGSTAQAHVIALDIEQAKAEAFGADHLDQPGRVCIRYRLESHGGHGFDSAPDQGALLLI

SEQ ID NO: 947339 - protein, 54 aa, Homo sapiens
MLLRHAGSRNMASDIERRWFLDIGANGDAFPLKNLMQISERDATAVCDHLRRKP

SEQ ID NO: 947340 - protein, 132 aa, Homo sapiens
GHHFYRRDVEGIRTHKVHVCVGGHEQVGRMLRFRDTLRQDSDIRQQYQDLKFRLEASNREGIGEYLAQKAPFIDALMGAQSCNCKCLVLPDRLLQRLSGPQLLLQQLGKGVPGAVVLYILVPDKAVIHWLQV

SEQ ID NO: 947341 - protein, 73 aa, Homo sapiens
DEAACEQGGEHLYIELSHVVGYVARAREKVFMLVPLLYVHELPIVADLPHVEGRVLLEDAHGENFEAFFGVGA

SEQ ID NO: 947342 - protein, 87 aa, Homo sapiens
MRLAHFLPACNGLRQLPIGVARRQIGTRCQNLDDALEARCVIRGADRPYTWEIAAFFLDGAEMLRYVELLWHNCGCGRLKVCAISHA

SEQ ID NO: 947343 - protein, 60 aa, Homo sapiens
IVGHVDVVSGLCERPEGAMERGKDGKERGGPDISRVRRKIEQHDGQLAVLALAPSELNRL

SEQ ID NO: 947344 - protein, 95 aa, Homo sapiens
FVNSVPNMYIQDQGPGGSTEIYIRGLVAQGGAGFPVATYFGEAVTSVLTNHGGMTNLQLVDIDRVEVIRGPRGTLFGANSLAGVLRVVPNAPNLN

SEQ ID NO: 947345 - protein, 74 aa, Homo sapiens
FQSWVSRHFGEAQAMNGMVNIGAVGRDYVAPQGVMAGGVEDVLAVVREEQQETVGVGLGVVLDQVRDPRSRCTA

SEQ ID NO: 947346 - protein, 131 aa, Homo sapiens
HLPPVLALLFPGGAEARVYDMYRSDSPKGAFCDAIGDACVADLAVENAFFQNPAVLATGESDWNFDGDIAAKTNLEPGSDPGNLVTETESNGGVGISTGRFGVGASMSWQKDAVEGKLLIFDENGNPLTAR

SEQ ID NO: 947347 - protein, 101 aa, Homo sapiens
RAWIGFEKMKGRLRRRAGGSVPGIVGEPAAFFGAAARLETRGFDGIVFGHTHHAGSAPLPLGGIYLNPGSWMLGSKYVLIANGAAEMRDVRSRRGRDRRAG

SEQ ID NO: 947348 - protein, 79 aa, Homo sapiens
GADHYLDDALVAALAGIVRGQLAGAEDGGAAQDLADIGLVRIALGLDLNFLTDGDIRDVGLDDFGAGDALGVGLEVEHG

SEQ ID NO: 947349 - protein, 97 aa, Homo sapiens
TSQMPVDNWHELIGDPTLADAILDRLVHNAYRINLEGESMRKRTQKLTRRAPQTNNATPASLRSDCLSRMIVEQVSGSAWAECPNGVEIRSVPVIVA

SEQ ID NO: 947350 - protein, 66 aa, Homo sapiens
GSLGLPLGVIQGQNLALMLESKLAHASDTRDLDKLPIPFRAVATDIASGEKVVFRKGHLPQVIRAR

SEQ ID NO: 947351 - protein, 54 aa, Homo sapiens
RTGGTVHVVVNNQVGFTTPPSDARSMTYSTDMAKAIQAPVFHVNADDPESVARV

SEQ ID NO: 947352 - protein, 128 aa, Homo sapiens
DQLEQLGVVNHVGLVQEHDDVRHADLTRQQDVLAGLRHRAVSGRAHQDRAVHLGSTGDHVLDVVSMARAIDVGVVTDRGFVFDVRGRDRDATSLFFRRGVDRGVVLELATEALGTDLGQCGGQRGLAV

SEQ ID NO: 947353 - protein, 102 aa, Homo sapiens
PSKLPDLSAIEDMREPIVRANILVPQEHLGNVITLCIEKRGVQHDMLFLGSQVQVTYDLPMNEVVLDFFDRLKSTSRGYASLDYHFDRYQSTNLVKLDVLIN

SEQ ID NO: 947354 - protein, 62 aa, Homo sapiens
YATSNVFSASGDQNQYNDMNGVMFCETPWLLDANGPLRRQVTAQWPPAGGSLGRLYAMGVDA

SEQ ID NO: 947355 - protein, 97 aa, Homo sapiens
AQPIEQKGGFRQGKTRVFQPVVFGPDRVVFRPTKIRFLQVRARKTSTGEIGTAQIRTAEVGFAEVGLSGWTIPQNSLLQIEARETRQSDHALLELRV

SEQ ID NO: 947356 - protein, 34 aa, Homo sapiens
QRKVSSSFSTCPCPIQSRNRVITTSAPAKRLIGC

SEQ ID NO: 947357 - protein, 59 aa, Homo sapiens
MSEELYGHELCAHVVFAGTESGFEESFGAQAARIPVLACFGERRCARQVGIHEHRAHIH

SEQ ID NO: 947358 - protein, 116 aa, Homo sapiens
AVEVVVAHVVQAPADRVVGGVYPGIAPEAVEVPFAQGGTGPPQEKMSLEIFSEALSEWARAVATDRINLVLQFLVVRVLLVFVEHPCGIAQQGFGSTQGHGVFTDLLDDVRLFAGV

SEQ ID NO: 947359 - protein, 67 aa, Homo sapiens
GRTGVGGLCHRRRGRQRPDLHPPQKAFLPVPGGLSVVGAASAGASCRVGCVRGAVASRPEALQKTSR

SEQ ID NO: 947360 - protein, 46 aa, Homo sapiens
FTGLILSVAPIDIQVHDTYYVVAHFHYVLVAGSLFALFAGTYYWLP

SEQ ID NO: 947361 - protein, 53 aa, Homo sapiens
PYRVYTREEWARLRDDTPMTLEPGEFDRLRSLHDRLDLKGVEDIYLPLSRLLS

SEQ ID NO: 947362 - protein, 89 aa, Homo sapiens
GFHETRNGVCHRKRAEFTLIGSFEMSTNYTPAQLSAMTVAQLNALAASQFASFTSAQIQALSPLQLNGLSKANLAAVNVSYFTKAQVNG

SEQ ID NO: 947363 - protein, 48 aa, Homo sapiens
PEPDSAPGAVRILFIGNSHTQGAAETPEGNYPAQVDARLKQLAPGKRF

SEQ ID NO: 947364 - protein, 39 aa, Homo sapiens
LGSALGPHQRGAFSRERQDREGPGGQKMFFGAAFMVALV

SEQ ID NO: 947365 - protein, 72 aa, Homo sapiens
EDHQQHRRLAVEQAEVAQVLDVLVDVVQVGDAHQAAVVLLDHQVGVVGALEQLVVGTEHMVMLAEDDRALGQ

SEQ ID NO: 947366 - protein, 65 aa, Homo sapiens
RFGLRGVLVLVRPVEAVFGAVHLHDLHAGAADADHVRGLRRDGGRERIRVIGGERLPHGLFVVVV

SEQ ID NO: 947367 - protein, 62 aa, Homo sapiens
STLYNQLITQDKVDLLVADSGSVLTAPAVAIARDHKMFLFDQTGTGASFFSKDNPYIALMAD

SEQ ID NO: 947368 - protein, 71 aa, Homo sapiens
RHEPCLDAGVGVGLEGLEHHDRTQVGSADADVHDRRDPLVGDARELSRAHPLGERADTPEHLVHVGVDVLS

SEQ ID NO: 947369 - protein, 50 aa, Homo sapiens
DPIAPAEKFETLKVKLGDGFVGTTFPDEVANPDGMMAKGRKPHSVFTGAV

SEQ ID NO: 947370 - protein, 83 aa, Homo sapiens
VPVLLPQRATQVGLEAIGNRLQHIEIEHARAELRSLETEGELIGLCADGRLVVDNPGRRGKGIALRRDAHPHFASANKPVREA

SEQ ID NO: 947371 - protein, 54 aa, Homo sapiens
RQPVDQRAPLIGVVRMPVQHQHDGAATGLQHPGPHRQFRHVEPVFFNPGSNLNL

SEQ ID NO: 947372 - protein, 59 aa, Homo sapiens
PPLRTIIAHVVAVVRVVLSDVSAVLVDDVCLVVHHHGLIDHRGVVDRDAVLVPAAKRRL

SEQ ID NO: 947373 - protein, 92 aa, Homo sapiens
HQVDEKERALAKLQLQLAEQEDLIRKGLVQEEIAMLRSTKEQLAALRDERDRLHLSNEGERAQLMEAARRESALIVDQGLSLKAHWEGLISA

SEQ ID NO: 947374 - protein, 61 aa, Homo sapiens
GRVDQHVRVMIRPVDLAEAFHGGLEERENVRQRSRLRPLLRRVPHSLFLAQSIEHTYDIER

SEQ ID NO: 947375 - protein, 63 aa, Homo sapiens
FAWGLFFATWAKVNRRRSDGQNGMSSSMSSKPVADFGAGAGAGRGAAAGRAAGRLTGAGASWL

SEQ ID NO: 947376 - protein, 70 aa, Homo sapiens
MSGYLPVLILFVVALTIALAVIVLVAFLGPKRPNKWKNAVIECGVPPSGDARKRFSVRFYLVALSFLLFG

SEQ ID NO: 947377 - protein, 73 aa, Homo sapiens
TRALLVGPDRHFQGLAGLDPEVIERAHHFQSGQHTVDPIKAPAFGLGVQVAAHHHRGSVRVAPGAPGKQVADG

SEQ ID NO: 947378 - protein, 73 aa, Homo sapiens
MPGLINLDFADVRSVMQEMGKAMMGTGEASGDNRAIEAASKAIANPLLDGVSMKGAKGVNVSITGGDDMRLLE

SEQ ID NO: 947379 - protein, 73 aa, Homo sapiens
MTELRPPMDRFRPERADDVFSRYGDQRVDSRTEALRRHPRRQEFRYRQWRFKADGSSDADACAGGASGVVPLE

SEQ ID NO: 947380 - protein, 97 aa, Homo sapiens
KTALSRIVGHLDLSTEEMRSVMREIMTGQCTDAQIGAFMMAMRMKSESIDEIVGAVSVMRELADRVELKTLDGVVDVVGTGGDGANIFNVSTASSFV

SEQ ID NO: 947381 - protein, 106 aa, Homo sapiens
VELLDASGMEIQHAVQRLAVPEAQARGVSVHEIIRAYQALIDRAIDRLVKDGRKKVFPKFTVTTFPQAVAKCQGESESQYLLGGAVAGFIAVAPDWNAKVGLILGL

SEQ ID NO: 947382 - protein, 37 aa, Homo sapiens
GYGVADLMAHWNFAPGATFNVGVFNLGDKRYIDWSNV

SEQ ID NO: 947383 - protein, 30 aa, Homo sapiens
MSVVVPVLANAVASGNMPAIKTRVFQLINR

SEQ ID NO: 947384 - protein, 52 aa, Homo sapiens
DVFHGAFALAITEKQELRQALRFASAAAALKCTRFGGAYAAPRRTEVEAFLG

SEQ ID NO: 947385 - protein, 38 aa, Homo sapiens
VSLDNFVISMMVSQAGTTTLPIFIFGLLRMGVTPDVNA

SEQ ID NO: 947386 - protein, 71 aa, Homo sapiens
QAEQMAVEGRVGDVADLLLVVADVGVGAALDQAAGRLPGVVLGVAVVAVAADVIDAAAHQRGRVRRPFRLQ

SEQ ID NO: 947387 - protein, 80 aa, Homo sapiens
AAANHRHTLALEQRPSQCGQKHTPLALYSCSPGTPISRQRAPVARITDLALRLAPLSNWISCKPPTSLAGTRALARCRFM

SEQ ID NO: 947388 - protein, 89 aa, Homo sapiens
MGAKKITYADFDVYTDAIGQPRTAQYPMDLEYRNLPDDLAAGVSWEAAQNYCGWVGGLIGRKMELPTEAQWEYAARNRGQFIIWPTDDG

SEQ ID NO: 947389 - protein, 64 aa, Homo sapiens
SPKLVALQGKVDSFKKNLEQTGLGKLDIRGLFKGGSLITPFLDGIKACDAFKGKLAEVGDSSAP

SEQ ID NO: 947390 - protein, 35 aa, Homo sapiens
MVRNRLRILSAVALPLALLACAKRDDDRNLDSLDN

SEQ ID NO: 947391 - protein, 52 aa, Homo sapiens
IIGADGKLNEQTTLGLAYRYATSDVDSDDGNSTDVKSQALIAYGSWKQGPVC

SEQ ID NO: 947392 - protein, 92 aa, Homo sapiens
LLEARLATVNRMAAANDLPDAIVTESGLKITLLDAAVPDTAQAMIDQTAMVLPHVKITELLLEVDEWTGFTRHFTHLKSGDLAKDKNLLLTT

SEQ ID NO: 947393 - protein, 90 aa, Homo sapiens
AVGHQQVVADPDLDLVAGDRVRHVQAGGQAFLFTRGQFGFGGAAQLALFDEGGQRRIRLRGVGGQGVFRRHGAEGHAHDGVDAAANFFAA

SEQ ID NO: 947394 - protein, 90 aa, Homo sapiens
MIAQSAAMREAYVPIPVLVTRTSSVPFSLRVPANTGLPMPLSFVSLRVRERFGHEAGAESYHAVGREHSLGWHAANVSFPERLGGNEAFD

SEQ ID NO: 947395 - protein, 52 aa, Homo sapiens
DLINEATGEIYIEAGDEVSAENLEKLDKAGIDRIELLDIDHIATGPWIRNTL

SEQ ID NO: 947396 - protein, 81 aa, Homo sapiens
YDAKRDGFAIAGGGGMVVVEELEHALARGAKIHAEIVGYGATSDGYDTVAPSGEGAIRCMEMAMSTVDTPIDYLNTHGTST

SEQ ID NO: 947397 - protein, 64 aa, Homo sapiens
DDLVLHAGRQGPTDQAMGGVGVGRESDGLEVERDAFLGAAFHQSGVDSLQLVRVLELLGHVGLP

SEQ ID NO: 947398 - protein, 86 aa, Homo sapiens
CNGTLIPMTPGDNGAISKNGSTYANYSIPLSQCNTVTIPAITSSRIYLSVGSPMYLRSAGNPVYGYVGPDINNPADPNIDVTFDFI

SEQ ID NO: 947399 - protein, 100 aa, Homo sapiens
FLNKCDTVDDAELLELVEMEVRELLSKYDFPGDDTPIVKGSAKLALEGDKGDLGEQAIMRLADALDTYIPQPDRAVDGAFLLPVEDVFSISGRGTVVTGR

SEQ ID NO: 947400 - protein, 81 aa, Homo sapiens
LRDLGHPVEVWGWDEANVGAAVDDPFELAEKIRAVIAAETGLSCSVGISDNKQRAKVATGFGKPAGVFALTAENWMTVMGD

SEQ ID NO: 947401 - protein, 46 aa, Homo sapiens
LFHGLCSSPLELIFLARGLHRAGYTVRVPSMTGYTYRNGKTLKAKD

SEQ ID NO: 947402 - protein, 60 aa, Homo sapiens
QHGEKADIGAGVDHAVSGLDGAGHDVDHLGFGQLAVLRVPEQVAVGLKLLGLEVEQELGA

SEQ ID NO: 947403 - protein, 56 aa, Homo sapiens
SLKQGCGHDHGPSLAEEHLHKDRNLDSALLHVLSDAVNSLAVIVGGVLMYFSHYYW

SEQ ID NO: 947404 - protein, 64 aa, Homo sapiens
VELLCDPDPVSVGRLIEAGGSALKMVTIAPERAHGLEAVTTFTTAGVHAAIGHTECDNTTASAA

SEQ ID NO: 947405 - protein, 67 aa, Homo sapiens
GPVRTIAAPHETGHDRPLCARCRRHAGKERIVGRNELGLGFEVRHRTGRKNLDSPVRTTFDLRLVGV

SEQ ID NO: 947406 - protein, 73 aa, Homo sapiens
NGLQNKIVDGGDLKVCRGCRTVRVDRGPINGALDSKFGTVALLNVIERARARRMPDNGDEPDIAPADVLIAVR

SEQ ID NO: 947407 - protein, 79 aa, Homo sapiens
MRKHAQVLFSANRGSSAPCLSSPPPVFEPFRLKELNVIRFGKVSLHNGRVSRMRVRADLRLFVHEIPKSMKQAVSSFLS

SEQ ID NO: 947408 - protein, 38 aa, Homo sapiens
LGRVCEIAAIDDARQAVLLFCRGEARRVVHGAGLDARQ

SEQ ID NO: 947409 - protein, 63 aa, Homo sapiens
MKSEMRGTISERNREPLNTPYMTDALLHVMHAAVIRNRRAQRMRRFGLAKTRDVILLAFHRHR

SEQ ID NO: 947410 - protein, 105 aa, Homo sapiens
RTDRQTEDTRMIQDHHPLAKDFPEFKDKIHALKTSNTHFAKLEREYEDLDKAIVRLETGVEHGSSIELEQKKQQRVTLKDELYNLLKADHQAATLKAIAARYLIG

SEQ ID NO: 947411 - protein, 47 aa, Homo sapiens
VDDSNQQHAETMPSRHKGEAVFLAPKCVDRGGGRTAVKPALSPASLS

SEQ ID NO: 947412 - protein, 74 aa, Homo sapiens
MQDLGRQVGIDNVQLRVVGDNHLPGRARMAYDPGTGTFLIRQSDILKTNWLDAQYLYHEMIHAEQDVLMAKVGL

SEQ ID NO: 947413 - protein, 34 aa, Homo sapiens
PTSFAHVTSSNLSTATGIGAQNTGITVGAGNLIP

SEQ ID NO: 947414 - protein, 98 aa, Homo sapiens
CTTLAGLVSDAFKVNDKGVCCHADGHDRAGDTSQRKGESDGLAEQHHGCVGSDTGNDEGAEGHQSQAPVVQQAVAADQNKANDASDNASSKLLTPKGG

SEQ ID NO: 947415 - protein, 52 aa, Homo sapiens
PHLMMDDSEAPQAVVHSLELREVRYSPPPVEGSEPFHLGPINLNIKQGDIVF

SEQ ID NO: 947416 - protein, 81 aa, Homo sapiens
VVITSRGGVAIRIKDVATVGIGREMRTGSASENGEEVVVGTALMLIGGNSRTVAAAVDAKMQDVRRSLPPGIEANTVLNRT

SEQ ID NO: 947417 - protein, 91 aa, Homo sapiens
VLLLVVAADVVGLADRAFGHHLEQGPGVILDIQPVAHLQAVAVHRQRLACQGVEDYQRNQLFGEVERAVVVGAVGDQHRQPIGTLPGADQV

SEQ ID NO: 947418 - protein, 88 aa, Homo sapiens
MQQPVMAWRHDVASHAMYNIIELLAVALADGVMQSPGHRQGVGPTPQVVLAHMDAILEASLAAPLIGGAMGWYFKRLSPYRFSQLLGI

SEQ ID NO: 947419 - protein, 91 aa, Homo sapiens
GGGIADFFIEYTNYADPSIPYGSMFSVLVGVIYPYLDSDNFFFGYSEGASESRLSEIVMRSGFTYTGLFETKEDGTTIYYYGRRDGHALGY

SEQ ID NO: 947420 - protein, 38 aa, Homo sapiens
MVDELACSQQSLLLSRIGLAFCLHGRQLGVLRIILGRA

SEQ ID NO: 947421 - protein, 71 aa, Homo sapiens
ETGEYPLWAYPLDVAGRRAVGITQQRTDDVGVQQMNRSQDVLRLERRVGDVRKLVFRPKRFVLSPLDQQFH

SEQ ID NO: 947422 - protein, 50 aa, Homo sapiens
VLDGQNDAKAQPDPDRREDLAMAWQIGGLFAGVVSGVVSWLIGQIYDNIC

SEQ ID NO: 947423 - protein, 49 aa, Homo sapiens
ELNTPLTAILNAITMLEERFTAEKEYIPMLRRNAERLRKTVENLLEISR

SEQ ID NO: 947424 - protein, 45 aa, Homo sapiens
HVLGAARDAGQHGIEECGVHDLDAGLLQPHGHRERVTVHPVRDGG

SEQ ID NO: 947425 - protein, 62 aa, Homo sapiens
RHRFELTAERAHRFPALDHDSQHLQGGDQAVAGGREVRQDQVARLFAADIEAALAHALHDVA

SEQ ID NO: 947426 - protein, 31 aa, Homo sapiens
FEERIRHLMYLRELQDETGGFMVFIPNSAQP

SEQ ID NO: 947427 - protein, 74 aa, Homo sapiens
PDRPSEHQLPLLKGHEKNELGIWINTANQLLASIERNTHLRHEAENSLLRMAQYDFLTGLPNRQQLQQQLDKIL

SEQ ID NO: 947428 - protein, 57 aa, Homo sapiens
LSKLTTAGINGQFRTPRHIIRLMVELMDPQPTDRICDPSCGTAGFLIETYDHLLRQY

SEQ ID NO: 947429 - protein, 58 aa, Homo sapiens
NTNFIGGEIEADDVQIKGGQLNLSNLHTDLTGNLSIASGAALQVRLSDSTNVNTPVVG

SEQ ID NO: 947430 - protein, 66 aa, Homo sapiens
PQRHFVAPQRPVVDQGRAGQVQEQLAGGRVLVEALGAGAEAGQLQLRMQALAAGFGEQGVGKVQGG

SEQ ID NO: 947431 - protein, 82 aa, Homo sapiens
MLVAGGVGDDELALLGREETVGDVDGDAKLALGGQAVDQQGEVDRPALGADLLAVGFERRQQILEDHLAVVQQAADQGGLAV

SEQ ID NO: 947432 - protein, 32 aa, Homo sapiens
PCAIAAQLDAAHQFALVLIAAIGARELDARRF

SEQ ID NO: 947433 - protein, 96 aa, Homo sapiens
MSEETEILTKNELFLAVTRPALWAGIPIEAAEILLISSASVLIWSNSPVYDALVVAFGYSISRLIVRHNVNAFRLLFLWGRTKLGNRNRTFWGGSS

SEQ ID NO: 947434 - protein, 84 aa, Homo sapiens
RTAPYDLGNGYGHIAFAVDDLEAARAKIVEAGYQPKDIKNMTHDGKPFGTFFFIDDPDGYKIEVLQRGGRFQKRFEDKMADDDF

SEQ ID NO: 947435 - protein, 64 aa, Homo sapiens
MIQDPTCADLLRDCGAVVLRQALSNDGAEDRVEARFQFLRYRADLLRHVVDADIFGLEHHAQDE

SEQ ID NO: 947436 - protein, 60 aa, Homo sapiens
MHRPALRIVVAQERLVQAALLLALDDGHAVALVGDLAQRVLARVVHGRGGGHRRRVERLR

SEQ ID NO: 947437 - protein, 69 aa, Homo sapiens
IRGRVDLALGGGALHDVGRRRQYRAHRIRGVADPPLARREAQVAQAGRLDGIVQRSLDRLDLVVVPVGL

SEQ ID NO: 947438 - protein, 55 aa, Homo sapiens
EKWKQDVGNVFHDTGADTAEEARSEAQERLTKHLMDKGWSREQPERWVEARWKDA

SEQ ID NO: 947439 - protein, 73 aa, Homo sapiens
IEPAIEQHVGQRGALAANIVSAILHLAVQPLQAVGGDHLKPGRCVRGARDSLLEEFQAFTEAKAVAHMLADVE

SEQ ID NO: 947440 - protein, 79 aa, Homo sapiens
VHLQQVVEGAGLGAEQMHQRRMRRRGRQLRHLGAAALSSVEDAPRPQQFQALAQGRARNPELGRQAPFRGQQLVGLEYP

SEQ ID NO: 947441 - protein, 62 aa, Homo sapiens
EATAVSDDPFEYECSIPGSTMMILLRNNKDPRTGEEIGGVTDLNPYNQRFFRCNRKQVALSR

SEQ ID NO: 947442 - protein, 30 aa, Homo sapiens
LDRVEQRPVAIREHIALRKWRAQLEPERAQ

SEQ ID NO: 947443 - protein, 125 aa, Homo sapiens
APYASIDAHEKYSTACFTTFREAVHLVRQVVKVEARPARGDRAQLTHQRLRAVVTGAHGDSLGVEESGEVMRVHLVGGEAQHAAVKLGFRGSEHFDRGHGEELFLRVLHERAFVGVDFVHADLGE

SEQ ID NO: 947444 - protein, 43 aa, Homo sapiens
ALYGRRIHITGSIVEDANIATAAEVTRAREFVKALVLDLLAKG

SEQ ID NO: 947445 - protein, 45 aa, Homo sapiens
MSLLSPAIEPLRFREALGHYASGITVVTTHINGEPIGFTCQSFHS

SEQ ID NO: 947446 - protein, 60 aa, Homo sapiens
ALDIATSFKRVELTTLTPYSGKFAGFRIRKGRLNLDLHYVITKGQLKAENKVVVEQLQLG

SEQ ID NO: 947447 - protein, 72 aa, Homo sapiens
TLRRSKSADDVFGDQGDLVVAAVLKLVHDVHEGEVLHFRIGADEDDLFLRVGAADHGRQVVGEVVERLGVRV

SEQ ID NO: 947448 - protein, 123 aa, Homo sapiens
DAWLDALTRIVEKGRKLHKEVVLHTHFNHPKEITAITQRALARLMERGIFTRNQSVLQRRVNDTPEIMGLLVKRLGHVNVHPYYVYVHDLVKGVEDLRTTLDTALYLEKHVRGSTAGFNTPVF

SEQ ID NO: 947449 - protein, 71 aa, Homo sapiens
TDGGADAILESEADQAGGRKDDGVIFAGVQLGQTGIEVAPQKTDLQVGATGQYLSLTAQAGSAHHAAFRRL

SEQ ID NO: 947450 - protein, 74 aa, Homo sapiens
EQSHRAARLPIPSSGEVVLQNRVDAVERNRVAENQPENRRAVALGRCCARHVAQPDLTAQIRIGDRRTVRLGKV

SEQ ID NO: 947451 - protein, 83 aa, Homo sapiens
HIEPARQDALVLEPLFHAVLHGTPERHQAAADFFFRTPDLLVGQHQFGDPQVVLLAQAQQFHRTGKIVRQLAAVQVRHTAVGL

SEQ ID NO: 947452 - protein, 81 aa, Homo sapiens
YKLTDTLSATAQVMTKYRATGEYKPDFDWAFAKWQAAPAVAVRVGRIGAPFFMVSDFRDVGYANTTVRPPLDVYGQVPVSS

SEQ ID NO: 947453 - protein, 58 aa, Homo sapiens
MPILFDIADRLSNAGADLLASRVLESAIPLAQLRAHAPVQPRQIFQAGANYHKHVVDL

SEQ ID NO: 947454 - protein, 75 aa, Homo sapiens
IKLSGPRAPWELNNKCTKLRSAVERIAAQHAGAPDAVGALVRLLNVSGTSIEWGYLNSGVHDAQRDHEFDRATVR

SEQ ID NO: 947455 - protein, 113 aa, Homo sapiens
TAQCVIGGARVINEIQDPAANDRMDDAEWYNIVTPILDGISLVGVGGSALTTLRLLKASKAANTGKSWMQLLKGLNRQERAKLTKELLTLRDPSLTSKLLKLQQRAGASPRRC

SEQ ID NO: 947456 - protein, 89 aa, Homo sapiens
MPIRHCVDLSELNLIDDGLPDRHHVGYGHRDLAEPHCVRSTPRSPNQADQAETPNVVTVLSRRSVNDCSRVPPDANVRPPDPGGSIADE

SEQ ID NO: 947457 - protein, 142 aa, Homo sapiens
LTVDVVDRGTVSQLEQLRAVLLEVGIAVDEQLVVDGVSGRPLVDALVLALVGLGHRPEGELVDTVGGGEVDHLLHLVDAVEIALDQHRCQTHGEVELLQLGNQSRQVLVLAVRRVNRLVLAALAVHHRNGDGGEAEVIPLLQ

SEQ ID NO: 947458 - protein, 113 aa, Homo sapiens
EEVGADGALLEHRAVVIARPAGVGDQRGRAAQVGEDSLARLEAGGEHEQHRVGEHDAGQHHQRDMQQPTGHPRPFGGSAHDPNLSTTFFLTEGEQQHEQEEEQSHRGAVGNVL

SEQ ID NO: 947459 - protein, 95 aa, Homo sapiens
GSGYLFCSFRRTEQAADVDSQAFTDPHQLVVAQGKLVVFDLGQRGRRQAGFLADLCQRPTALDPNRPQDAAWVSGVDLPRLFASFGNVPFAIEQY

SEQ ID NO: 947460 - protein, 129 aa, Homo sapiens
ELHVRRQETEVHIVVDFNGPGRTIAHVSVGVTGHAGNARTEQAALRERVVIQELPVHQRGDVDVALVGAGEGELQTADDVALCGREEVVLGIRIHTDFERDVVQRAHGEGLGVEQLVPAEGGAEQAVDL

SEQ ID NO: 947461 - protein, 123 aa, Homo sapiens
SGRGLEHRRRAAQGARLWVEMQARGKCRLRLAAGHVGAGNRSDGRDGHADVEAHGDRGRGLNRLHRRRRVAARTAREQSGGEENKGKRFINGRANHPRGNATPVPSRKQRNIGGQRARRRQLS

SEQ ID NO: 947462 - protein, 43 aa, Homo sapiens
FLVEALHRIRNRIGHVAHRDEERTLVFENAAEVFAGAVLRVGF

SEQ ID NO: 947463 - protein, 131 aa, Homo sapiens
MAAIGDAGERHLDGHLKIKRTVGAHRKAIKISHPLPVHTPGHVAGKRRKAITVGEHHKTGFEGGDDDVFEPIGKVSGMQQAKSIGNEELERLACLIVLLIRRELFHSVKITLWPREMSQLRNRSSWVDLPG

SEQ ID NO: 947464 - protein, 72 aa, Homo sapiens
MDITFAPMVDISRDPRWGRTSEGFGEDTYLVSRIAKVMVKAYQGQSPALPDSIMASVKHFALYGAVEGGRDY

SEQ ID NO: 947465 - protein, 74 aa, Homo sapiens
FPGSLFTDPWVPDFRMFLEKEFRQFRRLDALAAHARQVLVEQVDRQVDLFQHRHQLRGLVVEDSGQTDLDAHAL

SEQ ID NO: 947466 - protein, 124 aa, Homo sapiens
HSNQVTIHTLNVLQVVQTDGTAILHLNAVGCGSTACRTTNVERTHGQLGTRLTDGLGSDNADRLTNVHLVATSQVTAVALGTDAIAGFAADRRTHDHFVDAVELDEFNPLFVYQGAGRNDDVLG

SEQ ID NO: 947467 - protein, 122 aa, Homo sapiens
TIASQLVPIGIDSAFLLREQRIELLLEAVVIDALVQFHAGLHGVDHVLLGAVATDRGVDVFCGLVHGTEGRQRVQHQGNIHGFQLFGGVQRGGAELSDVGQDRSFHPIGEDLVHFELGDGFR

SEQ ID NO: 947468 - protein, 112 aa, Homo sapiens
GYTYSAHPVACAAGLAALDLLQKENLVQSVAEVAPHFENALHGIKGTKNVIDIRNFGLAGAIQIAPRDGDAIVRPFEAGMALWKAGFYVRFGGDTLQFGPTFNSKPQDLDRL

SEQ ID NO: 947469 - protein, 115 aa, Homo sapiens
KRNARAPLVACRDLTGVPDGRHDHCSVSKLDYLARAIPCVLGVQSAPWNGCAVDFASEAAVARVRCQRELGPVSGWDVVCHGRNGAETIGWAADCRGAEPVKFSDGWRLDVIPVN

SEQ ID NO: 947470 - protein, 72 aa, Homo sapiens
EGFNEFLLLFGEHNISRWHRRSRCSTLMAQYARRGLLLQSRSADLTKAIRPIRHRYPSADATCFRIASIACA

SEQ ID NO: 947471 - protein, 70 aa, Homo sapiens
NQDGARGLAEVKRQGGLTIVQDPSEAHVSTMPAAALALHQPDYILPLRGISRLLAELEEPMLSNIQAKLL

SEQ ID NO: 947472 - protein, 91 aa, Homo sapiens
EGTSTLFMRGALTKGSNKTDVPRDKVAYDEADNNPQAYKTYGGSVKARNDFGAIDFTSITAYETTSGYSRGDTDGGAAVNFPVNGVPNGYG

SEQ ID NO: 947473 - protein, 105 aa, Homo sapiens
SYANNINTHEGGARVSGFRTALTRVVNGFGKENDMFKGMAEQLTGDDIREGLTVVISAKIPDPQFEGQTKTKLGNSEVEGLVSSIVSEKLRIYFEQRPQIAKKII

SEQ ID NO: 947474 - protein, 43 aa, Homo sapiens
VLGQLFGADVNPHRHTLHDLDPVPGGVLRRPQSTRTPGAGASS

SEQ ID NO: 947475 - protein, 116 aa, Homo sapiens
FVPFLRFAFGHRQFNRRILSLALPSLRFLVRRVDRDQLKAQLISTFLTGVEAAWLQQRAEAFCQQAWNRLMRPAGLQAVAQELRSGALVTLCSASPALVLQPFATRLGISLIGTEL

SEQ ID NO: 947476 - protein, 87 aa, Homo sapiens
DVAQHRGVALDARALRHAEQAVLEVDDIGGDGGFVKLAVVRQPASKLVEVSGRSEPLMESKPDWVVAKGVEPVAAPWEARMFFDTLV

SEQ ID NO: 947477 - protein, 125 aa, Homo sapiens
LLDDEASPARLLAYVTGPEDMDARAIRQGLRADLPEFMLLASVTMLSALPLTPNGKLNRARLPAVHGAPRHDAGAPQGPMETALAAIWADLLHTPHVRRHDNFFDLGGHSFLVVQMMDRLRAMQL

SEQ ID NO: 947478 - protein, 90 aa, Homo sapiens
HQQRAQALAPANRGVTHRPIQIGARVFRNRQKLVQPPVDIGTDVRQGRSKRRGAAVMPSTRGKGLRADGAPLAIGADRFDPRLCGIEPII

SEQ ID NO: 947479 - protein, 49 aa, Homo sapiens
MRQQRALSDLAVGEMSGLSICTNERTRRGDPPIISRTLRSALIVVSTVA

SEQ ID NO: 947480 - protein, 41 aa, Homo sapiens
DETLLPVVEILQRDGLRVRHLEDLARDRFAEAGGVLEPGLA

SEQ ID NO: 947481 - protein, 53 aa, Homo sapiens
LPVFQGLDVVQPVHALHMHVAHIADREVAVQRLADAHAFSVQVVAGEADVQLL

SEQ ID NO: 947482 - protein, 114 aa, Homo sapiens
YYTREAGVRALEREVGKICRKVIKQLLTQSDRAKAEGKTFELKPVNVTGDNLSDYLGVRRYTFGMAEKENQIGQVTGLAWTEVGGDLLTIEVADMPGKGVIQRTGSLGDVMKGS

SEQ ID NO: 947483 - protein, 70 aa, Homo sapiens
KPSRRVDRVETTARGAASAISLASFSAAAQQLILRHQLIDQAPGERLFASDAASCVHHQRRFCSQIRRGR

SEQ ID NO: 947484 - protein, 111 aa, Homo sapiens
MRLVGACMSASPTPGTQHGAFWMTSSRRCIQAKRRTDQPLGQPYIGIHVEVLRNPKQSLVLGRLCEALKLIQLTPLIGGEGANILRHVETHRLWVIAIDPVSAGAPILWRG

SEQ ID NO: 947485 - protein, 103 aa, Homo sapiens
LQDGVQQDRPGDAVFGLQRGQELVHVEDVPRPLDLGDHDHVDLVAGLLDDGGDLVEMPGRIEAVDPRPKAHAQGLEVDLARHGHQARQRRALGVGGDGVLQIG

SEQ ID NO: 947486 - protein, 132 aa, Homo sapiens
SGKFVVLILLVLQLVASGGTFPWQTTPEPLHALHQIQPMGHVVDGMRILIYGADLSRIVPIILGLVGYTLFGLLLSYLAARKHKFWTLKTLQPEIAVMSGEANTMKRPERTMITRQKLFEASMQLIGERGPA

SEQ ID NO: 947487 - protein, 100 aa, Homo sapiens
LSINQSDRILADDAAESGRVEFALEFLAGQQQVEKIVVSQLEEMRQCRHVIVGKLGFVGVEIPGDDQVVFEQAPARPPTQTRPFQFSKPAHHYTLNTPKY

SEQ ID NO: 947488 - protein, 76 aa, Homo sapiens
ASGEFGQQRRILVHAVEALRRLGDAVEIRPDPHVIDPRHLAHVIEVVGDIGQGHHRLGVSVVPGLHPHLGLVWLAH

SEQ ID NO: 947489 - protein, 134 aa, Homo sapiens
GASQVVGQGDILLAIVALGRGEAQQAGDLLLVGDVFGRAFLHHLAEVLPEALVLLGLVLRQFLQHVEDTLGQCRLHRVNDRVFLQDFPRDVQRQVVGIHHALDEAQVQRQERLGLVHDEHALHVELEALGRFTL

SEQ ID NO: 947490 - protein, 87 aa, Homo sapiens
GVAISQIICTGLSKEPKPSLVVVRVALPSFETTSGNTNVSDSVSSRPSWYEIVNRLAAVAARVEVADTSTPRRSTVEVPVTALPSTL

SEQ ID NO: 947491 - protein, 104 aa, Homo sapiens
GVGLVDLVDRHDQRHTRRTGVLDRFLGLRHDAVIGGHDQHHDVGQLGAAGTHRGEGSMARSIQEADHALRRIHVVGTDVLGDAAGFAGGDLGAADVIPAARSCR

SEQ ID NO: 947492 - protein, 109 aa, Homo sapiens
LLEDLGIDHFGGTLGLFLALGRNLHVHAVDQDSAGVLVLDARQQLAQQAEAGRDHAGGIAGMHAFVEHLHGEVAAGQAAQRGGAPQLVVVGAARIQADHQRRLADAVGR

SEQ ID NO: 947493 - protein, 51 aa, Homo sapiens
MERLFEVRSHTNPAKRLDKLFSDLCKLGLRHWDPLLRKTKNPKARASGSFL

SEQ ID NO: 947494 - protein, 89 aa, Homo sapiens
REFLMLKYILVAALACTASLLAARDTAQASWHYQPQGKRITIQQAAANIAAGTQPSEITFAENQMFVEFTDYKTPANSTYGLTTTVAAF

SEQ ID NO: 947495 - protein, 118 aa, Homo sapiens
AAGRCGIHQCVGMRLRRRLERRKPWIDALPGIIVLALIRQELLNALRFHAHLEFRDVSSFAVRARLGAERGERIEIGAVESQRPVHQLPVSCPLLTCKAPVTCGSELRGPVPPKDVVS

SEQ ID NO: 947496 - protein, 91 aa, Homo sapiens
SDVIFGWLHNDVVSAKRQYERDTAINAMSVGQRHPSPCGETETPLSERLRTTNKAIAEDEGFRDDALDKNHIDTLTRPRIEINQSDHIARE

SEQ ID NO: 947497 - protein, 84 aa, Homo sapiens
FSFWPRKVAQGEPYYHLWYLYMIVGLYMFAPLVRLLYVRSTPRSRSLWVVGILGLAILDALYRRALGAQPGFFLTWFLPYLGCF

SEQ ID NO: 947498 - protein, 107 aa, Homo sapiens
AGIGVNDVLGQHAAVQEVFRHGDALDAAGSQVAQMLGVDTLVFFDDDLAGAVRDVKRAISPFQRSGTNSIMPPSLFSSKLSKSKKLARIDSGVMPIALHRIVTGILR

SEQ ID NO: 947499 - protein, 82 aa, Homo sapiens
MMLLGQAFHDRGLAHARLADQHRVVLGPALQHLDGATDFLVTADHRIELAALGTSGQVDGVLLQRLPLFLGILRLHVLAATQ

SEQ ID NO: 947500 - protein, 130 aa, Homo sapiens
LKSLHRGATTVTQLTGVRLYRPPAQRPMPGMPFMPPMRFIIFMRPPPRIFFIMVCICSNWLSMRLTSWICTPAPAAMRRLRLALLLPSISSAGWRRSLAVIAQMMPSMRRMSRSALPMSALTGLGGQFGG

SEQ ID NO: 947501 - protein, 38 aa, Homo sapiens
PLVMVPQPFHFGFALSASSVLGFVKTGFVSSIGSIKDV

SEQ ID NO: 947502 - protein, 76 aa, Homo sapiens
NFLGKFSVRPDADTLVDLTLKYSDRSEALTSNTARDTQYANNHGAYGLAARLEHRLPAARLTLQAGWDHAMSNRRS

SEQ ID NO: 947503 - protein, 37 aa, Homo sapiens
GFRGEAAEHHRVDRANAGTGQHGHHRLRDHWHIDSLC

SEQ ID NO: 947504 - protein, 56 aa, Homo sapiens
MAAALPSISIMVGQMPIELARRDEEDVEAARQKASYFQQDARITALAHGEGQPIAL

SEQ ID NO: 947505 - protein, 127 aa, Homo sapiens
RQLLDLALEVALTALQLTDLAHQRLVGRVVASELAIHLRLLKTQLLDAGFHRHFLIQKALGLQSQIHRVGTRLVGTRRLLGRVHLISDIRQLLLHEGQLRRCFGRVALDVQADVGLGHLLQEALCEG

SEQ ID NO: 947506 - protein, 91 aa, Homo sapiens
YWVAVEAFDESGVSRRTRPVRIRYICSSLEERGVIGLPSQPPVNPASFSPLRIGAQPCMRFQTKSFRIIRRLEQDRALVDADMVGVVPALG

SEQ ID NO: 947507 - protein, 69 aa, Homo sapiens
AELAAFYLRVFPAAEYSVSAPGRTVKTAETIAGDDFAVDGQIERQICRLQPDRRRRLQPDGLRDLGAAG

SEQ ID NO: 947508 - protein, 30 aa, Homo sapiens
AVIRGNLERLASEPDLHSFLGHMLLETTPQ

SEQ ID NO: 947509 - protein, 92 aa, Homo sapiens
APGAGASGEDDLIARYFRPLATDPGAFGLVDDAALLNHSGDDIVVTTDAIVEGVHFLPDDPPDTIARKALRVNLSDLAAKGASPAGFVLTLA

SEQ ID NO: 947510 - protein, 73 aa, Homo sapiens
VRNGLCVIGRVAVLEAVGHCHVDERVAPLERGPFDPEHQSERLGRATFAVLGSDEERVFAVGEAGQIDVDRLG

SEQ ID NO: 947511 - protein, 60 aa, Homo sapiens
GQGFLRRWNRGVNQGGNRSCYGLCPERLGEPQVVSNDKPNDTIWAIEARGLVKRFDGFVA

SEQ ID NO: 947512 - protein, 95 aa, Homo sapiens
YSIACKTLMSTVPGGRFAVMRACITEDVLQSFLQALPSLETNKPATPLLAALSLAMEDLQAGDALYTEARAEAVRRAPDHPWITRLAAVHDAEHG

SEQ ID NO: 947513 - protein, 70 aa, Homo sapiens
PFGCRVIHNRYGCLESCLGAKPAVVVDLVRPQHNIYRTLEADECDITGVVVVVQQRSSPQCQVCPERRLV

SEQ ID NO: 947514 - protein, 103 aa, Homo sapiens
EDAELGLRVFEKGLSAANHHEYGKGLMPDTFIDFKKQRFRWAYGAIQIIKRHTASLLRGKNTELTRGQRYHFLAGWLPWVADGMNIFFTVGALLWSAAMIIVP

SEQ ID NO: 947515 - protein, 69 aa, Homo sapiens
FFFYSASSRDSWITPSVPIKRLVERRARTRRLGALLGLDVVDYVAYGFHFLGVFIRNVDFELFFHRHHE

SEQ ID NO: 947516 - protein, 69 aa, Homo sapiens
RHARAQGRITMAGPNTSPMTLFNVAGRAMSAQLVRMNAAASNLANAGTVSSSESTASRPLRPVFSEELA

SEQ ID NO: 947517 - protein, 70 aa, Homo sapiens
MRTPSRWSPLESSYTAERVPPVTVSDFKVSRFGNVKDQFEGRRAPAHDQTGHTWSHSGEELFHKVQNGRF

SEQ ID NO: 947518 - protein, 69 aa, Homo sapiens
QRHDARVSFESSAASWESEERTHPCVFRCGVNYYMLYNGNGYGRTGFGIARLLNPDSLLRLRNRPPPRG

SEQ ID NO: 947519 - protein, 99 aa, Homo sapiens
RLAAHLGASRAIGRGLAAEFPCSGFFHPREAIENRDELIFGDSLSRVGNLNARPPRESGKAYRVLPPFGVNLAAFAQEVPDDLLNSHGIRADKRARRAE

SEQ ID NO: 947520 - protein, 49 aa, Homo sapiens
MREFAQRRRTCAWENALFDPGVHVGGEVAADGVDQAATYIAQTLRDDAT

SEQ ID NO: 947521 - protein, 70 aa, Homo sapiens
INSVQALLLYNIGDKELTAGELRTRGYYLGSNVSYNLKKLVELGFLDHQRSRVDRRSVRIRLTPQGQEVR

SEQ ID NO: 947522 - protein, 70 aa, Homo sapiens
PLVDPTWRFMTLDTDGKIRMDCSSPDAMASLIGIRDRYDIATGNDADSDRHGIVTPDGGLMNPNHYLAVA

SEQ ID NO: 947523 - protein, 39 aa, Homo sapiens
MRHLTRINSGAKNNHAFAYQADTDSNPFMTYRVFAVVRR

SEQ ID NO: 947524 - protein, 30 aa, Homo sapiens
IAPAMPMDTNHQIGLKYWGAVGIFKKFYTR

SEQ ID NO: 947525 - protein, 50 aa, Homo sapiens
SRELQQRLGDLGELVVLGREQLDLSHPEQIRQQVRAIRPDLIINAAAHTA

SEQ ID NO: 947526 - protein, 115 aa, Homo sapiens
KKDNSEHFASPATVLPPPVEAAPVVDSSSGHSDPSSGHSESLSGHKSVVQDTTLGLKERLQELLGPGPLPARMPPDRMEELIVSLCDEQFVTLRDLAQALSRSDASLRKRYLNPL

SEQ ID NO: 947527 - protein, 112 aa, Homo sapiens
RDDWPYDSNRDAGLEQVASGGGYPSCRQWWADGSNGLRARLLGQVDPSLLNRLAGWAGFLSRAEVDDSVIRTIASPRQQKLNQGNVYTDYGGQIDKTLPNIVTRATGGVGMA

SEQ ID NO: 947528 - protein, 63 aa, Homo sapiens
IRGRVDELVGSGANRMQAELVACFLHGLRRDHHAGAVGQLGDQRRVGRLEHQLDGQGIDDVGL

SEQ ID NO: 947529 - protein, 88 aa, Homo sapiens
TNTFGATSVAQDDYHMAHLVYEMNVESAKLAKAACVKYSTPDKPRFVAGALGPTPKTASISPDVSDPAARNVSFDQLVTSYMEQIRGL

SEQ ID NO: 947530 - protein, 109 aa, Homo sapiens
MSIGALASGPTRAISAVFFSGRVSFWFFSSTRLRRAMSRASLRCRRLSALVSAGSSSALPMRTYRVLEQAHVVLGGQHFTHGVVDVLLFDLAGLEQPRQLLAVQRIVHA

SEQ ID NO: 947531 - protein, 127 aa, Homo sapiens
YVAQQAAELARKDGEARLEALKKSGSADGFGPMETVSRAKADGVSPKAVDTIMRADASKLPSLVGVDLGADGYAIYRIAKVGTPPQANANQREADAQQLGLMAGQTELAAFYDVLKAGAKVKILHPA

SEQ ID NO: 947532 - protein, 79 aa, Homo sapiens
SRYWGFVPESNIVGKAFFIWMNFSDLSRIGLVQLIMSLATLENRLDHHFGDLALLEQALTHRSHGARHNERLEFLGDSV

SEQ ID NO: 947533 - protein, 94 aa, Homo sapiens
QIDEPWIKATIYTPDEYLGSILKLCQDRRGIQTGLTYVGGRAQVNYELPLNEVVFDFYDRLKSISRGYASFDYEQIGLREGDLVKMSILVNNEP

SEQ ID NO: 947534 - protein, 81 aa, Homo sapiens
LADRMLQITGVLDERSARAQYLDRMDIERERGITIKSQAVRMPWEVDGVTHLLNMIDTPGHVDFSYEVSRSLQACEGAILL

SEQ ID NO: 947535 - protein, 78 aa, Homo sapiens
TVCAGYLPDAVSAESITASAPSKIALATSDASARVGRGGSIIDSSICVATITGKPATLHLWMIIFCALGTCCGEISTA

SEQ ID NO: 947536 - protein, 51 aa, Homo sapiens
AVLDRLVQVHQEDRHALGLARDLVQRRGARQQDHQVGVLHPRDPDLLAIDD

SEQ ID NO: 947537 - protein, 43 aa, Homo sapiens
HTRFPERSAGLRMSESRAARMRCLAEKYSAEKFTSLRRSQVML

SEQ ID NO: 947538 - protein, 80 aa, Homo sapiens
QARTFSCILVCKRQRCLVSRTSIFREPEITEYWIDQVGRVQQVAAVVALVAPRLLEAAMRTGPLDVAIRQEALVVDRVDL

SEQ ID NO: 947539 - protein, 95 aa, Homo sapiens
TVPKRVSLASRIGIAPKTLDRVLNGDILAPLERTIPNPCAVPPAAIRVGYESARAVSRAQVVELPGKSGDLALARVYGFPPGHTRRIAGAMISVA

SEQ ID NO: 947540 - protein, 92 aa, Homo sapiens
FVLGGEGAHAQEAVFRLQHDFHAVGDVVGHQGRDADAEVDVEAVLQSAGDALSHLFAGKSHVCCPFSRAGEGRSLAHGALFDALLEGAADGP

SEQ ID NO: 947541 - protein, 69 aa, Homo sapiens
DADDDVHRDQRGFEEHVEQHASSAQNTPTIRPDRIRKAAMYWDTRLVMTSQPASTTMMVMNAVRSTNHS

SEQ ID NO: 947542 - protein, 100 aa, Homo sapiens
FRVEDAQLGDFAVGGEVKADIFEVGQIVDVQGVTKGKGFQGTIKRHNFRMGDATHGNSLSHRAPGSLGQRQTPGRVFPGKKMSGQMGAVQQSTQNLEVVK

SEQ ID NO: 947543 - protein, 76 aa, Homo sapiens
DGRRKPYCTRVSLRERSPRHMALELADGDVALVDEHQRVARQVVDQRGRRLAGRCARQMARVVLDALAEAQFLQHF

SEQ ID NO: 947544 - protein, 98 aa, Homo sapiens
GRVDQHGLAAKEGRGVGDRDVDLTISGPLFLADQKRRIGAGRHRHPLLALQVGPDDHRPGDVLLDPGRHERRGMNKLGGDAVDLRQGVIAVQVGIDGH

SEQ ID NO: 947545 - protein, 107 aa, Homo sapiens
MPARVKVTGMALKIAKRSQGIEDEGEVGDEAGQAVDQDHKDHDGSDADTTGDDRFFDGVLTEGRSDRALFEDADGHWQRASIEFLHQIEGLILSKAAGDLTAPASDR

SEQ ID NO: 947546 - protein, 80 aa, Homo sapiens
SSALARRDKVFVQFDVVEQHRAADRILLAEGMPVVHQGQARGVAVEQHPGAAYSLAAVQGNPFGQVGTGGVELAAVKDQL

SEQ ID NO: 947547 - protein, 43 aa, Homo sapiens
MSMKHASGLASRITRRASYSILCEVNLDISFLQKAGPHLPHSG

SEQ ID NO: 947548 - protein, 72 aa, Homo sapiens
FAAASTNTLLSSTDCITAFFSSRVSTRFLAVCSSSMRVSIAERNSPILALSPSLVENGSKRCDFTASVLKSS

SEQ ID NO: 947549 - protein, 49 aa, Homo sapiens
VSKIGMPSKAVPPLPGVTPATICVPYSLHVFVWNGPVAPVMPCVTTLVF

SEQ ID NO: 947550 - protein, 65 aa, Homo sapiens
TREVPARLDDLAQAGIDALDGIGRINHLTDRGGKRKEGITRSQARRQAAATVGNFWPHAPASKAS

SEQ ID NO: 947551 - protein, 45 aa, Homo sapiens
RPQPQDEALLDDLFARYTMEREREVHRDFLQALGLSSSAAARRVE

SEQ ID NO: 947552 - protein, 39 aa, Homo sapiens
VAVGGHWIPVYPRLYIWTDPDATIVRTAREANMTMPQYR

SEQ ID NO: 947553 - protein, 66 aa, Homo sapiens
YFLHVLAEVHRTHPALPWRFLAAGSGVLESELKRITGALGLTDRVHWLGYRDDASKLMPGINLLAF

SEQ ID NO: 947554 - protein, 79 aa, Homo sapiens
SASNEEGSLGAIIDMQASRPFDFSGPALSMSAKVGWNDLSRENDPRFTFLASNRWDTGIGEIGALISVAWAKRKTLEEG

SEQ ID NO: 947555 - protein, 54 aa, Homo sapiens
PFSHSPELTTEIARAIGLAVEVVVVLAHDVLDAGGVAQAAVRKGGGGVEPHLAR

SEQ ID NO: 947556 - protein, 39 aa, Homo sapiens
SDAQVYRLVTGEPQRIPSRTFAALCDIFDCTPNDLFEPY

SEQ ID NO: 947557 - protein, 36 aa, Homo sapiens
MEITTDGTRMRSELRKPTLMPWQVSPVQAEVQALTH

SEQ ID NO: 947558 - protein, 50 aa, Homo sapiens
GTGNKVSIGLTRSEYQSRYNFGYVDPYWTADGVSLGYNAFYRTTDYKDLD

SEQ ID NO: 947559 - protein, 75 aa, Homo sapiens
GRPTLGLELPIAQAGGVFHLEGNDDALLVDGQLDALVHRRLAILRLPCPDIREQHVAQLEHVVVADHAEIADQRL

SEQ ID NO: 947560 - protein, 108 aa, Homo sapiens
MAVLQATGSPEHLNGAVHQGCIRIIDVWSLEQDHARSTYRHVRPAEPSDTLGRDGSGTPVGHTGMTWSGFRPSDDACRYGYNIPAQFMAMRALRQIREFCRVWDDEAL

SEQ ID NO: 947561 - protein, 72 aa, Homo sapiens
IVNQRIAEAFMTEGADAWYMDGARERFLRERASEDWKKVDDICDVWFDSGSTHAFVLEDRQNFPQLGNIVRK

SEQ ID NO: 947562 - protein, 116 aa, Homo sapiens
WYGVTCGGRRSSSPGLPLNWYSRQVAASLGTGASVPSIMSSSRSRVTDPKAPYVFTRWRGSKLAFIICEPLRRLSVGLMLSIATTAARPKKITEGQAKLAAAAGRIAPAVPRNMAR

SEQ ID NO: 947563 - protein, 68 aa, Homo sapiens
IHALELGQLPGHQRDIGGRVEFAAVRCRGQIGAVSFDQAALDGHHAGHVAQVARVLEGEDAREGNVKA

SEQ ID NO: 947564 - protein, 54 aa, Homo sapiens
HHRHMEIAGLRQTQHLLQVQLARRGVEQVGAAHDVGDVLRAIVDHHGQLVGPVS

SEQ ID NO: 947565 - protein, 70 aa, Homo sapiens
GRVDIARQRLLERRDAQRLGVDTEQAVAALGGLHPAHQEIAEVRDRIAQRRELPVYQRDDPGLVMREDPV

SEQ ID NO: 947566 - protein, 67 aa, Homo sapiens
METRCPRPDRLYGPGNLRCATSITECSYLSHFSTEQMLEVGLQAASGEKIGCFIGRKCVHDRGEALR

SEQ ID NO: 947567 - protein, 88 aa, Homo sapiens
EARLVQQAAVREAFVLAHDSENGQQLVAYIVPSDAAIAVAGEAQAALRESLKTALKEHVPDYMVPAYLLFLEALPLTPNGKLDRKALP

SEQ ID NO: 947568 - protein, 83 aa, Homo sapiens
DFTFVCPTEMGDLSDHYQELQAMGVEVFSVSTDSHFVHKAWHTDSDTVGKVNYTMIGDPNLQLTRNFDVEREGAGQADRATLL

SEQ ID NO: 947569 - protein, 99 aa, Homo sapiens
IALVLEAHLVAHQRAQGRGQLFGDPAGHAAGGNPPGLGMADQAMLATTDFQADLRQLGGLARAGLAGNDQHLMLEQRLLDLVALGGNGQAVVIADLRHA

SEQ ID NO: 947570 - protein, 56 aa, Homo sapiens
QRRQQRVQLVVVLHVEDADVGVAADDAPQALPLAVALQLLRQGLFVGLELVGLSRR

SEQ ID NO: 947571 - protein, 107 aa, Homo sapiens
GLQELTGDVDAVFGEDLVDLAHHARNVLVDVQQTVLARVGWQRHFREVDRGHRGAVVAVLDQFFCHFQADVGLGFSGGTADVRGQDHVVQAAQLAFELFVVGARLHR

SEQ ID NO: 947572 - protein, 49 aa, Homo sapiens
MIVDKTGTLTEGKLTFERAIAVPGRSDDEILLLAASLDQGSEHPLAHAV

SEQ ID NO: 947573 - protein, 81 aa, Homo sapiens
DKVRKITFGTYVVCCQERIAERFCFVDGQHQIRLARQIGQLDTILAQKRMMAHVHKRRGERSNSRERMESLVMQIRDEYDC

SEQ ID NO: 947574 - protein, 73 aa, Homo sapiens
VEPERLHSEEIGYQGRFPGSQANLDVRAYRERMSTIIRNTAYDSPSDPDGLKDFTNAPGFELVGIEAQLRWRP

SEQ ID NO: 947575 - protein, 60 aa, Homo sapiens
PDKRIAMVVYTADTNRATGQISPVDRTILAKALAQIDRIGVKGVGIYILLDSPQDDDPLL

SEQ ID NO: 947576 - protein, 45 aa, Homo sapiens
VGDQRSEGGLAEELLDRRADFAVVGDLDVGQALGAVLGGMRGVFV

SEQ ID NO: 947577 - protein, 92 aa, Homo sapiens
TVRAEPEKGLLILYVLDPARAGARIGADWERPKNLAGAPPVLAFAVSFPGSSSDIKVPYKVNNVGWESEYSDIPEYVINGIGWEDMNAQLQQ

SEQ ID NO: 947578 - protein, 96 aa, Homo sapiens
VIEFDLNGQRRIPVERHFSDSLRVNGFNIKLPTGEWVLLANQAIKLPQASGMAYFLGKVEGKRLIGGMRLFALRSNDSASAELTPLKGCQPDDPGL

SEQ ID NO: 947579 - protein, 59 aa, Homo sapiens
PFRQLRHCVRIVRHIDEDKLVTPQPPCERRAGGERLQPLSQADQQGVATAATVQIIDRP

SEQ ID NO: 947580 - protein, 93 aa, Homo sapiens
LSDLLCNLPRAPVGEVGYVPVSRFQRSPNANQSMGGAGVPVRNCSSRESKYACQLGFVVVAGKTGPVLVAIVMQARLLTRMAIPPGGEQRAGI

SEQ ID NO: 947581 - protein, 101 aa, Homo sapiens
MYCDCRVEEYAFTEIDNSVSAGLSVKGSLWGRPDDTVGAAFSSNGLSHDHRDYLAAGGLGGFLGDGRLNYGREQDWEAYYSALAYRGIHLSLDYQLIVNPG

SEQ ID NO: 947582 - protein, 48 aa, Homo sapiens
MSKAPNPVDKYVGSRVRMRRIMLGMSQEKLGEALGLTFQQIQKYEKGT

SEQ ID NO: 947583 - protein, 94 aa, Homo sapiens
RVAAGRYGLNIADVQAVIAGAVGGENVSETVEGLARFPINMRYAREWRDSPQRLAELPIFTPMGQQITLGTVARIAITDGPPMLKSENARPSGW

SEQ ID NO: 947584 - protein, 47 aa, Homo sapiens
VHRHDITHQLLAARPWLGDHRHFQYRVLLQQTRFDLEQLDTEAPHLH

SEQ ID NO: 947585 - protein, 50 aa, Homo sapiens
AQEIIAVAGHQIAFQHLVPFRDRAGEAVEILLLLPRQLDRDEDTDMQPQR

SEQ ID NO: 947586 - protein, 63 aa, Homo sapiens
HIHRPAAAVPRVFIVAREALIAFGSLEIGQHVFLTPSRRSLTRPSRRSRTAHHGYEIMPLIDG

SEQ ID NO: 947587 - protein, 57 aa, Homo sapiens
PSDVLRVSGKTGEGVRELLDEVVRLIPAPVGDADAPARAKILDSVYDIYRGVVTCVR

SEQ ID NO: 947588 - protein, 124 aa, Homo sapiens
CLRSRLNGPCVPPPITEMPTVLPLRSAIVLIVESSITAQYDRKTAGLLEDVLSHDVGLEITANHAVGERERRLRRAIERTGSQSLRHRRRALKLGPFDVVGLADIGKFSRGTIIQYLDSSAGMV

SEQ ID NO: 947589 - protein, 89 aa, Homo sapiens
CSAFVACRDFAAMVELLGMLDARLGGQLSCFEALWPEFYELTTTPPARSSPILPYGQGIYALVEALGADPESDRERFERVLSDVMESGL

SEQ ID NO: 947590 - protein, 72 aa, Homo sapiens
AGLRSHGFNLRDAQQRIIHWPRKGSGVEQRLRLELEQWRQAEALVLEHVSAPWRSVSQKRMDRSLKSLWELN

SEQ ID NO: 947591 - protein, 102 aa, Homo sapiens
MCGYNPGFCNTYCYVKCRASYRQITKFHDSESQAIANKVVFSPDLAKLLILQRVAPGRIGGIAEECRKCFGALESGMRIMLDSSVHDLPNKRQLPKPKPEVG

SEQ ID NO: 947592 - protein, 49 aa, Homo sapiens
ASLERDLDLGQRQLVAQRDQVTGALGGHDAGHASGRDVVILGEAAAGDE

SEQ ID NO: 947593 - protein, 99 aa, Homo sapiens
MRDALDRRVQSVDGDQADRRVFRTVAVGRDIALAVVDRELHAHRSAVVQRAEHVVGVQDFDVGRRLNLTRRHRPGARGAQGHALGAFGVHAHGQLLDVQ

SEQ ID NO: 947594 - protein, 38 aa, Homo sapiens
NCMSVVAVDTEYGRKRQIDQSSCNKDFTCLNGFCPSFV

SEQ ID NO: 947595 - protein, 45 aa, Homo sapiens
LVGMLAHAFGISAGDRYLSPAPVYHAAPLKWCGGVHALGGTVVLM

SEQ ID NO: 947596 - protein, 59 aa, Homo sapiens
ISYGPHIKNPTHRQEKPPVISPYPHKEPPYAATPIRSRHAATTDEIASLKHGRDGILIV

SEQ ID NO: 947597 - protein, 58 aa, Homo sapiens
EDLVADRLRRLESRQGDHALRDLVDIDARLDVVRGVLAGRAGDAAEIRLRRARDFRVD

SEQ ID NO: 947598 - protein, 131 aa, Homo sapiens
ARPRHTVIDIDSPGPVAPSCPVDAGVVPTVGSVAVSGGQAHAHKTPGQGQAAGQTFGLHPILALPTAIGHGALQQGDVTQHAVCKQLFLQSRPQTRLGRGRILPIPPELRPKRSPACQRSDDEALKPKPIS

SEQ ID NO: 947599 - protein, 81 aa, Homo sapiens
GHFRLSVNGDSNTLTSSSAYTITMAAGMTTGGRYRRVGASTAPEDSSRVPVMTSASKALAHASDAGPDSSALVAVSESVSE

SEQ ID NO: 947600 - protein, 86 aa, Homo sapiens
DGVLFYDVAHCRPVMTIEERYDDDTAVRAVLNVVVFHPVVAGSGQRDTVPRHGLGRVEPGCFIFQATIRDDIARHDRVVARRIALD

SEQ ID NO: 947601 - protein, 72 aa, Homo sapiens
DVHETQLHAHRGLGGGRAKEAHVVVLAAESDLRDAAHDHEAHAPFLSVLAHARHVELVGVEVEILGAKRNFL

SEQ ID NO: 947602 - protein, 102 aa, Homo sapiens
GRRLINKPSTKDELHASPSSSFGESVTAVAKHTGNDMTLAIIWTSIFLAGALACATATWSASEAWPDSLDASFSGARFPSAVKAFLAALVLCFLAFKSSSDY

SEQ ID NO: 947603 - protein, 80 aa, Homo sapiens
SSGPFSSSSQAGFSYIRSDLKPEMTNTFEAGYRFHNRDLQLSLTGYYVKFNNRLLASSISATVVGNQNVLQNVGSVSSRG

SEQ ID NO: 947604 - protein, 82 aa, Homo sapiens
APSTTKDHVPAQVCFVNRESPEGYVFPACADCNAKDRKSEQVVAFHIHAISGHANEFSRTYSGLKNNSPSALPNPYMSLGEK

SEQ ID NO: 947605 - protein, 39 aa, Homo sapiens
MRVSSGGTAFMLDVELGVVFGLAGDDQRRARLVDQDRVR

SEQ ID NO: 947606 - protein, 94 aa, Homo sapiens
SPGHVRLEHGLDQVLDHAAQLLFAAAQGVDRALSVERKRGVRGDVAHELHLGPAELVPLGAIDHEFSDRAAAGDERNHGQRTDAFVAKHGQKVA

SEQ ID NO: 947607 - protein, 79 aa, Homo sapiens
MRRLERALHEVLAVCPASYCFLSVTSSTVETSLIAHAIASALPMAYTELEAAAMLPFASFTVAAHDEVASARGHERARR

SEQ ID NO: 947608 - protein, 49 aa, Homo sapiens
ADMAVSNYTKAPAMAAVASWTGYAGLNVGYGFNDPVATFTANDVVSNSI

SEQ ID NO: 947609 - protein, 61 aa, Homo sapiens
LIEQEMAMQNIPGYAIAVIRDGRVVYSRGYGYADLATRRPVNSRTVFGLASLTKTFTALVL

SEQ ID NO: 947610 - protein, 71 aa, Homo sapiens
CENVKISGIADPGGPAPFLIGPGNGKAGSGRARKRITRFPGTAFFKRLRIPVPEKAMNTAHRKKLPGTSFD

SEQ ID NO: 947611 - protein, 64 aa, Homo sapiens
MCEVMMPDGKTPHVSNKRATVLDDEGAWFGFEQEYFFYKDGRPLGFPTDGYPAPQGPYYTGVGY

SEQ ID NO: 947612 - protein, 72 aa, Homo sapiens
MSQIEDLKDLAAIVMDQIELQLSARRAVSEAKLMAKEIDHRVMNSLQFVSGLLRCKVDRLRMLTLSPTFSLP

SEQ ID NO: 947613 - protein, 76 aa, Homo sapiens
VRDQRDHQHQGIDAQPGASAVAQDREGADTDQQHQREGPGDARLQDQPERDDMQAHAQHQPRDLQQADHLNHVLPV

SEQ ID NO: 947614 - protein, 60 aa, Homo sapiens
MLHAENQDRLYLIAPSEEQQALVGALAFNVQDRHWLVYCALGGHQHADLPETDLLTGVSM

SEQ ID NO: 947615 - protein, 67 aa, Homo sapiens
MVFFAVPNVFRTSRSENVLLGLILGKFHDEGLLLARGQGIDELSEVPLVLASFGFELASIEKEGVFL

SEQ ID NO: 947616 - protein, 112 aa, Homo sapiens
EASGFRKAAFGVTVVAQEFREKGYAIDLAVVRRHAIVHHAAWIHELAADRGVLALLVQEIVIEPSQSRDLARYTLKVMPMILRHAGERGYCRAPLPGSRGFRERSFRSLPPR

SEQ ID NO: 947617 - protein, 104 aa, Homo sapiens
DIGTAVADRIERRQIDVQTDSGSQDHSRSRLAALTIRIRRVRTHFDGVQHHSGLRQLRAQVLFQNPVITLRIQAARDAGLIGHDHQQKSRLLQSLQGGDGTGNK

SEQ ID NO: 947618 - protein, 106 aa, Homo sapiens
RQALIFWPLSDARRGPLLVQRRPPAAIRHARGDDMVRTPVARGDAVVAPTPGTARPMSDPMGLSMFEPDLKAALATAICLGTAFVLGCLIGLERQIRQRNAGLRTM

SEQ ID NO: 947619 - protein, 111 aa, Homo sapiens
GERQSQLFRHDTIERSDDHRATLCSFGQAKRRLGSARLTLCDRYLRLRALERSRGDDFAFEQPALLICLYTSIHQAGFGGRQGCLRLCHAKPVRLRIKFCQDLAAGEPFTP

SEQ ID NO: 947620 - protein, 115 aa, Homo sapiens
ATDRRARFVGLEAYTAAGGTVLRDLFTEDRGGYLEDVALLDLLVTARLGREADRLRATECKKWTEPHLDFPHAHGMRRTYPHPVELSAEDQAALEAVQSEFDRLTEQHQTAEELP

SEQ ID NO: 947621 - protein, 94 aa, Homo sapiens
TVVVHPQSIVHSMVEFWDGATIAQASPPDMRLPIALGLSWPDRLPDAAAGCDWSTATQWTFEPLDNDTFGAVELARRAGHAAGTAPAVFNAANE

SEQ ID NO: 947622 - protein, 81 aa, Homo sapiens
VEQRQARDHGDRLLVQMARQRRRQRIGVAFDHSSAREALAQQRAEIRAVLDQDQTVFADPTLNQGLGHRACARADLDHRTR

SEQ ID NO: 947623 - protein, 113 aa, Homo sapiens
RSGVVGADAARRCLAVRRQPRSWGGPVVAPLRRQTVSPGDPGDAQVGEAVARRIQFVALLGGKMVMSELTTTGHDFLIILAKLAAAFLFGGLIGFERQIRQRNAGLRTMVLVA

SEQ ID NO: 947624 - protein, 89 aa, Homo sapiens
MGRREALAQAKLSNSPRKSRFDYFDTEVRFGEETILEYVPKPNFLTFVPWGEIFGKPKFSIARRKNKSAGSVQRSSFFPFGKFFNSSRS

SEQ ID NO: 947625 - protein, 103 aa, Homo sapiens
MSVSITPGATALDRIPRLPPSIAITRMSCASAPFDEAYAACVAKATTEEIEATETIEPPSAMTLIASRACRKFPRTLTARIESKSSVVVSCKGLLSVRPALLT

SEQ ID NO: 947626 - protein, 73 aa, Homo sapiens
LQALGETIRAVLIPIRKVLTPEWDISIAHVLAARAVLSCLVPASSVAVRTGTWCAITKALMGHVPDRGGRTNQ

SEQ ID NO: 947627 - protein, 104 aa, Homo sapiens
HGQPGGEKGRATFSRQNDPCKGSGAWRSSTLDETGRWYCPHFTRKEAKAAEDGQHLNASGLIVLHPSTRSKSIHFLLPKATVPFRWDQLPDAGFNLLHQNNHWP

SEQ ID NO: 947628 - protein, 88 aa, Homo sapiens
PGGPPGGAPGSPPPPPVPQSEGPLPADPLLSFHLDLGPSMLNAVLGVMKGGPKGVSPKPNGEPRPGRKPPQARCRPNGDLKLKEVMGL

SEQ ID NO: 947629 - protein, 111 aa, Homo sapiens
VPGREAQSRHLIDICYLDVERREVGFHSLHSQVGFPPRSPAELRAGAGLDSDLPLSTHTSTCSSQVGAPPSRSSPACCLSSHLEHIGEGGVLHKHSSQPPEKDTSERRPER

SEQ ID NO: 947630 - protein, 40 aa, Homo sapiens
ATRTMAGAPTVSLPERADLVNWATPYSVVHTKASNKEHLI

SEQ ID NO: 947631 - protein, 145 aa, Homo sapiens
FLYQPEGVQVFMQQSGLQALERHQEEAQFQDCVYAFQQTALQGCSCFSMSLIPFYGDMRVGLSSRASSDLGPNKVACSLLSNITEGRWVPGHPFGMDELCREEHEERPSVGTWPTCGRGYLDRLGPVMSPLVPHPPRQAIKVVSS

SEQ ID NO: 947632 - protein, 117 aa, Homo sapiens
PARVFFFPPRVVPQMGGGGGPPPFFKKTPFPWPWAPKFFPLNQDPGFSPPPFFGGPLINFPPPPPGPRFGKGGGGRGKGGAPPPPKGPPFWGPPLKGGGGGGGPQVFFFWGKKGVLP

SEQ ID NO: 947633 - protein, 164 aa, Homo sapiens
LLPTLRAFYAQHPRAFLGGPAPIPFPWEAPGAPPGRGPDFVPTQGGVEFFKPPPFSKDIVGGLFGARGPPPSSPGTLFFGEKPGAPPKSPNFFPREEGGPLCQYFVGQIPKQQAPLLSLGRGGGAPFPPPPFVFPVSFEGESFFPRLPRPLWENFPEVAGKIGS

SEQ ID NO: 947634 - protein, 50 aa, Homo sapiens
GQHIFIKHLKLLVGGHDAGHTVKVNVLHNVPGFNALFLDTDEDVPPSVVF

SEQ ID NO: 947635 - protein, 45 aa, Homo sapiens
VRCIFIGAGAVPEGAGHGTLIGTVAVSYFRVRGILCPKGTPSVVF

SEQ ID NO: 947636 - protein, 87 aa, Homo sapiens
GKAARSLPLGARCFGVRVSPTGEKVTHPGQVYDDKDYRRIRFVGRQKKVNENFAIDLIADQPVSEVETRVIACNGGGGVLGPPQRGK

SEQ ID NO: 947637 - protein, 102 aa, Homo sapiens
VPPITCTWDRPGWRVPLAVYVPAKKFWPASRCALKGDEGRCLARGFGLLHCMVGLFLLFVPPLPQLWSGFGRVVNVRCPNSERSRVGPVYSLIPLNKKGVCP

SEQ ID NO: 947638 - protein, 118 aa, Homo sapiens
MERIMKAQALRDSGMAGYMSSKKTMEITQENPIMEELRKRADADKNDKSVKDLVLLLHETALLTSGFSLDDPNTFGNRIHRMLKLGLSIDDDAAGEVDVDMPALEEADAEESKMEEVD

SEQ ID NO: 947639 - protein, 115 aa, Homo sapiens
FVGGCFIVPPPPHFSGVPQQKGLGNPLCLLSWGRGGPPPPTPVFPSMGPPSLGACSPGGPPPGTFGDPPPPQRGSGLSRGGKGKDQVWAPGPGGGGGEPPGPGPPMGVGEKTLCF

SEQ ID NO: 947640 - protein, 107 aa, Homo sapiens
CKARERCLWGIEMQDFFNPLLGDSRGLGHFFLQGPLNGFGFRLAKCEGVERRPPPGSPVTPVPTLTWVPSPIFFPVPKGGGGRFPFLFQIQGALGGPFFTSLKRLRP

SEQ ID NO: 947641 - protein, 182 aa, Homo sapiens
FGVCLGQIEKDPIICPMEIHLFGLKGFPRAPRFGSKNDGPGFLAIKENFMPKYFSLHVRKSNRAALHFYSNTLNFEISEVEPKYYANGEDAYAIKGDFIQMADEFRRHLEFKKKGRHVVLGAIENKVESKGNFPPSSGKAFCEEKGLASQDSGGDSKALSEVRETPKSTNVKDSSKASDSAS

SEQ ID NO: 947642 - protein, 102 aa, Homo sapiens
KKMGGFAPLDPGGLSYPVGKAPRIPPHGPCSKAPESDSWFWGAFCMFRDCFGDVSLLPASRGLQPPKTTNGTMQGWLGFFLGRGPVGGPEESIWGGLFFKMK

SEQ ID NO: 947643 - protein, 104 aa, Homo sapiens
CGFSPAAPHHTNFLVSARGERVCVIGCPLSPQYIAGVVCGVGPPPPHEAGGALFFGGEFLGDFFSKRRGVGVFVPGKGGPPQRGFPFFFFPPPKGGGWGAPWGF

SEQ ID NO: 947644 - protein, 67 aa, Homo sapiens
AEDKALLAKYTAHHNAEEQVESLVEKKQLLQMFKEQVEMERERYFSTVQETERDDNGETSDGIFLSF

SEQ ID NO: 947645 - protein, 104 aa, Homo sapiens
GVNQEPLEVLAFHMKKRREDEGLKGKISEADKKKVLDKCQEVISWLDANTLAEKDEFEHKRKELEQVCNPIISGLYQGAGGPGPGGFGSQVPKEGFGPAPPIKK

SEQ ID NO: 947646 - protein, 114 aa, Homo sapiens
GTWYGVDTHNKDIAAPFEAFVWDPAMVGINALPPPFEAGALFGFVNEPLKTPRLTVDAPPPPGRGRGWGPPPLKAPPPSHGWGGVGGPSPPWVGYFFFQGRGGNWPPLFFLGAF

SEQ ID NO: 947647 - protein, 116 aa, Homo sapiens
GRAGGWFAPRAPSLAGDGAAGIAPFSGGVRGFAILSKRTRVGYLCVHCGVPYNGVFNYDLPFGQWSRSVVHPLNKGFPHEARGPRARANPSQGTGVTPACQPFVDILNSREINPEQ

SEQ ID NO: 947648 - protein, 71 aa, Homo sapiens
GLRDENAGQWRWVDQTPINPRRVFWHKNEPDNSQGENCVVLVYNQDKWAWNDVPCNFEASRICKIPGTTLN

SEQ ID NO: 947649 - protein, 109 aa, Homo sapiens
PRGKRGGGFWARGRAQGGRGPGGPAEVFFGEKRPVGPGGGGPVFTPPLPGGGGVPPPFGGLGPLLDPGGGEAPRPLGPRGGGWVPSGEGGGGFFFFFPFFFFNKRVLNP

SEQ ID NO: 947650 - protein, 66 aa, Homo sapiens
SPGPGSCRLQVGKGGCHHCLGSGLLVAACRDRPDKGTRSWCPVRQTSVNGRQESVDEVCLPSWTVL

SEQ ID NO: 947651 - protein, 38 aa, Homo sapiens
MASSATFVALASTSVSQGPVLVRTAQVVAHTSPFCRLL

SEQ ID NO: 947652 - protein, 100 aa, Homo sapiens
MPDGVQNQGVSPGDNPPPCSLSFPVPVCFHPGFKRLTPPRISGRAKKFGGPNPTPWGVLKLCFGPPPVFPPPKNPCFLLKIFCGLKAPRAVKFKKGGMLC

SEQ ID NO: 947653 - protein, 66 aa, Homo sapiens
EAINLLVEALFYASHVLGHWWAWAFKVASCPDQGPSPLFLGLSVEQSSKTKAVLYERLEAGNNRAF

SEQ ID NO: 947654 - protein, 102 aa, Homo sapiens
PCPGPGFQGFYSLSPPPFVGRTKHVFQTPQFPPGIPPLFWGERNQKKHIFGGDWAPLIGFLVFKGPPYPPQKGAQKRGPRSKFILAKGQSPLFPFQKKGFLF

SEQ ID NO: 947655 - protein, 96 aa, Homo sapiens
ERGSAAPKDGDQVHMPSPIAVINEGERLGDIVPLGVTNMTSRDEEKGFRILKGTLIPTLSWVLKDEAVWEKPFRFPPEHFLNAQGHFVKRKAFLPF

SEQ ID NO: 947656 - protein, 174 aa, Homo sapiens
SPHPPPRGMVAASHDTLHPAGQDVSPPGDTPSPMSTSPPPAPPREVTLRGGAGGWVASSPLPGVLSSPPSPTHQKNGGCAPGPHVGWGRLHIGPLFSLQGGGKPHTTTRRGPFLGPGGGCGFFKKKPPKNLLLLFLSQAGEFTTPSPRENSFFLGFPPPTPPPGGVGPPHCPGL

SEQ ID NO: 947657 - protein, 105 aa, Homo sapiens
MAVIVMARSRDIVKAIARLIEFYKHESCGQCPPSREGVDWINKVMALFLRGDARPAEISLWEISKQIKGHTFCVFGEGAAWPVQGFIPPFWPGFEEGMQGFAQKH

SEQ ID NO: 947658 - protein, 128 aa, Homo sapiens
MVFRTRPQGPHNCSGFLHFWVNGNFGFLSGGPPCLEKELVVPTPGAGKRGPSPSLKPGVFLLWGGLLGPAFLRAGLGPVKGKTPPLYSGGGGGPRMLGFNQAGPVFRGFFFPNGIEPLGQIRLDFSPP

SEQ ID NO: 947659 - protein, 124 aa, Homo sapiens
FFPPPPQQGAWGNLSKCFILAGPVGKTQASNALCLWVPHSFSKKGEGPPPAGVFLFPPPCCCRHFKGQRGGRAREAWDFNCFFPPPPGQKTSPPSSGVFWIFGEGQRNLFPVSNYVPQKKMAFL

SEQ ID NO: 947660 - protein, 90 aa, Homo sapiens
GVQNWPSAGDFFEVEEDPGGDMLSWSLLLEFFRSFLGNPQSRASAEFGNKHDAVLGPTDIMVQYMELFHKIPNQQQVAVVGICILLAAPS

SEQ ID NO: 947661 - protein, 108 aa, Homo sapiens
VLPNPPWVSSSEWQCHNGFHGGQRQAHRLVGEPKLDRLLLDLKHQNIGPFPVELQEIMKHIVPILVLPRVNEKQKGFPLPTPAKVQLYKVVVQPPQNFLLFGANVVYK

SEQ ID NO: 947662 - protein, 81 aa, Homo sapiens
QWDGYNGFGNDGAILEVVESYNDFGNPTNQSSNFGPMKGGNFGGRSFGPYGGGGQFFANPRNQGGYGGSTTTSSYGSGRRF

SEQ ID NO: 947663 - protein, 122 aa, Homo sapiens
SFRQGAWVVTGSKEMWVHFFYVERAAKAAVNKLQGPSAPVLYVSFNCDESPLASHYPNLEFFFFGGGSKNRVLLALVLSSIPPLLLHPCVVNKVSVVMFRAGSQFCRETDRAKGSGQLQEPG

SEQ ID NO: 947664 - protein, 105 aa, Homo sapiens
MAFITKVFLAGMDWGIQKRFSPKVLGLCASPALVWVVMEVLALLLGLYLATGGSDLSTFYLAYSGYKKVGMILRGLTGLLFGNDWVISGAGLDLIGGHGFHCGVF

SEQ ID NO: 947665 - protein, 150 aa, Homo sapiens
SLHGRVSLVLKNPVWRFFTHFTHRGYWSHFGRAPWEKIFPGVEGQDPEWTWSLSPAGSVPMNDHGFCILGKKETSGSCQGVPNAWKRSWGFPPLGPGKGWGFPLPKSQGSSSCGGDNGDTGLFKSRAWGLLKENPHPLTPGGGGGQGCGS

SEQ ID NO: 947666 - protein, 95 aa, Homo sapiens
PGNFGGPFAMPGGPGKVYPRIRSPPGHFFSFFGPRGPGEGGGSPPGPKKGPRFFTWWRKFFFGPGPFGGGWGPFWGGFFPFWGVGGGEGGGIGGF

SEQ ID NO: 947667 - protein, 102 aa, Homo sapiens
GNNKGPPRPARQVRGDPARSQLEGEGEALSRALPQVLGYSHPVKPASPKPGWDLKPWPSFKVLSLSKGCTGGGPPWAPSLSPIFYPKESLPWPLPPGGPHHL

SEQ ID NO: 947668 - protein, 129 aa, Homo sapiens
HSFFGKLGRPFRVTDELVFKVPRRADAVRKAYKYLAALPENCSQLIQTIEDTGTFMREVGALEEQIETELGKKTLSNLEKIREGFRALPQENAGLLGRVREALGTPGKGLSPASGRDLGFWRQWARHMP

SEQ ID NO: 947669 - protein, 116 aa, Homo sapiens
ISEEALRADGFGDNPSIPCLVAENLSAPGKLLGPCVVGYGIYYFIYSTWKGRTLYLEDIYVMPEYRGQGIGSQIIKKVAEVALDKGCSQFRLAVLDWNQRAMDLFKALGAQDFTET

SEQ ID NO: 947670 - protein, 34 aa, Homo sapiens
GGPPPPPFFNQGFLGRGNFAGFGIFNPLNKLGKG

SEQ ID NO: 947671 - protein, 84 aa, Homo sapiens
RINQDEEEEEAEDLISFIWKILYEFLNKPWEPKWWFILVSLQCGLNRKLEIIVQGLPLVRPSFIWNLTSFFFGLKISILVVIPE

SEQ ID NO: 947672 - protein, 103 aa, Homo sapiens
MRDNGRSTDGPLYLLGRRSALAGGAWTCSMQPLTRSMREATGRHWRWAGGRCPPGQRSSLGEGDAPVPYYGGRAGQREREVQPENRGAESEERRRWAQTHARR

SEQ ID NO: 947673 - protein, 82 aa, Homo sapiens
ENPCGELASANLSPTLCWGEWRQTRAAKVLEQLTGQTPVFSQARYPVRSLGIRRNEKISVPCPVRGAQAKKILEKGLKVREY

SEQ ID NO: 947674 - protein, 72 aa, Homo sapiens
GTPPPLFFPPFEAPGPVPPPGFLFGPGGGFPFSPGPAFALWAFLGALFDPFFPKSRVGPGRVFRGFFGPRGP

SEQ ID NO: 947675 - protein, 72 aa, Homo sapiens
DKGHTILSLGDGRLACAGFDPPPFGGARGADAPVCPAASGPAGCLLAPPPGLLSWVYPCGMLDNKASAAPPP

SEQ ID NO: 947676 - protein, 35 aa, Homo sapiens
TLGAPTAGGIGLPPPRSNTRPPGCDAPINFFMLLR

SEQ ID NO: 947677 - protein, 114 aa, Homo sapiens
GPPPRPGDFFFLGKKGVPPGGPGGFIPTPGINPPRPPPGLGFPGGASLPGPGFKNSNLLGGPPYAGYFGKPGPFLLRGGGHFPGANPVGDLVFFSGPLGKGCLINKIFPVFLKG

SEQ ID NO: 947678 - protein, 119 aa, Homo sapiens
PQAEGRPKAGPVSSKLGAGGGHSGPGNHSPYPNPPSPATNPQVWGLKNHGRPAPNLGGNPFPSKPGPGPVWEAHLAKLRELRAKARLARPGRGRGCTGLCQNAQDIPAWVFNAVRKINQ

SEQ ID NO: 947679 - protein, 111 aa, Homo sapiens
LLCSHLEGSGVFRLPATFASLVLAFSCLVFRVLGIKCVPPPRVNFCFFSKEGGSPILARVVLNFLPQVTCLFWPPKWVGFRGRDPVPGPGDIFSWALFPFLNKLGVTFLVC

SEQ ID NO: 947680 - protein, 104 aa, Homo sapiens
PPPPPPPPGGGDFPWEFCCPKEARGGGEKPPFPPGGEFLRGAPPFLRGGGKRKAPFFRGGPGGVWSGPGPPPFFFFPPRPLFNPGGFQGGFLMGNKVFLFFFFG

SEQ ID NO: 947681 - protein, 107 aa, Homo sapiens
PLLSASGDKGPGPTLKAPSPLPPGDPCCEPKLSLPPPGHVVVLGTNPICVGGSPKPGAPPKGPFPRTLPGGQAWAPPVPGWSWELPPPSPQNLGSCCCCLQNYIFFF

SEQ ID NO: 947682 - protein, 127 aa, Homo sapiens
SQRFQKGTEPLGPADQFEVGPDSLKPEVERARTRSRWSPGPTGCGAPDCKRYRASEGPFRAGKALQRPRPPRSSRLALGLAGAQKPSRKPSLRWSPRWSQSLRRTPRKIPGDLGLPKNLCLQMKKCS

SEQ ID NO: 947683 - protein, 167 aa, Homo sapiens
NQPGFKISVPPREGSNGNPKGVFFLKAVGRPFLKTLIMSWKGQYLRSIRALETSSRQAFLPPLAGQWVRILGAPKFWTLWGLSLSYHSQCFCRFLWLKTISPQILSSLCLLPGTLSKPIHDLNPESWLWAVDCLPKLVVKLEEVKSPACYILTTQTLGQKEIKGLSS

SEQ ID NO: 947684 - protein, 68 aa, Homo sapiens
KEVGDQGAPGHILEKTVVSVKDDFYFLASQWDGKNCPTLTWRHGTVECEEGSEDDESLREMVELAAQR

SEQ ID NO: 947685 - protein, 117 aa, Homo sapiens
TTRSALNHRGTLHLGLLKGARNVASVGLQIGYPIVASAPHFIINGYKRVLALSVETDYPFPLEKVKAFLGDPFAFVGGAPVGAAPPAAPVVVAAPAKVEAKEKSEESDEEMGFGFFD

SEQ ID NO: 947686 - protein, 75 aa, Homo sapiens
GQDSLYAPGKRRYDRKQSGYGGPTKPIFQEKGLNSKKDCAKAVSALSPPADLKECWLLKNASLFNWEEIKKERAQ

SEQ ID NO: 947687 - protein, 164 aa, Homo sapiens
RANEYRFKHGQLEELKDETKKKEDRTVCKGTRGIYQQMIKVIEERMRVYEDEYRDYKADLKKTIEIINVAHGKCYNGIIEGIEGDQAKCNKCLKLSEFILDKAREGMKKKTITRMLLARCGADDQQRTCYSAALSLMANFDENIINKTPLEFCVKSNKCVVKDW

SEQ ID NO: 947688 - protein, 76 aa, Homo sapiens
MARVGGASSLENSVGLAIFNSHPFSLTSGQDKAYLQDLVEGMDFQGPGETQPLLLMGGLPPPCSPPPQTNKLVPGM

SEQ ID NO: 947689 - protein, 145 aa, Homo sapiens
MGFRGPVCVCRVCKSLSVFSQTQQVNGARDSQDLVAKLRAFLNGARVTPERKNLKWIGFDLSNGNPRAPNQAGGFDPPIVKVKGLKFAPEAAIPLFGIDVFFKFPPESKDDKHGSYENAVPFGALNVCFDVPFFFTNFKCNFFVP

SEQ ID NO: 947690 - protein, 156 aa, Homo sapiens
KIQPALPVPLPRPEALVKKGRICPFVLPQPQRGFNKKVAGVRNLEAYGLDPYSGGALLQQGSQGSPPVHPAPGAKGSLQGQIPGNPGPPPGGVLVERDPPPPKPPPGLKKAPPPGQKKGPPLLSPGGGPGEIPALGGEFFWAFSAFAKPKNNFFPK

SEQ ID NO: 947691 - protein, 123 aa, Homo sapiens
NSPAPGFPPRGPGPPPGVFFPPHQGVFPGGVGGEGVSPPPGGPGLGLKNPPKGALFPGVWGPRGFYGFPFFPFGLGGGGAPPPPPPFGFPCPPGKKGGVFFPLFKGGGGLLSPPGGGPPAPPF

SEQ ID NO: 947692 - protein, 152 aa, Homo sapiens
IVSRGWAQLVQVWNPANSKLKTNPSGPTGYLNTGAVSPNGSLCAFGGQDGPALLWGFHGQPPFPLNGGGIINPLWFNPNPYWLCVPPAPTSKFGVLKGRSLVNELKPKVFRSPSKAEPPPGPPPAWFVYGPTLFSGHPDHLGRVWPVALGPP

SEQ ID NO: 947693 - protein, 84 aa, Homo sapiens
SKKNKSGGITLSDFNITLEYSYQNSIVLEMKIGMYTNNRQTESQIMSELPFTIASKRIKYLGIQLTRDVKDLFKENYKTLLKEI

SEQ ID NO: 947694 - protein, 118 aa, Homo sapiens
GGLFSPFLFFFEPGGLGPLGVAHGGFPVEAPLGFFFSSPGVLPSWGGPPLGFKTGGISGGFNPPPFPGPGGGVSRGLVFNFGGPPPVFGPWAWVFFPLNFLDWGRVFPFGPPFPPFWA

SEQ ID NO: 947695 - protein, 97 aa, Homo sapiens
ARALAPQTTGAALLVAPGPRSAPTLGGAPKSWATDRVSSSAEFQGPIDKPKNNKPVLDKLQVGREKGIPVKAQTASFFSNWEGKQGCCSRPGVMTTQ

SEQ ID NO: 947696 - protein, 88 aa, Homo sapiens
PGKIPPPPPPGGGFPPQGGGAQKGAPPPPGLWGGAPFPLKKFLAPPGGGGPPPGGAPFGGGGGGPLGGGGPPPPFFFFWGFFFWFFFF

SEQ ID NO: 947697 - protein, 222 aa, Homo sapiens
FSPTSVVVSGGASQEWVLLPMLGVMGQSHSCHLKGPLLVPQVAAQALVSNGCRGSIINISSLVGKVGHVGQTNYAASKAGVIGLTQTAARELGQHGIRCNSVLPGFIATPMTQKGPQKVVAKITEMIPMGPLGDPEDVANVVAFLASDSGSSQGPQWKARGVFSWNCPKDPGLCSPPPPFAGPPADGGFKFPGYKRGGRVWFRNAEYGKQGGFGPNKFQVLL

SEQ ID NO: 947698 - protein, 86 aa, Homo sapiens
RWRAPPPGPGPPRQLVEELQSRYRQMEERFTCPICIDSHIRLVFQPTHAPLAGSALSAWLICPQSIRVRHTDVCVSPHRRPRPICL

SEQ ID NO: 947699 - protein, 81 aa, Homo sapiens
SPQPRAFGKPLGRSSWELVGLGNSGPTADARGFAGLCCPGQFLGLKKERTSSGMVERHLGANAKQSRDCLGCLREWCDAFL

SEQ ID NO: 947700 - protein, 101 aa, Homo sapiens
LLGTSVPFRAPPSPPPGFGSGSSSFGPNLGFSSFPGKGRVLGASPASLPQGPPEFPRRQLPQWGTWLGGPSARGPPGPPFRPPRSLGSPRKEGEVCLLPRG

SEQ ID NO: 947701 - protein, 73 aa, Homo sapiens
PGPNFPGIWPPPGPGPLSGINPRARLVFPSPPPPPALWAPGFQKKDFLAGFFTPGSGIGFFRDQKKAGFFRPP

SEQ ID NO: 947702 - protein, 75 aa, Homo sapiens
DAFTYTGCGGNANNFVSREDCQRAWAKALKKKKKMPKLRFASRIRKIRKKPFYTFLIWPPVWLKALFALKGGSEE

SEQ ID NO: 947703 - protein, 126 aa, Homo sapiens
NCLANPFKRIPNPKKKPNARVLIRPCSKVIAGFLPVIMKHGSIGEFEIIDAPKLEKIVVNLTGRLNKCGVISPSFYVQLKDLEKWQNNLLPSRQFGFIVLTTSAGIMAHEKARRKPPGGKILGFFF

SEQ ID NO: 947704 - protein, 236 aa, Homo sapiens
PEGYFLRVPLSSLSPRGSSILVARPPPGKQYEMFGARLCSPKILPPFPRGGPDWHCISKLSTRHRTTHTVLRCSPLHCPINRSWICHHRRVHSLISPIFRVHPRPNLRQNPFPYHIHRGKSNFLPPTLSRPIRNAPALLGLPRCIPPMKHPIICRVLPFSNSRKINNFPGFEKPFASKRKVLIVEEPPINLEWLYGCPPPFPPFEEPVFIKFRPKRKESNPPKLVSSPPPGPHGFF

SEQ ID NO: 947705 - protein, 74 aa, Homo sapiens
SWKGRESKSPSGPRKKFPPRVLKKNPLENFRIMLELNPYAKTMGRDPLFCQARNPKLRVDKAASSPAALPAQSN

SEQ ID NO: 947706 - protein, 138 aa, Homo sapiens
FFPPPPTSGGGGEILFRPPPPPNPRRGFPVLFPPPPPWRKRPGGLFFLNSRAGCPPPQMCGDPGNNIPASPRPPKSFLLARAPLPPPAKGFWGIPLKEPGFGQKPRGGAPPLFLGVFFWGPGGGNLTPPPLFSPPPLG

SEQ ID NO: 947707 - protein, 214 aa, Homo sapiens
MAQRQAAKTQMSDDYYYYGHHLMPPHARGRGRRASRGGYSYPPDYSGYEDYYDYYGYDYHNYRGGYDDPYFGYDDFQAPAEAEGAAAVPEVGHPMRVAEGPALHGVGQAFRSAEVPGPGREPAGACAEEPEAVFCREGAGYVVLGVDAVQNVGGKRKADGYTQPDSKRRQTINQNWGSQPIAQQPLQGGDHSGNYGYKSDNQEFYQDSFGQQWK

SEQ ID NO: 947708 - protein, 119 aa, Homo sapiens
MVSQSVCVYRRWVFPTQHIFVGVSVGKLRGKFQSCSRVIVAHLGQEGVWHSLPLWGPPRAAWGKADYGVVAPVVFLRKQTKLFLYGGPSQGEGEGRGTPPPSLAGGKARSFSFKLDSEE

SEQ ID NO: 947709 - protein, 83 aa, Homo sapiens
RKRMLPRNRSRPVAGSFNKVSDNFEMLVFNASSKQQLDVSFEHLQMFIRSSRLGFQELVHVCCAVKLYTRFYWTPFLFAFSEA

SEQ ID NO: 947710 - protein, 106 aa, Homo sapiens
ENGEFFFFGAPVSLFPEKKASWKGGGMVSPPGKFFSPGPALLKWVKPARPCGPPPFSPPLWGPRWVVPPRSRVPTPPGPPFLTPPFLKKPKFPPFGGRPPPPPPFL

SEQ ID NO: 947711 - protein, 124 aa, Homo sapiens
IVSRHPTGVEDLPTPPPLGRFSFFNIHTPSPGGVIKPGDQKGVGVGRVPHFPPKAQKGKRNFSPNPPPPLFNRGGKGGSKRFVSKAPFILKGKKGVIKPRLWPPQRKGKIFWAPLGFFFGGGPV

SEQ ID NO: 947712 - protein, 74 aa, Homo sapiens
IRSWTPGGEGCRSGSRQPLQRENQRPYGEGGMRSFGRLHFVLKGLPQGPAGPHPSGGQRNFVLFGFPPTRLPGF

SEQ ID NO: 947713 - protein, 179 aa, Homo sapiens
PPPVRLQISLASVRPTPPDAPPSGLLAHYTTRRHKQAAPVGIRGFAAPGRTTPGIYNSFPAQCPGSAERTLPRRNVPAYPRLFCGAAYHGHMGGRNKAPAPFRIMVSRREPAPSASRSEYKRRHGQSLSHDIPGDSSGDYRKILLKICGGNARTVTGGSFLPPCRPHPVPGKGQKNVGF

SEQ ID NO: 947714 - protein, 72 aa, Homo sapiens
SDTLEPHHQMIKIVCGIDEYYEVRVEEQSSAAAPEDIPHLEGENYASRMEEVDEIHPSICKSLITLISAIIP

SEQ ID NO: 947715 - protein, 112 aa, Homo sapiens
FFWVGVLVLFLFFTEKGRAKGLGGNRALGAPQIKAETPLLGAKPQQGGRSGPSFFFFFFLIFIIGAPGGVTGAMRTPFTPRRWGPRVGPTLGSLTGLPFIRGICLWAGLVME

SEQ ID NO: 947716 - protein, 72 aa, Homo sapiens
RNNKKLLGRVKAFDRHCNMVLENVKEMWTEVPKSGKGKKKSKPVNKDRYISKMFLRGDSVIVVLRNPLITGK

SEQ ID NO: 947717 - protein, 109 aa, Homo sapiens
MVWAWIKYFAGLFCNKGDIPSFQTLGREMSFPYLPSGTPELEVPKPGQPFEPEHGPSPGQNTFCQGKDGLYPNPRERSSFYNCATGGLFQQNCPTGLVFSNSCKLCPWI

SEQ ID NO: 947718 - protein, 79 aa, Homo sapiens
NIDIAFDTTREALQDNQTQLIMEDLIEVCNNSHSKIMYARDVDQRSSTFKKSLQIGTEFQRRATAMILRAHVLRNQIHV

SEQ ID NO: 947719 - protein, 102 aa, Homo sapiens
MQVQLERKEEVTGPVIAPLFPQKREEGWWVVIGDPQSNSLISIKRLTLQQKAKVKLDFVAPVGGRAQPPPDFMSDAYMGCDQEYKFSTEVKEADSEGDSDSD

SEQ ID NO: 947720 - protein, 69 aa, Homo sapiens
APLKENSAVPFRYHSVTDQINSPTLFVIFNDTQAYPKYLITCKKIYVNHMLSDPNAGMHLQQLPIMYSY

SEQ ID NO: 947721 - protein, 70 aa, Homo sapiens
SFLSFQVCANNTDRIIGALKSEEDAGNIATYIVAFTLDDRILLHETKIEDVKYEGLEFFSVWMYFHAKNW

SEQ ID NO: 947722 - protein, 96 aa, Homo sapiens
RFQANISQAQNAQPVSGRYERADEAQAQELANQLQVQAELLKRKLEMTAENLRTSMEVGVDELPSLFAPYSQKICEQLQEVMDKIKEATAALPTQA

SEQ ID NO: 947723 - protein, 136 aa, Homo sapiens
AGFPCATRGTKCLRREAPPWDAPFRDPPFKQLLLGAVFKTFQPSGPPSEGALWSGLPSTSPLPNFPWAPFLAPPSPWEGGPQFKAFPVKRGLWPKPPFQLPSPPRFSGPCGPGLFPTPRGVCGGGRVRFHKVCPLS

SEQ ID NO: 947724 - protein, 72 aa, Homo sapiens
RAGELNQEVNRLMVAMRDMLANIQFHEPQWEDNQERDEEEWDYQINKVVIFQMKLNDKLKKHKRGICMICSP

SEQ ID NO: 947725 - protein, 138 aa, Homo sapiens
VIARPGAKDFNYVPSPDGGGMNRTAELQYRSPVHQSHQSPTSVPRSPFAPHQKVAFISALERADSPHLGTREDIGQGKVNGQLKGQYGTPSGTPSRHTSVKKVTGVGGTTYEISVWLTARGANACEEQHCHGKPNSCS

SEQ ID NO: 947726 - protein, 128 aa, Homo sapiens
MGPPFLMVSDGPTRLRGVFCPTFDFTWGGALFLIIPKEKKTLVKKAKMPPENPFFSEPSRDLFWGGPYRAQKELGWMRGLKRPKIKGFFFFPFLAKKVRFFFFGPFEGWGNPCWPPITRDFFLLGCFP

SEQ ID NO: 947727 - protein, 87 aa, Homo sapiens
KVLHVSVRVLEDTLDTVKESAISAMPHLVPTTPTAYTSDEAVNHSICICLVQFLSIVLQLEHVLYWPSIKCFTFHLIRSSENNRHVD

SEQ ID NO: 947728 - protein, 140 aa, Homo sapiens
PQGAQGSGGGVTPPPGGLPGRVSKAGHQGGPPQPPGAPLVGESGFRETQSFRLGGPPPGAGVPRPKKFSPGGGFKGEGPPPFPRVQAGPPPLFWALALFSRGAPPLWGPPGFFFPPPPPPPGVFFCLWGGGMNKKRGFLP

SEQ ID NO: 947729 - protein, 123 aa, Homo sapiens
SPTCALCRIFCAPSYSARLTGGEDLEPASSHYSCGSGVGIFLRVRECQVLFLAGKTKGCFYSPPYLDDYGETDQGLRRGNPLHLCKERFKKIQKLWPQPSVPKEIGHAQEANQTLVGIGWQHL

SEQ ID NO: 947730 - protein, 80 aa, Homo sapiens
KQLPEADKVRYKNEIKSWEEHMMEIGREDLLRRKTKSALKAKAKTKTIATKNRKKTSKVTVIKAKAPKKKKDASGKAVYF

SEQ ID NO: 947731 - protein, 129 aa, Homo sapiens
ESLSQVAYLSDPCQCYLYKNTSVFTAIINQERVVNKTYKSNLMSLNSLAMMKFQQDSIVDPVDYEWFGFDKAGPAEELQTLQESPIYKEDRLGLAAMDSAGKLVFLASEGDHLQFTREWFNENLLSYLL

SEQ ID NO: 947732 - protein, 175 aa, Homo sapiens
HSPRGECRSSPVSCGLYTLPFPSMRRKHIVDEKQPGFYLNCGHVHGYHNWGNRDAERDGREGRERECPMCRARGPYVPLWLGCEAGFYLDAAPPTHAFSPCGHVCSEKTAAYWSQIPLPHGTHTFHAACPFLCTAAQWRAGIHQTNLPGASGLSTPAFDPISQTLILFPPSVRFL

SEQ ID NO: 947733 - protein, 165 aa, Homo sapiens
EQISQEECISQALRQETADKEQNLLQLRSAMKELSVQNQELMEHNLTLQERLQGEEPSSGCGLLPAGARLTQRLHGEMAACLCDLRSLCNVLTQRAQGPDPKPLLLLGIASAPPPVAEQWDDWLSPEGLQKKLNEAQQLRRDVEELRTTVSDRYAQDMGENCITQ

SEQ ID NO: 947734 - protein, 118 aa, Homo sapiens
GGKAEYRTSERLKNKMDSHPPRLFACSNKTGQLLIEEVPGEMTQEDLAPDDVMIWTWDQVFVWIGNEANEDEKSEALTLAAKYIESDPAGRDKRTPIVTVKQGFELPTFTGWFLGLES

SEQ ID NO: 947735 - protein, 124 aa, Homo sapiens
VLELSEFNAVQLHKGPWLVLFVHDEEEGELDPAIELIQPIAEEIMAKYKAKEEETPLLFFVAGEDDMSDSMRDYTNLPEAAPLLTFWNMLARAKYVKDVEEITPAVVEQFVSDFLAEKLKPEPI

SEQ ID NO: 947736 - protein, 102 aa, Homo sapiens
PPPPLGEMGGGGGGRVLFNQGWFCVPGGSPRRPLSPFFSSPRRPRARSTLPALAWAGGRFPIFPRDPLFPFGLFLWPFFSSLFAGAGWVRSGISGPSWPPAS

SEQ ID NO: 947737 - protein, 76 aa, Homo sapiens
IITAPEWSRHVNNKSSGPSSSKGKKGSSYTARQHKDRGIDFYFSKNKHFGGGDEVKLHFYSSDTAASAQATVYIAE

SEQ ID NO: 947738 - protein, 77 aa, Homo sapiens
SQVLSQVKDQLDLLSVSGQKQLQALGLERLKKQLMKRGMKCAGTLQERAARLFSVKGLTPDQIDPSLLAKPSKGKKK

SEQ ID NO: 947739 - protein, 102 aa, Homo sapiens
PNPVCGPECPPPFRVMEEPFVISIKACIDSPASAEAVFASEVKKMPQENIKPQEQFTLEPYEKDPSVVVGVYRPPPKVKNLSSALSGLRKMCVDTVARVFFY

SEQ ID NO: 947740 - protein, 104 aa, Homo sapiens
GGRILSPGIQNTTFVAGEGGSNPLGWPFLLEKIVIRSFWERPKWARDKNAPLLGGFFGPLSLNGGGKPPKNLGAPVPPLGKMGGPHFGLGEFFFSRPPLGGVCI

SEQ ID NO: 947741 - protein, 117 aa, Homo sapiens
PRPREDSAAERARQQLKALLNKTMGICMTDGRTLVGCFLCTARDCNVILGSGQEFLKPSDSFFAGDAPCVGPGHGDPAHHHCSPLKVQRKKFDPGLRYFLTTMAAYLYRLSLNLLPQ

SEQ ID NO: 947742 - protein, 94 aa, Homo sapiens
QRPIPDTEPKMEEFKAQFPADECTKLKEEISQMRGLLARKASETGENIRQAASSFQQASLKLFEMASKKMAFERKGFGSSGPGDQKEVPKGGTP

SEQ ID NO: 947743 - protein, 34 aa, Homo sapiens
SSRYFVIRIENGNGRRAFIGIGFGDRGDAFDFNV

SEQ ID NO: 947744 - protein, 175 aa, Homo sapiens
PVNSQMKGQKGGRIPRGPGLGPIRPIVGCPTVWSHKKVGPGPGFSLKEFRVAGIHKKVARTIGIFVDPRRGNKSPESLQTKVQGVKEYRSKFIFFPRKPWAPKKGNSFVEKLKLAPQLTGPVMPVRKVYKKEKARVFLEEKKNFKAFVSFRMARANARFFGKGAKKAKEPPEQDV

SEQ ID NO: 947745 - protein, 130 aa, Homo sapiens
ARSAANQQGGFGDRAHCGPLGGVPGCQPFAPDELTVKTKDGVVEIPGKHKERQDEHGYISRCFTRKYTLPPGVDPPKFPLPLSPKGTLTGGAPLPKLATQSKEIPIPVPFELRAQLGGPKTAKSDETAPK

SEQ ID NO: 947746 - protein, 105 aa, Homo sapiens
HPPPPPINTMAFFGNVPKRRLAPCQRTGQPVGTMLQLNEHGPQCGFHCHCLLTHANEDGSCCHHPTKCFGWDLPSECCDLWSGSTTAPPAQQVPNVKEPENKARA

SEQ ID NO: 947747 - protein, 126 aa, Homo sapiens
RVAGFPKKGAGPMGFFWDPRGGNNSRRSLQAKVKGLKGARPKFFFFPRKPWAPKKGNIFVKKLKLAPQFPGRLIPFGKFFKKEKARFFLGEKKIFKPFVIFRMARPNPRFFGKGAKKPKEPPNRDF

SEQ ID NO: 947748 - protein, 41 aa, Homo sapiens
YRKEKNIYSKRWQKEEIHRESIVWCDSVKMAVPSERDIILT

SEQ ID NO: 947749 - protein, 150 aa, Homo sapiens
DQLGRALQIMSRFSVQAGSVGVICSASPCSVTSSTSASKVKAVQNLGEELVVSGLDSAMSLIQAAKNLMNSVVSTVKASYVASTKYQKSQDMQSLNMPAISWKMKAPEKKPLVKREKLDDGQTNKVKRSSQKKHINPVQALSEFKAMDSI

SEQ ID NO: 947750 - protein, 114 aa, Homo sapiens
ITQDGGSQAIENAVTMVHNDGSMITIPPTESLLASAEAHSVTVATEDGTERQMTIMMPELTSRNTQDGLSAHPITLLATSNGTQIAVQLSEQTSLEEALRIASSLQAEEAELAD

SEQ ID NO: 947751 - protein, 76 aa, Homo sapiens
MIARHRYEGFLYFNIIQIQREGGVQLSTQTGKQVGTAGDQTRCGLSESEDHRGKPSVAYRFKLNVVATTSHHIIQA

SEQ ID NO: 947752 - protein, 73 aa, Homo sapiens
KLKPLIKAVNEDFDDQLEMVCIDPGCFGIDELIRCETKGKGTLDVLSLKDVEDEKLETLHLFSPAFFNTLNYC

SEQ ID NO: 947753 - protein, 112 aa, Homo sapiens
LVQEHNVPRVEDPGEPQELVEDEAHVNVLQQTALPNDCVQVSVYTEGAHCSRGWGAGGTTWGEWERGTWQVCPTLNQPTAWPPRSSILCTACGHSGEVCRSFNTLFHVAFVS

SEQ ID NO: 947754 - protein, 163 aa, Homo sapiens
QYQEPIPCEQLVTALCDINQAYTQFGGKRPFGVSLLYMGWDKHYGFQLYQSDPSGNYGGWKATCIGNNSAAAVSMLKQDYKEGEMTLSAALALAVKVLNKTMDVSKLSAEKVEIATLTRENGKAKNQSPQAKKKVEELIKNPEAEEAKAEKAKKEKDQKEKDK

SEQ ID NO: 947755 - protein, 66 aa, Homo sapiens
GPPLKVGGCQEVEIQEGAAPALQTQDGLAVNGATQRPQIGPSHPWVLPAPAFKNIAFGCHVAQTFE

SEQ ID NO: 947756 - protein, 125 aa, Homo sapiens
PPGPPRGPPRGRPPPKKGFKVGLPPPKNRVFFPIRPAPPNFPPWEEGGGLPKPVFMARVFRGGPFRGGPPLLGGPPRAGVLKNKIPPPPPPPPVFFFFPKKTLGDLGGPFGAPKGAPGEKKFFGF

SEQ ID NO: 947757 - protein, 120 aa, Homo sapiens
AFWDSTLTQITAGLDPFGRIQMKTRTLRWHLAKIYAIHYGTYSRLLVSSSQDWKLIIWDSYTTNKVHIPLLSSLITFSYSPSENFFAFWGLDNIFSIYSLKTRDATSGSAGSCLATLGTF

SEQ ID NO: 947758 - protein, 224 aa, Homo sapiens
MRTSGRTLPWALGKDLCYALGDRFKAVCVSASQDGKFIIWESYTTKKVHAISLCSSWVMNCVYALSGNFVACGGLDNICSIYSFKTREVNVRVSRELPGHTGYLSCCRFLDDNQIITSSGDTTCALWDIETGQQTVGFAGHSGDVMSLSLAPDGRTFVSGACDASIKLSDVRDSMCRQTFIGHESDINAVAFFPNGYAFTTGSDDATCRFFDLRADQELLMYSM

SEQ ID NO: 947759 - protein, 67 aa, Homo sapiens
AAVHIQEMDDLDKIASRNDKSRPVPLFQRFEDLKRELSSQREEERACGLKLNCLLDIVDNWRCFSLT

SEQ ID NO: 947760 - protein, 112 aa, Homo sapiens
KKKNWGGGPFHPLFFAPGGPPGPKPGIPPPGGGGPHWGGPPPFFRGFSKGFKKIAPFVAGPPLGPPRVLKKRPRGGPPPGPGAFWGFFWFFWGGGGPPLFFSPPPRFLGGGF

SEQ ID NO: 947761 - protein, 96 aa, Homo sapiens
QRAAEAFALVPAKTPECGQLRKLLEESRRQRARRALHTRSRTHTASQNETPLNSGWVNSRTQTLAALLIYSDISKMKLRDPLYFVLCSKEIKGHRN

SEQ ID NO: 947762 - protein, 58 aa, Homo sapiens
MLFWNLGVGVIFGDYGYPPEFECRECGSTLGKWGTRALQVFTRSALCNVLGPIKPNVS

SEQ ID NO: 947763 - protein, 109 aa, Homo sapiens
LAIRESIENESDGNVIEQYNPSAMKLNEDDTVREIRKDHFEAMRFAAAPSADNDIRKYEMFAQTLQQSRGLGSFRFPSSTREDSGTSQGSSGGGGGNVFNEDSDDDLYG

SEQ ID NO: 947764 - protein, 217 aa, Homo sapiens
QGSRRRLPQVHAGPDGGVWNDEQKLLLHDLQQYFCLKDSERNRKLFDLLDVLKFTKVVIFVKSVKRCVALSQLLVEQNFPAIAIHRGMAQEERLSRYQQFKDFQRRILVATNLFGRGMDIERVNIVFNYDMPENSDTYLHRVARAGRFGTKGLAITFVSDETDAKILNDVQDRFEVNVAELPEEIDLSHLHCTVQMKVLTFSEQQQMDHGGALNLRF

SEQ ID NO: 947765 - protein, 113 aa, Homo sapiens
KKGLQSRDKTPAKEEKKRKRPRKESYAIYVYKVLKQVHDTGISSKAMGIMNSFVNDIFERIAGEASRLAHYNKRSTISSREIQTAVRLLLPGELAKHAVSEGTKAVTKYTSSK

SEQ ID NO: 947766 - protein, 78 aa, Homo sapiens
PGLLPGAGGGLPFPPGNRFGPLAFFGGPFDPVWSKKAGGARAGIPGILAPPGAPPGAQEFFWPGFWEFGFMDGPFVAF

SEQ ID NO: 947767 - protein, 175 aa, Homo sapiens
QGETRFLKVIRTGKRQKKAKRMVTVCFVGDGFTRKPPKYERFIRPMGMRFNKAHVTHPELKATFCLPILGVKKNPSSSLYTTLGVITKGTVIEVNVSELGLVTQGGKVIWGKYAQVTNEPKKMMAVLMPCCWFNGDPERFIIELCPRVQLESAFLWKTPIIIVIIQGILKLQKKI

SEQ ID NO: 947768 - protein, 122 aa, Homo sapiens
AYLLGTCRPCISGDGFIFSWDRRGHSGYDLIGAAFRKRVFFPQFPQEFAQNVGRMFKQFNKLTEARAEVQSIMGLQGFFKRGMKEAFGDTKFFVVVVEPPPMSLPGVGLSSQELFGGPGDGP

SEQ ID NO: 947769 - protein, 156 aa, Homo sapiens
CSTPVQERMKNLLQGNTQSVGLLLSERFVNVPPQIALPLHKQLQKEMAEAQRTNKPSGKCQFCLMISKTCKPLKKKSISAGDQAKDELLFVNDEEEFFYEQATVKFSYCVQDERDSCATGKWSYDDEPMKPFRTVMVIPMDRMDTIMQKMTDYLTV

SEQ ID NO: 947770 - protein, 117 aa, Homo sapiens
QLATKPARKSALATDGVKKPQRYKARNSVSGEIRRYQQCTELLIRKLPFQRLVREIAQNFKTDLRFQSSAVMALQESSEAYLVGLFEDTNLCAIHAKRVTIMPKDIQLARRIRGERA

SEQ ID NO: 947771 - protein, 117 aa, Homo sapiens
RAKPLFGGTPFFFNRHRGGGRPPQKPRGPPQGGPPGESPAPAPRSAVRRALACRTRCCPSTLDLGPSHAGPGAGRHGPGAPGGGFPQARRGTPPRDAAPQGRFRPNADLELNDVIGL

SEQ ID NO: 947772 - protein, 188 aa, Homo sapiens
MMEYLCKAVYWTISGESLASIGLCDNMKPESCADHELLYLLKGQQGNQFILRARRSLLDTSVPWHLRYLGQPEVGDSRHALVRNCVYVAASHSLPDFLNEMGFRMDHEFVAKGQVFRKGVMKVVSEQTVRVLVPANTDNTEPLYLSYLVELSVLALAGQDTVSEYMRSFAEQLKPLVHLEKIDPKRLM

SEQ ID NO: 947773 - protein, 148 aa, Homo sapiens
LCGCMWTAVWQLQYLIRKLCQDIPSLRIMDAWWMPRLQVPAPLLAHNQEDKLRFQLEAFMQDTPSPLIYITCIVKATVAARHSDHLHKSCSFANGWFANDGHHGACNCCDSTCGVEGQLTGDGFKGIQWEGKALVGPVVVKDTQRNLV

SEQ ID NO: 947774 - protein, 115 aa, Homo sapiens
LIGFSPLRCTNAPSPLLYHKSILAPLITILVIIETVSLLIRPIALAVRLAANITAGHLLMHLIGSATLAISTINLPSAVIIFAILILLTILEIAVALIQAYVFTRLVSLCLLANS

SEQ ID NO: 947775 - protein, 170 aa, Homo sapiens
LAGRRTNGWGVLLFVEKAEKACQKLQSWRINIKMPNISPGALMYTVKPVLGSVRSPPPVLSASEKNIEKELPPLNDQVRPLSNGIPVDIKKDFPKKQMDAGAFPGPSSLPFNAPQRKCLQGVLKKQGEPLAGLIKQIKGLQNPFRFWPSTVQRALPTALGQVFLKSPKNP

SEQ ID NO: 947776 - protein, 198 aa, Homo sapiens
ESGPTPWGELMPSDEESSEEQQEEESDEEYPDTGFFTRADSHSGLITPDGFSSVPAGMETPELIELRKKKIEEAMDGNETPQLFTVLPERRTGPVGAAMMASTHIYDMTTTVTSRKVGVSVLDGDSQGVEVALAPEELELDPMAMTQKYEEHVLEQQVEKEDFSDMVAEHAAKQKQKKRKAQPQDTRGGAKKYKEFKF

SEQ ID NO: 947777 - protein, 66 aa, Homo sapiens
ISKDSQDIKQKVQDKYRYCESRRRVLLQHVHEGYDKDLWEYIEDVEIDLRTTDSRREAPATRALMQ

SEQ ID NO: 947778 - protein, 153 aa, Homo sapiens
IPYQTTVHTRHCSRDHASGTIELLGYFMKQFSHNINMDLHIPQGTVVMPNFTAILSNKENWKHPDTFNPENFLDENGHFSKPESFIPFSLGPRSCLGETLAKTELFLFITSLLQRIHFSWPPDAQPIDMDGIMGIVRYPQPFSIICCSRDTKK

SEQ ID NO: 947779 - protein, 171 aa, Homo sapiens
GTLFRPKKGDQASRDFSHHIVLRPFESHLVMLQLETPASFNERVSQICLPPERYIVPDGTICAIAGWEQLKEKGDETVLNVAQMPVLSNKDCNQYFKGRVRENEMCTMAFQAGVGACERDYGGPLACQNSDCWVLEGVIIPMRRCGHAGQPNIFIRVSVYVDWIKKVMEMT

SEQ ID NO: 947780 - protein, 79 aa, Homo sapiens
FIVFHHSTDHRASLLRTFSLIGFEIVRSGHPLVPTMPGFLHGLQNRKRLQMVTNKTPQSHLASYNYAVSHPTWSPLKET

SEQ ID NO: 947781 - protein, 154 aa, Homo sapiens
LKNRRAATNLTALLLCKFKHPKEQTDLVRELDASPLSVVRVEVEISNGEKRQSFEAHLFRGFAAHETIIDVVMIIDAAAAHLQDTGLPGGALAVVGAGPFPERGEETGLCLQIETINLQGLSQDHAVVRDPMVGSEVFKPSIVRKSVSVPALTD

SEQ ID NO: 947782 - protein, 107 aa, Homo sapiens
DEVQDECPDLVDLSACNKEFRPFRDQLSLENDHRRRTTSEMSMASVASCSTIPPEVIRQKVKRQLTKQQKAAQRRRLHKGEANLVTKERRENQNNIKSSLETASFWG

SEQ ID NO: 947783 - protein, 113 aa, Homo sapiens
KAEYEGDGEPTIFVAVAGRSNGLGPVMSGNTAYPVINCPPVTPDWGAQDIWSSLRMPSGLGCSTVLSPEAAAQFAAQILGLNNHLIWAKLRAFRLNTWVSLKQGDKKMQDCSL

SEQ ID NO: 947784 - protein, 72 aa, Homo sapiens
ICRSNYAESSGYNYNIGLSMPYDTLSGPVDSMGLLDDWYCYLKDNLGSHRFKVILTVMYVFYGQIIDIACLC

SEQ ID NO: 947785 - protein, 139 aa, Homo sapiens
AAFFGVTELLGVDPLTNKLLFDALLSHVAQERAWMVRHVQYSCLGHIGCMDRPAYWAPGDTAPSARKPHRVIQGVHSGCLESRDGTRAARGFRGKVGDPDLLGESDGETLDVELNMGCCPLAGVESPNPRLRKRNSLVE

SEQ ID NO: 947786 - protein, 121 aa, Homo sapiens
RGWWQGGVPQKEPPVLWAGVNPVPPLVENKKAQWVVIAPVDPIEVVFLPALGGKKGVPFCIIKGKARLGGLVPRKPGPPVAFTQGNWENKGALVKWVEAIGPHFHAQNEIPRSWGGQCLGS

SEQ ID NO: 947787 - protein, 127 aa, Homo sapiens
MVKWDPCHGKNKPCGLLPRGEVVPKDVNGAFATIKTKGTIQFVDWCPPGLKVGINYQPPPGGPGGNLAKVQKAGGMLSNTPAVSKAWGCLAPKFALMYAKGAFVPWNVGEGMEEGEFSKAREEMAAP

SEQ ID NO: 947788 - protein, 100 aa, Homo sapiens
SNIQKLFFERINVFSPVEFNKVWVLPGFIKISLKTLLECVGLGPFGGFGFQQGKMDSPFLQFYLWGFLAHKKFVPFLLEKMVAFFALRCPNPLPMKPQLV

SEQ ID NO: 947789 - protein, 151 aa, Homo sapiens
MGGKCSKEVAPATRGAIILAKLSMVPVRKGYWGNKIGKPPTVPCKGTGRCGFVVRLIPAPRGTGIVSAPVPKKLLMMAGIDYPSARGCNAPLGNFAKATFDALFKTSSLTPALWKETVFPKFPYQEFPDPLVKTPPKVSVQRTQAPAVGPT

SEQ ID NO: 947790 - protein, 114 aa, Homo sapiens
IGGLIEATPGLYQLPSGPNHAWKANAIGRGAKSGREFLEKNYSAKALCTDDLPLCWVIKALLEVVQSGGKNIELAVMRGDQSLKIFNPEEIEKYVAEIEKEKEETEKKNPKKAS

SEQ ID NO: 947791 - protein, 86 aa, Homo sapiens
GAHVQRVSQKFRGDGGGHQNNPQGSTGFPSGVFLPLRGKRAGVAPGWLPPRSPASQFFGKGKIYPPFGKKGERAPNFLSLGNPPLV

SEQ ID NO: 947792 - protein, 109 aa, Homo sapiens
RVVLVLRERWHFCRDGRVLLGSRALRERPLGLMGFQLLPLPFEENGGPREGLPPLKSFLRQKLPALGLRWGPEGGLGDYVGFRMAPPWGGGDLPFGSLGFGFSLKFLSF

SEQ ID NO: 947793 - protein, 75 aa, Homo sapiens
GFSLLKRNGDKPGPPPGGKRVGFPSPPVDSSSLRGNPGFFWAKCGKPNVVQAKNVVNPRGGLALGCASQKPPFFK

SEQ ID NO: 947794 - protein, 67 aa, Homo sapiens
VGPERVPAKTTEAAPAKMIFPKGLSLNLTELPDPATDSEHTRTEGTKSFSLGRWKVLEMDGGGDRTT

SEQ ID NO: 947795 - protein, 147 aa, Homo sapiens
GFRLPPLARGGLFAPNPGVFQIVFPSPPLSQWAGGGAGGGVYTPFFVPPHLRGDPPPWFLSPLKNPGAAPPPGFFPGAGGGFSFSPGAPLAPWALFGAPFGPVLPKNPGGPGPGFPGFFSPPGPFPPNFGGGRGFLGVPPPKGVSLG

SEQ ID NO: 947796 - protein, 75 aa, Homo sapiens
IDQAGLQREKDFRPKKVAALGSRGSAATEVEKETQRKMTILQTYFRQNRDEVLATLLAFVCDIRPEIHENSRING

SEQ ID NO: 947797 - protein, 100 aa, Homo sapiens
AQGGGGGQDNGLEGLGNHTQNMYMEFKGGDGYLAPEKGYFIEGCPGVKRLSFPFVGFGGVPAQPLGVIPSPNLGHLSLSSKGRCFICFGPLDLKKKLISC

SEQ ID NO: 947798 - protein, 60 aa, Homo sapiens
ASSATTDAQRVVLVLRERCLFSRAGRVLLGSRARERHGLMGYQLLPLPFEELESQRGLPQ

SEQ ID NO: 947799 - protein, 73 aa, Homo sapiens
ASHPFELDGPFGVPKVVGKVLEFDSLTGEGPGKVFRKNPEFMETVAEKGLQEYRQKPPEELNVEVGFAPTGGF

SEQ ID NO: 947800 - protein, 134 aa, Homo sapiens
SPKKAKNQCKKADNYKNQNPSFPSKDHNSLLAREQNWMENEFDKLTEEASEGEYQQTLLRKKERVLTNCKEAKSLEKRLDELLTRITSLGKNIKDLMELKKQQHENFMKHTKVSIAESIKWKKGYQILKVNSKK

SEQ ID NO: 947801 - protein, 112 aa, Homo sapiens
RPKAAPAWGSSQHPSLAALFAFWPPVGCGGAEQGGGQTQPLFSDLGLAKGLAPRASFSQGPSPGPGPGISPRTVGPGTTSLVQIFPRETVVCCPPAWWFSPSPTSPLEKNVK

SEQ ID NO: 947802 - protein, 88 aa, Homo sapiens
EQIFPPFSPEGPQRLLPVLDKISPVPEIQGAHKYMGAHKNIGKFFLELPPVKEDGAGQEAPPPALSRANLEKIPNKQAQKPGASPQPV

SEQ ID NO: 947803 - protein, 160 aa, Homo sapiens
RVVKKVVGRRASPPQNSPGEKSLCPGVDQCFMASDPLRMPGPPPKNSRVGGQRLASLTKFPLQKARGAPWWASHPFPERSIRTSLRGFLKTLFPGRERRDSSPPPPPKKNGFGALGENRGAGFKERKLTFFFPLGPRSGFFWGFKSFFVWVFFLKKGEKI

SEQ ID NO: 947804 - protein, 103 aa, Homo sapiens
SPRVPAAGGWASLNVIGQAPPSIQVFGGPFFTPGKTNDLLTKDCPPPEILTFVSSVLIKGPPPRARSQLCRPPPPPPTLHPFALPPWFHPLYTHIFIKKSMFC

SEQ ID NO: 947805 - protein, 85 aa, Homo sapiens
FQEEETTGHQQRSGVMKLPPEDGWEKKIQELLVSVLVTALIGKAEAIALTKPPAFKLCCGVYVTPPRGDPHLSLHTWGDRHGSGH

SEQ ID NO: 947806 - protein, 93 aa, Homo sapiens
QKEDSVEKKRNKRERRGSTPRKNSKREGERQRKHRSRGSTHRANKGGLSTESREAKKSQASEKKAHREPIAQQKPKPKDSPGGGSTSQNKRKK

SEQ ID NO: 947807 - protein, 118 aa, Homo sapiens
WLDGHHLVFGQIKKGLIFLGALGPFGSRNGNPPQKFPLSGWGPPQKVLLVFFFSPPIFPFVGGGGPPPPPFGPGFQKIFVVSPAVPFGVPFFLFPPPPPGGFRVFFFFFKLKFNTLFP

SEQ ID NO: 947808 - protein, 70 aa, Homo sapiens
AQQSTATAQGAAVLATLPVIFKKNKSSLIASVPLFSSCSSGLTNGCVSLFASLLGSQRNPGAHIEWPPDM

SEQ ID NO: 947809 - protein, 71 aa, Homo sapiens
FPGVGWAQRFGQGACRRGAPQACIEEQLCYSCRVNMKDLPSLDPLPPYFLVEAQLRPQRAWGLQEIRDFFI

SEQ ID NO: 947810 - protein, 116 aa, Homo sapiens
FSGGWGFFPANPRQWGAPFAQAILGLVGPGPVTPRVGLVLQLGGGALIFMFQLLGSVLPVCWASRVGGLPWFSCIPCPLPPSKERVLPEAPFPCGGLQRGPQCGPPCQKKIKARPA

SEQ ID NO: 947811 - protein, 30 aa, Homo sapiens
SPAITIAYGQSGPLMIDYLVFAVTRRTFNL

SEQ ID NO: 947812 - protein, 118 aa, Homo sapiens
ALQPLVNIRDFILERNPTNVKNVAKLINALQALLDIREFILERNPTNVKNVAKLFTVPHTLLDIREFILERNPTNLKNVAKLITGLQPLLNMRNHAGKKPDKHEECGKAFNQYLTLTK

SEQ ID NO: 947813 - protein, 162 aa, Homo sapiens
GPPVFLPFPGSKPKPRYGKGSSHQDEGSPISSPRPSKQGGFLLSQKSEEKWGWGPFGKSQFPRPPAFIGFARSPPPLFLGPARFFKKSFIFSGPLLIMGGGPGNSGGPGVVFQIAPLLRGPKGNPGGGGCFFPPCFFPPQGERFGGTPLFLFLKKYRFPPAS

SEQ ID NO: 947814 - protein, 142 aa, Homo sapiens
PGPSAGNDRLEPRPSERMHNIRGVRLPPGSYFGASAGTGDLSDHHDIISMKLFQLMVEHTPDEESIDWSKIEPSVNFLKSPKAPPVSSPPDNVDDPTGTFRSGPLTGWRVFLLLLCALLGIVVRALVGALVFQKRQERPKGF

SEQ ID NO: 947815 - protein, 107 aa, Homo sapiens
CPLPPPTPPNWFFRHTSEGPWPRGGPIQSVGGLRMLFLVYMNLVQGHTPLSAEWALSPWSWLPRSLAFRLCSQINRIFFTSTKNVDTHSCKNKHTKTHTDFRTIEPY

SEQ ID NO: 947816 - protein, 154 aa, Homo sapiens
RFSLGAGVCGPTSSFIVLPPPSACGGRGWWGFINSAFVPCLGGPPPLFFSPINPGAASSVFFCGGGGNFFPGTLFPLAFLGLLRPVVQKRGGRGGFPGIFPPRAWCFSKGPTPFPVGGGGFYPAVGSTPTIGGGVPTGPPPNFGVFGGKFLLFF

SEQ ID NO: 947817 - protein, 96 aa, Homo sapiens
HHARLIFYIFSKDGVSPCWPGWSRFDLVVHPPRPPKVLGLQAQATAPGRSPTLNNTPKRDSDDMHQDTCARIFTGHFCNNPKQETTAMSTSARKDK

SEQ ID NO: 947818 - protein, 86 aa, Homo sapiens
PLRIAPLGPVGVEALPPPEVAGRMLGGKVHGSLARAGKVKGQTPKGAHQEKKKKKPGRVKRGMQSTRGFVNVGPPFGKKKGPKAHF

SEQ ID NO: 947819 - protein, 111 aa, Homo sapiens
GTFFSPLPFSHDLGKGLPLFLTFRAGLRHSKWSFLEREPRSKGTERGVAEVRGNQESKISPCPQANVPGGRQEMLMCFYVRQCKHKKGGRKWRHTPASFTRRSHQSRCKEG

SEQ ID NO: 947820 - protein, 78 aa, Homo sapiens
MTVGTSLHLTECHSSFVDVCMVNAEHIFLTYAISGYREKLVVSKRERKPSPDTETCQSHDLGLSTFQTVRNKSLLLKP

SEQ ID NO: 947821 - protein, 99 aa, Homo sapiens
PLPGPRGPGIVSAPGPKKLFFMGGFDDCTPQPGGALPPWGILPRPPFMPFLRPKGTCPPPFGRGVFSPSFPFRGSLPPLSRPPPEFPVQGIQAPPVGPP

SEQ ID NO: 947822 - protein, 175 aa, Homo sapiens
VNSHLGPSVVPQSRTKAKVSPSFCFPLFTPKPKAPKLENPSRVTCPISGKPLGILDLTPVHFTPLNSSLARVGFFPPNERYFFSVTPNSLKNPPPWVFLGPFGVVVPLKWVEKFFWKKHGGPFYWKQIPSPRLFFFSAGGSRFSGFRSKTPNGKFPPGYPALSFWGSPNNPVWVP

SEQ ID NO: 947823 - protein, 106 aa, Homo sapiens
WPPGPCRLVNVAGTQKRPRGWGFVGLTLVTPPPLRPHNKTFWPRWKLGKLLLGLLAGGLVDGLGPHPCFLVLFILFPFPVLDLDLAPSPFFLGEWVEWSINPHVPV

SEQ ID NO: 947824 - protein, 34 aa, Homo sapiens
APKSRLKPVTMGWALQGPHSPPVGNGPGGWVGVN

SEQ ID NO: 947825 - protein, 72 aa, Homo sapiens
DFKWAQCKAVCVEAGMIAPAQGATEAPPPEDYMEGILEVQAKKKANLQYYAKGTQASPSLPAEVPNKKWFRV

SEQ ID NO: 947826 - protein, 88 aa, Homo sapiens
RGPGAGGRFCPPVPAPFGPPGEPVFPRNLPGGGAPPRGPCPPGGLGGGVSWARGGPTCGGVGSPPCALGLGARVSPLFPKKKKGFCRC

SEQ ID NO: 947827 - protein, 106 aa, Homo sapiens
PPGPPPGPPKKKKKLSPPPGGWGGNGEINRGPPPKGPLGKTPPGVLRDCPLGGPPFFGVWGGRSGSPPPVERAPPFGGFGGFSPFFFFLPRGGGGFRKKNGGPFFF

SEQ ID NO: 947828 - protein, 99 aa, Homo sapiens
LRPTRPVQKRKRLETAERFQKPLDRVIEMIQNCLASWPDDLPHSEAGMRVKTDPMEADDSTNCSGQNEPQRENSGHGRDQIIEKDAALGVLIDEMNESP

SEQ ID NO: 947829 - protein, 134 aa, Homo sapiens
PPLIKRLGRKTPPTLFRGSSLQQGARMGMLFFKKNPELLVRKKSSVLMPPPKRNPGRNKTRIFLTDFRKKIQFVAPSVNTFLSEKTGVSSQNTRKHFFVALAKQFVSYIFPRKPGGQPPGEAIFAPPIGLQGLP

SEQ ID NO: 947830 - protein, 102 aa, Homo sapiens
KPLPPQCDHFPFFPSFHTEVPVFLCLRGPQVEVPCCLCPLKSEQFLAPVGRSRPKANSRPCDKPRVEACPMKRLSPLKPLPLVGTFQRGRGLGDMKLGKPLF

SEQ ID NO: 947831 - protein, 121 aa, Homo sapiens
AAPVAVEPGATVGSLLSPGLLPHLWPAVGFKTKTVLKKGCKDCYLVKRGGGWDVFCKTHPGAKQRQMEPLSLQSQGQTCHRIPWGNGCILWEELSHQGVRGKGLEANALKVPPPVSGEMGN

SEQ ID NO: 947832 - protein, 111 aa, Homo sapiens
ATDSLFPWPAGGPLGFTCIRARLQKKVSPPKVSPQEFPRIVGRMFNQFHKLIEDKAKGQSIMGLKGFFKRGMKKALGDTKFFFVLGKPPPISLLGVGLSSQKFFGGPGNGP

SEQ ID NO: 947833 - protein, 160 aa, Homo sapiens
MGFLHFYYDLTLCGLPEDPDLQVSAMQHQTVLELTETGVEAVAASAISVARTLVVFEVQQPFLFVLWDQQHKFPVFMGRVYDPRAWDLQDQVRASATSPASVLSGSHGACMDIGACHLMLEVSGIHQKGSLRVWARDMLLLALGHGRAMVFQPLFGGLCR

SEQ ID NO: 947834 - protein, 94 aa, Homo sapiens
ILCGATVWCVLPWDQTLFAQTTKGLATGQGASSAILKTLPKRVVLVLRERGHFCRDAGVLLGSRALRERHQALMGYQLLPLPFEELESQRGLPQ

SEQ ID NO: 947835 - protein, 206 aa, Homo sapiens
DTPIPPEEPVFSIPVKPTPSDISVRQGKYNRLQTHTPGQFSLMKSPHALCEVPQIYVTFDITANGIVHVFAKYKGTGRDHQIVIQSSGGLSKDDFENMVKNAEKYAEKARRKKEQVEAVNMAEGIIPAQNPRWKNSRAIPLFMSAPSLKKNFSKMRGLLARKASETGKNISQAASFFHQASLKLFKMAYKKMAFEREGFGSFGPGD

SEQ ID NO: 947836 - protein, 115 aa, Homo sapiens
GGGGGSGGGFKKQSPFFSPPSCRGTPPPLFFPPKKNPGAVPPPGFFLGPGGGNNFPPGNSFPPGPFLGPPKNQFFPKNRGGPAPDSPGIFPPPAPPPQFFFSPLFKIKKKKGPPP

SEQ ID NO: 947837 - protein, 196 aa, Homo sapiens
CCPPVSVPSIPTKKRVEDPWHFPFPKGKGLKNKAANKFVASTSHLLLDLITFLTKYHSGHMTRASDIIERLKWVPLNRESVEERVVLSRNFSNEIRRNLSQVLLATMNILFTQFKRLKGTSPSSSSRPQRVIEDRDSQLGSQARTLITFVGMIPIPNRFGPPNSKVGADGGPHELSAMLCGSLGRHTVSTSGTWAH

SEQ ID NO: 947838 - protein, 78 aa, Homo sapiens
PKVSTPFIGWYPCNFNFRGNRPDIPNPQDGKETKAADPPVENLSAPEVEQGGVEKRRLTISPIIRFSHPTRRNMKFQQ

SEQ ID NO: 947839 - protein, 51 aa, Homo sapiens
SPQIPNYLPPEGRYNDITKVYTQVEFKKIDLPAAILHLLPLRVGINRAQVC

SEQ ID NO: 947840 - protein, 132 aa, Homo sapiens
PHPEFVECLYVNFDFDGAQTKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRTQMLALEF

SEQ ID NO: 947841 - protein, 150 aa, Homo sapiens
LPLPPTRAGVAFRPQPPVAFSAPPSRPSGRILWLAFIVPSPRFYFKPQPTGAGGWSWPFGAPSRVPGVPGAHVKVLFWGPPPLLGLKKIWGGGGPPHGGPGPPRPGWCFGPSVKTPGGGEVAPPKPRGNGGFPGFRKNPLRGGAPPPPLF

SEQ ID NO: 947842 - protein, 100 aa, Homo sapiens
RWDAADDIHRSLMVDHVTEVSQWMVGVKRLIAEKRSLFSKEAANEKKFAAPAEKNHTIPGFQQGLLFLGSPDSPDPISYALETFCHLGPFLPPPRLSPWA

SEQ ID NO: 947843 - protein, 114 aa, Homo sapiens
LPGVSKGPPPRPGCPGNQKEAKVKFAPGFEVRGKLETNLALNMPQQKKEEKARLLIGLSVGAKNPGKKSIFGGGKLFGDSSGSSTGFYFGSGSRDFWGGRGFPLSPRICGGQSP

SEQ ID NO: 947844 - protein, 197 aa, Homo sapiens
GWKAGIVLPSPLVEGHRGAFPHLVFIPDGNRFFSGARKNVKLLCWDLRQFGYPLWSLGKVPTNQRIYFDLDPPGQFLVSGSTSGPVFVWDPDGPANNGNPDPVLSFFPQKDCPNGVSLPPSLPFLAIASGQGVFPEPTKSGDKGKKLALPLFSRAQVPLKCRLQLWWCGGGPNSSIPYVPQGKKGQGGPEGGVGELK

SEQ ID NO: 947845 - protein, 91 aa, Homo sapiens
RKAKLDAQVKKLVLSPPVKARRLVAASSKTRQFENEKLFSGKRQKLVTKIAHIEMPCSPCPHPPGGPGCLHFFVAAKLGGSGRLGMEASES

SEQ ID NO: 947846 - protein, 105 aa, Homo sapiens
PSGHPLEDHDLVSPSPIADGDASRQRHRLYSWIGTGFLRQDQPLGREVLVDIWVRHSREGHRVGQVDPWNRMGQALTRPKPAPKESGKGLVSQGTPRAQELFLDR

SEQ ID NO: 947847 - protein, 97 aa, Homo sapiens
FCGWVPHKFKTTVCDIPPWGLKKAVPFIGKRTTLPGVFKGILGQFPALFPRKALPPWDPGEGMGEMGFPQGESHKNALVFEDHPAPDAPPKKEEVFG

SEQ ID NO: 947848 - protein, 138 aa, Homo sapiens
WNWSCRQLNFLLHRPHQKLILLNPLSLKCNPLFNLYHSKIYGTRPGVVARACGPGTLGGREGRITWGQEFKTRLGRRNEARSLLEMQKIGRAWWCAPVIPATREAEVGEPMEPRRWRLQWAGIVPLHSGLGNGARLHV

SEQ ID NO: 947849 - protein, 107 aa, Homo sapiens
PQVHGCVPPKSLRPHHREGAYLGPGFPHMFFMVHPEYRPKKPPNQFVPRFFGFKIHPMAYQVEFQAASNFKSPVKEILVIPSPPCPAVFDFSFFFCPPFRNPVWFLV

SEQ ID NO: 947850 - protein, 151 aa, Homo sapiens
DHFTYGLSDEIMQAHRQQLLLVSHDKLLSVADRYLGIGKSTHGLAILGPENQKIAKDPSWIIRGAAVALDCTGARVNTPPSWIEKVRNGAAFAQKPKAIGCRPSPPTATLGAQINPKSPQDTVRLDYHAWSAKDAPRRSFTLERQARFPSL

SEQ ID NO: 947851 - protein, 106 aa, Homo sapiens
GGGAFLGPLRGFFYFPFPGVRARGLPLERFAPPPGCGGGGFGPFLAQKLFLAPFWPPNLACGGGAPALPVGPPGGRVGPGPPFPGPPGGFFRGGGGGFFFFLFFFR

SEQ ID NO: 947852 - protein, 76 aa, Homo sapiens
GRARGGVSPFDTVRAPIIMQSGRKGAIMYTGPVACWRKIFKDEGGKPFFKGAWSNVLRGMGGPFVLVLYDELKKVI

SEQ ID NO: 947853 - protein, 124 aa, Homo sapiens
GARAGAGGFGPKGGPPPPFLLHLKGVKTPFFFLDPGGGAAPGGRWILNQSPGLWGGFLWVFFLPAPALKGIFFLKKKRGGGPPPWFSLFGENTGVFFPPPGGGPGVFFKEGNFFSPPPLPPPLV

SEQ ID NO: 947854 - protein, 90 aa, Homo sapiens
LGEVGKIVFRFGYKLGTGPNFLQFGEAAIVNWVLGKPMCVEGFSHYPPLGRFAVRDIKQTVAVGVIKPVDKKVVGAGKVPQFAQKGQRGK

SEQ ID NO: 947855 - protein, 79 aa, Homo sapiens
SITSGELPGVVLAPPSGPLPKVGSTIMGGILLAFIEGVGILFTEKAKQFNGPPFVEDPSKLPLKDGTRAPGYPSYQQYP

SEQ ID NO: 947856 - protein, 191 aa, Homo sapiens
RGGGKPPPCFFLQKPRGPFHLPFFSWPGGGINFPGAHFPPLPLFGASITNLFQKTGGARAGFSGIFLPPGAPPRPLFLGPLKKRGSPWAPPGGFFFPPGGPWFSLWPPGWGGGGPLLPGGFFGGGAPPPQKGGPPLGGFPQTPPGGGGGFPPRGFWAGVFFFWKPRGGCFPPFFWGAPPGGFWGGFFFFAP

SEQ ID NO: 947857 - protein, 165 aa, Homo sapiens
GNLLGEDQRFEATGTKVKGWLNPCFKNWDGSPVSSWILLAESNSADDETAIPGRYQKYGYIGTHEYPHFFNRPSTLQAASTPQAEEDWTCTIFECQCILGERAPVLFGPVPSFSGGTFDPERTKLLSELVYNPGQNPGFLTPGLLCPLSYHRNIFPSPHFIPPIF

SEQ ID NO: 947858 - protein, 119 aa, Homo sapiens
FSPEPCHGLGRHLSAPSWWGWGPPPPPNKATTGRGPEGFWALRLSSGGPPEVSVAGSGIKGAPWRKRGPKIVFGFPLPPPPGGLGGGDPGGGVFPPPPGDQALFPALNNPPINFFFVNQ

SEQ ID NO: 947859 - protein, 168 aa, Homo sapiens
QKWPLEAVAPQMDDMAMVLAREFFQALKELKVLVAKALLDPPKSLGCTAFRGKVGVFFEMEANFKNLSRGVVKVAPKLPPNKNVKNLFVALGEKFGEPPRSAPWPLKEGGFFLNQDLGFVPSLEGFRPQALWGRYMGPPRGGLRGLFYDWGASPRPAPAANKVVLGLG

SEQ ID NO: 947860 - protein, 99 aa, Homo sapiens
QKGFFSPGPLFPPGGGGGFFGTPPGVFFLSPPPKKGKGGGRGGGGPPPGFRGGGFPPLFGPKFDFWGGGPPPSIGPPQGAGWFLSPLPRAPPGVFPGGG

SEQ ID NO: 947861 - protein, 112 aa, Homo sapiens
ADHRKHGKTLFVLCGYPGVQALVTGPFFNIGKQLGAGVPFFPPRWEELALKKLVTLMCLAPGLSPKEVLVCWLQGSKELPRKKSFIWVSGEGPSRGPPPFFVTRILGVEPKD

SEQ ID NO: 947862 - protein, 118 aa, Homo sapiens
LKNLENGGPLKGPPSFFLAGKPSPPGAPIIHLIFLTGPLAWPVFFPTRALGGKLGPPCEGGLFLKKLVGPRARALSHWLILFNPFLKKLPRLIFPPRKAQKMARFSICEKKGLGCFSP

SEQ ID NO: 947863 - protein, 135 aa, Homo sapiens
TPSTLPGFFCTKDGLQVQHGPPQQPRRRKATLDGRHPLRHRGCETEKGALACVNEQRPENCRNPPVICPQGSLKEVCKARNIKFWGYFFVYRPKWAQLIFGVFLYNGLKGKEKMLGRCAARVPRKCVLPLKILSC

SEQ ID NO: 947864 - protein, 100 aa, Homo sapiens
PPPHIAKILWDRGPFCPRPGNRGPMGTFICPPRSFSPRDPQSTPKGVEWQKAPPSPLLQEVCRELKPLGRGMPSWGCPHNLFYPPQPGPGLYVFCKITRF

SEQ ID NO: 947865 - protein, 116 aa, Homo sapiens
YVYIHVFAFCEYVLALITSSYVCVVDMLGYVFCSQSSLALVSVEDTQGGTAGVIAPGVLWGLLFVLVGFLFFFAGLVVFKTRGYIWVCLRFCVVYPVFLQSLILVCIVYVKGWGEG

SEQ ID NO: 947866 - protein, 94 aa, Homo sapiens
MLVLIAENTPYEISDSLPVIESVTIYFTLRFGVVIDRFSPGTIWNKLYPSKGYHSSSWWQALHVDIAFVSRREQIAPGGRMRMRRERAGEKEAA

SEQ ID NO: 947867 - protein, 96 aa, Homo sapiens
YPTNVRLNRGDSMPPVKRRRMNGIDPPDDVFYMPTEETRRIRKLFSSSETKRVVRRPNMTIALRQSQAFRSDHHHLRSPKMSQLSSKNRNNHRVRP

SEQ ID NO: 947868 - protein, 79 aa, Homo sapiens
ARCGGGGIGGLQVPGKCFLLRNLVSSQEAWGPPEKGDGGGVPSGKWAVCHHWPGTAPVGTVVDDWNFTIDLLLLFVIHK

SEQ ID NO: 947869 - protein, 124 aa, Homo sapiens
PVQKAVEGGDSILTPKSFFFGGIFLALLPLRPGPHPPIRGGGAPKRDPPVNSLGSPLPKHIGFIGIGGFNPLGSPKFKRNPPNPNNSSPGYYNFRGFFFSPPTSLKVFGVSLPHFRGDLGVNIF

SEQ ID NO: 947870 - protein, 162 aa, Homo sapiens
RPGWGSIGPIVGCPRVGYHKKVGAGPGFSLEKFRVAGIYKKVARTMGIFVDPRRGNKSTESLQTKVQGLKEYRSKFIFFPRKPSAPKKGDSFVEELKLAPQLTGPVMPVRKVYKKEKARVIEEEKNFKAFVSFRMARANARFLGIGAKKAKEAAEQDVEKKK

SEQ ID NO: 947871 - protein, 70 aa, Homo sapiens
RKHEIEAAIVRIMKSRKKMQPNVLVAEVTQQLKARFLPSPVVIKKRIEGLIEREYLARTPEVRKVYTYVA

SEQ ID NO: 947872 - protein, 108 aa, Homo sapiens
MLCAGNTGRTIPGRFGRAPGVKVNGTWLQGGVVNWGKGCAQPNRLGIYTRVTYYLEWIHYVPKKPGVRPGVSTWVIGEPAPLVQKTGSYPGGCAPTPFLPRPEGPFLS

SEQ ID NO: 947873 - protein, 51 aa, Homo sapiens
TGDKLTDRDIIVLQRGGTGFAGSGVKLQAEKSRPVNAGLSVCGRPNKPVWV

SEQ ID NO: 947874 - protein, 68 aa, Homo sapiens
LPHLPGLKNLGIQATPLELKAIEVLRGHRTYRWLFAEIEDVKPAKPVNISVPPEQLLVLGFFGSAHVV

SEQ ID NO: 947875 - protein, 107 aa, Homo sapiens
PPPPPSRETRIIIRVLGREGATPPFNFGKFPPPPKGFQTPPGKKPCLVGVVSSLFSPSPWQGGKQLLEPLWFPPPIPFGGGVFPSQKKTPGRGGSPPPPKKKSFARA

SEQ ID NO: 947876 - protein, 116 aa, Homo sapiens
PPPPPPGGGKAGGFFGVFSFPERGGGGKPPPPGAPPKGVSGVSPPPGGPPLFFKIGGGGGGGKGEKKGGDLSPRGGGGGFSPPPKKGGPFFFGGGGVSLSFPPFPGEKKIFFFFFL

SEQ ID NO: 947877 - protein, 89 aa, Homo sapiens
LWGARGGGPESNKIVFWFFPGGVRGKNSLHEWGPSRGKQKVVPPGWPWGKKGEMEVFTTPSVGARPPVFQKKEKDSVGQPGFARLIRGI

SEQ ID NO: 947878 - protein, 114 aa, Homo sapiens
GLNSISPIFRHPRPNLGQNPFHYHIHGGKNFFPTTLFGPIRNAPRLLGPRGIPHMKHPIIWRVIHFFNSRKINNFHDLRSLWFEGKSPNSRRTLHKLGEDYMEAPPPPTHLKNR

SEQ ID NO: 947879 - protein, 70 aa, Homo sapiens
GSRWGPMFQLTLAPGTIKFHLGHAMWGPMNVYGTQLNMFQPLKTVAILGSVTFLAGNRMLAHQPVKKPAH

SEQ ID NO: 947880 - protein, 105 aa, Homo sapiens
FFPPGGPGGVGGWGGLPGLPPPFPPGLGGGFSPTPPGFKGRGFRQGFWPPSSGLFFFQAPPGGPGVFGVKISLVPPQGGLDPGGGGFFPPGVPGGGFFFRAKGPL

SEQ ID NO: 947881 - protein, 155 aa, Homo sapiens
FPIPKARRKNKGKLGQFSGFTLWGEPITPPRNFAKAKKKPPGNHLVPQIMDLLYKNHFPILGGGHPAPFRPPFYGENGPLGDFFFFFLINQKQGPFPQGFFLPAPSVIFNRILGPRFQFRATAGQFLVFHPCLASGVATGFWGNPFVFFNKGQSW

SEQ ID NO: 947882 - protein, 76 aa, Homo sapiens
MRAVLAKVTSLGLKIPTVPGFDLLETPKNVGSLILCPRAEVLILQAFCQEVFGIFQEPTDLLREGDSLHLAKRVGG

SEQ ID NO: 947883 - protein, 46 aa, Homo sapiens
WKLARSAVTTVLWRLCPQVEQPPMSLFLSSLAIVTNPEVHYKNLVV

SEQ ID NO: 947884 - protein, 86 aa, Homo sapiens
LRVACQESYPIAEVQAKFVQDEQVNMRPWDDSVTHEPFKISSVVVIFGDGQKGASGFEKHHQLSVKHNYFLHVETTEGQWSAQYSR

SEQ ID NO: 947885 - protein, 173 aa, Homo sapiens
GIPLPTRILGTPAGPFEIKIGQPPVSFFLKAAGGIKKGARQTGKKVAGLVPLRHGYEIARIKAQDGAFAPQEAPLWFVVRPIMGLARFLGIGGGKAPSSKGVAAFQKERAFFRGGQKGADLGAQKKGAKKGPLPPPSPDFKGGGCKSGAQGGEGGPPKMRGGFMPLKEKFWDI

SEQ ID NO: 947886 - protein, 129 aa, Homo sapiens
INAHRKPHSGADRKRLRMTISTSLSGTRCAPANCTIAWPGSGYQDLPDGVATGQRIERSLISAIGRTPVAASPPAGARPATARYSAECRAPAPLNPIAANHRLGLGHQAHRRDGERIGRIGQANGDDAA

SEQ ID NO: 947887 - protein, 108 aa, Homo sapiens
PTSFIHIPYPFPTKFSLHGRCLGKGGPPFPLVLIYRPRRAFNTHDFSRVVRGEPAMGRSPTSPGLGFPVRSTGKQASSWKGQAWSLPFQYLRQFQFFVFFFLITKQFF

SEQ ID NO: 947888 - protein, 150 aa, Homo sapiens
LGKGSPSRWGENLFLPTLGTTFMFGKKFWGAVGSARFQEPIISLWNKSASAQAPPAGIGDTFGGGFTLPPTPIMEYKTPPASIKMPGRLAPQRLLFQTLWNPRLNVPCPSPFLEGPIIKAGVIGVSCFVGGPPGKPFFPGQKELEDLFFF

SEQ ID NO: 947889 - protein, 146 aa, Homo sapiens
RPLFFLSVGRPPKFPSRAPPGFFPPPGFSSCFRFFPTIFPGIFKIFWWAQRVSPYQGTPPVSNPFTLTLSLNPCFFKGSILLGAPLLPRFFANSKTLFSGGFFFKGGFLLTPRGGTPFFSKKSPLKMGGVLFFPLFSPPKGFFPLI

SEQ ID NO: 947890 - protein, 71 aa, Homo sapiens
PPPPPVGRPKILFFSPGMVPGNIFPGTASVVNPPLGAIFLESHFLDFAPLGKVAPGPWSSKIVSCEFCDSK

SEQ ID NO: 947891 - protein, 84 aa, Homo sapiens
RAHSRISAGPDQGETNRPGVIPAGGADALGRRLPRSVTELAWNEEFGALKAHPDSRADGDRLLRGNHVAGAMRVFTTPMHTPFV

SEQ ID NO: 947892 - protein, 85 aa, Homo sapiens
SAALGRSPRGTKPEGQVASPGSELGSRGPPHEKGGLDGKAQKASPPAFRWKAPSTTLVEVSALAWLPPDVAEGGFKPCVLRRGWP

SEQ ID NO: 947893 - protein, 81 aa, Homo sapiens
QRARCRISGNLDLVLTCGAEKGCPEVIVGLTGSEPWRGKRERDMRSEAAAEPAQWLSRGLTPAPPCASRIIWCQHSFSIPD

SEQ ID NO: 947894 - protein, 139 aa, Homo sapiens
TEDVPGRDERGVERHHHEVQHDARLGDQRHAADDHSKERDGRELSVSGVDSRFHALAPNMPCGRNSTTPMKMAKMPICPSDSPRYSPPSDSTTPTRKPPMSAPTKLPMPPSTTIVKATSTKPLADLRVDVVRGQQEASG

SEQ ID NO: 947895 - protein, 43 aa, Homo sapiens
LLSLALVPHQPELSSGSSTCRQGGINAYIILFEVNLKLFQDKS

SEQ ID NO: 947896 - protein, 44 aa, Homo sapiens
MTQRRQSAGSTSSEPGQAAAPPPAAWRQQKAAPEQRRRHRPPAA

SEQ ID NO: 947897 - protein, 90 aa, Homo sapiens
VALCADRDNSPLLTSHPPSRPFQPPKHTPSPPPAPRVNSRHPGRSVSLSLPSASQAPPVPLASPEGRPHTVRRPTRKYLEENKRTPAGAA

SEQ ID NO: 947898 - protein, 98 aa, Homo sapiens
GGGFGKGGFGMGGSGKNGMDSPGGFGPFGKMGMGPHSRGGEGPPQGLGGYAPGGGARGGFYGPGGQGGGGGGVLFLKPNPPQPGFAPGVGVEKAFSQI

SEQ ID NO: 947899 - protein, 101 aa, Homo sapiens
HLRRSHKSLLTYVEEDMGLRDSTFAGQVQDMMVNLHMILTDTVKMKEHQEDPEMLIDFMNRTGRGYQASPDPRMTWLQNMPGNQAELGIHAETATVHGARG

SEQ ID NO: 947900 - protein, 87 aa, Homo sapiens
MFRGLSNWLGLQQPVAGGGHPNGDAPPEQPSETVSEYAEEELQQAGDQELLLQAKDFGNYLFNFAFAPTKKITDSVAVTAQTIKKSV

SEQ ID NO: 947901 - protein, 50 aa, Homo sapiens
MSLQTRGVPLRMGRPWVPEIPSPRLAGGVGISRIGCKYDPYLMIKHKQSS

SEQ ID NO: 947902 - protein, 84 aa, Homo sapiens
AQENPFRGAGQERVPQIKVYVPSVGGIAPENQFGFLAGGPLEKKALLGQWGGGALTPLEEAGRMFGGKVHGSLARVGKVKGQIP

SEQ ID NO: 947903 - protein, 53 aa, Homo sapiens
SKQVLNCEGRAVSGQKEEGSTLDRPTPPGRQGQRVRRSARGDLFRGVLSPSNR

SEQ ID NO: 947904 - protein, 82 aa, Homo sapiens
VGVQGPPPPPGAGSQGGPQPPGWPPPPTPVQRPAPESYQGKAPGKECPPRPLGGRPPPPPGPAMGPPPPPHKGKGLIDIFKS

SEQ ID NO: 947905 - protein, 40 aa, Homo sapiens
VNEVRMWGQCVIAPSPSMYHPGGMRLLSEAHGVQGGAGGG

SEQ ID NO: 947906 - protein, 182 aa, Homo sapiens
RPPAQGFGVLKATKASVQGPFILYDKGILRQIPEKTLPVGRSVDETLRLVQALPFPPKPGEGGPAGWKPGSDPLKPDVPKSQKYFSQPKWALGCFRARVRGAPLRTNPFLDFFFSLRKTPDFRFSRIVVSSQAGPFPPGVGKPPPSSFGRNGPSWGWGPATGLYDVLVEPPLYLLWFGLTLA

SEQ ID NO: 947907 - protein, 105 aa, Homo sapiens
PGFFYPRGPPRGGGRGAPPLGPPLGPPGAGGPPLFFLGGGPRFFPLFFPPGRGGVWGPPPLSKTPGFFGPPPLGGPGGPGPFFRGGGGPPFWVFLGEKTLFFFPP

SEQ ID NO: 947908 - protein, 112 aa, Homo sapiens
GGFMKPGKARWLVLDKTKHQLRYSDHRVDTECKGVIDLAKVEAVAPGTPTMGAPKTVDEKAFFDVKTTRRVYNFCAQDVPSAQQWVDRIQRCLLEALAFQPWPGLVSVVTHP

SEQ ID NO: 947909 - protein, 132 aa, Homo sapiens
LSPEIKDVIEQLNLVPTWWQVQNLGIEEGNNFGVAVQKKVFELMTSLHTKEGFHTQIFKYFFEGGDAVIKAAKQPHVGDYRQLVPKLDKAKSREIRLMVMEIPKAYVVLYDIILKNFEKLKKPRGETKGMFY

SEQ ID NO: 947910 - protein, 83 aa, Homo sapiens
PGLRAPGGSNKPPSESTQARREGPAPPLGFWVSAVLGTQGGRKEDLSFLFFASPPPFPGPGMNPFWGSFSLNAKALGGNEKAS

SEQ ID NO: 947911 - protein, 57 aa, Homo sapiens
ASVCLQIGLPKLFDQYPPFYINGVQEFLALSVETDYTFTAEKVKAFLADPFCLCGCC

SEQ ID NO: 947912 - protein, 36 aa, Homo sapiens
DEKLSPYGDGGDMGQILSCRLQDTNNFFGAGQNMRP

SEQ ID NO: 947913 - protein, 107 aa, Homo sapiens
KCLKGKRVAFCPPGKGLPEGSWSNGKPSGLEGHPLFSKPEGSPFSLEKSGDPLLPQLWEGGNIIQACPQLSKSTPPCGGGVKGSRFLSTLKLLPNSGLVFEIRSRKR

SEQ ID NO: 947914 - protein, 120 aa, Homo sapiens
PTGGESSFPLFFPPRVLRPPPFPPPFPFPPFPFPPPFFPGAASLGCLPGLGNPFNPPPSLEKIFSRFWAPIFFWFKPPKQRFNFPPKFGVPGGGPMKKFLLGIWVWCWTPPPPLGGTRSP

SEQ ID NO: 947915 - protein, 168 aa, Homo sapiens
PAPGFGPPVPPSERGEGSCQPTPAFPLIVGPWGSVPGQGGCVFLAVEGHPCPGSKKTEHPVLPPSLKVPVHFLEGDKWPGNLWLIGPSVKGEPSLGVLGPPPRVGPFSKKKGPKTKGKGGWKNPPQVWGPQGGPKMGFFFGPPRGAPNQFFLESRPGPGNTGERGGFL

SEQ ID NO: 947916 - protein, 89 aa, Homo sapiens
GKRSDPKTLYLVIRVWWRKMSLLARVHSYPFDTVPRRIMMQSGAKGIYIMSPGPLWWRKIARYKRGKAFFKGAWSNFLKGMGGAFGLFL

SEQ ID NO: 947917 - protein, 94 aa, Homo sapiens
HRPGGLGPPLPRGGRGGGFGPKGPPLLFLFGGKGAQIPYRVRGRFEVFGGTFPGRIAFSPNFGGGGGPPGGRAAPPGPAGGGFPPPFRGPRLGG

SEQ ID NO: 947918 - protein, 98 aa, Homo sapiens
PAGELFLSPNYGLPRRFFLAGVVWGPIAPRRVGLPKGNLKGGGPIFFPTKVWFRGVPGGEFSPEGFLFRVFFPAFFDRGPPGPWFKGVGGGWFFPPGT

SEQ ID NO: 947919 - protein, 163 aa, Homo sapiens
KVTLKGFDFSPPVVGNSKKPSPVFLFYPSYPEKVRGVFAVGNEKNKAHFFTQGSAHSDTTADPACHASSFLVHEPPLLYDLSKDPGEYNLLGGVAGATPKVLQALKQLQLLKAQLNAVVTFGPSQVARGEDPPLQIVVILGAPPAQAIAQIPMPEGPSVGLGM

SEQ ID NO: 947920 - protein, 111 aa, Homo sapiens
QSLVRARIGFNPSPAPLAPPNPRGCGGLLYGLFCGRPGPQGVSLSSPPGGPAPPFFPIKAPLGAGGGMGNTPPPFPPLFFGGPRVPLVLAPPPRGGKVSPRGPGTLNLVPF

SEQ ID NO: 947921 - protein, 101 aa, Homo sapiens
PPPPFFRGPPLVLNPPGGGGGGPPPPPGGGGGGGQKGALGPPIFFFPPRGGGGPPPPPPPPGGGGFWFFPPEKQGGAPLAPPPPRFFFFFLGGGGRGVFFF

SEQ ID NO: 947922 - protein, 32 aa, Homo sapiens
LRNPIDRISQKGLPKKSQKDRGGKREKPSRRK

SEQ ID NO: 947923 - protein, 112 aa, Homo sapiens
PHWFPRVPPKWAAQSKQPSFLFFGVPPLPFDPPFLGGGFSPPRGGGFFWKDSLPVALGAPPPRLFGFPPIFFPNFLWGGGVYPWGGVFPPVRVFWGLAPFGGGFFFFPPPLP

SEQ ID NO: 947924 - protein, 152 aa, Homo sapiens
MPLQMPKFGPLLSGPLVLSTKNLSHGPFFNRPPIPGVGFGGPVESHGDIGPPLDGEQGGCGGFPPFICLISPLGAPFGGGMVGRNPPFFIPFPFGEGGEKGGFPFPPFFPGPPPPPPSPPTQGPPFPCPLWAPLVFGICFPPRPRPLTSGEM

SEQ ID NO: 947925 - protein, 130 aa, Homo sapiens
KEKIVFGGPGNRSPVPDVRIPATRSVGKSFCAKVIKWFPAIFHGFKTWWHGVLAWVKERWWPWSIQGRPFGNSSKVFGVFCQRFLCPFSSPRRPPGGARRGFPPKSGLNPHPQNEEIDPPFALPVTGDPP

SEQ ID NO: 947926 - protein, 72 aa, Homo sapiens
ETPPRGPLSTGGGGGPFFFPPGPPKGLFGGSPPPRGGAKNSRIFRGAPPRGGGGPPPPQGNWGLFSPPPFPP

SEQ ID NO: 947927 - protein, 67 aa, Homo sapiens
QSTVPIVGIVLGAFLPVWYIETVVASVMCRGKSSGGKGGSYSKAACSDSAQGFYVFFQLEKPEPVVL

SEQ ID NO: 947928 - protein, 104 aa, Homo sapiens
LVGRGAGFPKMQRRPLPLSKPGAASSLGIGAPLVLRWASPPAPPWGAWGKPGQGTKSWGHVEHPPTHFLGGSPGPQVFPFVSPGGLCSLVRGGGDGGRRFFKGP

SEQ ID NO: 947929 - protein, 122 aa, Homo sapiens
GGAALNRGVNGKFKKGVFRIRAHGPWGGFLYYNTFSPGKFVKTKNGVGGFPRKPKEGGGGDGFIFRGFGKKKPPGGGPPQVFFSLFPRGKIGGGPMPKVTPGFGIPLPVPFELGGPFGGPKM

SEQ ID NO: 947930 - protein, 105 aa, Homo sapiens
GNFLHPPPGPQKAWVVRGFLPLAPSLGNPGPGCHPFVSKGDPVGFPLFFPPAGGLRGPPPWSKTPDFFGPSPLGGPEVLGPVFQEGGVSHFWVFLGKKNMIFVSL

SEQ ID NO: 947931 - protein, 129 aa, Homo sapiens
GPPPPPKWLKGATGWVPPPLPPGSSRDGAPFLFPPPKRGGKRGGQFFPPPPLKNWGGGPQGGPPKGFWGLFPPPKRGRKKGLWGPRFPPPPPPLKQGFLGPRAGGGGARENPPGGGVPPLGFFFKGPGG

SEQ ID NO: 947932 - protein, 152 aa, Homo sapiens
PQRQCFGFSGPPVRAIFGPPCVSPSFPLCRKGPLPRFGPWTGVSGTRMAQGLSLPATPPVWSPVPGLRFSQKHAELLSPFLRPRSPKSCISPRMSRPLLIKWATFWLDPPPPFAWNLGKKIVIMGLDGAPYALEGPPQSLLDSKSWIKEMPF

SEQ ID NO: 947933 - protein, 167 aa, Homo sapiens
RNTLFPKIISSGSAPEVVEGAPPHYPALEHFVDNSVFQRPRNLGELCQRLVRNVKNIQSKYVFVFLGLILYCVGTSPMLVALAVFLGACYIFYLGPLESKLVLFGQKVSPGHQYVLGGGISFPFFWVGGGGSPFFWVLGTPLVVLGPPLPFPQIEVVDGEELQMEPV

SEQ ID NO: 947934 - protein, 107 aa, Homo sapiens
GPCVFPPKQRGFFFSRPPPPENAFFLYPNRAFPVAKPQVVSKTKDTRSLFWGWGPPPEPLPPPQFKKKKFNIRGLGPFPLNPLGKKFFFSRVWPPQGGFPPRGAPFF

SEQ ID NO: 947935 - protein, 118 aa, Homo sapiens
KEGNDQMLTARQNQQLFVGMVPTNVDSRFDIPPCGLKMAVPFIGNSPPIQELFKGILEQFAMFPRKAFLPWYTGEGMDKMEFPEVESNMNALVFENHQYQDAPPKKEEDFGEEAKKEA

SEQ ID NO: 947936 - protein, 67 aa, Homo sapiens
GSHSSWLFALLHKIGRLLIEKVLGELKQEDLATDNVMVLDTGTRFLFGLERIFKKKKKQKPLLLNGT

SEQ ID NO: 947937 - protein, 124 aa, Homo sapiens
GAPSVTGKIGPDIQDNKCSWLVVQCLQRATPDQSQILKENYGQKEVLKVARVKALYKELDLPPVFFQYEEASSSPIFVFIEQYAAPLPPPVFLGLGGKFSKRRKCPKDCKGGERGFSINNRVPL

SEQ ID NO: 947938 - protein, 112 aa, Homo sapiens
VGVRLPPPKFHTPPLSRMEFFGPNHVVPQSRFWDFVSPLKNMKKFSGEIVYCGQVFKKSPLRVKNFGFWVGYNSRKGPPNMYREIRALPPPGVFTQCYQKMGARPRARAPSI

SEQ ID NO: 947939 - protein, 38 aa, Homo sapiens
VEYSSDRAPRVSPIGAYHCEQRGRRAEEGREKRRVLRP

SEQ ID NO: 947940 - protein, 98 aa, Homo sapiens
GSSKLPAQASCHTTVPVGPVVVFPGAGVFSLGAKEGAVGFLKEEGPQVLGGPGFIPGVGGSGGSKDFYTTRGQSGGSSARGWGGSYKNSFAGFVSPKG

SEQ ID NO: 947941 - protein, 54 aa, Homo sapiens
MRLRLPRRESLVCDVSRPLSPLLGFRESDSAKPGIVSPPTTHPEREKKLQDCRG

SEQ ID NO: 947942 - protein, 122 aa, Homo sapiens
RGFFYPFPPATIFNNMAKISEAPKTVEQLKLEVTLARIKVFQAPAEFLAFLETHAKNYPLVTPVPPGENPFRDKGLFFVLFEPSGQVSLPCPSMDPINLVTLVGPVLLGGFRPAQSLGPPLG

SEQ ID NO: 947943 - protein, 181 aa, Homo sapiens
TPVPPAHPLGDARFETHSGAVGWPWRLWTQARISRPPLTMVWFAACSGTGQGLVAHFLAPPNQGKKEEFWTGGPWSQMAKGCQLPFLCGLCPVPLEKMDAQRASPPGLGSRNRQQKLGALGPWGVVPLKPTLALAPNCFFSFLGLSSLALSPPSTQVSCSKHSPLPLPFSPPIAAPPGLLV

SEQ ID NO: 947944 - protein, 61 aa, Homo sapiens
QQHRVSALRTRGLRGSGPETGSPLGSTERAFNELSENFFLNYKNAKLNKAPNLLEIKYELA

SEQ ID NO: 947945 - protein, 97 aa, Homo sapiens
TSQPSQPGVCQCRISDPSTSRKDHRVTKMCASSCDFVKRHFFSDNLMGFINFGILKVHVDSCKKDFCNGAAGAGHSPWALAGGFLFSLGPALLWGGP

SEQ ID NO: 947946 - protein, 108 aa, Homo sapiens
MRPIKLQDQARRSRCVRDLVHSLPATNHDTLRMLFQHFCRVIEHGEQTRMSVQSVANVFGPTLMRPEVEETSMPMTMVYQNQVVELIMQQCAEIFPPHCLLACDWGGG

SEQ ID NO: 947947 - protein, 88 aa, Homo sapiens
GARLVEVPPDRCRFLLAPCADLAEDTNGRNSQGIPIRIGDGGGTTGGRALKLSPEAEAVTGAAQMPSDKTIGGGDDYFKIFFSEKGDG

SEQ ID NO: 947948 - protein, 114 aa, Homo sapiens
PSYPGTLCPAPEKAPFFFFIYEVEPSRTKPFPRKKLGDRKAQRPMLEFLTQDGFQPNPQVKVIAPPNRVDFLDPPLLRWGPLARKIKFPMPNEEARAKFMQFPSRKMNVSPDVN

SEQ ID NO: 947949 - protein, 121 aa, Homo sapiens
MAWTISRPDAVAYPIMQPVPFLSNNKKEGVLAWEETVAREKASRGTYQETSVLVSSRTPKGGAIEGHLTFGQENGPLHLGNVVHSRRISLAVVGPRMKNAEDSLSIRRDLSALHASTRFEK

SEQ ID NO: 947950 - protein, 44 aa, Homo sapiens
CGLRGRAGSIQLRPGGPAADQMVGVETRLLTPPCMQRHMEAVRP

SEQ ID NO: 947951 - protein, 70 aa, Homo sapiens
GQDPFLNPSNPPWTPANGGKSPRKFSHSFIATKAQKNLLIGTATCLAGVYVCRDERSDKSVSVEKEIRDG

SEQ ID NO: 947952 - protein, 130 aa, Homo sapiens
LGTGRRTDGRRGPYPSPRAMAERKQSGKAAEDEEVPAFFKNLGSGSPKPRQKFCGMFCPVEGSSENKTIDFDSLSVGRGSGQVVAQRDVAHLGPDPQPPYSRQGRRAGGEPSVESGRKVEIRRASGKEAL

SEQ ID NO: 947953 - protein, 60 aa, Homo sapiens
CREVIQKTGKHESLVDAPEAQLLLEERPEHVCGAVQLTGAVVNEHIGEDARVPIEEELAT

SEQ ID NO: 947954 - protein, 140 aa, Homo sapiens
MSKRERGGSFGAKFRISLGFRVGAVINCADNTGAKNLYIISVKGIKGRLNKFPAVGVGKMVMATVKKGKPEFRKKVHPPVVICQRKSSRKKKGVFFFFENKAGVIVTNKGEMKGFAITGPVAKECANLGPRIASNVGSIA

SEQ ID NO: 947955 - protein, 89 aa, Homo sapiens
MTHRNPQKDHVEGVAQQQRESHELSRQERCLQSEQSEEVDPHPRTAAVPHVHQHEREGLPQEEQPAQEAQEDQKDAPDEKHEDEDGRAA

SEQ ID NO: 947956 - protein, 102 aa, Homo sapiens
MLSRVHTERDRGRGIRREREVGPESARPRLHRRLEEELGFAGLGREMPLDPRREQTRVAGGRATGRGPQCAEAWRERSRTAEVHSCAHTVQGHPSLTDFVRP

SEQ ID NO: 947957 - protein, 69 aa, Homo sapiens
KNPGAGPPPGFFPRPGGGIPFSPGNRFAPWAPFGAPKKPGWPKKPGGAGPGFPGIWPPPGPAHLGQKGN

SEQ ID NO: 947958 - protein, 106 aa, Homo sapiens
RGLSLGPMAPGKVLHQQDPFEGLQGFPRSPPLRAPQCPSSLLGLVPSPPQGLGLLGAKGPLVFSSLTIPDQGHPRPLVICKNFYWPQFSSELGGPFGSPSSVITWG

SEQ ID NO: 947959 - protein, 103 aa, Homo sapiens
FFPSRSGDRMLAFWDSGPQRFRPGPSWPFRLFGVLGPGVPVFLPALRELFSLGTPCNFPFRIPGQGKAGCFRPTNFLTCFVFCHPCFFFKNTLPSPPATPLSV

SEQ ID NO: 947960 - protein, 181 aa, Homo sapiens
WLLLGRIGAEWGTKGLFAGFLPGIKRGAPSWAIMISTYGFGKRFFQRLNQARLLGGLKGQGGKDPVFPPDGERAGGNPPKGLFLSLKGGGLFPFPPGDKVQGRGVPLGGPAFPQTKFFPGGPVGGIIIYPPPKFKTKFSRGPLWVSLGLGEGGMFPGTKKPPPGGVSLPLVNSLSLKMMNF

SEQ ID NO: 947961 - protein, 181 aa, Homo sapiens
QTFSICYPKTGLLGAHFVCDRMKIDDMMFVLQGQWMGLCTSAPESEVARGKNILKNALVFYLNGTTPVCEDIGSSLLTYGPRIPLVNGKAGLRRWMPVWYVKFVPSTFMTSAHQWLDMAPFNSSQITTGSVGACFGWVFRGEAYVSKRAGPGFVVPPPPQTQHLGSFNLCPRCPPIKSFVE

SEQ ID NO: 947962 - protein, 131 aa, Homo sapiens
MRPPGFQLRGGRCALARVFGKLAVHGAKHGVEDFSVSQTMLEEVFLYFSKDQGKDEDPQKQKEAGVGVDPGPGLQHPKRVSQFLDDPSTAENVFLASLPGAAGRPWEWQGQGKVPRSPGLRLAKGVVPWRK

SEQ ID NO: 947963 - protein, 190 aa, Homo sapiens
MWFSWAFNPVEFWCLLYCGGGVCVSVGVPLGEKEKGFLYGVLGIKVNHRRGEVWALYQELLCSGRLVFLAFGARRLLVGHHPWDRLLGHCERHLPNGGCGWRTVDPIEPKPRERPQIGGTIKKPPHENPPPGPPAEARKKPSKEEVAAAGGGPPGGPQVNPIPVTEEVVDLAPDLPSRQVHPPAINAGKP

SEQ ID NO: 947964 - protein, 175 aa, Homo sapiens
MPSHNGHKEIIGLNDPGLPLKSTMGSDLSPDMRVFMRCFVLRALITDLYIHAPNEWTFLRIRYKKDDFMDAAKLRLFIECDLESIRICHSVGYLLSFLNVVPAKNVNANHVCGLSHGRRLEPTHTSTVTCVGWRLYSLTNGTAVCSNLIQSCRALYAHYQVLDHELARSPARAMF

SEQ ID NO: 947965 - protein, 37 aa, Homo sapiens
HRGKLETARARAEKVTGELSDLTVQIDELQEQTRDAR

SEQ ID NO: 947966 - protein, 120 aa, Homo sapiens
GLVVVHAEVGTTSKYFVSSGSIAVNADSSVQLLAQKARYLLDMLDLGAAKANLEKAQAELVGTADEATRAEIQIRIEANEALVKALEEASQPPRLTSVWEPPLDELPPAPAPLKTRKHEK

SEQ ID NO: 947967 - protein, 108 aa, Homo sapiens
GGGPPPPPPPFLRGARGPGLGPRGGGGVPPPPPPPPRGGAGFFKGGERDPKFFFFFFPPGNKGGFFFLGPPPLFLGGGGFPKKGGFFFPLFFPPPPGFFFFFWVFLGG

SEQ ID NO: 947968 - protein, 106 aa, Homo sapiens
LRPPRVIFWKLWVCRGGLGEGPSLGGLILDFEPLPRGKRQVVFRQMKKAQFGEWGGVLHAHGGRGVGVLGPVLKPMVWPHGWHGRVGVGVGPPKMFWGGLPMGTLS

SEQ ID NO: 947969 - protein, 103 aa, Homo sapiens
LIFSTQPGLGVQGCCPLQGSSPLHLFCGSQTLGANESCLKRELVARQLGTGQWDRAWPGGHSDPWLFNAGCIRTFVTLAVCFVCSLFVLCGCSFFFPLRNCIS

SEQ ID NO: 947970 - protein, 124 aa, Homo sapiens
FTSSSRTVPTEVCPTSVAEGRHNTPWAATRWAKKIEARERKAEMTDFDRFKVMKAKKMRHRIIKNEVKELQKSALLKASPKKAPGTWVLLLLVLLQRLLIVVKVPAKKVPSASEKAPAHKVPAL

SEQ ID NO: 947971 - protein, 90 aa, Homo sapiens
GPMQLTLGGAPVGAGPVLAASLFWACAVGLYMGQLELDVELVPEDDGTASAEGLDEGGSAATRVSDTAVGLGRRWTGPEDWDIKPALPSS

SEQ ID NO: 947972 - protein, 65 aa, Homo sapiens
YRFLVMFATNREYTALHWGLRISGPPREVGPARSLGVWHVPTGSAGPFYGVIGCFLLYFIKKGSH

SEQ ID NO: 947973 - protein, 45 aa, Homo sapiens
MDSQPYSNRGTKKEELVPFLLKLFQTIEKEGLLSNSFYHISIILI

SEQ ID NO: 947974 - protein, 100 aa, Homo sapiens
APAKVALALSPGVPPGVFGKKGPLWPPPARQARVPPWVSKALGPRPPFVLAWAPHLRGGLAFGVPPLLCEVPCGCHHGFRDLGQRERGGPGCVDIKSALL

SEQ ID NO: 947975 - protein, 67 aa, Homo sapiens
LLCVPHWRRLLNALFSRAPPLEDTEGHYLCYVAPAFFQWGGGRPILPSPPTTRTPFFCPLGNNKPNQ

SEQ ID NO: 947976 - protein, 108 aa, Homo sapiens
GGGGPLGSPPPPPGGFFHPPPPRFFSPGGPGPPPPPLGFFGGGAPPPGERVFPPPFFFSRGGGVPPPNYRPGGGGVPPPFPPGGGGGGPPGVFFFFGGFFFNYPGGGP

SEQ ID NO: 947977 - protein, 105 aa, Homo sapiens
HALGLFLNIEVTRLPKKAGFFPPSPESPYTPLKQRVFYMEGLPFPEDGRGDFLGTIGMRPNAQEQPGLGFPPSTGLQGPAVGVVLLPRIPDGLRPGFPPLHKPRG

SEQ ID NO: 947978 - protein, 139 aa, Homo sapiens
CAPPAAGQQQPPREPPAAPGAWRQQIQWENNGQVFSLMSLGSQYQRQRRRDPGAAVPGAANASAQQRRTLIVLSRDNRTTEALKVDDRLIWSHRSLPQAHRPCNGSKLATRHLEPEKVAHLRAETLTAPRKVHALSNLR

SEQ ID NO: 947979 - protein, 39 aa, Homo sapiens
TSAVRISSASVLHDRIRDDWDRPILFLSLNPDIITGFPS

SEQ ID NO: 947980 - protein, 31 aa, Homo sapiens
MEGGDTGVHEDMRRPWAAASYCLSTMSVSAA

SEQ ID NO: 947981 - protein, 147 aa, Homo sapiens
LAGLNRSQFSNQQGLEEHAHKIEILMEATEGNRGVFSAIVSDEALTPWVPLCPATDVVDAPRDDHPIVTGLVVRADFSQQKVGSGAPECADPSRGPGSPTPPMLHARVMGIPGGGRGPSKTPREAKSAPGHRLRRRPLHRPRPTAAA

SEQ ID NO: 947982 - protein, 40 aa, Homo sapiens
IHISITTFIPQTPIERLLMRLYPSASVRPRQPCENTISAA

SEQ ID NO: 947983 - protein, 95 aa, Homo sapiens
CVGRSVVAADIRGLVCIGGHHIVVVLVRAETRTQIRLSTLQRLHERITHLTLEQTRRLMGGTVAPAGAGVEFASSSTVCHAEGIILGLRTEVQAA

SEQ ID NO: 947984 - protein, 71 aa, Homo sapiens
CRERTVIPQNPEMEEEEEEQEGHGGAGDSPAEAAPVTTMSEKQPAHASGVTAPHGAVLFWARHEIPSYRCG

SEQ ID NO: 947985 - protein, 34 aa, Homo sapiens
MPALFSRAGPGAGICLGLLRGGSGDVGGMDCHAA

SEQ ID NO: 947986 - protein, 75 aa, Homo sapiens
MSKNVDDMLKPPGRETIPERIVLIMRGLPGSRTTHLAKLFRAKEAEFGRPSPRGLILHAYFTTQVENEEKEPVSG

SEQ ID NO: 947987 - protein, 35 aa, Homo sapiens
LPTYVVLALVVVALEKVVCLVQRIKGPRPSAARVR

SEQ ID NO: 947988 - protein, 46 aa, Homo sapiens
MASLSVLSRPYRTTRCVGRCRTRACTAMLSGGASFPEKENKKFIID

SEQ ID NO: 947989 - protein, 59 aa, Homo sapiens
SDLGWGRTWGVQNNIVTTRYLAFRGGCETDLDPMPEIRWRMHNNQMTVGSTIGWGPTPL

SEQ ID NO: 947990 - protein, 43 aa, Homo sapiens
VEEAPDLGQLKVREVRAPLRSVTWVMVRNVLLHVKRDVVGKAA

SEQ ID NO: 947991 - protein, 80 aa, Homo sapiens
GCPSRDRRDVPCAPKESGTGYPDQSHCGHGAPELCSMMPRDPTSGCCHLKHSTDRSDKWVPRPNRMCSRMVGVGTVTLRI

SEQ ID NO: 947992 - protein, 78 aa, Homo sapiens
ASASHRFLKPQLPGVGPLLGVALQEQGKLTHRELDGCVNGTASRRYLEEGKGNEMNEMNPCTAREHLHPDTLLQGEGR

SEQ ID NO: 947993 - protein, 89 aa, Homo sapiens
MVLEMGFTGMPTDKFIASTVWKNDALCKPQHHPTRDQHDTLFNREPTEALQLPMATVQRVKRTHSQGGDGSQGYKYKWKLDEDRKNVCG

SEQ ID NO: 947994 - protein, 91 aa, Homo sapiens
LQPEEDDDEDEEDDDDSSQAYDSSERDFSLIDDHMILANSDTSEVNDEEAPAWAPFNRRLLYFHVIWPMDYGNVGGAGEMCRSPGLQEVER

SEQ ID NO: 947995 - protein, 123 aa, Homo sapiens
PYPGVCLTGGGGPFFLKTKRGYSVGPCFFQKIPGGPGGPTGRAKPGGPLARGIKVSPPPPGPPGGPGGVGGPLPKNLFGGPIKKLGPKKKPAKKGALRRLRGVFFPLPRGPPLFFVPPPPLCF

SEQ ID NO: 947996 - protein, 97 aa, Homo sapiens
FAVRWSPVRPLVFAAAFGKGDGQLFDFQKSSQKPPVLIKQTQDESPVYCLEFNSQQTQFLVAGDAQGPVKVGLAQSFREQGPREVEDLDCLATKVAA

SEQ ID NO: 947997 - protein, 132 aa, Homo sapiens
KFHIHAIGIGKCKRRIVKCGKLHKKGRKLCVYAFKGETIKDALCKDGRFLSFLENDDWKLIGPNDPIEESTQPVYEVEARSFQVEVEKRMVPSAAAWQNPESEKRSTCVLRGQIVAQHPSLKSASETIIGIF

SEQ ID NO: 947998 - protein, 100 aa, Homo sapiens
DARDLCAKETKMLMVSGDKDGDGKIGVDEISTLVGESEEALTAHGVAPACREHPIAARFATLVHLCSVGEGSFVLPHPLWPSNVTICVEIVGEAIRVGPV

SEQ ID NO: 947999 - protein, 48 aa, Homo sapiens
LVSGRELNGQVAQIVLRESVEAEVMVKGDPAAAPRHSGALPKRGALRP

SEQ ID NO: 948000 - protein, 55 aa, Homo sapiens
CCSMRSDRTMEMEFEDGEVSKGAARVSRKRFHTAPIILASIIRHQSSSDLKGWRP

SEQ ID NO: 948001 - protein, 51 aa, Homo sapiens
ASSTDAPTLGQGRQCACERPFARQPVAGPQGEAQARMAPGRAVTGLLWLAA

SEQ ID NO: 948002 - protein, 33 aa, Homo sapiens
PVLMVHRAHCLHGQMTHGLAPSLPGASVGKLGA

SEQ ID NO: 948003 - protein, 68 aa, Homo sapiens
SDCPQCFIIRMHGCVLVPVDPGIFVCPLEQVWSVTVCHHRGVVRNGRVRQPGAVVLNLTIKLFSPRKE

SEQ ID NO: 948004 - protein, 34 aa, Homo sapiens
THIRTLLCYIHVTRTQIGPFNTFRTDICGMKKGV

SEQ ID NO: 948005 - protein, 102 aa, Homo sapiens
WKPPSNFCTAPQNAPTLELELDVKGQAWKLSTSVPGVSKSDLGSAKPPEIAREVGGICDCLEGWGCALPRNLQHPDPQLMEKHGAESRTRNPAQTPVPWLEF

SEQ ID NO: 948006 - protein, 52 aa, Homo sapiens
LWRSNIFRDKPRRSPLVKGRQVLELLQLLRVVSPPLMLPTSLQLLLRRLTRP

SEQ ID NO: 948007 - protein, 106 aa, Homo sapiens
PFGGFGFHQGQVDAPFFRFSLGGFLAPKKFGPFLLGKVGAFFPLGVPNPWAHGAPFGLGFFGGGVGAPPSHARVFPCPPWAPGFGLGGLSPRGGFGAGLLKIWGLP

SEQ ID NO: 948008 - protein, 32 aa, Homo sapiens
EPGSPDGVFPRPGGKFWENSGPPFLEKLPGGP

SEQ ID NO: 948009 - protein, 68 aa, Homo sapiens
KKGGPPGGGGEAPLIKGGEPPGPRPPNFGVFFPPGPPGPKGGGFFLKTGAPQKKKRGGRKWFTFGPQK

SEQ ID NO: 948010 - protein, 82 aa, Homo sapiens
IIGAVGIGIPVVMIFGMIQNDLVLCYPQDPRNGLESAYIPEQESLPMKIGGIFGWFVLFGWLFVVCFFAPNFSIHSALLDKS

SEQ ID NO: 948011 - protein, 153 aa, Homo sapiens
KGEPENHGGSPFPPPGVGLPKTGSPSLCVLRVFFPTHFPWVGGAVGRGGKIPNPPLPGGVPGVFFFFKRSSPGPKAGGRGGVFFFFLFGLGFCPPPPRKRPFPFFGGKGGGGGEPPLPRVFWFGGGGLGGPPFYFFRGARGGIYSPPGSLGPP

SEQ ID NO: 948012 - protein, 115 aa, Homo sapiens
AGKWCPQKNKKFVESINFRPHLVIKSGKYVLGPHTPLKMISQGKGKLVIFAHPGPALGKFEKGYAMWAKGVPPPRGKNIERGPAWGKNSRGGPRAFIDPGGFALFRGRPDQTGEK

SEQ ID NO: 948013 - protein, 111 aa, Homo sapiens
MKIHSVKGQRCPDHTPKSSKPASRTWSRRAGGSVNIRGTLLILGPSSTSCGSITKDSRTRLISQTWEHCHCHSGAYMDKTKLAWLFGPGVPFPRILRAFCGNLSLKVKNNS

SEQ ID NO: 948014 - protein, 216 aa, Homo sapiens
SSHDNVGFVTQDAGTSAKAAISDSATRSLSPDVDPVLAFQREGFGRQSMSEKRTKQFSDASQLDFVQTRKSKSMDLGIADETKLKTVDDQKAGSPSRYVGPSMGLKKSSSLESEQTSVAKVTLYGDIPFHRPRPRIIKGRGCNDSSSDTSDKRYEIPSVIHNNQRPEGLTITLRVKNAARAVVCMPTAVGNPPALKRILEIQNESQVPTAIVQPLT

SEQ ID NO: 948015 - protein, 78 aa, Homo sapiens
DPARGGRDRKAPGARFKEERQTQRFKPQPGVPPRPRADLIFNRCRKSPKRKLGFPVLRLEGSPQLGFRPLPPRACKNV

SEQ ID NO: 948016 - protein, 146 aa, Homo sapiens
QGGGPPFRGGLIRAKLSMAPWAKGWGNKIGSPTLSPCKVTGRCGCVLVRLIPAPRGNGIVSAPVPKKLLMMGGIDYPSARGCTAPLGNFAKAPFDAIFKTYSSLPPPLWKETVFPKFPHQEFLDPLVKTPPKVSGQGTQAPAGGPT

SEQ ID NO: 948017 - protein, 43 aa, Homo sapiens
LPCELSILYSSSPDTAGPTGKVKAPLLSSKFSSREDPPGPLSG

SEQ ID NO: 948018 - protein, 37 aa, Homo sapiens
SLVGLDLLANVLPVGAAQESSVSLPPAGSVQTSPGST

SEQ ID NO: 948019 - protein, 41 aa, Homo sapiens
MKFLSVLALGGAVSAVALPGDDWKTWQSCAKETQYVTVTVT

SEQ ID NO: 948020 - protein, 39 aa, Homo sapiens
TPGPRNFPEGVLTLNSAPYPRNDSGSRSLPPWASRDGGR

SEQ ID NO: 948021 - protein, 47 aa, Homo sapiens
GHRRAAETVRSPSDIMRTALIVYLDASKLTSPHMHALQGSHAGDSMN

SEQ ID NO: 948022 - protein, 104 aa, Homo sapiens
DSNPDHTAKFGLTQEFNTTPRLQPELPGYVDTPTPTNNNTNSSPSGSPTSLPSNGTTNGNGTSPSGTPSSTPAGEGAGSITSVSMVNACAIALSMVFAVATWAV

SEQ ID NO: 948023 - protein, 63 aa, Homo sapiens
LPMEVEKNNTPSEPGSGRRPPQEEEEDEDEEEEGLTKKMLRPQASENMRACSHPMFQEEPPPC

SEQ ID NO: 948024 - protein, 114 aa, Homo sapiens
MGYVELMEMVEVELRELSMAQSHPGWDSCSASRGMSRNLTAEALCDRQDQLTARSVQVPGGILAGCEVSGGSRPSPLSLQITLSGSYGEEALDQAGDDHVPIWLGGCKKVSRKT

SEQ ID NO: 948025 - protein, 83 aa, Homo sapiens
FSIKLYTDLRKAKPFLNYSSQFPNPPVLLTKNILCSCGKIMDFCPGSCNSQLNSTVAIFRQLPSKKHSYQFSFEDAISDELPL

SEQ ID NO: 948026 - protein, 113 aa, Homo sapiens
SSGRLSGMRQGDHLKPGIQSSPGNSETLSLQTKKKKKKKNRGTAGGSSLLYFIRGRAKGGKPKISLNYLGMWRGGLAPGSPGGLAPTVPTQPVGKPKRKKTPCSILTQKPNKN

SEQ ID NO: 948027 - protein, 120 aa, Homo sapiens
EHIHLQFRNTSQFGNQCRPVRTSYSLLNKGSAKDSAILSIYYNAKGNTENLILLSINTLSSVAEFCKLISESSGRSVKPPSGAQVLRVRHKHRPVDGPLVPILMPLACQYLGNKFPFNTI

SEQ ID NO: 948028 - protein, 113 aa, Homo sapiens
KIFRGKGTRPPPFRRSVRLRVFRMKCHCAFSDKKISDKQTMNGCSFLPIPLFSSWRLRDWRIFGIVNVHCVELNPLCVRQDASGPWWPGGQTRGQVGHGPWPAGTCWGKRARK

SEQ ID NO: 948029 - protein, 53 aa, Homo sapiens
MVDTSRLQCDMLYKYTAAYLLAPSWAMFPDLSARQHKQYRHPSPYSAMELLLI

SEQ ID NO: 948030 - protein, 46 aa, Homo sapiens
GILITRKLCHNSREGNTVRQPRSFLATHKSSRFLGFRLVNSGATAS

SEQ ID NO: 948031 - protein, 152 aa, Homo sapiens
NRQVNIMPYELIRVLTAAQPWRGRALTTSMPASWIGYRQQNAYIANTGASGESTEDFWRMLWEAQNHHKRHANQATGNGQGEMPPAQASKALCSLTSTIVVHPMAEYNMPQYILREYKVTDSRDGQSRTIRQFQFTDRPEQGVPNTGEGFID

SEQ ID NO: 948032 - protein, 56 aa, Homo sapiens
MSGWIPPSSPFSTSHPEVMSMLAMAHSESLQDTQDAVERFTNVALDADAKDEALPG

SEQ ID NO: 948033 - protein, 139 aa, Homo sapiens
KYTFRQPLTDDRRPSVLDDLRPAASRPEAAAASIDSNVIWFLSDSASNLNVGEDDQLVRGRGSGSVQLADLGLPGDSHVQRVYDLDRVTVADHGDELPMTPATGGLLLGLRWLRYVTEQVEIFGSHHLTSELISIGHRV

SEQ ID NO: 948034 - protein, 126 aa, Homo sapiens
YCQNLICMNLSHSAETVIWFGGAESNLARLANALERVTHDFRCNALKCDCDGIFFKNFFGRFDGNDGVKLRSGDEPVIGSEGDHRSPRRFPINRFALSTFRPRPVGCQGPSRRTFGAGAGALMLIG

SEQ ID NO: 948035 - protein, 40 aa, Homo sapiens
CPSREPLAGLYLEGGLFPIGATQSGTGAWAAIQSQPGVEG

SEQ ID NO: 948036 - protein, 160 aa, Homo sapiens
EGPPGADHRMAMERKLTELIRQAGGVIPEERGGDPTPSPFVPHHDATAQPTPSQPTVINDDTVPIDDIEDPLGSIDVWDEIDQQVAAEGHFMQSVYSLLVRMGVDPHGLVGGYDDEETGGHVSLAIPSSQVGISVEGDRPQPLIDAGWYIVPMQIGQLEA

SEQ ID NO: 948037 - protein, 69 aa, Homo sapiens
MTKCGVRTFDVRAALIGLDVANGCVRLMLRGVTPLVRPDDVLRALATRCPAVDAARVTRLAQGACNEGE

SEQ ID NO: 948038 - protein, 136 aa, Homo sapiens
TTAIHGGDEVVRSIIDGDRDQDENGGGDEGLTMLRWDCGETYAAVESLLIRCEQRPILHWDSFANCLIVVYTQEAGLSTDALSQLETGSCLLLRRWLLFPDDALHLAQSHDPVQIRESVPPATADRVLLRLGVPSS

SEQ ID NO: 948039 - protein, 69 aa, Homo sapiens
MKMCTTYELPRRRLMKFVNKLLANLTDARSGDLDDRIINTLTRIVPSLEFVACGSIFVPPSLKLGNPKY

SEQ ID NO: 948040 - protein, 108 aa, Homo sapiens
SGGNQSGDEIVLDHREPPILRLAQMVRFAFRDRFEIDLPVLRRFRIDRGTRIRMYAENLLLFGGFIVTQEVIVRGQRAATVDPVTDVYQIGATRKRKVFRTVRPSAVE

SEQ ID NO: 948041 - protein, 59 aa, Homo sapiens
LNNQLFAPGWRLSWGKGSSGVLMSQALRRSIRSCSPSNQNFEIASQPFNKQYPQKAQII

SEQ ID NO: 948042 - protein, 35 aa, Homo sapiens
MPDSPPLAVPPDAHGVVHPGLLLLHHLGASLLRRV

SEQ ID NO: 948043 - protein, 37 aa, Homo sapiens
MAMPDRPTLPFRQMHTVVVHPGLLLLHHLGRLPPAEV

SEQ ID NO: 948044 - protein, 69 aa, Homo sapiens
LNVTHSKLTTHQYTKILCSIDSNNQLFAPVSVRLELGAKVQQRDVLSEPMPFSTQAYRKLAAPQLTRYF

SEQ ID NO: 948045 - protein, 61 aa, Homo sapiens
MGIVREAAELLNHLDTLPCESNNLAPMYELNGVTLDGRIQNVKLQTVNAGGNGHWSRTRSK

SEQ ID NO: 948046 - protein, 113 aa, Homo sapiens
FFGPCHLSKGLLGVNAIQLDFLIHGEAAPGGLRLLLPCLLSGRQVLDMVQLRQVVVTPIHISWERKVFARHNTFMSSYTHRGGNCTLANWVNTLVANILRPLPAANALYNRCS

SEQ ID NO: 948047 - protein, 50 aa, Homo sapiens
SLKEEQCAVKLAGSASPGWVLPFTAVWLYLSSNSVCVARAAEGGITIAIT

SEQ ID NO: 948048 - protein, 50 aa, Homo sapiens
GVVALTFRKQTIDFLNDNIRRVIENYYDDLDFTNIMDLVQKKSSAGGGED

SEQ ID NO: 948049 - protein, 40 aa, Homo sapiens
PFHQHLSCPCHMQPQLRHLGSGVSKTGKVLPCGACLLPAD

SEQ ID NO: 948050 - protein, 67 aa, Homo sapiens
TTPPPEAAATAAAAAEHAAFSCPATPSARSMVTKRISCGSTGSSSWELRMLSPSMQSSGLRDPETPI

SEQ ID NO: 948051 - protein, 48 aa, Homo sapiens
SLCKTDVILDREKNPEPWETVDPSVPQKLITINQQWKPIEELAKCPKG

SEQ ID NO: 948052 - protein, 54 aa, Homo sapiens
SYKVSSVLTRKGKCDYWIRTFVPGCQPGEYTLGNIKSNPGLTSYLVRVANTTNT

SEQ ID NO: 948053 - protein, 96 aa, Homo sapiens
VDNWSANYGRWQVRGTLSDHFIRFIRMLRHIRLVRIITDIDIIRVVRVNGVLAVHMVIILFIIHIIHVVIAFAGFKWKGLLFKVIGFFRGHSILWG

SEQ ID NO: 948054 - protein, 160 aa, Homo sapiens
LRGRTPVPTVLTESIVFTPLRMNADDNGHERLGDERDGKGLRRPEVHRSGNQHRTNHASYHSSPHNQRQGPGPAFGRNAIRCGKTKAERDRRIGTAHKCSNAEQQEEPMKTARAAVSPVMTPAPVPTIKAALRPFVRASEPNGKIQAAIPRNNMVMGRVA

SEQ ID NO: 948055 - protein, 72 aa, Homo sapiens
RRGNDSENGQLVGGRKVPRIKQTKKQEGGYQKKKRGTRGQNHGIKNPQAIITLYSCDPASSVPYSSVCFFTF

SEQ ID NO: 948056 - protein, 112 aa, Homo sapiens
LKPALSLSSCTWLTTNFYSTGPVTLAAWIGLVEGEEPLPPSGKERSQENHTECRTLCGHLDHYLLPPWCTKWPVSQYKAHLQRQGIQHPILSQVQHACADDRTQIKDSTVVA

SEQ ID NO: 948057 - protein, 82 aa, Homo sapiens
MPCSLHTTHFPASSTTSGHSEKSTIYKSSPDASGTTPSSAHSTTSGRGESATSRISPGSTEITTLPGSTTTPGLSEVSNHLL

SEQ ID NO: 948058 - protein, 67 aa, Homo sapiens
DRPYTPQSPVSGRDVAARCASGADVVVGRGLRRAGRVFALIPELGVLALKAGRVLAYLGLAAALAAC

SEQ ID NO: 948059 - protein, 46 aa, Homo sapiens
VGTQHTVHEAASRDTIPLRVQRGEVTYKNVKINVWDVGGQDKIRPL

SEQ ID NO: 948060 - protein, 116 aa, Homo sapiens
GRKKVGRTHQPKVRGGNLGKQVQPQPQKGWESRADQQKEKLALIAFQAGRVFRPFLPFSEVSPPAGDVPRHSAPLALAQGACDVISKASALSSDTQPCPAGPGAQALFTEPGRGGG

SEQ ID NO: 948061 - protein, 140 aa, Homo sapiens
GFGRGPFVVQRVRHRFGGGVADRAEQWRQTRRRSRRPREVGGRGSLVRSFRRREPGALVPQPVAVCRGGREVGCAVGQDDAVDVERGDRGHLAVADVGGDAFGFAVQRVADSAAALPMGEVDVRFGEVGFQVRREGVRAA

SEQ ID NO: 948062 - protein, 32 aa, Homo sapiens
MGWPGGLLGPSKVGFHPLGRRQLPKKIYFLHG

SEQ ID NO: 948063 - protein, 175 aa, Homo sapiens
LFKDVKNAGALRRKALEGPLDGSLINPPGIVDPFQKLGAANKAVPLFKVGKMKPRTLFGIIFPPSPKNKISGGLKKFGISAKAPSILIVSLEGGENPINQETPIFQGEGPRGFLKNLPEKMNIPGGQKKNKLFSQKERIGPFIGGYPLEKGPQKCFMKGPKNYPKFSALKKTLIF

SEQ ID NO: 948064 - protein, 109 aa, Homo sapiens
YRSLINAKRALCFEFPPTGMLLEGKKPALVFGMQNCSIQQRPTSGYAGGLSSAYGGLTSPGLYSLGSPFGFGGGSSSFNRPSSSRAVVVKKIKTRDGKLVFESFYVLPK

SEQ ID NO: 948065 - protein, 53 aa, Homo sapiens
APLTLTKLDERLTYMVRAVVCANCHYMLTLTDMGSSVIEVYRLDLVRSRDEGG

SEQ ID NO: 948066 - protein, 33 aa, Homo sapiens
LLLTIVAAKQDDSHLQSSPRFCLLTPWIPVEEG

SEQ ID NO: 948067 - protein, 51 aa, Homo sapiens
DSISSSDVSISSRDVSISSSEVSISSSEVSISSSEVSILSSDVSISSCDIS

SEQ ID NO: 948068 - protein, 36 aa, Homo sapiens
GDSRDPLETLTELMHPGLGTLQKLFDLIEACYCWMG

SEQ ID NO: 948069 - protein, 64 aa, Homo sapiens
LTLAGPQMSKKFEMTTAPKAESNTTRRKKRRKKTRLQLLRNHIEELKCSGTQFLDNAQPTDSFQ

SEQ ID NO: 948070 - protein, 29 aa, Homo sapiens
MEPLGLTPTNNLNRFVSGCYPAVSGGTRA

SEQ ID NO: 948071 - protein, 34 aa, Homo sapiens
SEQDPRFLAEYLSYDSSDPCPVQFTCRTGRCIRK

SEQ ID NO: 948072 - protein, 33 aa, Homo sapiens
LTAACVATHSLSQPQPGPQKALKPVGGGFFQRD

SEQ ID NO: 948073 - protein, 46 aa, Homo sapiens
KPVCRKGGGPRRLCDLPGTLQRKSNNGPHSSMGATPEVHPMGRGTE

SEQ ID NO: 948074 - protein, 80 aa, Homo sapiens
TVRCSSSIHRSPQVEKCIHLIINLRNRLKYALTGDEVKKICMQRFIKIDDKVRTDITYPARYMDVISIDKTGEKFRLIYD

SEQ ID NO: 948075 - protein, 68 aa, Homo sapiens
LRCFGGSYLDPALAALGIPGANLNSQSLAADQLLKLMSTRDPKLNHVAAGLDITKSEIGYLKGYRDSK

SEQ ID NO: 948076 - protein, 140 aa, Homo sapiens
TKESNSCLETDYRSCPRGSTLLAASRMRDEGSVLDQKATEDTMWQRSPCGETYANNRLMEKLGKSGCPLTPFPYPFKHPHGDKGLIVKSCYKHSLLKCKEKPRGTTSISFGCFTPERGSRGKSSLLIKIQVMLTLLLTFG

SEQ ID NO: 948077 - protein, 138 aa, Homo sapiens
PKTFTHRDLENRLWIMPQVSKLLAASRRGMKGPVLDQKAQGGDVAKKLLVGRPCIEQASGKAREKWLPAFPLSLPFKHRKNLGFIIKSCYKNSLLNVKRSPGVLQAFLRMLHSRKRESRQVLITNKNQVRLTLLLTLG

SEQ ID NO: 948078 - protein, 122 aa, Homo sapiens
MSRTIYAGMYTGGLVTIANNWNQPKCPSIIHWIKKMWHIYTMEYYAAIKTDRVHVHCRDMDEAGNHHSEKTITRTEHQTPHVLNHRWEFNNENIWTQCREHHTPGPIMKCRGWGRDSIKRNT

SEQ ID NO: 948079 - protein, 86 aa, Homo sapiens
SVTLPRTSVSTLKPYGEGSTLKLFFPKAKPLSSDVIGMGTGWQKLISSQGEPTELSRVPGKKTGGDYTELSFCQITFLKPLERVNR

SEQ ID NO: 948080 - protein, 188 aa, Homo sapiens
SRGFICDGYDPPKVYHLYQLEKKYAIRVLSLFDGIRYRAPGAEKDLGYRWTDTLPRKVCEDSITVGMVRHQGKIIVRTGTSAASTQKHIQEWGPIRSGDWGQSLEMTSPIVNTALQGLYRALARSTKSSTASCMIGVPKEGDCRPFFWLFANLVALGVSDKRDISRILESNPLMIDAKEVSAAHRPRY

SEQ ID NO: 948081 - protein, 85 aa, Homo sapiens
DPDEIAFPGEVTSLRNNSANNGLSLAQVDPKVVEEVWDFAEQHPGEQLTLSLENRTINLPGRTTYPFHIDDVTRQLLLAGQIPFQ

SEQ ID NO: 948082 - protein, 157 aa, Homo sapiens
YFAIDLTSNVTTCPAERGTHPRLSLFDGISTGLVVLKDLGIQVYRIIAWEVCDDSITVGMLRPQGKIVYVGDIRSVTQKPIHEWGPFDLVIEGQSLSDLSFVNPARNGLYWALAVFSKSSTASCMMRDPRREMIAPSSDFFENVMAMNVSYKRDISR

SEQ ID NO: 948083 - protein, 70 aa, Homo sapiens
EKGHLYCQAAKLEYRDGTKITTSSNSQVHAILPPKPPKELGLQVGATVPGLRCRIFPKENSLSSVSVIFE

SEQ ID NO: 948084 - protein, 147 aa, Homo sapiens
MPRRCVEDSITVGIGAAPGEDHVNVGDVRIVTQKHIQDWGPFDLMIEGSPCNDLSIVNPAPKGLYEGTGRLFSEFYRLLLLLGPSEGDARPFFWLFDNFVAMGVIDQRDIYNFSEFNPVMIVAKELSLHTGPLILGYLPGFDGLASL

SEQ ID NO: 948085 - protein, 72 aa, Homo sapiens
YHASVAQIANLEYRGSELWINASTNSQVLAKLPPKPPKVQGKQVRTKRDPALDSKNYHKREYFEYLVTVIFE

SEQ ID NO: 948086 - protein, 226 aa, Homo sapiens
PGLCDELNLKGYTVQLRRKTIRALSLFDGIATGLLVLKELGHQVDRYIASEVCEDSITVGMVRPTRGKIMYVGRRPQRPQNHIHEWGPFDLVIEGSSLLMTSPIVNLACKGLYVGTGRLFLEFYRLLDDARPKEGDDRPFFCLFENVVAMDVSDKRDISRLLESNPVMIDAKEMSAAHRARYFWDNLPGINRALKSIVNESWSYRIYDLEVAIQQVQDLLKAILEG

SEQ ID NO: 948087 - protein, 60 aa, Homo sapiens
KHLGSSAKPPGDKTLRNVGPSVTYKLRDASGQSREFHNYMLPIELDAQRVFLAGVRDSPA

SEQ ID NO: 948088 - protein, 65 aa, Homo sapiens
RGQIKIANPASSPYRNCPNNAPLADLSGCAGDNGFPRTTNTQSGDKKDVCRSDRRQPLMSGRHQS

SEQ ID NO: 948089 - protein, 54 aa, Homo sapiens
LSDTPPEKGTHMRTVGTGHRWNKKGGWRLLVSGRAGPPFTFHKSFPGFIVLAFG

SEQ ID NO: 948090 - protein, 45 aa, Homo sapiens
MEPILSGLGTSQRQSGDVSRNRYADNDSVNLGPGQRNKGSLLESE

SEQ ID NO: 948091 - protein, 35 aa, Homo sapiens
LLQVDQQAQFTTMAIRELKVCLLRGTGTNNDGVEY

SEQ ID NO: 948092 - protein, 66 aa, Homo sapiens
NEDPGYELKEVVRVYCTMPWRLPDARENNKALIILRSRAVQPHLIKISNEGLAPNTPLTGVKHPKE

SEQ ID NO: 948093 - protein, 237 aa, Homo sapiens
TRLALDPVEILHEREYQFAGSHRTPGQELENLPGSLAGDLRTKATIELKALRLLNFQRQLRQEVVVCMRRDTALETALNAKAYKRSTRQSLREARITDKLEKQHKIQQEPKPRQKHHEYLNTILPACQGISRNITHPSPAKSPKLPNPIRKYHANTGPPTTEQEQAGRARRHDKGHNIKKEKDNARQTTRPKHQATGQPKTNKPAKHRDRHPDRHTSKQEHTARRPPDPSAVQNRHN

SEQ ID NO: 948094 - protein, 233 aa, Homo sapiens
SGLEAVEILQERENMLLARIAHRIQHCGNLPGSLAGDLRTKATIELKALRLLNFQRQLRQEVVVCMRRDTALDTALNAKAYKRSKRQTLREARITEKLERQHKIEQERKRRQKHQDYLTSILPHAQDFKEYHRSRPGKIQKLTQGTGQLTMPQRNGSTETKRPLKNEPMRRPWLEMRTRPPAHRPRKRQRVAYIRHHTTPPGLPPPGRSRINNDPQDRQRTNDPTNPPRRRTR

SEQ ID NO: 948095 - protein, 35 aa, Homo sapiens
MPHQLREVSHYSSVCCKMYARRLSFLNMMSSVAVN

SEQ ID NO: 948096 - protein, 99 aa, Homo sapiens
IVREAELRETLVRLVLEEHLIAEGAGALALAAGRRVAGKRKCAVVSGGNIDAAVLAKLLSEVRPRTPRIPRRRSADTPQQLRQFTVPFYLIPPHIHACQ

SEQ ID NO: 948097 - protein, 129 aa, Homo sapiens
LSGSPARVLNYVADVAKAIRLNSPYNGKYKDLAPHEVGLDVMQLANSLHCLGRLGDAIKNADNSKIVDACDALMSYYAMFTEGGRGEGMKGDPKASFDRHCHICNPQQAISVFAGIRDKALAKCLEKRA

SEQ ID NO: 948098 - protein, 118 aa, Homo sapiens
HVVPTFVWEDFVNYYVAPVPLKDFQTIYGANKFTIDLLVTQSYCLGVVSGRELSRVRDNKTLGGGRERFTARCHMVVCYQRPARLGGYGEVKTLSSATFSLALFYLFGTPSPLPSHHK

SEQ ID NO: 948099 - protein, 71 aa, Homo sapiens
YPLCVGGPSLTREGESGKQESMVDHAAEHRVRSETHRPFRSSLQKRPPGWTAVTQRDTEPDYPTHLIYALL

SEQ ID NO: 948100 - protein, 63 aa, Homo sapiens
HHRKGIRLRFRNLDMDSSGNVTECGDVGASPGRSYLFFLTAYHPGIGLSGDGVLWLEEASTFA

SEQ ID NO: 948101 - protein, 107 aa, Homo sapiens
TCGTHVCGGRPFYYPATSGAALAEGLDYPVQFGLHSGQANRDPSAFETEEVQSSRHVFPAFIVVYLLEELLATGGPHLGYQGISVLLEDTTVNFCVSLTTSKVAGAG

SEQ ID NO: 948102 - protein, 100 aa, Homo sapiens
HVVPTEIVIMANIEGEYKLDDPLREVLDVGEDTCSGQGESWVLLFGLDALEDSLCGDRDKLHLSVDPEAFVVQRGREAGTATNKVHQLVLQTLVLPPQTW

SEQ ID NO: 948103 - protein, 144 aa, Homo sapiens
PDYNLVWRGFRNGHVLQGEPQFPVSSNKRSQFQGVSTHNLSFRPSAELLGYEIRPCVCQIPGRGVGTTLSDRVRPLGKHLAVVPFEPTARAKGLWKSSPRCKLPTTELKSYRGCHPNWARANSFTYTRSIVGTIDQPRRRNSAS

SEQ ID NO: 948104 - protein, 123 aa, Homo sapiens
MWSHVCVGGPLVQQGLHLLYCWLRGSLLFIQGEAEVQMVIDYVQDQVTSAILNDCNYLIFLQVDKGGLDTPELLYFLSAWGSLVVEGCNLQLKQLHCSLEGAPVSGESGGALDDTMSLVLPPQ

SEQ ID NO: 948105 - protein, 65 aa, Homo sapiens
PSGHQPYGTSAHAHDDIAIACVVGNGLWQIRHVVYKKRLHAARHAQRAGERTAIGGHHRSLTGGV

SEQ ID NO: 948106 - protein, 118 aa, Homo sapiens
TCGNTFVWEATFTFIAQYGAQRADALSYTIVDSHAYNIILLIIIEAPNSTPPNTLLLFSTVITSLTSPKAYYSKYTSHAVSFRSPNVQAVGVTVHDTVNFYVIAAGPNAHNNYAVISF

SEQ ID NO: 948107 - protein, 112 aa, Homo sapiens
TFVVGGRVLASSLPGRLWVSETLFWFFVFRNLCLPGSSPRFGQHLVSVKSGNRFHSKRVGTLLTLFSMVLHSEQFETDLSSRKQQLANQQGGRLKGLSIVVGAIESSHHGRT

SEQ ID NO: 948108 - protein, 115 aa, Homo sapiens
GASHQIGWTGDTGCPQVGRGPWSCWGRVLVDIALGGSGVQIPGIGLMGALRGPGLRPTRLCFGSRLGVGQWQLVGWGPEVVAPTRAVSNRTKGPSPCTQPPLPWVIVRPGRSSHH

SEQ ID NO: 948109 - protein, 155 aa, Homo sapiens
ASDQNLIRCRVLTTGIFENKIQVDKVNFHMFDVGGQRDELRKWIQSYNDVTAIIYEVASISYKMVIREDNQTKRLQEALNLFKSIWNNRWLRTISVILFLNKQDLLAEKVLAGKSNEEDYYPEFARYTTPEDATPEPGEDPSVTRAKYFVTQSST

SEQ ID NO: 948110 - protein, 36 aa, Homo sapiens
ATACLIPPGHHRAQRLVQARYARFLLLALAVAQPGI

SEQ ID NO: 948111 - protein, 146 aa, Homo sapiens
LQQKTQESQKKRQQDDTDEYDDDKLQTRLHKSHSLCNLSKVIFLQWHRQDCNQYQEHQECLQEYLNKCQVFLLLMPGMPPVMPGMPPGLHHQRKYTQSFCGENIMMPMGGMMPPGPGIPPTDALNATRYAPTYTTSWNSSNNSSTG

SEQ ID NO: 948112 - protein, 107 aa, Homo sapiens
VVSLIFSKKGYSRRSSCNTRSSRRDSVRQASFMTRYGKILPLSHRMYSRRAAEYVLLHNLYPGHEPCNLDVIMREALGIRNSPGISTSAVCDEKLLKNRQYSSIEEE

SEQ ID NO: 948113 - protein, 99 aa, Homo sapiens
MVWKVIQKKTWMKEDDFLKRKHKKVKKKKQKDDSDEYDDDDSAASTSFQPQTVQPQQGYIPSNGTAMTGTSTRSTRNASRHTSINGKVFPPLMHKNATS

SEQ ID NO: 948114 - protein, 72 aa, Homo sapiens
NILNGRSTKKKTWMKDDDFIEQKTQESQKKKQQDDSDEYDDDDSSSLQLHFKPQPCINLQTRVIFLPTGHRP

SEQ ID NO: 948115 - protein, 66 aa, Homo sapiens
QQLADTGITGQNIGITMIGRGLRGCVPNLSTQRHLAKSAPSFLYCAQRSDRPSNPWVVVSPFVPAM

SEQ ID NO: 948116 - protein, 77 aa, Homo sapiens
RKTEPRAHYAFGEKEKPPAGRFLFAGQGGVRHSIDAYTASPSGNESLRAIGHHLSYSVKPQVFAVSSAPGFRYFSNC

SEQ ID NO: 948117 - protein, 70 aa, Homo sapiens
MSRSEQKGGWWKPTAATAATYTRRLGENHECMSSNRTRILRRKRIDQRSQICLLTLKRPRHPLHVYDQPV

SEQ ID NO: 948118 - protein, 146 aa, Homo sapiens
MSRALRRSEFADADGQSHETSWLVKGIYSYKKNVLIEVNPQIRIPRTFDRFCGLVDKKAENKVRMNLLVGKNGGRRKGSTNCGFLSEKMGDQPDEYHDKAVIIFYVCGNSTSVLAVASFLSEKGIEPSKYWIEFCSQGQYLDGALV

SEQ ID NO: 948119 - protein, 91 aa, Homo sapiens
IDQELLLVRYGAQVLIEESAAHRFGHRHGLPVILPTALKIGVQVRHWPRADPQPWTAIEGLYRCLGYFHLQGPSFWATLPPDCSWAHCNCP

SEQ ID NO: 948120 - protein, 116 aa, Homo sapiens
MAPASVGNCSVGNCSPEAVWPKTEPLENGSTPGTYYSPSIALQKLWISSLPMTDLDIKFQDRGKEYGPDLTVSNPQGLADSSMGTLGPMPDQEELFGPVSLEQVNSSQGYRLNRIC

SEQ ID NO: 948121 - protein, 123 aa, Homo sapiens
MAPDSVGNCSVGNCSPEAVWAKTEPLEMEVPQAPFQPFYSFPELWISSLQMTDLDIKFEERGKEYGQTKTVSNPQDAEYFYGDLGPCFDRRSSLGRRLERLNSSQGYRMNRICQRLQKDKKTE

SEQ ID NO: 948122 - protein, 63 aa, Homo sapiens
GLALKDPHKLQDVQTPSNAITINHVKSEVPESPAFLPFLCPPCFVSLRAPGLLLPHSCYRCRS

SEQ ID NO: 948123 - protein, 90 aa, Homo sapiens
HHSNKQQSICVNELFRGVSDLRNVWVVLGLDKPFQCSCPFSKTLIVLYRQAWHSTHGSVESFLCKKQGGIQELLYFWPLVSVTKRGEPAP

SEQ ID NO: 948124 - protein, 117 aa, Homo sapiens
MVNPKDYKSCYYKDICTRMFSAALFTIANTWNQPKCPSMIDWVKKMWHIYTMEYYAAIKTDEFMSFAGKWMKLETIILRKLSQGQKTKHRMFSLIGGNLTMRTFGHSAGNITHQGPS

SEQ ID NO: 948125 - protein, 217 aa, Homo sapiens
MAHPTMERIFFALWMTHVGETTAKALAHSFGDLAIIRATPLALIHSVPDIGGEVARAIGHFMDQPANQQAIDDLVKRGVRITDTHTPTSTLRDQLTLASILEHLDIPKITPLRAVQFSRPRSHIALIGLEPPLIHSFRAGVSQPAAQSLPEWFQSPDNISLARRLKHCCDVLLAQLPSADRAHIPHSGPKRRTDLANSVMTGNRALIEFGANVEVQK

SEQ ID NO: 948126 - protein, 122 aa, Homo sapiens
GQLGPTRVYRRSGGVGGFLAICLRLEMDYISICEKLTQQLLSGPCSMCMGVAVKHLSSMSQYERVGRGTDSGEQLQTCKFSCLTVYTLETLNLSMPTVEAGGNGLSTHHFQVAFLHLFLLME

SEQ ID NO: 948127 - protein, 114 aa, Homo sapiens
SKGYPCPAHKIEAILVLSLFDGIAKGLLVLKDLGIQVHHNIASELCEDSITVGMLRHHGKIMYVGDVRSVTQNPIQEWGPFDLLIGGSPCKDLSIVKPTLQGSLQGTGRLLKEF

SEQ ID NO: 948128 - protein, 60 aa, Homo sapiens
MSAAEAVKEKWLPYEAGQRILEFQYLTGSLVEPEVHGRISTEEAIRKGKIDGRAAQRLED

SEQ ID NO: 948129 - protein, 236 aa, Homo sapiens
VTLDDPQPDIGLDTDVTFASDISDLWALFAHLGDGQAIGLAENQSDWYLGNLWKNHRPWPALGRGFNTGVILLRLDRLRQAGWEQMWRLTARRELLSLPATSLADQDIFNAVIKEHPELVQRLPCVWNVQLSHHTLAQRCYSEASDLKVIHWNSPKKLGVKNKHVEFFRNFYLTLHGSKWYTLLRRELFVCHSQPQPGADHWGKRMHQLAQEKSLLLCTARPTSLTNIDQERIVHP

SEQ ID NO: 948130 - protein, 123 aa, Homo sapiens
PVPFCPLPLIGRCPACCPATSGVSREAWRVTTPWPFGNFPLCGCPTCRMLPPLLPGLLKASLSAGGTIAQAGAGPAWWPGIWHTPFPWGEGQSPTLLTSACFFPFAAFTGEFLFSLGSLGQHL

SEQ ID NO: 948131 - protein, 70 aa, Homo sapiens
PPPPGPPGGPGGVGGPLPKNLVGGGYKKRGPKKKRAKKGAPRGGGGVFFPLPRGPPLFGPPPPKFCFKVF

SEQ ID NO: 948132 - protein, 128 aa, Homo sapiens
LSPQWRIRLLGKKKGSGLSNGGGTKRNWPPFGLFGVMHHNMIKGVTLGFRYKMGVGDAPFPPHGVIQEKGFFVEIPNFLGEKNTRRGGMRPGVGCSVFQAPKDEFILEGKGIGVVLNSGGLIQPAPPV

SEQ ID NO: 948133 - protein, 109 aa, Homo sapiens
GGGGPPSPGFPNPLLKKVFNQGGGGAISPPFFPGPPPKAPPPLKPGRPPFLGGFFGGGGNKPPFCKGKKAPPGFYFFPSKKAPGGFRDKKGEKKPPPPPPGNLFFEGNP

SEQ ID NO: 948134 - protein, 136 aa, Homo sapiens
RGRNETRSRHCTPAWATERGSISKKKRKRERKKERKRKKERERKRKRERERKKERKRERRKKKEKGKKERKKERKKVRKKERKKGKKEEIKKKKERKRKKKKERKRKEEREKERKKKEERERKERKKERKKERKKE

SEQ ID NO: 948135 - protein, 72 aa, Homo sapiens
KHSFPDDRESKKIDRHMYHSLYLKVKVNVFKNKRILMVHIHKLKADKARMKLLADQAEARSSKTKEAVLPEL

SEQ ID NO: 948136 - protein, 56 aa, Homo sapiens
IVEKAPKARMPDLEQRKYLVASDLTVGQYYFLIRKIIHLRTEDALFFFVNNTPQQT

SEQ ID NO: 948137 - protein, 42 aa, Homo sapiens
RVLQSGCLDHLQSDVPLIRKVTPQCTDFLTSLISSCQHTKEG

SEQ ID NO: 948138 - protein, 58 aa, Homo sapiens
MLVSPRSMVYATDPDPVLPGSSQFSTRHAEGESGVGIKGAPPPGHREWRRGQGAERWR

SEQ ID NO: 948139 - protein, 133 aa, Homo sapiens
RNAFGEIDVLPACVEQFTNATAGGEGNPNCSFGGRKKAGFRSELGQGADLIIAQHAVAFDILATNLGLADAGQSDRAQSDLDPTANRNICRIRLKISLAIRLTPRARKGIGHFGDVPFFYVSHGYFANNGKTS

SEQ ID NO: 948140 - protein, 60 aa, Homo sapiens
TINLIGKGGVGINRRRLGTAQIAPRMSGNKTLPPVSPPSGRRLDLPAISIGQQPPNPGLP

SEQ ID NO: 948141 - protein, 149 aa, Homo sapiens
MCRHGFHQPRLVGLTLLTRHKRGQNNPENSRPQSLTQPTEAKQQARCTARCYVASAGLGRVTDGNHRYPTSTCRSAPRPIQCVRLVFGVGAGVWRYRGFGKATGGQPEQASQKPTAYACWHNIEPVATRPGFHRVPSQQTTSLPVYGTD

SEQ ID NO: 948142 - protein, 116 aa, Homo sapiens
CTLIDYVYFMVYRYGFLSCIIIVMVTIVMVIVMVIDCYGHRYGDSYLLWFTLMLSINLLWLSLLVIYHFMVIVYAILDGRYIYRCICMYYSSFRLGIISCMCWLACIAGLSCILIL

SEQ ID NO: 948143 - protein, 189 aa, Homo sapiens
KYNIDRKMYQCIVEAQESQCAAIADEIQAEKLTCRRDGKCENEKTDRPEPEKLLKGLDRVGSKTVGCPQVKIPNPWREADDVKQPDRGALPVSCASEHDGHQKFFLQVHAGVKAGNVFRIAIEHQGWTPVRTEEAPCPDASLSCLAPSGMIDLRINVGKKTILAWRDDIPGVLWLRIGQRNTNNRFASL

SEQ ID NO: 948144 - protein, 183 aa, Homo sapiens
LNRADDTGCCEPQVADHEQGANVSGLAAASQAATGNVMAAEPHRQSDEYHTEYSPSDRRADHRDERAATTARHKADKARLRAIVSRDSSSLSPQIVRIMYAGQPSDDLGDVCPGCQEGSGPGGAEGSSALDDDGVVVTAPSEGDVYGQQPQLGKSEQSKPGPGGVERHRRQQDDDAKPGHGRD

SEQ ID NO: 948145 - protein, 119 aa, Homo sapiens
SQKTSYNGLKKHKRMGGEVESSFDYTLSDVDKNMLQMMQVDEHLDCHGDELMPILQEMMNQIDYDGIGSASQAECVRSGASTGPLLVLLGLEMTLKDDGQHMGRPKGFPRPVYCNLCES

SEQ ID NO: 948146 - protein, 42 aa, Homo sapiens
IGLAHRMQAGPHEKGQAFDAGISERCTPETLREKSGIPIGND

SEQ ID NO: 948147 - protein, 48 aa, Homo sapiens
MAILHAQGNQCCSERYLFGNTTAHTLTSAFFIQKVISHSDEENSAVRG

SEQ ID NO: 948148 - protein, 122 aa, Homo sapiens
IGNYETLLAGGLGAQESTTHQGELLGTLDAHCFRQLPRFGPPREQAFAEFFYSQLPLFSRLSCQQLFLKLDFGLRSEARVGGKRRIPKFGSSALKARGAVPGMLAGASGQGLGTWPPEVYTT

SEQ ID NO: 948149 - protein, 222 aa, Homo sapiens
MPVKFTSGSRTPHSTHRHLRCILLGDPCTLTITRTMQKPESLRIPHGKRPPSSLLLPPPPAPLLSSSPRRPARPVTGRPCGRAAFCVSRPPVRPSPPRSVPPSSASLFPSGVRASPVRSPFSPVLVCARRHAAVLAPPSSRLAAGCVVRPRGGPAPVPWLSRAFAAVLPLRLGRLALGGWLPGWRACPCRRSAAVRAAFLLRSCALPIGAARFLFFPVGRPG

SEQ ID NO: 948150 - protein, 52 aa, Homo sapiens
YTDKYTSPHDQPQYGYELDPVTDKNLTKEGQRRTINGTETKAKHTSMEFRIP

SEQ ID NO: 948151 - protein, 70 aa, Homo sapiens
DPADPLTERQGEGGGEATNRNSHQFFGSRGPLPSTPWAKIGPHIKNRGNSPTCWNKGRTPPHYTWLILKP

SEQ ID NO: 948152 - protein, 33 aa, Homo sapiens
VAYGLYKLKSREGGFAIFREGGFAISGKEALPS

SEQ ID NO: 948153 - protein, 51 aa, Homo sapiens
SRRRKLAPKPEETWVEEMLCGLKMKLKQPRVSSILPEQPQGPKQSAWYEEH

SEQ ID NO: 948154 - protein, 75 aa, Homo sapiens
CPIIIPLHVFKYIAYIISSGQLEDQGPMVALQHSSVIEQNGQLTSSITQEGVGSPRVIYIMNGGCDECSELINWI

SEQ ID NO: 948155 - protein, 45 aa, Homo sapiens
DIGEAGAEGAHSLEMTPGGLCLPYHSLSPDRIIGLLHNQTPQTLS

SEQ ID NO: 948156 - protein, 146 aa, Homo sapiens
ISDLNGFIKRIGPLGQEFGTRVTPFRPHTQDKDALAGTTQAAPQMALVTVQRSPYPQHHLQPLRLESKTGILGSGSQISSDCKEEFVTVECTALQNSECTLLEIFKQRLENILPGRWYKNFLQWGTSKTISNLRFCDLRILVLQSW

SEQ ID NO: 948157 - protein, 104 aa, Homo sapiens
RLVPTLPRKKGPWGFAWARPTKGVKCFGISSPSHSNPRQVGWTIRFFSHFGFVGFKRIFCLHICTHSPFFKDGFKPRCLQERGRNEYIHRGIQKIQFGGKCNNF

SEQ ID NO: 948158 - protein, 105 aa, Homo sapiens
GFLGGIFKFSTGADVPLSGGACRGVKPLGQKTKGPGPSGLPTVFQFPLPGEFFGIQDRKSGAQKGWGTWGLCWGKHPCPPRPPAGHPLWAGKTVFLCFPRGPPFK

SEQ ID NO: 948159 - protein, 105 aa, Homo sapiens
MYPWADFHFFSFKAEKFSFVLVESSYWKAAIESFLFYFCYEWGMAPFGDFYWVIFYVKEGNLGLNVVGNKNDDNNKVKAAMGARQSNCLGEENLFKSPDKKLIFF

SEQ ID NO: 948160 - protein, 105 aa, Homo sapiens
PPEPSSSHPCFEGQPTARDGQPILTWDVPKAWPHSSKPGTWGRGSTGLSGSAAVRSAPPAPSASVPPTPTTHRSRRQAQGGAVWAAYWGSRLVSCDRRRLLLSVM

SEQ ID NO: 948161 - protein, 101 aa, Homo sapiens
GLEWVASGQDTKALQDFSSSVKMCQGNRDTYFHLLQTLKRLDRRDEATALWWRLEAQTKGSHEDALWSLPLYLESYLSWIRPSDRDAFLESCIFSLKFWSM

SEQ ID NO: 948162 - protein, 139 aa, Homo sapiens
VQSANSRSRRFRGSMQALEIKCKSQLSIKASSQGNCAETDNRCVHWSQIQRMIGSVKEQMAQLRCEMEQQNQEYKILLDVKTRLKQEIATYRRLMEGEYAHLTQYKKEPVTTRQVRTIVEKVQDGKVISSREQVHQTTR

SEQ ID NO: 948163 - protein, 67 aa, Homo sapiens
TQQVSNRDRMGIQPHLTPELASFHIPSLRATSMTEKPKPTRMARGDFLNLPAFHLLGPAWCRFSSLL

SEQ ID NO: 948164 - protein, 106 aa, Homo sapiens
MKIIYVLCYECVSQNSYGGNFIPQAAVLGGGASEEIFRHKGSALMNELVPFQNGLSVVGSFLPALLLCEDTGPSPPEDTASAFWAAERSPGQMLDPDSGTSQPSRN

SEQ ID NO: 948165 - protein, 62 aa, Homo sapiens
SSKAPVLGTPRGGGVPAFGPWVDPALPRYKSQIGSRGRQQGQPQPRVGSSTGGLFCKKSRGF

SEQ ID NO: 948166 - protein, 110 aa, Homo sapiens
MPPPQGKSYICGFVKHLLSFTPGHRENLLRVLVNPFIKRVPRGDSPRFGGPGILKKKVVVFSPLAGFNQAFWFLGPGVCGGPFRNFKPFFGGVGNGFFNVARGFLIFFPF

SEQ ID NO: 948167 - protein, 98 aa, Homo sapiens
HVLGNRLGNYREKKVDSGSSLVCQMDKTWIQIGVVSWSFSCGQRHFQGIYTSTAHFNQWIRTEVANIRFISRAGPAFLSPVFLTGYILLGSLSSLWLL

SEQ ID NO: 948168 - protein, 125 aa, Homo sapiens
FFHHLLEIQLGTLHFIEVVDGHFQVTFSFPTSLFHLRPDFFFLLPVILQLQRQEQQEKVDEESLRSEGKKEPNWVRSFNCGIKRALTPRGMCWSSFQNKFSDPVPPKGFGLGVVKVATAMGITSW

SEQ ID NO: 948169 - protein, 67 aa, Homo sapiens
FTPKILAPRVLGLEPFPTKWKRKNEEVRRFSDFLRAYNPCQVILHRWIPFPKKPLLCSGTLCVSPQK

SEQ ID NO: 948170 - protein, 118 aa, Homo sapiens
RRLGKVAKERVHATWLRRKRRRWSPPERSRARLGAALRRALRRGPALAPERLALTASRQEGPPAAETGRSSSPRAGGQWRGASLVPGRAGRAGPLTGGAEPSAAGPAVLPARHTAKLS

SEQ ID NO: 948171 - protein, 121 aa, Homo sapiens
GFYPKGLGPATKTPSLLVPASSGGPPPFFSRVGPPFCPPFLGGFFGGPPPGGFGPPFFPPRGFPFFFFFSPPAPVGAPPGPFGGPGARLGGGGPPLFFFFFWPGEGGFFSPPPPGGGSGVP

SEQ ID NO: 948172 - protein, 106 aa, Homo sapiens
LGASMDAGPILRGSALLSLCLQHFLGGLVTTVTFIGMMRCSQLAPRALQATHYSLLATLELLGKLLLGTLAGGLADGLGPHPCFLFLFILFAFPVLYLDLAPSPFF

SEQ ID NO: 948173 - protein, 110 aa, Homo sapiens
TSSPVSPMVQFPSSSNIPTQPPSKSFGKPEDAAPKTRGQGQKEVVETACQQGLSARVGPLPFRDLFGVHLGVPPRDHLQLATPQAPVPAALLVPETPGLLGGSNKANPDQ

SEQ ID NO: 948174 - protein, 101 aa, Homo sapiens
GFGRFSPPPAPFLGPAQGIWALGFFSKWGVSKGPPPGEETKGVPLGGGGGPIPFPPFGGGPFWGKGAGGGAQSPPAQGPLSRFVFKKLAPPPFGGGEVLPP

SEQ ID NO: 948175 - protein, 197 aa, Homo sapiens
LWVRWNSPTGGGSAINEPGPVEGSLVPKPVTPLPGGQPRVWKGFNKTQLGIIAPFWLKKPGKPIGPRGAEGALQLGLFFPPAKALQVGIVDQVVPEKQVQSIALSAKAQWMAIPDHAGQLTKAIMGKAPATRLVTQRNGDGQNFVSFISKKPHPKVPANVLKKAQKKKRLTIGLPQAYAHTGPCGSQGGFKQGIFQL

SEQ ID NO: 948176 - protein, 82 aa, Homo sapiens
MLRQIIGQAKKHSSLIPLFVFIGTGATGATLDLLRLALFKPKGFVGPENNPEPWNKLGPNDQNKFYSVNVDYSQLKKERPDF

SEQ ID NO: 948177 - protein, 121 aa, Homo sapiens
LKSSQIGEELFMSLTMAWKSPPRAPHSFSAVSMLWLGRAAAAARRTERGEQRKGGGQAARALAPRPGRASRLQAALSGRPRRAPGSRASGGRRGPCRSGAGGRRGGRGAGSSRRSPSSRSR

SEQ ID NO: 948178 - protein, 108 aa, Homo sapiens
LQQLDQFKKATGTAFGSGTRAPEQKPWRKRKANIRWVKENKEVVLQWFPENSNKSPALEVTRPPSKVPTVSIPTGAGPPFLEPQAPVSSPQGQSFQPTVSLPVRQSSS

SEQ ID NO: 948179 - protein, 130 aa, Homo sapiens
MLYSQMKENLKGFFPRLLGEGGSIWVWKKPMGLKISLGWGFRGPPRKLKASGVWLCSFYRRKATHPRILKFGILPRKGIFGGAPPKPFPPLKREKTLLGPQNLLFFKVGEILVGFSFWGGEKSFFLKGIR

SEQ ID NO: 948180 - protein, 105 aa, Homo sapiens
VPAADSQALSLLRRAPPPGATRGPRVVRVLPGLCPPPGLPRLLLAMFSRPVSLDFSSPPGPSSGPSPPGPGFPGPPPPPRGGPFFNPKPKNPPALAVPPTPGPGS

SEQ ID NO: 948181 - protein, 96 aa, Homo sapiens
AQGVISGGFQTCRQFKDGGPRLRLFRVNPTDQNKEHLDLLVKAMWYKAVQKKSSMLVPEDFRGEIQMLSSLTGMERPRLHYNYNISLAMWLLRPVP

SEQ ID NO: 948182 - protein, 105 aa, Homo sapiens
SQTTFSSQVTWVEVLTNPSGHLGRHLGVPKRLGGGPPSPVWWFWNPWPFPGPCRVFPPPQTRGLFPQGFFLEFRPPPGGAKLGFGLGKPPRNPRGGSNPVSPPLF

SEQ ID NO: 948183 - protein, 193 aa, Homo sapiens
GLGPFVRGFCLLHAPTEAGWAAPTVYFSRLFFFLLSRGHARPPSFFFFPNPQGKGVSPFFMGGGGGLPPLFFFTPGGGSPPGVGGGAGGFFLTRVFRGFPPPPPWSAPLLFWVFNFLGRGPPLSPKNPPVFFWPPLLKKIFLGGGGGGAPPGVGFRPLGPPPFSRGGGAPGFAFFPGGFAGFFFGPINAPPRF

SEQ ID NO: 948184 - protein, 115 aa, Homo sapiens
YSHTGMDACVCNKHFDPGNWVYLSPCEPEAQAYVFTLFRSWGLNQRIAIVEYARQSPRHYTVTFTFRPLTSCKGHQITRNSEGKSVVQSWWDQSVCMIIHMILNMKEPVYKLGRP

SEQ ID NO: 948185 - protein, 70 aa, Homo sapiens
MIMGATKMAFGRGNKEFIVFNNDEWTFSLTLQTGLPDGTYCNVIYGDTINGNCTGIKIYVYDGTKSSFFI

SEQ ID NO: 948186 - protein, 41 aa, Homo sapiens
GGGGGGGQVLVEPLPSPVLFASSGLKLFVRIPLGLKRKNKD

SEQ ID NO: 948187 - protein, 140 aa, Homo sapiens
VWYLVHALRLPIPLARHFGVVTARYRWVAGVYLLLGFLLLPLAAFGLSLAGGMVLAAVGGPLVGLVLLVILVMVLQRPRPAWLPVRLRSWAWLPVWLHSLEPWDRLVTRCCPCNVCSPPKATTKEAYCYENPEILASQQL

SEQ ID NO: 948188 - protein, 130 aa, Homo sapiens
GGQNGHPPTVPFKVKGRWGWGGNPPSRPPGGMGFVSAPGLKKLFIRGGNTPSARGCAPLGNFAKAPFDAIFKTYRYLPPPLWKETVFPKFPYQEFPDPLVKTPPKVSVQRDSGSHAVGPHKGVFIQRKIK

SEQ ID NO: 948189 - protein, 110 aa, Homo sapiens
RGFTPRMVGFLGPGGPGVPPQRVPSWASAQEPSQGPPPFLVTSILGGATEDWKKGDPFFCMVGPEALPLAFPQKTLGRLGGEPPPVNVFVVMAEVGGPCFLAARLSPPLN

SEQ ID NO: 948190 - protein, 151 aa, Homo sapiens
RKWGARIPPGPFFFSPLGPPRGKGGVFLNPPGGGFLFGGPWVPNGVPLRRTPPNFVFAPSPQMGFGRGKIPNLFFGGFFQKEKGGGAPPPGGEGFFPPKKRNFGFGGGASLFRKGGAPNFSPKSKVFLGSGGPRGWGLFWGRGFFPPNGGF

SEQ ID NO: 948191 - protein, 145 aa, Homo sapiens
TPPRLRSGGARESLPGRGRLPRKYNELLKSSQGKRLNPPPLWDQLNEQFNWVSRLANLTQGEDQYYLGVPTVASHTFESDVPSGVTEVVVKLFDFDPIPVPVPVEVSRKTPKFMETGAKKSPAGIPQKAPGGVKCGCCFCPHGGI

SEQ ID NO: 948192 - protein, 125 aa, Homo sapiens
PQNKNPPPGGGWFFKPSGNPVWFSPPPLGGAPRGGGEKPPFFFFLPSLKRRGAPHHVGPLLSPGLSCVTIPACYISVFFPMDWGLLTPRTQPVGPGRGQPARKSRAGIKRKINYKIIFNNQSDSL

SEQ ID NO: 948193 - protein, 110 aa, Homo sapiens
RLFMGMVFKGPTKKFLGAGFSHNPPRENPVEVPFKGDVDPPPQHLLGGIPFTGPFLGAVKLKKLGRGTPFIRVPPRAFLGGEARKPPVLENYPKKSNGILGPPPPLLKIF

SEQ ID NO: 948194 - protein, 30 aa, Homo sapiens
GLRVKFNDFRELLGSYVLFTGRTRVCEGMT

SEQ ID NO: 948195 - protein, 73 aa, Homo sapiens
MTVAILLVMEGLSAFLHALRLHWVEFQNKFYSGPGYKLSPFPFAAPDDQGPLQVLPDLLPDLRQERNKDGPPW

SEQ ID NO: 948196 - protein, 187 aa, Homo sapiens
GAKPIWFSTILEKPPGVPPGLLRVGVVALSKVRRPVTSLEMSLAPMRNLKARLDNNLREVEAPFALQMEQLNGAFCPFSQSWPTPGPRGSRRPPRFRALLTLKAKLGGEIAPPPPLLENGEGFYFGDALGSSNSLQTLQKTPPPRIVDGKVVFETHSPQVFGPLAPQSRGPFGGPGAHKKFRVPWVA

SEQ ID NO: 948197 - protein, 37 aa, Homo sapiens
RYSGVCLESVQEAEAGGLFELKVFENIVYYDYTCRIA

SEQ ID NO: 948198 - protein, 33 aa, Homo sapiens
GTCKDQILLSKLDLLLNAGCNCLRIVITTGEYC

SEQ ID NO: 948199 - protein, 57 aa, Homo sapiens
VIAEPKKKRERDLELEMGDDYIDLQKYWDLMNSSEKYDKIPEIWEGHNVADYIDPAI

SEQ ID NO: 948200 - protein, 114 aa, Homo sapiens
AELVNAPLGTIKSRRNRAKAHLIITAAQEVAEDVSDEIEGRADGIDTATVTLAKSAYVLSAYCLWEYMRRYSRSTKIVRVGCHNAVMNARRYRRIIVAENTPDNTAGRHYRRLL

SEQ ID NO: 948201 - protein, 112 aa, Homo sapiens
MATYLIGDVHGCYDELILDKVEFTPGKDTLWTGDLVARGPGSLDVLRYVKSLGDSVRLVLGNHDLHLLAVAGISRNPKDRLTPLLEADDGACLTGGASLCCKRRRKKLVDGP

SEQ ID NO: 948202 - protein, 106 aa, Homo sapiens
MATRTLCIPSSRLSRGRLGMAAPFGCGSRTSSSSGPRSNYGFFAGDEARLLIIPDIFSVLHPEQGHSKIMNRDGERQYLFHISGGGGCELSSKRYLQRFQVPQCLL

SEQ ID NO: 948203 - protein, 115 aa, Homo sapiens
GENCGTQTPPKNQKKTRFGACGVLPTKIPRLFFFTFKNQQARATCEKSLCFLPSSPPGEKKGCGVFTSGGPPSPLITPGKPLCFALENTRNFCTLKGPFPSSLPRRWFLFNPPPF

SEQ ID NO: 948204 - protein, 37 aa, Homo sapiens
PPPLGGLGKGFFWGRLNVEDPEDLKNEEMDLEEQEGY

SEQ ID NO: 948205 - protein, 30 aa, Homo sapiens
SPAFFHFAHFGFFATAKYPFTLFNPDGGPP

SEQ ID NO: 948206 - protein, 112 aa, Homo sapiens
VIKWNIKRGFAGEGKCGKCNAQTKAVELEVCPAASPGEGGPGGQRLPREKDALSGRGMGGPLGGGGGPARDLSGRDPGGARGPVPPERDGGGPRYPRGGKVKGPPGKKDPDF

SEQ ID NO: 948207 - protein, 100 aa, Homo sapiens
PPSCRFSGLKGESGIEFGPFPPPGGGDPLKEVGVGPPLPIWGEYPRGAPPPRLPKFFPRGVFSRKGALPKVVLRGGGGFLPPKNSPGPNPWGSLGPPRPP

SEQ ID NO: 948208 - protein, 97 aa, Homo sapiens
SRVGMDYGSCFLRPAGSVDASAMVRCFLGRDPKQGAFLLSRGLRVGGCEPEPQVFGVEHWTAQYGMRCGGGGVFVLGSGWGRIWFVPGFGGVPERLS

SEQ ID NO: 948209 - protein, 145 aa, Homo sapiens
MFKRGPPSTPKGGWSWFLVGDIRPDRPIEGADKALKPFQEGFKPVETFSEFLDVAGFLSKIPDPKRFLKGLLNSVPWPPPNNWGGEKKGGLPSPLCFPSLGIKFPPGEGGLLPPPPLFHFFWGGWGVLGFLFFFGGGGPPLWGCL

SEQ ID NO: 948210 - protein, 85 aa, Homo sapiens
SLEGDDTCTDLYPPELFTCTDLGRTEGVDSNDEGRRETTVYRGMSKKRGKKPLGSLKMKFKILLRKPKSFSSCKQRRLIKALFRD

SEQ ID NO: 948211 - protein, 131 aa, Homo sapiens
VGQTLVLIENEGLGTQKEQYIRATSVSAVERTFTYNNDQDYKASVVTVEISDALRYDFTGSPATRTFTRATNSTKVRDTVVADAGTYVGVVPLTQAASVGDFTIKGTSIYTQLVPSAQTETPISFVPPYAA

SEQ ID NO: 948212 - protein, 89 aa, Homo sapiens
LALRTLPAPSWVRGSGPPVMTRLQDAPVVRPGFLSTAEEETLSRELEPELLHLRDEYDHWDVTIHGFRETEKSRWSEASRTIMQRVQAA

SEQ ID NO: 948213 - protein, 127 aa, Homo sapiens
FGLRVHLLPPPLEELALKKLVTFTCLAPGFSPKDVLVRWLQGSQELPREKYLWASRQEPSQGTPPFVVTSILGVAAKDWKKGDTFSCMVGQEALPLAFTQKTIDRLGGKPTHVNVFVVMGEVGGPCF

SEQ ID NO: 948214 - protein, 55 aa, Homo sapiens
MIMATPAIQAWNRVGSIINFVFLSQPEKLCQLPARESFVPVPSPFRDVGNHNHAA

SEQ ID NO: 948215 - protein, 116 aa, Homo sapiens
MALNFEEFGNPLVERVPGKPVGVESFQNNPPLGRFAVRKIKQTVAGGVIKPMDKKAAGAGKVPRFAQEAQKGKGILSLKPAPPLFNQGGRRVSKLFVSIGHLSLVGKDGLNDNNAW

SEQ ID NO: 948216 - protein, 84 aa, Homo sapiens
MPHSHWERIASARWTHVLMGLCLEGDQPGLSPAPTGPSTYPAPQSIAVNEPQPQPRGVNSLLPVFGGCGVNMEAVVQQRQGERP

SEQ ID NO: 948217 - protein, 96 aa, Homo sapiens
EWVFPGAFADRPLGSPGLQFSLGPLTILARACLTPVPSGGFPFCFLPVSPMFSVGGPLLGPLFCHHLKTPTPNIECHLCLPPGSPLGPVFDSTQLL

SEQ ID NO: 948218 - protein, 88 aa, Homo sapiens
VSSPPGVENSNLATPRIQHPFGFVPFGYGVRPCLGRRIAELEMQLLLARLIQKYKVVLAPKTGELKSVARIVLVPNKKVGLQFLQKQC

SEQ ID NO: 948219 - protein, 62 aa, Homo sapiens
CTENFTRIVDRLLDGYDNRLRPGFGGPGAEVKSDIYVTSFGPVSDGEMEYTMDVFVRQTWID

SEQ ID NO: 948220 - protein, 73 aa, Homo sapiens
LFLLLFLFFFFLLLLLFFLLLVLLPSARRQTEDSLEISEISSLGFASAKTVGIKDADYCIIVILLISQWKDYR

SEQ ID NO: 948221 - protein, 126 aa, Homo sapiens
MLKPLHCQMKMMICEEHEAGAQRQKSSFIGNCPVMWCSVFATLLYSCAEHVLNLFGMQKEMNGLRSECGSSENNSFIFWTCVFSCLVLQNILPSSFKSSVKTATVSSQNSVVNLVTVIPIPFSFRS

SEQ ID NO: 948222 - protein, 82 aa, Homo sapiens
MYVEPEDRREQYRNPCESDEMSHQQKLPCEQARRTTVRRPLDLDRRDDPYCPEPKRPTLDEPYHYDFNTQHGFHEFEHRDRG

SEQ ID NO: 948223 - protein, 41 aa, Homo sapiens
APPATRPARAGGRVPRTERRVRDPVRIASRPEKRKENGMRP

SEQ ID NO: 948224 - protein, 66 aa, Homo sapiens
RECVLVDAGILRLPLSGKLGSNVDDEGADTAIGPTKAVLFHLAQDPVGQRRLPVDEPRRVLNPEPP

SEQ ID NO: 948225 - protein, 76 aa, Homo sapiens
AQIPKGVTPKLVFAFFAPPQLGKGVCARFSQGVRLVRPKAKAKAQAKVQTKAQGAAPGLVPGQGPQGTRAPTKGLK

SEQ ID NO: 948226 - protein, 100 aa, Homo sapiens
FQNFLKAHVGATCTPIHHTYLQQLLGALHPPLPATVAGRTTSDLFLFQVTIIISPNICQFPRTIKSPYRTFYAMPTKKHFLPTVSDPWDNHRQLRAAFSR

SEQ ID NO: 948227 - protein, 34 aa, Homo sapiens
GNKRQWAKADVYGINGRADQRANVEVPVSLKIHM

SEQ ID NO: 948228 - protein, 82 aa, Homo sapiens
RQIKGFRQGFWEEPAYSNPSLLLGPPRSHSKALAQIPAGPTPGYKVGQGKRFFSSVEDFPGFVWGRGPPSCIGLGGFCLSVK

SEQ ID NO: 948229 - protein, 51 aa, Homo sapiens
CGHCMAAHRQLGEEEPTVSGGSGQQPVQAGRVECCVANLCRSVLKGSLLVG

SEQ ID NO: 948230 - protein, 82 aa, Homo sapiens
IEQYCGEEEVHLDGGAMCGSQAKLDCGGQAKSQQFVMMRESSEQVLSRWPVDELEPICVNGPKFIVCQCIPISHGAYFISYF

SEQ ID NO: 948231 - protein, 46 aa, Homo sapiens
WVRKRIGAYFPPVSLEELRPYFRRPVGVAFARAPLDVHQKYKAKTQ

SEQ ID NO: 948232 - protein, 53 aa, Homo sapiens
ALKLDGRKAMADAFQKLLIVVVGKTVLIILDVRQCQKASKFSLKSDLNENVDL

SEQ ID NO: 948233 - protein, 109 aa, Homo sapiens
GAPGSPPPPAVPQSAGPLPADPLLSFHLDLGPSMLDAVLGVMDAGRPEAVAAKPDGEPRPGKQPPQARCRPNGDLELNEVIGLYGSLIPRALPARHPIFVNINGQGVCP

SEQ ID NO: 948234 - protein, 33 aa, Homo sapiens
MRPDERKNLPIWTKGAVAVNDSTAMALGLLWPI

SEQ ID NO: 948235 - protein, 166 aa, Homo sapiens
GVPGLRNLPINKSPALVRCGAFAFNEGSMRLRQDLGKPKLVPADLDEIPPDRCARCVDDQRLGLVLIDPRSDERREQLAVPSPIQTRNGGGELVDVGRSFAELERHVMVEDADDLPARRGQMHVASVIPEWTEGSGERIQKLGDVGTNFRCPLHRQIRTLDRSVAA

SEQ ID NO: 948236 - protein, 102 aa, Homo sapiens
NPPRWFFSPQIGGGGFSPSSPPKAFKKRALSPHKSYVGPPPPPLFNSRGQQELKFWKFFPPPQECKLHEGPDFFLFFFSIPKVRPHLNLAKRSCLIKTCLSM

SEQ ID NO: 948237 - protein, 56 aa, Homo sapiens
PHQQPQGRHKCQVFQRHITAQAFLSLIQGDSIPPGKISQPRLQKSLCPERGTLARP

SEQ ID NO: 948238 - protein, 43 aa, Homo sapiens
LVRVVFLQVAVTAHFVLGPRDAGLARGHAPAQFCSIRREETAA

SEQ ID NO: 948239 - protein, 54 aa, Homo sapiens
RHEGDRELALQGLDLHLFCSHSCARVGPRRPPRRPRREVIFLPLFLPPPFLTRP

SEQ ID NO: 948240 - protein, 33 aa, Homo sapiens
MLVANSQFDMGSKFGHSRSRMADQSRYVNVPVT

SEQ ID NO: 948241 - protein, 75 aa, Homo sapiens
RIRHEEGIEKIPLVTAVSKDLSSAFFGCGMNKRPIEETGFLLPLNPVAGSTDVGGILLAARGEGDMCEPMIGSLD

SEQ ID NO: 948242 - protein, 70 aa, Homo sapiens
DVGVRSSLAWSDQHRLMWTCDTVVFLSPAPVRARGRCGVQAAQPEGLCMRALGPVMGLTWWIHIKPVSVG

SEQ ID NO: 948243 - protein, 70 aa, Homo sapiens
IVSPGLSVLVCHRAVRLFSKIAVQRALKTAGPQQEAPSRPRQWRRFIFRQKRNGQAGTVARACNPSTLGG

SEQ ID NO: 948244 - protein, 110 aa, Homo sapiens
LYQQEAIAILTLEGQGGKQCYQSPVKTAVMKEGPPCKRHHYYQNWGAKLLGFFFGETNQKHLLESPGGPKKGWKKNLGKEMENKQPSVIHFCKFLCKRLSVRNKVILLVA

SEQ ID NO: 948245 - protein, 126 aa, Homo sapiens
MANPNSLPTNNPFTTAVTVAYDQRHKHADHALNQDHPIHAKNTTDNQTGDHKVQQIGIFHQQVNGSHYVCLEEIKETNTDDTIRHRIAGPPISRNTGILFPNCASAKPSVIITARPPIIFFGKRVD

SEQ ID NO: 948246 - protein, 47 aa, Homo sapiens
NSGLCIFPSTQPALLTGVPDSAEVSSVSPVAQAKVLGLLLTSVSGRR

SEQ ID NO: 948247 - protein, 81 aa, Homo sapiens
AQEGAGSLIDELRLCEKVRKASLAIVPEKGQSHGYFWPSRLPRRWVSGWGSFGRRKRLVWQGPQGCGGLLSKTSSLPWKGR

SEQ ID NO: 948248 - protein, 140 aa, Homo sapiens
SDQAEELEPASALLDHPDVATHLHTPEPSPLPPGWEERQDVLGRTYYVNHESRRTQWKRPSPDDDLTDEDNDDMQLQAQRAFTTRRQISEDVDGPDNRESPENWGIVREDENTEYSGQAVQSPPSGHIDVQTHPAEEGVD

SEQ ID NO: 948249 - protein, 109 aa, Homo sapiens
VDGQSGAVETKGEREGEKGVRERRAESKRIRKRGGTNRDTNRERQREREAETQTDTQRQTERDRDRQRETKTNRDTNRERQREREAEEEMERLRERDREEKESQVYSRR

SEQ ID NO: 948250 - protein, 108 aa, Homo sapiens
LPSAFCLSSPLLSLNSAAFFSFLLGLSMHTPLCILQVPWVHMCSCFVCAPLHACGLVCMHAWCFCVQMCVCSLCAHADGPVCMHACIQSCTVPCVHTCMPFPRDRAVD

SEQ ID NO: 948251 - protein, 37 aa, Homo sapiens
GQGYTSSCAPLIEPPNKLSRSIVGERRVVKLPRTPDH

SEQ ID NO: 948252 - protein, 66 aa, Homo sapiens
MAAVRGNKPVILRHLLENHGFSFCLSDSGCLFLFNTHMHMDVHTHVYAQAWARTQIYTHRYTHTST

SEQ ID NO: 948253 - protein, 134 aa, Homo sapiens
CAVLCCLCCAVLSVLCCVVCAVLCCAVYAVMCCPVCPVLWCLCCLCCLCCAVLCCAVCAVLFVLCFAVCAVCAVMCCLCCAVCAVLSLMCCVVCAVCAVCAVCAVLLLLSSCHCEKWVVFSFMSSFIRLLSPTI

SEQ ID NO: 948254 - protein, 108 aa, Homo sapiens
MSNSDFFLSGLKYLHSAGILHRDIKPGNLLVNSNCLLKVTVYTFVLAVSLCVNFLKRHTRKHYASQEKNELSRGQYGLKNFVYTPFDKHTCVLCCNYTGQPTLIIPST

SEQ ID NO: 948255 - protein, 117 aa, Homo sapiens
MLTELENPLNSIIDVYHNVLLDKGEFPCRLSADLTHLLETECLQYISHNGADVWFQELHINTDGAVNFQQFLILVTQLAVAAHQPSHARKPPRVPESLGPEAGPLDMYLQNNKVINT

SEQ ID NO: 948256 - protein, 156 aa, Homo sapiens
RRMKGEWWIIEEWEDDGLWKDDGMDDGLEDDGMDDGLWEDDGMDDGLWEDDEMDDGRMAEWMLVYEKDDGMDDGLWEDDGMDDGLWKDDGMDDGRMAEWMLVYGRMMEWMLVYEEDDGMDDGLWKDDGMDDGLWEDDGMDDGLCLKHRCSCDAGRH

SEQ ID NO: 948257 - protein, 33 aa, Homo sapiens
TPHTHTHSMLCQALTLYTGSPLNPGNKKSDPVD

SEQ ID NO: 948258 - protein, 52 aa, Homo sapiens
MIRSDFTHTAHTHSTLLHRSGQILHTQHTLTQRCCINPVRFYTHSTHSLNVD

SEQ ID NO: 948259 - protein, 34 aa, Homo sapiens
VSIMELPCPKRHTGIILDSSGRCPPDDEEVIVDA

SEQ ID NO: 948260 - protein, 56 aa, Homo sapiens
MSSFLIQVHSRHGELLVDYLVTQVSGLVPISYFFLILSLLLPSTLSQAPGRRGREF

SEQ ID NO: 948261 - protein, 82 aa, Homo sapiens
MVVICTISVDIQLFEAHVCTVFPDIGGHSVSSNFFRSSVVDGMDIPLYQGVFVASVDDRAKGFIQIGQSTLPGMPHQVFGRR

SEQ ID NO: 948262 - protein, 111 aa, Homo sapiens
KAKHSRDSTARTAQTSQHRQHRQHRQHSTDSTAQHRQQSTPQHSTDSTAQTALNAHAHAHSCTPQSRESHKYGSPHIGYRQTKDLISMVRSTWSIQEHGWNGGVYPGKAST

SEQ ID NO: 948263 - protein, 113 aa, Homo sapiens
FFFLRLSLTLSPRLERSGTILAHCNLRILGSSDSLASDSQVAEITEVHHHTPLIFVFLVEKGFHHVGRAGLELPTSSDPPASVSQNVGITGVSHHAQQACPYIIILHNIPRRR

SEQ ID NO: 948264 - protein, 47 aa, Homo sapiens
MTNQYPRALVSSCIYIKRWLQSAITGKRGPLVMQTLYAPVQVDAAAN

SEQ ID NO: 948265 - protein, 123 aa, Homo sapiens
STMVCVDNSEYMRNGDFLPTKLQAQDAVNIVCHSKTHSNPKNNVNLITLTNNYKLTTLTPDTNHILSKLHTIQPKDKITFYTSIHITHLTLKHQQSKNHKMRIITFIENPVKNNEKNEINTEK

SEQ ID NO: 948266 - protein, 131 aa, Homo sapiens
MADDLNFETRNTRASTFPMCSLRKNGFIVLKKPPYKIIKISTSKTNKHHHTKVHLININIFTEKKYIYPSTHNYNIPNIKKNNFQLITIQDKYLSLLQNREIRKNLHLPYNLCKEIKRKYDCREKILITLS

SEQ ID NO: 948267 - protein, 139 aa, Homo sapiens
LGTMASLSLAPVNIFKAGADEERAETARLTSFIGAITIGDLIKSTLGPKGMDKILLSSKQDASLMVTNDSTTILKNININNPATKVLVNISKIQNNKNNSTTSITILATELLKKTESLITKKIHPTIMRIKEKPRKLQE

SEQ ID NO: 948268 - protein, 122 aa, Homo sapiens
TKWPKTPLLLEAEFMAEKSNEKFWQFLETVQKLAIYKQTESDYSYYNLILKKARQFLNNLHINLLKFAFSIKAYSPIQIFQQITANKPPPNNYNTFIIIHKKHTYKINKIKKLLKRATSKTR

SEQ ID NO: 948269 - protein, 73 aa, Homo sapiens
ELCDVAACGDCKQPRRARPSLFRCRRGNGNICPTCRKPSGGDNCTPLRSLPHRSSTYVLTRQAHQNGHISKKL

SEQ ID NO: 948270 - protein, 114 aa, Homo sapiens
RGRNLVGPLVRGLRMGLGGLVFIKPLCPAHHIFITSKGRDWVPPSSEFTSHCSPVGEPTLPPAWVGDRGGGTGGGGSPCTYPAIPTPGINSRGFGFYFNFFVLIFLIRIFILSP

SEQ ID NO: 948271 - protein, 103 aa, Homo sapiens
MKSAFFICRKDGFRLWPLPFKSFQGVPSTPSYEGLIIPFPSCPWASPGPFVPFGLMPQRGLAPICILSLRRIGPAVGFESYRLQWCGREPWVESETTRSTTAS

SEQ ID NO: 948272 - protein, 99 aa, Homo sapiens
ACPPPPGPPAPPLGDKVPPPHPSPHSSGPPAPVPVTDCPKPPGFPPPPGGLGPFHLGFLLSRGSSASPPFGWGSLPGVSPPAPVLGPPAPAVVKPPPKI

SEQ ID NO: 948273 - protein, 144 aa, Homo sapiens
HWLPRYPMYTSNKVTPPPRRQNEKVISWILTFPSLKEPIPYNLGAKTPPASIEVDDNIELISGQNERMGPLNISTPVEPVVASKSDVSPIIQPVPSIKNVPQIDGTKKPAVKLPEEHTIKFPSTHHTQQSPQSAKVFLIVPPSQ

SEQ ID NO: 948274 - protein, 68 aa, Homo sapiens
GSRPFAPLHWVPIQTQIIDVDFLTDKEWDWVNNSHLPCRDVIGKELQKQGRQEALEWVIREQPISQQH

SEQ ID NO: 948275 - protein, 129 aa, Homo sapiens
VGTNSPLDNPLWSISWSLWQKPVGPSQQQPLGLWTKEFPLEGHLLTRNETFTEAPPLKPEIGMLFQMMSKEHFNGDGRAQKSSMTQWKWFIKDHATQGMQRIFFPLGLTLELCEKLLDFTGPNKQLSPA

SEQ ID NO: 948276 - protein, 89 aa, Homo sapiens
MNDGPAPAIPGTPRCLGGHEWCQPTGIPGQVEELKPRQKANPADLITEGNCAAFTVLRLRRAGGRKASRTFEQDPTASGRVWSGLLSEV

SEQ ID NO: 948277 - protein, 73 aa, Homo sapiens
LRFASTLETHQSDALLKWGRSQSGYPGSVKGRLKVCAKRICGMHLLQLVLLSNHSDLASSLIKLQSRVSRAGD

SEQ ID NO: 948278 - protein, 164 aa, Homo sapiens
GTPLRFVAKPGSHPRCLFFPAPRGPLGDPFVASRNHKSPVGPLWEAPPPVGWKAKNPSCLFSQPPPPNWGSSGLVFFRAPSWGAPPKVVLDPPKRGGPLGVFFFSQEKFIWAPLGFRCNDPSPGVFSPLRLGNPRDQGEDPPDDTPPPPGWMGVLPPPPRGGPP

SEQ ID NO: 948279 - protein, 132 aa, Homo sapiens
VHTKGLALLCDGVFYELTHQLAEATAKPPSTIAVQVVPDQLMAFGGSKEPVAIASLHSIGKIGGAQNRSYSKLLCGLLAERLRISPDRVYINYYYMNARQCGRGTISTFRLRADRDPRLFALVSTEPAGTCV

SEQ ID NO: 948280 - protein, 120 aa, Homo sapiens
NQKGIIEAKTAQDFMKNEEYIKKNQSGYGVCSFWREGLLWLTGITNPDSPGFPSQPGGSEQDVIVSGAEGKLHFPESLHLYYESKQRCVWTLLVPEEMHVLLSFSHLDVESRHHVETAGI

SEQ ID NO: 948281 - protein, 62 aa, Homo sapiens
GIYRTFYPKTKGYTLFSVPNGTFSKIDHIISHKVGLNRYKNIEIVPCILSDHHGLRLIFSRR

SEQ ID NO: 948282 - protein, 103 aa, Homo sapiens
SIICNHVCSLTYSHIFQVTVYKLTWAELDQKWEAALVQVLAQRVPQLIVPGAPCPLGVAGLPVALPQKLASEPDSLAFWRHPALQLLHSLSQALAFWPPAPST

SEQ ID NO: 948283 - protein, 94 aa, Homo sapiens
GSAYILFIIAILHFIKRRSWQGASINSRSKSLYFETILFSRLFSNNTSHFFISSMIVLVRKSDSTCTYIKIIWFSSAPECFALCCCSGCRVCDC

SEQ ID NO: 948284 - protein, 41 aa, Homo sapiens
EVRRSRKHGKIGNEEKQDAGETGSEEKQDSTDGFSYILCRR

SEQ ID NO: 948285 - protein, 110 aa, Homo sapiens
YRVDRNRVDHNRVDRYRVDRSRVDHNRVDRYRVDRYRVDHNRVDRYRVDHNRVDHNRVDRYRVDRNRVDRYRVDRNRVDHNRVDHNRVDRYRVDRNRVDRYRVTVTGWVD

SEQ ID NO: 948286 - protein, 117 aa, Homo sapiens
TAQGAHCPPRKGALLQLQTPVCTRSSLLRLVGGRAHTRCESHSPQAYWHGAECSDPGPSLTGPLGQELSVFSCHHLTVGTDLTWQILCLPVCSAQGCPATRVNKSCSFPAKQAPRST

SEQ ID NO: 948287 - protein, 46 aa, Homo sapiens
PVQLKGRKTGIAPTYESQQPGTHQTSKLAEGFAPLEKDLAGVFRRR

SEQ ID NO: 948288 - protein, 69 aa, Homo sapiens
MNLQERDAALMLVENVRVLSRITAKVLSALGGGHNGVVNRDGEIMERAVLPREEEELRLAEVQLEVVST

SEQ ID NO: 948289 - protein, 111 aa, Homo sapiens
MNLSGLSVCRWESWPQFHAKHRASTYYSLNGPCCILLPVFTHFVSCRQYNSRLSEGITVIVLGKLQKSVYFSWSDKHFEVTIHVADKNRFLKTEKIRSRCFAKAALQHRRR

SEQ ID NO: 948290 - protein, 69 aa, Homo sapiens
PQGKKVLTEDKGLQRQNRFNGQGVGFGSNLQKKLGKQKYFLGGAGAIGWELLKNFAMIGLGCGEGGEII

SEQ ID NO: 948291 - protein, 40 aa, Homo sapiens
MPGRVIRHEELTGSPSASEGAEPPAAAVFAYPPRTGVRAK

SEQ ID NO: 948292 - protein, 130 aa, Homo sapiens
ELVLGVPRFPPTCPGFPRCRAEGHAHTRPFSSGPPWGTAPRGWGFQRVPSGGRSFSQTLHFQPGQSGFGGQGPPRQQPQGPWGFEVPPLFPSGLFPSSLLPGLFGFACVFSELFFHFANLNKGRPFSEKK

SEQ ID NO: 948293 - protein, 76 aa, Homo sapiens
PKKPEENPAFKFSFASKYAALSVDGEDENEGEDFFRIDLYILCFSPSFSPPWNIREQIKTFFPARQNKTQHLLKKK

SEQ ID NO: 948294 - protein, 139 aa, Homo sapiens
GTRPRAGIRMSIKLHQYLGSFYFSDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNGKGGPPKKKGGP

SEQ ID NO: 948295 - protein, 41 aa, Homo sapiens
VALGPQNSARGCGVPQGAHLPLGAPPPPPLPVFRVNVPPVG

SEQ ID NO: 948296 - protein, 73 aa, Homo sapiens
ASILNSDEEESLSMYEIEEVHMKSPSLMGLGHPSFLLPVYLWIGNVGLAGEQKLFSVADFSTSNTKITWRKKK

SEQ ID NO: 948297 - protein, 45 aa, Homo sapiens
RHEEYPHCEEKMVIITTKSVSRYRGQEHCLHPKLRPSGQHEAPGG

SEQ ID NO: 948298 - protein, 135 aa, Homo sapiens
SKRDIEDRIVARSVDADDSDVEVNSDDDSDEDDDDEDDTEALLAELEQIKKERAEEELRKERQQQEEELKVKQAELLRGNPLLNNPTASFNVKRRWDDDVVFKNQSRGETKTAKRFINDTIRNDFHRKFLHKHMK

SEQ ID NO: 948299 - protein, 35 aa, Homo sapiens
WQVVIPPYGREQSTAVNFGALEILTASNRINVVFS

SEQ ID NO: 948300 - protein, 39 aa, Homo sapiens
VDNLLRTIGPHVSSNINIIRKSIRIEMRVANQGDLFFRS

SEQ ID NO: 948301 - protein, 42 aa, Homo sapiens
PWMFSEVAIERSGWYHRNVALIPFVSVNMSSAGQTHINFIHV

SEQ ID NO: 948302 - protein, 70 aa, Homo sapiens
NHQKNNLYTESTIIHNSRDYQMPKGHGRNLTNRNQDHSPSPEPSTPTSPSPGNPNTPETSGPHTPHDPQF

SEQ ID NO: 948303 - protein, 141 aa, Homo sapiens
WRKCHQYWENNRNSGEFRKTGVLDAEFEAHMMDMMVKASKIDVCRGNGAGPNRDRSGPSIGHRGSSPGPRTSNPRPIMMQPRGVMLCPANHETGGPAGPDTHLRCGRAELLYIPANHVTQGKLLADVSSLRQSMTFGAGPA

SEQ ID NO: 948304 - protein, 121 aa, Homo sapiens
MRWVTLFHPIPGARIQRVFFFGCPRKLKMGPVAEVHFRSCFHPVCVFLPFSAIRSWRFAVLLANFGASAGFQINHYPLPHFQAFNKVCCLLRGFEGETRGPGHHKLLTLGKHLAHKVFGTF

SEQ ID NO: 948305 - protein, 46 aa, Homo sapiens
SGTRGYREPVPYCRRKSSGQVRNRGSSWVMLRGASGDVGGMEYLAA

SEQ ID NO: 948306 - protein, 64 aa, Homo sapiens
MHTTVPSVYVIHTSPGTQTQASCLYSKHHGHCLISYSPPPPDLLLKPLPWEGKIVQKVDAAASL

SEQ ID NO: 948307 - protein, 88 aa, Homo sapiens
RCVVSPGRHRPPCCVRVRAPGVGGAEWRFPFSCGSGVCMRESSFHDADGRRGVGAGGRWGSPRPRLSVGLSSPRRQSVITGKENCFKM

SEQ ID NO: 948308 - protein, 80 aa, Homo sapiens
FGHHMNQQRMVTYGVTSGLEETAPGLPAIAAMSVMTTTTVVIGTQCDSLGFEVQLWLKDCDRQQRLGTLPILARIQTPGL

SEQ ID NO: 948309 - protein, 69 aa, Homo sapiens
QVSSPGGGMGMVTVVLLMSPMMLSASFSAWCMCSILLCCACFANSSISVFWFPHEYILASGSEMMNSGV

SEQ ID NO: 948310 - protein, 83 aa, Homo sapiens
VKCARERLPESVRELAPLALGHDPELLVVVLEQLVLLDDLGVASFPDRFNRAFHHLRRHPRRHPSDGVAGAAVPATTAPERMR

SEQ ID NO: 948311 - protein, 98 aa, Homo sapiens
VTGSVGSRNIEDSTLYHLMNIILLQRKIDGDSTNSEGEEPTAHVNCQHLEFRRENQLHLISFYVWLTKPPIGLVLILTVQKPNHLSDRRRRGPRLRRP

SEQ ID NO: 948312 - protein, 91 aa, Homo sapiens
GNELKHSIVEPLGQRTKEFPSVFIIMHCYTQETSGRISGNFGMRCLEKSLVFSMRRLDRLSFEVMYGNENHLYSLEKNFMLMANIFRPPPP

SEQ ID NO: 948313 - protein, 63 aa, Homo sapiens
RHEEEKKKESILKTERGRAGEGASCGAPGFPHAACGGCGKEINFSSLWDRRCVETKKNMRHVN

SEQ ID NO: 948314 - protein, 48 aa, Homo sapiens
MESLTHVYKSYVLEKGYLAVIGKHLGRSQAEAGDRREQGWGKELRGGV

SEQ ID NO: 948315 - protein, 45 aa, Homo sapiens
MDNYSEDQVTEKEWSDVIRSLSLSLAQDVLVRLEEGPPHCQEVAA

SEQ ID NO: 948316 - protein, 70 aa, Homo sapiens
MRFPYVPSLVLNSWDQVILLIQPHKVLGVQVCATAPSPYNFYTYNKKLKIQCKNLFCYKEADYGGSVKDY

SEQ ID NO: 948317 - protein, 73 aa, Homo sapiens
GREASGIFKGFDPLLTFVVGGPIGKMGAPAQYRFRGDPRQLGLVGGRGRSGGLICPQEGMGAIPTPFIQKGDP

SEQ ID NO: 948318 - protein, 166 aa, Homo sapiens
CLFSILCLLICLCLSFSLSLSSSSISMCFCLRLSSSSLSISFFFSSSSCLCFGIFSIPFLSTSFRLLCSPSIFSSMSIWFCVHLYLSVSIFSNSIRCSLIFLKTSSNSDVFLSLRRAVSISISLSTLFFISSSLRLQSFSLSLSLSNVLSGSVVDAAANLVVVGGR

SEQ ID NO: 948319 - protein, 42 aa, Homo sapiens
HSHTHTCTHLLSLTQRLNPSSFLIVSFLCYTEGTWYNQWTVP

SEQ ID NO: 948320 - protein, 92 aa, Homo sapiens
MTWSESGVINATQRKGPARSNVVLRSDDADIYKTLIVRKLESVPPRMTLWMPDLHRYLRITIHVLLGKCSRASRHMWEGRLFKIIKCVTISL

SEQ ID NO: 948321 - protein, 60 aa, Homo sapiens
MWEDEMTLEHGDVGTRDDHHEITDVEDLVHTYPHRPCNCCVPMMAESSEVRQITQLDPLC

SEQ ID NO: 948322 - protein, 127 aa, Homo sapiens
AEVEEDGEQRMQRISRMGSRGCRGGGGWGAEDAEVQEDGEQRMLEVEQDGEQEDAEVEEDGEQRMHRCRRMGSTGCRGGGGRGAEDGWVEGLTSFRAAVALLGNIVTDVTTRFVLFNVDAAANLVVV

SEQ ID NO: 948323 - protein, 47 aa, Homo sapiens
EPTTQQGVLKATDGAVTLAPRGDPDDDGHRLSPGGSVISEIRKKAFQ

SEQ ID NO: 948324 - protein, 116 aa, Homo sapiens
PGHAYLATLNTMKDVLNDSENKAQVSVNVLSDHDKVEKSLQEKKSCDEILGNQKPALHKLAEETKALEKNVKPDVEKLCKQEFDDLQGKWTKLKVLVTKDIQMLEENAITIRAFAA

SEQ ID NO: 948325 - protein, 67 aa, Homo sapiens
SLSGSPSVNGLASVEYVMNRGEQAYLEYTITDQTMRPEGTGRWTNYLYKPTNATDPKIIKAGSGLYV

SEQ ID NO: 948326 - protein, 53 aa, Homo sapiens
VRGTQDSDVMRELTYPCRFCRSRLTSKLNQLSAFRYVKASVYQSDLNKVVQTQ

SEQ ID NO: 948327 - protein, 86 aa, Homo sapiens
KAQFSPRSADAVLGVPLFDPEAKWPVAKSCLSVSRLQIRDLSGGGESLDSPRASAPFVTLACPVLPTVYFLSVCLRSPMGPVFLCP

SEQ ID NO: 948328 - protein, 117 aa, Homo sapiens
AQEIDEMNQKLQRLQLALVNRKGPILLHDNARPHVAQPTLQKLNELGYEVLPHPPYSPDLLPTNYHVFKHLNNFLQGKRFHQQDAENAFQEFVESQSTDFYVTRLKQLFFRWQKFPE

SEQ ID NO: 948329 - protein, 77 aa, Homo sapiens
GFPHTPEHAQRHAREGVISKVGVQPFTHPQVVCPAHLSHPRHRFVQWFDLVVPQAVKGLPSQGQAPNARKFLGASPG

SEQ ID NO: 948330 - protein, 131 aa, Homo sapiens
RIYAMPCASSGDLRGLDESDRPLSYNATRTLSQRFIDQTDWRPWSTFNRHITFILRSDTYTEVVYEPTQGIADRGLRSFGKTFFQATQHQYDFVLADRHHPDFAIGEHRFVRLDMAEKEESSAREFSSSRR

SEQ ID NO: 948331 - protein, 107 aa, Homo sapiens
MTAGVLRGRYIHGNGHGMVQGLQKLQLIIQGFFSCDPAPDLTAQLHDSDDRNQQHQQCAADDLQDDQFVVAPVLATHSRISAPANGDCIKLVRWDAQQVDAAANLVV

SEQ ID NO: 948332 - protein, 49 aa, Homo sapiens
GHSVCLLYNTHYIDLLTVHHLKMKICSGSLGSFNILCRRGREFSSSRRP

SEQ ID NO: 948333 - protein, 121 aa, Homo sapiens
DVCVCVCVCCAVLCCAVLCCAVLCCDVCAVLCCLCCAELSVLCYAVLCCAVCAVCAVLCCLCCAVLSVLCCAACAVMSVMWCVVCAVLSVLCCAVLSVLCCLCCAVLCCMFWQCWCLLCRP

SEQ ID NO: 948334 - protein, 98 aa, Homo sapiens
LTHNLMSSYVWVRSVAFPLRFQATEVRICLVEFNPNFVACMILKVEWSVFLEVADNLCLIQVPKGLVEGYEENEEFLRTMHHLLEVEVIEGTLQCPES

SEQ ID NO: 948335 - protein, 82 aa, Homo sapiens
STSLHHVLPTVLTTTSRKKKPKKTDLVSPLCQQAKKHATVSGHVGDMTHVKVQDKNVPSPAPFRVTQTDSNLKKLQNMKKGY

SEQ ID NO: 948336 - protein, 123 aa, Homo sapiens
MTSHSIPLHSIPLHSIPFHFIPLVLIPFHLNPLHSKWVDSNPFHSIPFHSILLHSTRVDSIPFHCIPFHSINLGLIPFLSIAFHSIPFHSIPFHSIPFHFIPFHSFPLQLELIPCRRGREFSS

SEQ ID NO: 948337 - protein, 56 aa, Homo sapiens
MVYINTIIPETLDPLQFAYRPNRSTDNAISIALHTSLPHLEKRNTYVRMRRRAREF

SEQ ID NO: 948338 - protein, 111 aa, Homo sapiens
MGTATSHRRFSSATVMSLGFFTPLIANTHASGSATICSDGGATLLRTNKRSSGVIRPEPNALRLVSMVLALCTIKLSACFQDAKAGKALACVFAFSWASAADKGVRLAVPA

SEQ ID NO: 948339 - protein, 104 aa, Homo sapiens
IPSSCPQSPFPPVVTIPSRCHHSLPLSPFPPVVTIPSRCHHSLPLSPFPPVVTIPSRCHHSLPLSPFPPVVTIPSRCPQSPFPPVVTIPSRCPQSPFPPVVRRR

SEQ ID NO: 948340 - protein, 102 aa, Homo sapiens
SVSTSGKDLFMFHTTTKPVVRGHDKCLFQLRRLKIFGMGPQILKRFQSCVFESILTGCITAWYGNCLSTDQKVLQKVVYTAKPLYQAVSGEAPKNLLLPPKS

SEQ ID NO: 948341 - protein, 59 aa, Homo sapiens
MGFLAISMDNHLELRGRATINKVPDSSPQQKQQESPRVHCPLSNSVYSGLKGGCGEGRR

SEQ ID NO: 948342 - protein, 50 aa, Homo sapiens
MEVVVVAAVGGSDGGGGGELLWEEVMEEVVVAAVRGSDGGGGGSGCGRGR

SEQ ID NO: 948343 - protein, 121 aa, Homo sapiens
CVCFCENKHMWVPVCMDAYRGACAVLCCLCCLCCAVLCCAVLCCLCCAVLCCLCCTVCAVQSVLWCAVCAMLCCLCCAVLFCAVLCSAVCTVCAVLCCTVLSVQCCAACAVCAVLCCVGRR

SEQ ID NO: 948344 - protein, 94 aa, Homo sapiens
WGARGGQGPLFPPVPGGPKGGRCPPPLGWSKPFGGGFGAPPPGGGENRGGGPPKPPPPWGPPPPGGGGGFSPPARGGAVCPRKSPPPPFFLGFW

SEQ ID NO: 948345 - protein, 107 aa, Homo sapiens
GRCGFVVRLIPAPRGTGMVSAPVPKKLLMMAGIDDCYPSARGCTAPLGNFAKAPFDAIFKTYSSLPPALWKETVFPKFPYQGFIDPLVKTPPRVSVQGTQAPAVAPT

SEQ ID NO: 948346 - protein, 110 aa, Homo sapiens
PIQGFSPPGGGGGSPPPPGAGKKGEQRGKGGRPFPPPPPFSLGGVLKRGFCWGWALTQGAGPPFFWGFFPFGGGGGGGPLIFGAPPPSPPPPPKKNPLGGGGGEKIFPPF

SEQ ID NO: 948347 - protein, 30 aa, Homo sapiens
MWVRGRKEKKEPGKALYVTLMEPSYDRQSI

SEQ ID NO: 948348 - protein, 107 aa, Homo sapiens
VGPKTPPFQGGAASRNPFPLGVTPKNFFETLSSFSKEGGGPPLGGLKIPNFLGGGENSPTKFFGVFPFFPFQKGFKKNSSPPGFPHPFPKPRERGGVYFSGQKNRGL

SEQ ID NO: 948349 - protein, 173 aa, Homo sapiens
MNASQIGFCPAPRPTTATLYSSLWGGANLLKVWTLANCKLKTHPIGHTGYMNTVTVSPNGSLCAFGGKDGQPMLWVFNEGNPLYTLDGGDIINALCFSPNRYWLCAAPGPSIKIWVLKGKIIVDELKQKVFSTSSKADPPQGPPLAWFVDGQTLFAGYTDNLGRVGQVPIGPR

SEQ ID NO: 948350 - protein, 107 aa, Homo sapiens
MELTLIYDMAHYHPCKVAAAASCLSQRVLGQGKWNLKQQCATGYTENEVFQFLQHMAKNVVKVNEKLTPFFAFKNKKASSKLLKMGMIPQLNSKAVKDLASPLIVRS

SEQ ID NO: 948351 - protein, 122 aa, Homo sapiens
GGKNFGFWWGFYFRGGPPQFFGGNGGFPPPGVFPPFFQKMGGGPGGGAPPFFFFRGGGFPAPKSPRPGFKNFPHPKIIFSFPPRVLGGWANPLFPPQGPPPFFLGGGPFWGGPPKNLGGPRV

SEQ ID NO: 948352 - protein, 145 aa, Homo sapiens
LRSFLELYTTMHVDWLAGFLYLTEQQCRIQLLVFEHKMNSLVWTSGMSALDGEFQSASEVDFYIDKDMIHIAYTKVARRYGDFFIRQILIFEAFTCTAEEDGTETLMIFTHIQEPVLMHYQAGSVFARVKPLRRSAISLSPQLTS

SEQ ID NO: 948353 - protein, 92 aa, Homo sapiens
PSGLMRLFLSLPVLVVVLSIVLEGPAPAQGTPDVSSALDKLKEFGNPLEGKGRELISRIKQSELFAKMREWFSKTFQKVKEKLKIYSLGPEG

SEQ ID NO: 948354 - protein, 74 aa, Homo sapiens
GISCEIINIHTIKPLDEEIILKSVEKTGKLVTAEEHNFLGGLGESVAGDFGKKKANTTGICCCCRSGREFSSSR

SEQ ID NO: 948355 - protein, 77 aa, Homo sapiens
RAVWPENKPIMVRISATDWAEGGNTADDGVEIARLFKQAGADLIDVSSGEVVLEQQPIYGRMYQTPFSDRIRNEGKP

SEQ ID NO: 948356 - protein, 102 aa, Homo sapiens
LSISPFFCPPLSVCPSLLPLSLLSISPFFCPPLSVCPSPLPLSLLSFSPFLCPPLSICPSPFTSLSPPHLSFPFSSSLHLSFLLSSSLRLLVSFYVDAAANL

SEQ ID NO: 948357 - protein, 30 aa, Homo sapiens
FPWHHHHLTTSTHLQGARVVDAAANLVVVG

SEQ ID NO: 948358 - protein, 111 aa, Homo sapiens
AAGLELETHIGDVKRFSQVQREVDGVGVLHPDQHGLALPPGGVGLVVVVGQEGCPVMKVGLPGVAQVTGLGDTGHPGLHTVFLGRSPTRVGGPHSHVESGVDEIGHAALRP

SEQ ID NO: 948359 - protein, 146 aa, Homo sapiens
RHEGDLGQHPLTLQAVSEQRAEFGDRSVVEASPDLYANALQASVLPWRLLTLLPHLHPPGYCNLNFDPATAGDELFQLKETRWVLNLGILLEPLTGGGPFPGFKQLTADAVLARPVRGPPLGREVEVSNIVVCLGVTYPRSSPLGG

SEQ ID NO: 948360 - protein, 71 aa, Homo sapiens
HPFAGASKGDGLFAVSIENSISTRIQQKPQEAPQSVVLGAAADQDTIVKAAKKFAHSDNVKALAGGVNPST

SEQ ID NO: 948361 - protein, 151 aa, Homo sapiens
MIAILLATSQGIIIRSQANIRLLLSVGPYQGIDFGHIDVIEFLDSLFDLMLIGLDIHNEHKSVVVLYFLHGCLRGQWEFDDSIVVKLVSPGALFRGYFGCLRSRRVLGRRKVGDVRIFFFLWLWTPFSTAFLAFKAFALASALGGAGASVD

SEQ ID NO: 948362 - protein, 70 aa, Homo sapiens
EALANPRRVDGDHSVRRTVLVVALDGALHGDYTVEDDVDECRNGEDVGDRSEGRVLSERVTGEDAVVLVD

SEQ ID NO: 948363 - protein, 68 aa, Homo sapiens
AEKFHQARKGVGTRHKALIRIMVSRSEIDMNDIKAFYQKMKGISLCQAILDETKGDYEKILVAFCGGN

SEQ ID NO: 948364 - protein, 161 aa, Homo sapiens
IYDPRGRFAGLGITPEAKYKLCKVKKIFGGTKGIPHLVTHDARTIRYPDPLIKVNDTIQIDLETGKIPDFIKFDPGNLCMVTGGANLGKIGVIPPKKRPPGFFDVVPVKNANGNSFPPGLSNIFVIGKGPKPWIFFPRGKGIPLPLVEKKNKRLAAQQTSG

SEQ ID NO: 948365 - protein, 77 aa, Homo sapiens
KRGAPGPPPNPLAPKGQGGFLALGGDLATNPSRSGPWMWKTAREVREVLAVFTPGASPGSKKGPVLNKGPGQDEREI

SEQ ID NO: 948366 - protein, 52 aa, Homo sapiens
MKWPRSRAGHLLHPSRLCDVGTGRPGPSSSLRPPSGSRGNRLGGSRASSKDT

SEQ ID NO: 948367 - protein, 126 aa, Homo sapiens
CPPGVEAPLTANFKNRETIPARGPLVAAPVGGVGLEQVGDVKVLGWFQPQECVVLLVAGVTGVAPRKVLDLGFRAGAQPGPPPFCCDQHFGGGTRGLEKGGPFFLHGGPRGPAVGFYTKDLGPFGG

SEQ ID NO: 948368 - protein, 50 aa, Homo sapiens
MAAIRKKLVVVGDGGFGKKCLLIVFSKDEIPEVYVPTVFEKYVADIEVDG

SEQ ID NO: 948369 - protein, 71 aa, Homo sapiens
RGAPSTGERLSSSSPHARWGACHPGLCPSGPEGQHVVCERQAPGPPQEQLRGDPLREIRAFGCIRSDLSCF

SEQ ID NO: 948370 - protein, 70 aa, Homo sapiens
ASGGLIEKVLLRPGFPTRAPDLYRIPEAVRPHKPQKLDLEWGMVGVGVIRPEACPGTRVSPGYGKTHVLG

SEQ ID NO: 948371 - protein, 125 aa, Homo sapiens
TLPPPTSPVGRSRLLLSPPPNYTALPLPHRARGILFLPTPSAAPSNFVARPHKTPRSSLAFISPPLPCVRKRCNPHFPCVYRIPRGTKVFQVLEMSPLTRCDVSSKHRLVVTGSGEHAPVYQIPY

SEQ ID NO: 948372 - protein, 145 aa, Homo sapiens
ASAIRGVLYLAKVSFVSVARGPWGNKIGKPHIVPCKVPGPPVFCWAPHPRTQGNGYGLRTCAQKTGHKGWYDVCYTSARGCTAPLGKFAKAPFDAIFKTYRYLTPALWKETVFTKFPYQEFTDPLVKTPPKVSVQGNQAPAVGPT

SEQ ID NO: 948373 - protein, 110 aa, Homo sapiens
CTDQLASAFTDIFNLSMSESVISTCFKQTTIVPVPKITMVTCINDYRPIALTSVVMKCFERLVMAHKHHYPRNPRLEVGRLIEVDYEVDRLIGMANFGRRGREFSSSRRP

SEQ ID NO: 948374 - protein, 67 aa, Homo sapiens
VNREYRRGLSKHPCGVPCVEDKRGGGVSYLHHLGAARQEVQDPVAQGVQTQGPDLNDELGGYYGVEC

SEQ ID NO: 948375 - protein, 105 aa, Homo sapiens
NLPGILGAFQKKLGIRVGETPPAKLFPLIKVECLGAWVNAPMVQINANSYGVLPAKDIEEIIDGLRAGKIPKPGPRRGRFFCEPGGFPFLIDPPKGPGFGVQAAL

SEQ ID NO: 948376 - protein, 116 aa, Homo sapiens
VDATSCVNGCLAPRSLQLIAAMMMARDTKYRSARLICATSSASPPVIIRIAAISVSPSKSLFIQLVVLLFVIFPGLERFMKRHVVSRWLIILAKQGIEELVIGQACVASCLLLGSK

SEQ ID NO: 948377 - protein, 42 aa, Homo sapiens
EEDSEIISDDISDIFRFLDDMSVCDSLGVIQSSCYNSIGSLS

SEQ ID NO: 948378 - protein, 48 aa, Homo sapiens
SGAQWGLRTHHISNIKPSFTGENTLRFKHLSPIFLLSLNPDIITGFSF

SEQ ID NO: 948379 - protein, 108 aa, Homo sapiens
MNRLRSAHYQTDNGINPEDHLPHKQGKYHVTLTVNLTVAGKSASDGIQLMAPSSTIQKLSGHSYVFGVGGVVVPNQNVFVTYTWLADVNASVGNACASSSDNAVITNK

SEQ ID NO: 948380 - protein, 171 aa, Homo sapiens
TLNGAVARSRGSLIAPFGSDDIMLPERIAIQVAHMDGKPEVGICAGNMELIDSDGNPFPEKRPCRDVPFRRLDFDDMFLDRKPYPPAPTLLIRREALEKVGGFDPTIRLEDLLIELKITHAGYFIDALGVSMALYRKHASNSSKNHRFMIEAILKTYALFSDHAASTRPRI

SEQ ID NO: 948381 - protein, 121 aa, Homo sapiens
KARSGRPSNISDRQRRRMVRTVRYSPQTTSKDIQHHPAADGVTVHRSTIQRTLHKEKLYGRVMRKKPFLHTRHKQSLEVCKRTFGQSSFILEKVLWTDETKIELFGHNKGRYAWRQKNTST

SEQ ID NO: 948382 - protein, 91 aa, Homo sapiens
KEEADFCNISVNDSSSSSENLMAVTSRVVQWSKALHHSASCVTTDHGFNPGLGSCRPETRKPMWRCPASSGFEGLTGRDVLVPLCSSDSVD

SEQ ID NO: 948383 - protein, 125 aa, Homo sapiens
VRVVLDTPPDKSESSSYTTCKVRVVLAVPPDKVRVVLDTPPDKVRVVLATPPGKVRVVLDTPPDKVRVVLDTPPDKVRVVLAVPPDKVRVVLDTPPDKVRVVLAPPPDKVRVVLAVPPDKVRGRR

SEQ ID NO: 948384 - protein, 30 aa, Homo sapiens
REVGFTSSEGCVGSMAGEASGNLIMAAGEG

SEQ ID NO: 948385 - protein, 81 aa, Homo sapiens
VVSEGVDLASLLEEEDYYYLVVSEGVDLASLLEEEDYYLVVSEGGDLASLLEEEEDNYLVVSEGGDMASLLEEEEDNYLVD

SEQ ID NO: 948386 - protein, 95 aa, Homo sapiens
VDAAFKTLQLCGFRKKNTSYQQRHIEHASLLSGLVNFFQQNATLVLPLNKMNQENTTELIDNENIRCEQVGLICVIMRLASVLATGVLQPRHRRR

SEQ ID NO: 948387 - protein, 107 aa, Homo sapiens
SEKNMKALFLAGHWRQGRGAVARSIFPADGSVNAEFSTASLEDVQEAVQAAHRAWQEPSWNSLPVERARVLYKVADLIEQNVAELAALQTRDNGKPLAETRSTRPRI

SEQ ID NO: 948388 - protein, 125 aa, Homo sapiens
LLNSRPRRPALAGNLLVQSADPTSLIHIVLKGGTLPVTHTAHSNFTTPASAWRLSDQEVADVVGFIRGSWGNQGGAVQATDVAALRKEDMPAKPEAGACQTVLADSPDSITVYKYSNGAFPMFVD

SEQ ID NO: 948389 - protein, 36 aa, Homo sapiens
MAWESKLFRSLLDLDLALWYRLPVDAAANLVVVGGR

SEQ ID NO: 948390 - protein, 156 aa, Homo sapiens
RRWVGSQEQPVDHENARVGGRQQEDRAAHTEDSYQRRTAEGSNRIDQLPHFLSQRVGRLVTTALDDGLRTLIEASDDPQTRHEQLAFVVLNQRVHVAARHQPGDDDIVGHIQPAEETEEFVEHLPGPALEVLAFSLLLDTIDHIGPFALHLLAGRR

SEQ ID NO: 948391 - protein, 90 aa, Homo sapiens
VNGSVGIARPQLTTDAEPADITRSRILLRLPSTAPTRLPLYGINTRYEATRYSLPGDFYAETSFNGYRFFAPAEHYRSADFSRAERDLVD

SEQ ID NO: 948392 - protein, 91 aa, Homo sapiens
IFWVAEESEEVLIKNWVSTSSGVKKVVFRFRSVRSIVIPAANTGSERSSRTAVISTSAATTLQSHQTDQVYSMANALKFAAQITASYPLYL

SEQ ID NO: 948393 - protein, 76 aa, Homo sapiens
PINARHLIGLETIPPGPQSMEKLCSAKPVSGAKKVGARFWKSWKRQVNAFSPLRLKGPSPIVLLSLNPGIITGFSF

SEQ ID NO: 948394 - protein, 126 aa, Homo sapiens
RVVGAPRPPTPPPPRIRAPGVFCPGGVSPGGTPVKKNPPPGFGPPPGGPPPGGQRPPPFGARLDLVNLGEGGPPFWGPPPGGFFGALFPPPGGGPFFFFFFWPFFFFWACFGFFFKKKKFPFSPRG

SEQ ID NO: 948395 - protein, 115 aa, Homo sapiens
MAELGPGVPVAAAKPGILTGGGGCTGARTEKPPLNPTRGDCWGPIPTAPISLRWRTGREAQPGGPQAGRAGDPEADQAMHLQPAWAPKLQPPSVCRQQPPGNSRIRPSLPTSWNE

SEQ ID NO: 948396 - protein, 81 aa, Homo sapiens
HEAGLQILGRKEFRLRRETRIWRIRGSNTRGTMFYYPNVLHRHTGCFATIWLAATRGSRLVKREYLTANVVKTCEEILNYV

SEQ ID NO: 948397 - protein, 97 aa, Homo sapiens
MAIAELCCAVPVTDRFLSSEPSQALMDESALRCTAPPSILTAALSWVGQHVGVSQEDGAQGLPGDCRAGGSREGIVEEVSSCGLPSAPPRTRICTVR

SEQ ID NO: 948398 - protein, 99 aa, Homo sapiens
MARMAVMGPRTLVLLLSGALALTQTWAVSHSMRNLLTSVYRPGRGEPCFIGACYVDDAHVVRLDRDAAEPEDGDRDAADRAGGSGVLRRRDTESEGPVT

SEQ ID NO: 948399 - protein, 44 aa, Homo sapiens
ARGLVPEAVSEHNLMDYPGEENFKLQSYGAYPTQPGQGYSQESS

SEQ ID NO: 948400 - protein, 33 aa, Homo sapiens
EPILHSLSLRYMCLSKLISLTFSLLSSSRNTVY

SEQ ID NO: 948401 - protein, 114 aa, Homo sapiens
GIKHGVMGSWPHGHGVMRKAELWVQGLTDGTHCRAPPLCPHLKQLHPSVLRPSQSFGDGFPVPGFPQETGGQDKYKPRGSIIKDPTGSNIGCGEDPEFYVLVGLGSFSVVSAPC

SEQ ID NO: 948402 - protein, 107 aa, Homo sapiens
MGYMMAKKHEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 948403 - protein, 108 aa, Homo sapiens
IQRGLFYGKAGGGGSPKVLSGELSEPGEGSSQVNRSVKVGQEQINGGMSSVKAGTGPFHFFCDSSLASGHLDVYMQVTGDMMALLGLRGLTHITKLTLWIRLKFFRRR

SEQ ID NO: 948404 - protein, 100 aa, Homo sapiens
MATSNEANYNNTFFVVSLPVQGAFWGNTPILAEFAGEEDVQRFFAQGQQLASTTSWQADPGVNQTRMGGSGPRSSHPIGHPHWNSGGSGGGMGGGGAKVD

SEQ ID NO: 948405 - protein, 121 aa, Homo sapiens
CANSPAALRLSRCRSGANINYRVNGTPMSIWLPAFLLLLRPTIKRFLAVDFPLQEYLIPLRKNRSKASDNATIGTQGLAVDPGTVDTGQKRHCRRNILWLAQTLYRCHFCQALYQFRRFVD

SEQ ID NO: 948406 - protein, 90 aa, Homo sapiens
SIPVKKVASVCLRNWEGFGILLITPLMWFGESLSPMKIGGLVLLITGYGLIKSGTKKATVRGSAQKVKQVAEHAVNVAKSGALPRSEAKS

SEQ ID NO: 948407 - protein, 75 aa, Homo sapiens
STSTQNIYVLFHEPLCYHFCLMARCSIMLEKALFVTKLFLDGWEKLLSEDVLVPFFIHGFVLGKIVSEPTPLAST

SEQ ID NO: 948408 - protein, 87 aa, Homo sapiens
RRRSVSSSSGGDISSSSSSSSSSSSGGSSSSGSSSSSSSGSRGSSSISDISSSSGSSSSSSSSSSSSGSSSSGSSSSSSGSIVVVQW

SEQ ID NO: 948409 - protein, 122 aa, Homo sapiens
ALWESFGIQGLQMIFSNVIILGSLPSHWLSTSASFFFLLLLYSCSAAAASTVEQPTALSDLMALLSLLLGSYGSNPTTTILLLLSLLSLCCSSAVLNTKGHQEKATQDNFLSLGYNFLFYFL

SEQ ID NO: 948410 - protein, 88 aa, Homo sapiens
RACLEVLAGERSYSYTLDRRPVLLYRGWSSSSTERAASGGTHMELVREEGDTRLASQISRINPGDQWGDRCRSQIARRRGREFIVVVV

SEQ ID NO: 948411 - protein, 69 aa, Homo sapiens
RVDALSAHMTLAQAFTTRAQTQCPRMAPIILHIAVYYFIQHCEGQPELPEKSLSFSGLGYVHPPYKCIK

SEQ ID NO: 948412 - protein, 142 aa, Homo sapiens
VYSLYTAACLFPIYSSVSIPYIQQRVYSIYTAACLFPIYSSVSIPYIQQHVYSLYTAACLFPIYSSMSIPYIQQHVYSLYTAACLFPIYSSVSIPYIQQHVYSLYTAACLFPIYSSMSIPYIQQRVYSLYTAACLFPIYSVD

SEQ ID NO: 948413 - protein, 67 aa, Homo sapiens
DTALNVNGNTSLVTITFSETVNNLALGALTVADGSLSNLVQVDGTHWTATLTANPGVNHVGDVISRR

SEQ ID NO: 948414 - protein, 54 aa, Homo sapiens
PEGQPPGQKGGQWAQAPGRGYSPPHCQAPQAPGDNHVVACTALTPDYYNGSFWA

SEQ ID NO: 948415 - protein, 224 aa, Homo sapiens
MGEYFRKTKGRNTGLLESIRVDELNAPKQGQVWPSPFQDSSFMDLFFRAPKPPPGVSCEGRYFPWGESLFSYPYHFPRVRLEAVAKPPKWEPNGLSKADVGIPLEPGFWSQVPLRINNKGLRELVVLAEHFRYPNVPFSHPLERVPGSFMWKNEKFGLLTIQRLVPDPRKLLFFGVLVHDIPSMFREFTLAAKIPRGTNRYAHELAHGYTTWKCMRNSGLKVIR

SEQ ID NO: 948416 - protein, 139 aa, Homo sapiens
LIQVAVTELSFLKKVIIQSLNYPDNYSDKANCDWIFQASKHHLIKLSFQSLEIEESGDCTSDYVTVHSDVERKKEIARLCGYDVPTPVLSPSSIMLISFHSDENGTCRGFQAIVSFIPKAVYPDLNISISEDESMFLET

SEQ ID NO: 948417 - protein, 132 aa, Homo sapiens
MGHSSTLSPDVGTSPTGSVGLSLCAAMRECRNKDTRQRDKRKGSWARGTTTTNAQTPVVAPNVWLRCYLLDTRQKGQGKECESPPMIGKVTWVTCPLDRGPFPAWQLRQRGRGSRERDSLHHYFCISGTIVD

SEQ ID NO: 948418 - protein, 33 aa, Homo sapiens
MALVTVQRSPTPSTTSSPCASEADSGEEGIGPR

SEQ ID NO: 948419 - protein, 30 aa, Homo sapiens
GTRQEVEKFTKRLVKVTKQHNDECKHLLLG

SEQ ID NO: 948420 - protein, 157 aa, Homo sapiens
ARGAYIEGAKGTSTQFRPLLWEPDRDRCCQRCLCLIHRVNPQMLRLNADPHFFTHDFQDLKNEGEAAASGGGPPSGGAPAASSAAREQLRGRNQALDYEPGPLGIPRGRAHPPPQPLTHTRTARDHKATVAVTDGHRPGWAEEETPMPLMGKWRPGH

SEQ ID NO: 948421 - protein, 31 aa, Homo sapiens
HEDLAVKHFSVEGQLEFRALLFVPRRAPFDP

SEQ ID NO: 948422 - protein, 98 aa, Homo sapiens
NISATGNFHKGVNDLRDKARRALYAIKRNINFNIPIRIWLKILESVIEPIALYGCEVWGPLTNQDFTKWDKHQIETLHAEFCKNILRVQSNTPDNGRR

SEQ ID NO: 948423 - protein, 171 aa, Homo sapiens
ARGRTAASWLKDFYYQGPIPRPTPAMVFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGK

SEQ ID NO: 948424 - protein, 102 aa, Homo sapiens
HSHIPLTLSLVPLHRSKGMIQLLLLTLCNFRPRVGHLSPSLSSVGLGTDVGQGAHLACVHALVAVDLVADHEDDDEDEHGGYDDATDNDDHGAAQELAVEST

SEQ ID NO: 948425 - protein, 129 aa, Homo sapiens
SVSNQIIARPSSAPTLPLLPPLSRPERDTASPQEEQAATRANGDSELAMQYAIALNLAGRRTHVEDFDHIAPHSTFGQWWRHLHDAFQLPDVQQWIKALGVDTTSIKIDPKSGQISFYRERFLDPLRST

SEQ ID NO: 948426 - protein, 40 aa, Homo sapiens
ARGIKKIFEFKETLGTGAFSEVVLAEEKATGKLFAVKCIP

SEQ ID NO: 948427 - protein, 107 aa, Homo sapiens
TSHLNVQTSHLNVLTSHVNAPTSHLTAPTRHLNAPTSHLNAPTSHLNVPTSHLNVPTSHLNVRTSHLNAPTSHLNAPTSHLNAPTSHLNAPTSHLNAPTSHLNAPST

SEQ ID NO: 948428 - protein, 146 aa, Homo sapiens
THATSLFALCTRVHLGALSLLCPHVSSPLSLLCPNVSSPLSLLCPHVSSPLSLLCPMSPVPSLLTLFPCLQSSLLTLSHVSSPLSLLCPHVSSPLSLLCPHVSSPLSLLCPHVSSPLSLLCPHVSSPLSPYSVPMSPVLSPYSVVD

SEQ ID NO: 948429 - protein, 112 aa, Homo sapiens
MRISAGVSKLGPVYSGKYPFSQWNTHAFSHLGQLAAQVTIISVRQAKETRTKTLIVVTNQWRFRHKINVVSKRYQAARWYRLAQRTGCVGRQQEFTTKQFESAHGGGHHLVD

SEQ ID NO: 948430 - protein, 78 aa, Homo sapiens
CQVLSWRQRCFQEPDGAGPGTSVRNVLGEGGAPGAASRRSRRVRTAWPLYPAGSGAGDFGKSEKVWIPVDVPPALKSG

SEQ ID NO: 948431 - protein, 98 aa, Homo sapiens
GGGGGGGGGVAPGIDVGGELWVLETRCPGSEIIVLTGLDIATALYSLYIFTTAQGGSLTHHINNIKPSFTRENTLMFIHLSPILLLSLNPDIITGFSS

SEQ ID NO: 948432 - protein, 176 aa, Homo sapiens
MRWYRPKELSWRRSARRSLPLIGQWPECARLLHGAAGSTGSIGAVRAHAVARRGGGRHARTDHRQRHRRVVYAFAGERLPRVDDSHRRRAVEVASHQTDANPRPTIDLHLVTVMAAALRNPMAPIEGGLRSAPRTATTENVCPEPADTVGALQVNCTPPVNAMAFKDVGARGGPAA

SEQ ID NO: 948433 - protein, 88 aa, Homo sapiens
VYTGKRFNGLTVPHGWGRLTITAEGREERVTSYMDGSRQRESLCRKLPFLKPSDLATLIHYHENSTGKTCPHNSITSYPVPPTCGNSK

SEQ ID NO: 948434 - protein, 44 aa, Homo sapiens
QGCASLTAGGLALDPVAVSGELHSGVQRAPDPPRSVSFRIVAAA

SEQ ID NO: 948435 - protein, 102 aa, Homo sapiens
RRPDPMWDTDKGRPPNLTLLLRLWSAHKKGSIMTALCKTKDAAARVTVRYLHATNGQKLLTPLVELGEKLEEAEEEGDPVGDPAVPFNLCPRNLSDTGATKS

SEQ ID NO: 948436 - protein, 164 aa, Homo sapiens
NPFELYESLIRFFITFLFLPPLSNQLSVTVLSHRYNSRTGSGVTFCPSFVCVFLVLVFGQDVSWVGILCCGSGLSISMFGPDMVLNQRQVLVIVSDWEPYLGSLFLCWVFVGGCLLSLCHCTKTELFGFSDLLFCIWLVFTFIVFIKHDEHEPRCVLVLSFVRR

SEQ ID NO: 948437 - protein, 45 aa, Homo sapiens
MSICDRLSLYFTSNNKVVDTGFRATWKAVDPSQGEWSWASGPRRR

SEQ ID NO: 948438 - protein, 119 aa, Homo sapiens
VDKTRGYKRASDSLDLELQMAVAIMWVLNLVLPRQWIHQRIRLVPLLLGSPIRIFPAKIYSQCYESPKLPGKAIYRCVLIDRLDGLLNPQQQQQQQQQQQQQQQQQQQQQHKQSAWQVT

SEQ ID NO: 948439 - protein, 75 aa, Homo sapiens
RRLHSCRHLGGSVGLFLSPIGTLKFSNFLLSPLPPSLSLSLSLLSCCFSFIPVLGSLPVLEFLFVSFVPSLRLGI

SEQ ID NO: 948440 - protein, 66 aa, Homo sapiens
IPGGTGASIIYIPQGLIKVQLVHQGPIPQSQDDHLGMGDRREQGSHRHVGDHADAHSNRGVVPTAA

SEQ ID NO: 948441 - protein, 108 aa, Homo sapiens
QLDYPITFTMVPRQLDYPITLTVVPRQPDYPITFSVVPRQPDYPITFSVVPRQLDYPITLTVVPRQLDYPITFTMVPRQLDYPITFTMVPRQLAFRPAQASHDLHCTS

SEQ ID NO: 948442 - protein, 124 aa, Homo sapiens
RDVFHVGRRSTNGTVSSRRLKSSCRGRARGLWLGILQDPMDQALTLFSVHGVSAMPGTSYPVTGRIGVPPGFSSAREGALLPEVFRKRCQRKPESLPPSIDEAFSPLATDFLFHGKDVSSFSLL

SEQ ID NO: 948443 - protein, 48 aa, Homo sapiens
GGCVLEGDPERKSWLMTHSVYVELGHGGGRVLEEVPQILLLVLGMGGG

SEQ ID NO: 948444 - protein, 66 aa, Homo sapiens
CHRLPGSYDSTSSDSLYPRGIQFKRPCEYKEGPLPWVPGRGSPGVGVSVNLQTSPATLGLPTVPLT

SEQ ID NO: 948445 - protein, 91 aa, Homo sapiens
PTEDGRKGEPDKAPKTLIPQVAHWRDALGDQRGRPATGSSSVAPAGIKLLDPNESAGIPGMSQRSRPAYGMIPVDCHLKEANTKESLALRG

SEQ ID NO: 948446 - protein, 44 aa, Homo sapiens
QCEPGSQLGPTPSEAQEGPTLPAPTLAEVPPVRGRMRKALKGER

SEQ ID NO: 948447 - protein, 44 aa, Homo sapiens
KIQDQEQEPMQISDMENPAIPIPTFDYNKITNNYQNFDIPVKMM

SEQ ID NO: 948448 - protein, 71 aa, Homo sapiens
MYHVPSYARHTCWSIGCAPFVHAVDQGPAEQVLERPIRPVGYRDADAAHAVLRPLALKLDVVGGEEEVVAA

SEQ ID NO: 948449 - protein, 104 aa, Homo sapiens
NCCDLIMLPDLLVAPYKICVCQLPRAAPDDPCDTEEFEHLMSLGEEEPMRLSYCSWNRGDIVPMRPDLHRTDVVWRQACHAHLCLCAKVTDVDSNQKHPYPGSK

SEQ ID NO: 948450 - protein, 47 aa, Homo sapiens
SHGGGGGSVGSGGDDSAASSAPDTRAGPAAAAAARLHESVLLLLLRP

SEQ ID NO: 948451 - protein, 67 aa, Homo sapiens
RKGTFKNDTLTVSGIMEKIEVVPVEIEPTEEDLNLDVGPSTEDSPEEVTTHALSHSPVVGEIPPRWC

SEQ ID NO: 948452 - protein, 72 aa, Homo sapiens
YRYVVLGAVSAGCVLVGRLTEDPAERVLLLESGPKDVLAGSKRLSWKIHMPATLVANLCDDRDNWFYHTEVP

SEQ ID NO: 948453 - protein, 64 aa, Homo sapiens
MPLINHSTLLPFQALPTMWHLLKERGLRILGSHTYYNPQVLMNGSQLAPLRRTHVVSGDGGGWS

SEQ ID NO: 948454 - protein, 40 aa, Homo sapiens
GTKRPAMLDIEADGNKTMIELSDYENSGTIFLDKVDPELA

SEQ ID NO: 948455 - protein, 196 aa, Homo sapiens
QVETITVSAEPPKPVQSPGNNSKPVEDKDAVAFTGEPEAQNTTYLWWVNGQSLPVSPRLQLSNGNRTLTLFNVTRNDARAYVCGIQNSVSANRSDPVTLDVLYGPDTPIISPPDSSYLSGAHLSLSCHAASNPPAQYSWLIDGNIQQHTQELFISNITEKNSGLYTCQATNSASGHSKDYSQDNHSLCGVCPSPSS

SEQ ID NO: 948456 - protein, 72 aa, Homo sapiens
NRLMQIGGCTSLVRKGPTMLWLPSGIPNDRREQSFRAYGWCLPRIKEVVGWFRSFISSSHIYLSRVVVKMLH

SEQ ID NO: 948457 - protein, 72 aa, Homo sapiens
GLKRSSRFVGSVNVSCAVYLPSSCCDLGLFCFFDELPLTISAVTINILWHFELALLASSNNISALAMSAAVC

SEQ ID NO: 948458 - protein, 145 aa, Homo sapiens
VLGEPSKWLHLTHTLGGAGAEAAWLATNLCTVNSGFLYKKLGELLAHSFLNLLSQNHPGPPWPLLETLYSEKQGPPVAVTVFGEKRRCQVSKKTNVRWSRPSRVWLVPGDVGGRELQVGGLHTPDLPCIIRDGPVTGDLPEQAMF

SEQ ID NO: 948459 - protein, 122 aa, Homo sapiens
NVLLMTPCYTANFVAREALQRQVLDDGCYIWSLGILLYIMLAGFTPFANGPSDTPEEILTRIGSGTFTLSGGYWHTLSAKAKDLVSKMLHVDPHQRLTAKAVLQHPWVTQKESFPKAAVPPA

SEQ ID NO: 948460 - protein, 56 aa, Homo sapiens
DSHGRWHSTPYKSFLQGAISHVPPETRTICTPQSRTQKHLFPGYNLHVIATTLLQS

SEQ ID NO: 948461 - protein, 155 aa, Homo sapiens
ELQKLQQDIEMVERNEDHHLVVLKESEILLQAKRAELEKLKSQVTSQQQEMAVLDRQLGHKKEELHLLQESMVQAKADLQEALKTGETEVTEKCNHIREVKSLLEELSFQKGELNVQISERKTQLTLIKQEIEKEEENLQVVLRQMFKHKTELKI

SEQ ID NO: 948462 - protein, 105 aa, Homo sapiens
FGTRLQTPPKKETFIPPSNLWAVFFVATLVEPTETIHSLQQSLQQDPTHVAELGRLLLIIPTWGSPHRSGGRKKAQQSLQNLLLQDFYPSPQILGTQLDQYLSVQ

SEQ ID NO: 948463 - protein, 81 aa, Homo sapiens
SPLPDRASFQKEDVVSLCQQADVLGDEKPEREYRSSFVQELLHLLLAVCIQGTGGIIQAKYTRFPGSMLGAMRLSGDDTLT

SEQ ID NO: 948464 - protein, 119 aa, Homo sapiens
MVQSVLLRVTEAPASFDHRETRGPLSGTSGRPFLSVKSKQDIQLPPATPKRGDANSIHTETHRQRNGQLGASLNTQTTKTTQCNGTPETRGSRLPHEARESAFSDLWARRSLSCWLNSV

SEQ ID NO: 948465 - protein, 49 aa, Homo sapiens
PPRYFNENIVVDLNSGFNLEELETNNAQRLRSIKGPHLANSILFQPSAL

SEQ ID NO: 948466 - protein, 80 aa, Homo sapiens
NKHSAAMSSNNNFQTWSSNECNMRQHFLCKYHHRGRIKILLTPAAAPSTSFQLAWLNRHIISDGKPSKLRVNRALLHWLF

SEQ ID NO: 948467 - protein, 115 aa, Homo sapiens
NAIIAEGIPEARTRNLIQKADQKGVTLITPATVGGIKPGCFPLGNTGGMLDNILASKLHRPCSVSYVSRSGGMSNELNNIISRTTDGVYQGVAIAGDRYPGSTFMDHVLRYQDTP

SEQ ID NO: 948468 - protein, 52 aa, Homo sapiens
MWRPYVSSVLPRLALHDVGGPLFVLEKSFAIDTQNYLEQQLGKPLLRIFEPI

SEQ ID NO: 948469 - protein, 49 aa, Homo sapiens
GRPYVIISAAKGCAYISRRTAVRAGRKLAIDTQNYLEQQLAKPLLRIFE

SEQ ID NO: 948470 - protein, 84 aa, Homo sapiens
KSSVDSSVKRALKPLGLQELAGNPAWMLLWGFMEFAPACAKASSWFQHPLTCVLPPARSGTQQVLSEWSLIPLSLKWLALSSAC

SEQ ID NO: 948471 - protein, 35 aa, Homo sapiens
GVTLTFWNRPPLPSLTIESTPFKCRRWGMDGASYL

SEQ ID NO: 948472 - protein, 50 aa, Homo sapiens
RKSRCGCCRSWQLPTHYLEQQWLSEGGGPEDVKGAEGSRQVWEGERLPAA

SEQ ID NO: 948473 - protein, 99 aa, Homo sapiens
LFSYLNVVPSLGRQTSLTTSVIPKAEQSVVYKDFIYFTVFEGNVRNVSWKSRYELFNALQPFVFVQLWKPVSFILEFQTVGIPRGTKHKGWERIEKTFF

SEQ ID NO: 948474 - protein, 41 aa, Homo sapiens
MATNITMLMTRNTATAISTEPEQRMGIARLRSNTSFLAMPR

SEQ ID NO: 948475 - protein, 123 aa, Homo sapiens
TPSHAPPPPGSPTPGSASCPAGLAPAPLPALRVPGSAAVAAASAREGPPPAPPPPGPLKRGASPASPASRAAGLGSPPGGVGGGGGVGAGGPRAGGGGGLRLSQVFGGTPLAPRVEPENLARP

SEQ ID NO: 948476 - protein, 58 aa, Homo sapiens
EFGTRKTTPEPVIHCRREKGTNFFDISVWFVRRHFVLSAICNRSAMKFLILILGFVAA

SEQ ID NO: 948477 - protein, 68 aa, Homo sapiens
PLLVGNSRRSMPRGSWLKKFPQQDHTTTTDSEMEEPICKNPKRRVLPYKLQVVSSSGLGMTFALISYN

SEQ ID NO: 948478 - protein, 68 aa, Homo sapiens
FGECSRRPGQQRRTYRRRRSHLTTCGEPGERRPQYSNPPVQAEVEGGCLTTRVAGDQGKPSEAEICIR

SEQ ID NO: 948479 - protein, 75 aa, Homo sapiens
VEKRDKNIFMRNEKIVKEVVLMVGTTLLNDLKRDSTVGSRLVTLKDVEDGAFLLRLSGGGCSYPDIGEFPTGTKQ

SEQ ID NO: 948480 - protein, 59 aa, Homo sapiens
DVLPDLTPPSWIVLDPVPQLRIFGSKTSTSLAGPPAPGGRALLRTVFGSQSITMSPCPY

SEQ ID NO: 948481 - protein, 53 aa, Homo sapiens
MSRLMVSITPSMGIRGVGMPCGKKWARPFLILERNAYNHCARSIRGRAIVRYG

SEQ ID NO: 948482 - protein, 42 aa, Homo sapiens
LVEQRDTNIFMRKRRTSRSCASLEDFVEDLKEDSTAASRVGY

SEQ ID NO: 948483 - protein, 48 aa, Homo sapiens
DVPQEAAGSVEPRAVGVSEPVSVKGSACFWLTFSEVTFFGGFWTAIVR

SEQ ID NO: 948484 - protein, 41 aa, Homo sapiens
KARWRVLRKAQRVFSTTATREGALTAPAWGIQAHTAEEVDL

SEQ ID NO: 948485 - protein, 67 aa, Homo sapiens
NHPDSDFFGQEGFYPDWIPQCSRERIFSERNSSYHCDWQLIFGMNQLYSFLIMWLTFITVNFEDILD

SEQ ID NO: 948486 - protein, 47 aa, Homo sapiens
EQQNKMLETKSLFQQQKTARSNMESMFESYINNLRRQLKTLCQEKLK

SEQ ID NO: 948487 - protein, 86 aa, Homo sapiens
KDGNAGNDTGAHFAIQTTLGSRVHACLCLCCQTRVGRNPLWLPCISTVPPPSSPGSPDTASTIATPTPELFSVLELDHPGTPWKKK

SEQ ID NO: 948488 - protein, 59 aa, Homo sapiens
MNGHMHPPLSTKHCDLRLSNSKSCSGIGCKSLDVAGQRQGRRREPHQQQKQEPDRGCGG

SEQ ID NO: 948489 - protein, 129 aa, Homo sapiens
GGFGRPAVDKICLFKLSLLVGMMQVRVCPQRIQKDGSSFTSFVGGIGIACTNGHNFLDAHDVEKVACILATDLDYVVQCVTGRDCSFNEKVSTRDCVRNDGNQIRESFFGNFILQRKIPRQIPQQRDDC

SEQ ID NO: 948490 - protein, 114 aa, Homo sapiens
MYSETVEFIRVCYATKNPLRPQCHLRKTTNWLHYVADDLALLYWRMCRLKRDLAVKYAKAIIDYLKNSFKAAQAPYPWGTSGNSVGSQGSLTNASALSPSTIVSIPQRNHQWAA

SEQ ID NO: 948491 - protein, 126 aa, Homo sapiens
CVQDRLVKVQLSNDFDEYIMAMSDIKSAHEAGCRARITHQVQRSLKLRRRNTHVGSLLRFLGDEKPNLSYIIGKDTWVEHWPEEDECQDEENQKQCQDLGPSPRAWLSLGAPTDHTPIPPLPYQGY

SEQ ID NO: 948492 - protein, 77 aa, Homo sapiens
RGRGEEDVAMSTASQTASRSNPKNGQELLLIPTHGEDGLPMLPKWVQNETALFAMWGSLTMNAIIKTSSDEQMVKKK

SEQ ID NO: 948493 - protein, 71 aa, Homo sapiens
PPGTGVEWLRRYLENGKETLQRTDAPKTHMTHHAVSDHEATREVLGPDASTRAEITRDRGSGAWGRTETQG

SEQ ID NO: 948494 - protein, 36 aa, Homo sapiens
IKVDRIQQCASALQRIQTVVSSWDDVHQDPLAPVLL

SEQ ID NO: 948495 - protein, 78 aa, Homo sapiens
RSRGSLVKRKHGAPKYQELKINAENKAKINMAGAKRVPTAPACNLQARTEAKNSSRGHWKQKSVNNLQAKNAYEEAKQ

SEQ ID NO: 948496 - protein, 58 aa, Homo sapiens
KLSGAGGGKAGNGRPEPPGGIQRLRDTEEMYSKKQEFLEKKIEQELTAAKKHGTYKQA

SEQ ID NO: 948497 - protein, 65 aa, Homo sapiens
AIENHGPGEVTAVSPGWPGVTRIIEAGPGKRPLDTTLQSSAHFLAEQREGEAESRVPTMAGNYPS

SEQ ID NO: 948498 - protein, 53 aa, Homo sapiens
HIVVDLGVDSRSVLPGTAIGPSETTPMEPVRLHDHMGPPRVTLGLTATEPGVT

SEQ ID NO: 948499 - protein, 90 aa, Homo sapiens
RCVMAAQSGLISGGDEPRPLLTAGGAFGQLSSHSRPPAPAARRAGAPEITASTILPFLSPTFMGHSFCSQQVSMASSTLCAFPGSVGLQH

SEQ ID NO: 948500 - protein, 72 aa, Homo sapiens
LEVDPVQTPITPSAGRADTQDSVGLTSPTSSNEAALHAAREGTHFRSTLLNYRRTPLEPRPRQVHCQQKEQR

SEQ ID NO: 948501 - protein, 43 aa, Homo sapiens
MLRYEKVSSAIQQSLLVMSYSVGHEKAPAFRDYVAVARGSKDL

SEQ ID NO: 948502 - protein, 66 aa, Homo sapiens
DLIDPLIQHLPGPGLCQAPSYGARPVSSAASVYAWRWGLWFPGSPCPGSTIFRVRHGGPGGLATVD

SEQ ID NO: 948503 - protein, 36 aa, Homo sapiens
LKRCRPSTWSSPLSRWTVKVNNNGRNRAVHSKSSTA

SEQ ID NO: 948504 - protein, 38 aa, Homo sapiens
MRELPSIPTGTRSRIHFSTWNLDHIIEKKRTIIPTLME

SEQ ID NO: 948505 - protein, 96 aa, Homo sapiens
GVLPSCFSVPGRTLLNISLSWLDYLASMASFSWWFSVRRSFICCSQLLRGQTCPGWGGAGGGVHFLCFQWGLSSFSVRPDEQVDGSVAHGSRARTR

SEQ ID NO: 948506 - protein, 40 aa, Homo sapiens
MSDQTPMYSGNHPRAVLQAAVRSFKSSTNSSAPGLRSSSA

SEQ ID NO: 948507 - protein, 35 aa, Homo sapiens
MVTMKYLCPECWTWGISPVGSDVLYSVTTQRCYLD

SEQ ID NO: 948508 - protein, 161 aa, Homo sapiens
SWVTPVSPQTLAGALKRVGCDPAELEESFLQNKAFLTGPHISLADLVAITELLHPVGAWLAKVFERPTKLATWRQRVQVASWVEDLFQEEPNEVILPAKDFPPAESHHKAKADALGAGHDPVELGNLTLAPSSAVHKHFHFYWPMDASAQQSRNGLPKTCP

SEQ ID NO: 948509 - protein, 92 aa, Homo sapiens
TQEQPTQASLRKEQMRVDAHGTETLEQTNQEIEELTKMYVTNLIARNGEQANSDTECIGLEPVECNMTVVHTACSSQFHGTGSSFHFIRMRL

SEQ ID NO: 948510 - protein, 120 aa, Homo sapiens
GQGTNDAGVNAVVQGDVLRILVVLAFTHNSQYSIRWQVRVFVVVALVMVIRSGGWYRHRHFIRQTWRYDVHAREPGSGYITCPTFSRIILEMVFGVYSDTQLTTPKARSSGSACSSFTRS

SEQ ID NO: 948511 - protein, 103 aa, Homo sapiens
ELGTRQTLNYVRTPDRHSALQPRTPGLKRSSHLSLPSSWDCRHAPPCPANFVFLVETGFRHAGQAGLKLPTLGDPPDSASQSAGITGVSHRAWPTHWILKCKC

SEQ ID NO: 948512 - protein, 49 aa, Homo sapiens
DYPGWSAWIDTAHCIPERGNTDRGAGPESLSQHLPPLPPPVAAGPGTRG

SEQ ID NO: 948513 - protein, 128 aa, Homo sapiens
LADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLT

SEQ ID NO: 948514 - protein, 41 aa, Homo sapiens
KITVDACTIPVSTQGLKLCVPPSGCGCDSDSDTHSKEAIEC

SEQ ID NO: 948515 - protein, 80 aa, Homo sapiens
MIALTKVDAKLWDRAHNPHRTPRQLRVTPPAPLAERTRHPNLSRRENARVRAAIPSALAHRMSPGIAHTSPGPPYPSGGG

SEQ ID NO: 948516 - protein, 37 aa, Homo sapiens
CTVPSIAVPEPNVVLMMQIVSDAMRPIVSSKKLAQIC

SEQ ID NO: 948517 - protein, 39 aa, Homo sapiens
GTRAAPAELLIIGWYIFRVLLQVFLECCIYWVGFQEHLQ

SEQ ID NO: 948518 - protein, 78 aa, Homo sapiens
NSARGGSAEENIRSGSWAWPPPGPSGRNLEQGMGSEFCLNCTFSEVCEQGTHLVWVSEKRLGHIMKRVSSFYQELNVS

SEQ ID NO: 948519 - protein, 72 aa, Homo sapiens
VLPSLSLVYITPARAYNPSSISLESENLILRTSECLHPVIISYDNFFNPIHAEVSGMITSWSVSVKIQTLPL

SEQ ID NO: 948520 - protein, 66 aa, Homo sapiens
HRDRPIGTQAIPEESVIQTEESLRTPHALQDEKNLPPLANIDLRDMRGRSGKFPSHYPQERLSLQC

SEQ ID NO: 948521 - protein, 133 aa, Homo sapiens
PFDVAAEIPALTAELGGRAGAVVSFTGLSRDEDGRVPALELEHYPGMEPEIGLVLDEPARRPLQGAVAIHRHGLVRPGEGIVLVLAASAHRTAAFEASFLMDYLKTRAPFWKREHRADGTLGGWVEAMEHDAA

SEQ ID NO: 948522 - protein, 69 aa, Homo sapiens
GTQPVCGTEPDPVSPQILKPIRVCEHPHLCPDTCEVVTTGFDDRTSLRPPCLMLTPLQSMIGRRLRCFY

SEQ ID NO: 948523 - protein, 57 aa, Homo sapiens
RHRTVGWGVGASMGDQSGTAGKGDCDGGAVLGLGLSHSWPALWPIPDAVCCQYEVST

SEQ ID NO: 948524 - protein, 51 aa, Homo sapiens
AELDSWVLCGKADHAPIHGFVPWIPIFLILTLVAIAFLFLSIMSKNPFPLE

SEQ ID NO: 948525 - protein, 70 aa, Homo sapiens
RYFPTSFLQNVDSGVVKEYFQRGSVVDDVGKYYKKQDSECSAQHHMTLHVVIHPWSPRCVVLLSILQSAW

SEQ ID NO: 948526 - protein, 101 aa, Homo sapiens
FCMALPGGPFLGPGFDPFLSLLCRAGPPAELPTFRCTLSMPSFHVFAPCLGGPRNPLVGVGAFFMACPSLMGHPQPLPLGALFQGPHLVCPTPHLSPFKDK

SEQ ID NO: 948527 - protein, 39 aa, Homo sapiens
RHEADPPPVHTRRQLTMDDDIGGRGALRAAPAGRDGRAA

SEQ ID NO: 948528 - protein, 36 aa, Homo sapiens
RPPPPDRSPPPADALRDETWGGGGRTGDPPGSPGAA

SEQ ID NO: 948529 - protein, 44 aa, Homo sapiens
SPATPKTQPEPAPYADKTSPWGRWRETPHNAAPKLCRPPDSMGG

SEQ ID NO: 948530 - protein, 109 aa, Homo sapiens
TDHPYMPQLPTPRAPGHEVVTFHPRLFPTLRQWLCNVLSSQVHAPPHTEFGCSSPTNLCLGTGPCVPGFSEDSLYIRFQVVLWLSLGKWLFYMICHGICYNKSFFYPLA

SEQ ID NO: 948531 - protein, 52 aa, Homo sapiens
AAHSLTVMSSTEPPPRHPITTPRRLPRLQPERRVPAPTHVRPAYEDDEVGGG

SEQ ID NO: 948532 - protein, 182 aa, Homo sapiens
LRSVLYTTLRPIHRGHKSPCWQCRFHPIRKLDSIFICLSSHEEAGYNRLQTMAQLVIIRSRYVTIPYLLLFQKDIAKLRVILDSNRVNCGSNFKTSLFEHHHRCIIDAGSFWEDEDRQLAFILHMFSQSLSHQVAILHFRALKPDVWAGLHHGSLNHTHESPVHLNHHWIIAIAGQDDHIDR

SEQ ID NO: 948533 - protein, 100 aa, Homo sapiens
ELGGREPIIRLLIWCLMEEDDTPNTEVHAVVSCQQQQAVEAPVLLGVLGVNGLKTLGNAPSGLICSQDTLARCHDAVSDFRELLLLLRGHGWIWVGMMND

SEQ ID NO: 948534 - protein, 110 aa, Homo sapiens
IHYLPPAGLGVNTGSVVHNQRKQVVIVVRREVVWAQVGQSLIRVGQFREQVQSWFCGLPGSRHADGPHHACGRTEGQFTHSFYSSLGPSTARTLMEGLNVAAGDLEPPQG

SEQ ID NO: 948535 - protein, 85 aa, Homo sapiens
MEEDDTPNAGAHAVVSCQQQLATEARILLGVLGSNGLQPIGNAPRGLICSQYALARSHDAVSDVRQLMFLLRGQCWILRGMMKDG

SEQ ID NO: 948536 - protein, 36 aa, Homo sapiens
MDSNRQQQRFAETVIVDSMVDKHTGTTSVYSNIDYN

SEQ ID NO: 948537 - protein, 33 aa, Homo sapiens
TRTKLPVLSYTKKEDRLLKTVIARHMKTTYCGM

SEQ ID NO: 948538 - protein, 52 aa, Homo sapiens
PTLTCPAVNAHILLPLLEPLAVNKIPLRPALECGLIKGPSSDFLSHCNTVSQ

SEQ ID NO: 948539 - protein, 122 aa, Homo sapiens
YRFMHIIRSCSKVTSWSWSEISTATDVESPKAESGLRLPLLETLNFRHFWSRQSLSYFCIMTIDGMVFLQYDFIHRIMVIKSNKAKASFLSRLPISNYLNGIDFSIFLKVISKVMFLSIFFN

SEQ ID NO: 948540 - protein, 38 aa, Homo sapiens
SDPSGRSSDRDFGSFEHILSKASSISFSDLVVVNRACV

SEQ ID NO: 948541 - protein, 55 aa, Homo sapiens
GKGVSATEGRSRKGWSEGPHNPGRNTAIKTQSAFQMHNSSAFAITHDLYACTHIA

SEQ ID NO: 948542 - protein, 72 aa, Homo sapiens
SRKLLTPNYSDGHLAPAFPAQKASAAFRDYGYLQWDRWLLAGPSKRAEVSKTCPLGVVVQVRCSIPVYAGST

SEQ ID NO: 948543 - protein, 64 aa, Homo sapiens
RSISGGNGDMPKLYSVSFLWGEGSITSLYNGYFLKSRVISVWCQLLHKYLKDMDCCLHASWRPV

SEQ ID NO: 948544 - protein, 35 aa, Homo sapiens
KQYRGNEGQMRELQDQLEAEQYFSTLYKTGRLKDA

SEQ ID NO: 948545 - protein, 49 aa, Homo sapiens
PRCSLPISTVNFGHDFGNDNLCFNGIFEFLIRWGSCRSPGEPLEMVANP

SEQ ID NO: 948546 - protein, 60 aa, Homo sapiens
SISSSVVLIQLTLSHHSPTLLRLHPTAARCERQIADLSPLIRARSITRPGCFSSPSLWMA

SEQ ID NO: 948547 - protein, 81 aa, Homo sapiens
MQLKAGAKIIEVGDTPKDRALLQRSPKVIWHDHYYRPVYRVCNDRECMGTLLTWVLKFACYSPFSSMYAGLIVLLKDELLH

SEQ ID NO: 948548 - protein, 96 aa, Homo sapiens
QKDKNTFKTQEKTPKTPEGPSSVEDIQAKMQARLEKGGSLPKVEAKFITYVKNCFRHTDQEAIQDSLAVDENVSLRQLRFNTMYKKFSVLFHFLYN

SEQ ID NO: 948549 - protein, 50 aa, Homo sapiens
GFQYPESAMYPDRPCTRGSTQPLYPRLTKKKKETVLATVTKSVGGDMNGG

SEQ ID NO: 948550 - protein, 80 aa, Homo sapiens
TTTLDAVWRKRCTHSEKTNRNHSYRTGLKITSLTGIECGEDLCNQGNSGRAVTYTQKPLPRMRSSSSSDISCERGRHQRL

SEQ ID NO: 948551 - protein, 35 aa, Homo sapiens
SNGTKEDVDVLKTRMEEMKAESEREKKTNETQGMQ

SEQ ID NO: 948552 - protein, 97 aa, Homo sapiens
QRASYTCDLVLIRVLAGDVVARTGCWMPGSTWGRQVNVLRAWVNFYNWTDNAELMICPEVIYPCSCEVEGEEDNSASVRKGVLRGPLVIKTQSGNYP

SEQ ID NO: 948553 - protein, 69 aa, Homo sapiens
MLVFLQEMDKPCGCPPGVCDHGTGDRRDPWYSTVGLLPPVRAMSQRNLNAKTEQGPTGVTMTSNPITWG

SEQ ID NO: 948554 - protein, 73 aa, Homo sapiens
YLYRQYVALGGAHRLLQDYKSLQVYHCHPGDMRCTLLSEDKLTVSRARHNIQRFCVSSPFPGLLAGSSTASNH

SEQ ID NO: 948555 - protein, 70 aa, Homo sapiens
LVPACSCLRCYHQYVQSLQHVPGFTSIVASLSLDLNTCDFYGSAIIAQLIFPISSPCEAPYRENDIIFSE

SEQ ID NO: 948556 - protein, 136 aa, Homo sapiens
FSWWTEILQIRFVTRLSCVVPIWQNILEFRCGMKPYKCSECSTPFSNRSSLVCHRRIHSGEKPYKCSECSKTFSQKATLLCHRRLHSGEKPYKCNDCGNTFRHWSSLVYHRRLHTGEKSYKCTVCDKAFVRNSYLA

SEQ ID NO: 948557 - protein, 125 aa, Homo sapiens
LRSQSIHTAPKILDLALVVSGDGSSGTPRLHDDVLELEMDELNLAECMAPRDGPDQAHAQNPGPASMEKRIHVAIEDLPSGDEIPPMANLGNSNKYHLNYPVSFFAQAFVIYYKKTVLPPPPAHS

SEQ ID NO: 948558 - protein, 39 aa, Homo sapiens
YLQVGYAAGTCVTGQAVLSILVMLEVMFWYTGGVRFAEF

SEQ ID NO: 948559 - protein, 52 aa, Homo sapiens
TIHSYGESEQEITGRNAGSKPRPRRLLGDSFASFRDAAPDEEQIQTSILHYD

SEQ ID NO: 948560 - protein, 117 aa, Homo sapiens
MKSLFSSAPVPEGEERGSALALSATGTRSVLASFAVSVSSVPDNSSPSVPSAGHAVFGLPATFVLKAVQTQLSHVPLRRKRKKKNLCGVIWLPHSSLYTYLSWLWTAYALLRDDLGK

SEQ ID NO: 948561 - protein, 97 aa, Homo sapiens
MSAHFWVGVGLPVAGFDTTTWPLPADDGLTTSKTIPVPVLKMVPSLRNTQRSQADPAQSQYFTLTLPAGISGQALPLKEQPRGRADGAVGVDRPLHA

SEQ ID NO: 948562 - protein, 87 aa, Homo sapiens
QAHLGEHDSYVVFQMSLQSKSLEEKLKSSGIPYEVHIYPGCSHAFMNTSPEALKRKKGMGLTDENQEAVDLAWSRFSSWMGRFLGSA

SEQ ID NO: 948563 - protein, 174 aa, Homo sapiens
VVKPHYGSGSIRITLTGGLRQSCIACKLMPVPFGVLVTKCFPVVMSASININGKVRIFTCCIKRRIIYGFSIRNLIPSKRVHSSLLSRRIQPFDISDIIIIGRIRIIHINGNELRVGCRFVNHSSNMPRTFTPIISPLADTLRPSFTHINWVIVTTTASMFIIVPWVFPSLRDG

SEQ ID NO: 948564 - protein, 147 aa, Homo sapiens
DYRTSSGSQDCVAKLKSTILDSPKQTCIFSALESVQQMFPVATFQQDWHFIMFPPVSIIHSITLIASKFCIPWFRCQPKSFSHSLQFPGIASTFPGPLRVFSAVRFYTAEPIQGTQSRRFIIICPIQPGTLQLTVHQSSIWLSAFFD

SEQ ID NO: 948565 - protein, 65 aa, Homo sapiens
DPAGCCDTTAIVHSTDTNLGLSICARCLGRPNKRSANFREHIQRRHRFSYDTFVDYDVDEEDMMN

SEQ ID NO: 948566 - protein, 134 aa, Homo sapiens
MGTRLLEKLRYLSLLYLLGVRNILLVSDGHLQDESLDITAREEEPPAHQVIRLRYRVSLRELVTYPDPRGGRLVALQGTLASLEVDTRIQKPYSIEGWGSGLPARLPESQNLGWPLISLAVTLSKFLNLSSGKP

SEQ ID NO: 948567 - protein, 127 aa, Homo sapiens
MLLCNLKRPKKLFLFLKKKAKRHTTHIYRSTLAGTHLFFYLAQGFRMEAYIHHGGWPAQLNRARGKERKGLRFRNVNIGPLGYVAVHPLRKWPHEVKKNKPALHFKIKLGKSPGPRSGILYFVKLGL

SEQ ID NO: 948568 - protein, 70 aa, Homo sapiens
MITKTFGLDDHGGSLGLNVIAVRAYALPTELTCYAAESLTVKLKGKGFSGLGDWVEATPVVEGFTEPAER

SEQ ID NO: 948569 - protein, 76 aa, Homo sapiens
SHKERGYEQFTDAVVSWLHQQLDYGLDFLLCGLFMLRTDGSAIRVGRGTMYSQTAHPYPFVRCIDGFLEMIDTLYK

SEQ ID NO: 948570 - protein, 58 aa, Homo sapiens
MPMATALPLDFPSIFCYMATGNKSMVVSLPRRKWISRLTICVTERRQIDLAVQSLRYR

SEQ ID NO: 948571 - protein, 62 aa, Homo sapiens
MLEAKMHATGYSIQASTPTRGCATESRAHPPRIGNIHTHLVHYRVSLAVAGTKNSFQTLQSR

SEQ ID NO: 948572 - protein, 42 aa, Homo sapiens
MPFKCMQLTDFILKFTRTVPTISMCSMPGSRQPSILLFRPGY

SEQ ID NO: 948573 - protein, 58 aa, Homo sapiens
DRTGFGQWTCRTVRRQAMPYKCMQLTDYILKYRTDAHQKYVRQAWQKADINTHVQPGS

SEQ ID NO: 948574 - protein, 196 aa, Homo sapiens
WRLMKTDDKANSVQDIINDLSEAIESHSGRHEQLMPPVELAKPENHYRVDYILSVMNVPDFDFLSRIYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKS

SEQ ID NO: 948575 - protein, 63 aa, Homo sapiens
MHIFERTRVLAAFLWVARGVLFAVFLILLRLYRMKKKDEGSSALGKKPIYKKAPTNEFYGFVG

SEQ ID NO: 948576 - protein, 48 aa, Homo sapiens
PFIYSAGVMAFLVSGSFLTRLCSPVVVVLLHTGTGASVAYPVVLSHVQ

SEQ ID NO: 948577 - protein, 59 aa, Homo sapiens
LTLQVVEDGYEFFAMLQLVTLFSAPNCCGEFDNAGALMSVDETLMCSFQILKPADKNKG

SEQ ID NO: 948578 - protein, 35 aa, Homo sapiens
EVALLYTQDMENMSDDDGWEFVNLGHQQSFGIKTA

SEQ ID NO: 948579 - protein, 89 aa, Homo sapiens
LDQTCCPQGCSSRVVRRVSGYLVSVHGVLGEKPLLCQRPVSGCRWPCRGVANMLRAIWHLLSFHNEAPICIPFFSWLDPVIPRLTCGRA

SEQ ID NO: 948580 - protein, 39 aa, Homo sapiens
FGSPEGNVFFICFDDIFQEGKGTFLQFHYDTVQDTHHGG

SEQ ID NO: 948581 - protein, 71 aa, Homo sapiens
EVMGKVKEVLGIGVNLEAIQATANGQIKELSGTKWVVGDIFFLGFPRAIYNGVLEHGTVAHAGINVQSYVP

SEQ ID NO: 948582 - protein, 55 aa, Homo sapiens
LYYNKYINVRKGNILGITMVLACYMLLSYSFSYMHLKHSGSANSPEEDTLWTPPP

SEQ ID NO: 948583 - protein, 47 aa, Homo sapiens
VVRQTAGGWRALSDYNIQIESPCTWCCACEGGIIEPSLRQLAQKYKC

SEQ ID NO: 948584 - protein, 47 aa, Homo sapiens
MLPEQQVNTGQRELEPEGQEAAFQNTPNEGVRSAFSFPRMDSSRLRL

SEQ ID NO: 948585 - protein, 47 aa, Homo sapiens
AYVSIQQREYSIILYYFLTKSKPLCICSQAFLRPLTTPPNTNYLTPT

SEQ ID NO: 948586 - protein, 54 aa, Homo sapiens
MSAVRFIKKAINDLTVVMPAAVCSQEGSGCGRNHALPSRYTRRSRPQRFSRNFV

SEQ ID NO: 948587 - protein, 86 aa, Homo sapiens
LLALPGSSAFPSGGIQHVPLLPESSSLLFLTSGCLLHVAGSALVTFDGLLPSADLLHAFQLLPSSFFLLAGSLLDGVLLQPDSAPS

SEQ ID NO: 948588 - protein, 45 aa, Homo sapiens
PVLVAWNSPSTCRARSHAPLQTAGPEFPSSWPRWTANGPISSRAL

SEQ ID NO: 948589 - protein, 32 aa, Homo sapiens
MFEILLLHYSPCIQCALLLKIIRRRCGYHGPA

SEQ ID NO: 948590 - protein, 70 aa, Homo sapiens
VVDERVWFVCSPPQKKPLKQLQRMNGRIVATKPLYVAFSLSAKKSARLTLTNHVYADEWQCVQSVFPHPC

SEQ ID NO: 948591 - protein, 113 aa, Homo sapiens
RSSVIAVLVYHSIEMQGNQAGVCIVSPHLPIQLSTWCAGQDLLSLLTPSLCCPFWDPNFLDFEKCAAPVDASKSPLEGSGGADLSVFFGSSPCQIVLPLDSEKMVLLPHEEAQ

SEQ ID NO: 948592 - protein, 44 aa, Homo sapiens
IPRKRSGLGAAGRIAPGIILEWSEVLALMQYQRWTWSIVRAIVA

SEQ ID NO: 948593 - protein, 66 aa, Homo sapiens
VLRTQRLQTTVLGQAQVGLDGHNQRTEGTACPGTILEKCLLCLGEKGCIAQVKAEGGTLVPWSLFP

SEQ ID NO: 948594 - protein, 92 aa, Homo sapiens
ATLDSKRWTTVERPKPAFGQQHQQQPKSQAEPPSGNKEPLADTSSNQQRNFETCNSAAFFHVLADCNRMSQAGSVQIENKLTPQQRAYLKAE

SEQ ID NO: 948595 - protein, 41 aa, Homo sapiens
MIEWFPPHSGPPFPRVMANGCVTPRALKGAARSMKTGWAAR

SEQ ID NO: 948596 - protein, 76 aa, Homo sapiens
KILQTRVQAAGRSHTEFRNLKSFPGPGRDLRTKATIELMALRLLNFQRQLRQEVVVCHGRDTALETALNAQAYKAQ

SEQ ID NO: 948597 - protein, 116 aa, Homo sapiens
MVCQCQCLPSGFQHLQPVHGQLGHKGDIVRPGGWRFMGQESDMHTVHSELLLAELKAGVFLVQLCQGLLQLLSTRWGLAGVHKELSPQQVPIVLLESQVEIAEEFHMLVLHPKLLW

SEQ ID NO: 948598 - protein, 43 aa, Homo sapiens
LRGEYRLQVIDTEFMELENLPGSLAGICEPKLTIELKALRLLN

SEQ ID NO: 948599 - protein, 77 aa, Homo sapiens
PAAICRGGRLLHPGLPHGLSFLPSALRSAEAAFGSVGRDLVLSDSRISPPSLPVLPCAARCETLLSPPPSRKLSLEP

SEQ ID NO: 948600 - protein, 35 aa, Homo sapiens
AICDSCYAKQNLVMKLSLENGLILYATNSISLGVP

SEQ ID NO: 948601 - protein, 41 aa, Homo sapiens
VCNSQFYDYGHQPLVFHLFEMPLLCLLSDRNGVLCCSLHTS

SEQ ID NO: 948602 - protein, 121 aa, Homo sapiens
TGIESILSPFPRARLAQSPPRLGQVGPRLRQGSLSTTPPCSVECLDWDVARGTMGGCCASPHSTSRWPWSVRDSLHILNIPVAGAVPYRRRVWGPGIPHIFLGRASETFHRGKGAGVIIPH

SEQ ID NO: 948603 - protein, 42 aa, Homo sapiens
SREEGPPEQPASLAKQGLQTLRLCLPPPPVTLQVKIPRGTEA

SEQ ID NO: 948604 - protein, 103 aa, Homo sapiens
RQEAKCTESKWGHADGCKSRAPTKLCWREPLTASRTWSNDECGITDDQLLALLTSLSHCSQLTSLSFYGNSISIICPGKVSCEYSYGLSNLTQVLYPVPLEEL

SEQ ID NO: 948605 - protein, 120 aa, Homo sapiens
RCRKSDREKTPVHGGDALLNRANRFSKRPQSWLLQSSQGRLDLHSQLYVFCTGVASPLPSWLRGWSRKLLLCPSASGPPECWHQSADTLPSGCTLASGAALPHWGSHCEQSWPRISSASC

SEQ ID NO: 948606 - protein, 96 aa, Homo sapiens
PFRNRPSLCPRGSQGRLVFIPSSMCSVWGRFSTAFLAKRLAKKATSMYFSFWAAWVLAPICRHPIYWLYPGQCANPSPLGFPLRAQLGQNFITILL

SEQ ID NO: 948607 - protein, 122 aa, Homo sapiens
MRYPRLRRTTGTEDSHVTPVESPIPLFCIAKGDCIPEATEKYLGGTDDTFKKKDLFLDLIADVMFGVPSVIVARSHRDAGEPTYMYEFQYRPSFSSDMKPKTVIGDHGDKLFSDFGGPIFNR

SEQ ID NO: 948608 - protein, 187 aa, Homo sapiens
VIRTIMLSDVSPTAAREYPRPTVYDACLKLQSRFAEKPQSQLLQAPKAGWIFIHSSMCAVWGGFSTAFLAKKVGPESYFFVLQLLGRLSVGTNLQIPFLLVVLWPVWQPFPIGVPLRAKLAQNFITILLSLISSSEAPSFKNGAPKTEKSSSPWSPITVLGFMSDEKLGGTETHTCRWVLRISVVRA

SEQ ID NO: 948609 - protein, 62 aa, Homo sapiens
SQEEILRSSVASKYWKVVLNLRFPSKNFLSEQIYACERNRITEMVRNIRVVPDALEEVLSLL

SEQ ID NO: 948610 - protein, 33 aa, Homo sapiens
NGRLTVYGHFQATITIVEGLLEVNIIQMTDVLM

SEQ ID NO: 948611 - protein, 61 aa, Homo sapiens
EISFGPSAAWASGTWGGCLLLHHLLHDALVCGLGEPALLVQQGQNCRAACWLLNEVDAGPS

SEQ ID NO: 948612 - protein, 36 aa, Homo sapiens
IATLTSCQHLYGIAENITGPSYLTMNTTYQQTSSST

SEQ ID NO: 948613 - protein, 42 aa, Homo sapiens
EVWYIISDPNCEIAQSTVCRPVDVDEMCLLTVRRTFNGSGTY

SEQ ID NO: 948614 - protein, 38 aa, Homo sapiens
VRADSPFLTCYLLNLEEEKLSQKKESEKRNGDSTALMT

SEQ ID NO: 948615 - protein, 143 aa, Homo sapiens
CEMSEEECREGLDSDINNRVVKHDSCRDPLNWSKPKNAFPEGPLGALRAMCKRTDPVPVTIALDSLRWLLLRLPCTTLCQVLHAVSHQDPSPGDSSSVRKVSVLGLLHEELHGPGPVKSSQPALLLTEVTLGRTMGQASAHIL

SEQ ID NO: 948616 - protein, 71 aa, Homo sapiens
PDQVHRSGGKEINTTEIKEEKCKSRLQESCPFHPKGHSPEIKLILGITSAALSRREDDFVSLLARRAYVQK

SEQ ID NO: 948617 - protein, 96 aa, Homo sapiens
MGVFKSTSSNSKAKKTKEGPVTQAYWRCRLSEDDHQSYFPDTVRTGEPDEPEGKGRLTGARCNRLYKNTPGQLIIDSEETHYCSSWLMHGCLSAPQ

SEQ ID NO: 948618 - protein, 54 aa, Homo sapiens
AAPEDNHSVIAGSQKHQYQQRRQARRICSARAEENPRHPEEDLSKNFIQPHTHI

SEQ ID NO: 948619 - protein, 66 aa, Homo sapiens
KGRTSCKIIPRRYLVSATVINGGVRGFRLLPFQIRGVDKDDVFGKLVIGDEDVVELVIHSPSWGSA

SEQ ID NO: 948620 - protein, 50 aa, Homo sapiens
PDGETRVFEQELRAATAWGENKKAQLVVSAHDVDRIETGSLSWPGLCRKM

SEQ ID NO: 948621 - protein, 38 aa, Homo sapiens
VRCAVCGVASVSPLVRRNLEMNDTGGGDLAYRSLAARS

SEQ ID NO: 948622 - protein, 37 aa, Homo sapiens
MAAWALSLRCSRESSSLRFLSELFLLQPHRSDDSSSE

SEQ ID NO: 948623 - protein, 55 aa, Homo sapiens
CDHIAEVDSEAGWSRRSTRSTCAQEEQDLDLHVLGPGRISFCILSAMPGTWWCRQ

SEQ ID NO: 948624 - protein, 48 aa, Homo sapiens
LPSHRVSPREASSEALGVGEVLHVKTESWHPARVSWEMTQASSFETVQ

SEQ ID NO: 948625 - protein, 44 aa, Homo sapiens
MRRGPVSEPCSDKGQRRGGAVRRGNSEQNIECGGGYVKVVPNSL

SEQ ID NO: 948626 - protein, 35 aa, Homo sapiens
SRGADRRLPEQGYTKVPVPGYTKVPEPCPSTVTPG

SEQ ID NO: 948627 - protein, 60 aa, Homo sapiens
MTHGVHREGKGQQRMHLLIAACYSSYTWCVGPLEHALGPLDVEEDVGGRPGMASVVTTHR

SEQ ID NO: 948628 - protein, 51 aa, Homo sapiens
KGIISASLLIPMFVMGVNHENDDNRLDDHQQCAPVTSILLAPLAKVIRCTT

SEQ ID NO: 948629 - protein, 51 aa, Homo sapiens
MARSPLLEFSIYPGPQVATGVVEPDNSFVSTHTTLGSTLICAVMVDNEAIY

SEQ ID NO: 948630 - protein, 38 aa, Homo sapiens
PSAFHQSPTSLETYIMAESSATFTPMALIIFIFLFFLT

SEQ ID NO: 948631 - protein, 45 aa, Homo sapiens
KNRTFPARLGPFPYPDLGPPCPAPFLFPSSVSSKDNCHWLSLIPD

SEQ ID NO: 948632 - protein, 58 aa, Homo sapiens
LPSKAAVSHFSKAVRDTSEPWARHWLEPESSSLLFYRELFLLHLTAASTAPANTAPKR

SEQ ID NO: 948633 - protein, 45 aa, Homo sapiens
ARYRPPSPNLQGKSRSKWSAHGLKGLKRVQWLTDEDTRNLNAISS

SEQ ID NO: 948634 - protein, 49 aa, Homo sapiens
QEIACNSHPGAKEDELSPSNYSRDAKASQMSGPSRVNLEHGSTTRSGPG

SEQ ID NO: 948635 - protein, 43 aa, Homo sapiens
RGPGRDALRAHQSREPQVSSDQKHDLTADRNSLMITSLSLGPC

SEQ ID NO: 948636 - protein, 45 aa, Homo sapiens
DREEKRADPLYQIDLQAYLTDFLCLFCSCKKIPAFQKWSDTNAIS

SEQ ID NO: 948637 - protein, 53 aa, Homo sapiens
MISSAPDCPSIVRAMNEANRFSLILALRVCYNFLFLWALVREVGGLGMCYLSH

SEQ ID NO: 948638 - protein, 48 aa, Homo sapiens
DVRDTAGQDEATAKAVLEPIQSTSLIGTLTRTSDSEVPDVESREDLIK

SEQ ID NO: 948639 - protein, 73 aa, Homo sapiens
LVGYRRYYTVFSDLIDTVYLNDQHVTFYYEPRVLRASGDMAQDTGIPADIWRFYLLYIRPEGQDSAFYWTFSR

SEQ ID NO: 948640 - protein, 55 aa, Homo sapiens
ITGIELAVADKIASITDVTPIRWGSSGLVEANDAESPAFQWTWAQASILCWIIGT

SEQ ID NO: 948641 - protein, 34 aa, Homo sapiens
VEINSKGDQLMRHRKEQMTHQKHMQGKGSYWASG

SEQ ID NO: 948642 - protein, 106 aa, Homo sapiens
SYLLELRRTCRLEIELQSQLSMKASLEGNLAETENRYCVQLSQIQCADEAAVDGARWPMLRYAEMEQQNQWIQISCVDVEDACWSSEIATTALRGGEKDAHTSLKY

SEQ ID NO: 948643 - protein, 37 aa, Homo sapiens
TRLPIVTESKQTAGEEIAVEAIEGSREDIVVPVYLRE

SEQ ID NO: 948644 - protein, 47 aa, Homo sapiens
MKNRVCHESIIRVCTDDDCKVKAPGQLAMPVLLISLFSRAHSLFNTP

SEQ ID NO: 948645 - protein, 52 aa, Homo sapiens
PGSHEEQRPWSNLAWGRPHPRPRRFWERLSARQCRIYELRNKQRYLFQRYLS

SEQ ID NO: 948646 - protein, 42 aa, Homo sapiens
MGIVPVLLPALSAASTVRRAAAGVGHYVIYTGHLTYLQLHCH

SEQ ID NO: 948647 - protein, 32 aa, Homo sapiens
SWYLLMLAGPRLLQEGRCGHCADRMAPNCPVL

SEQ ID NO: 948648 - protein, 89 aa, Homo sapiens
LILIIQFSKPLTIPIPPALEVTGGGGTVLIFTFPLPKGKSATKGACHKRKKGGLHWKDYLAELTRSELKQRFFVFGEIEECHHPLPCPR

SEQ ID NO: 948649 - protein, 72 aa, Homo sapiens
RELTLEDPINLEIAVVPCHRRECVRKGLDPDSYLCDLARVGSSPKDKRVPYFTRNQILEHRRKLTLVLCAGK

SEQ ID NO: 948650 - protein, 57 aa, Homo sapiens
RVIESFVETLMRGGGPAQSRGNGSVRPLGLLRQIIKGPPLEQRGELMALIRREGRMD

SEQ ID NO: 948651 - protein, 30 aa, Homo sapiens
MQTLVSDSSVVLSMDKTGAWTWIASSLRYK

SEQ ID NO: 948652 - protein, 64 aa, Homo sapiens
INLEIESSVIECVELEECGWWAILFGESFSCECRASRAIQKNDDAPVADHCLTQVANEAFRAET

SEQ ID NO: 948653 - protein, 46 aa, Homo sapiens
CSRGSSSSKGLVLSFLSRNSDSIHFQVLSNLQVSNIALSLSIHGVP

SEQ ID NO: 948654 - protein, 101 aa, Homo sapiens
DPPCGYETLPMYTAQAEVLPPPPLELEPRPEPPCSRRESKNFFILRIGSSKAKYRWFLDFFFFLFLLERTGFSPCCFLLSSFAPLPFPSFFFENFSPLQFA

SEQ ID NO: 948655 - protein, 85 aa, Homo sapiens
ACRALQITTGLFLAMPYSPARLNLPFPSNLPHITRDVNIHGLQSILLTFHAHMAASNHSSILPSSFTTICGCRPLSFTGIHFLSL

SEQ ID NO: 948656 - protein, 52 aa, Homo sapiens
LACTSWTLASRLRDISYKCICVRSACISLLYSSEKKIFIGLIPHNLGKFVNG

SEQ ID NO: 948657 - protein, 64 aa, Homo sapiens
TIRVLIATLEWRRNFQRKMSEWEGCKRVEYDNSMEKTRYAQKENGKNKSHHPQQMTAAKENTNP

SEQ ID NO: 948658 - protein, 38 aa, Homo sapiens
WCDALGFIFLFTVVGCWHCISNFITRHRYYSDMYYVCR

SEQ ID NO: 948659 - protein, 42 aa, Homo sapiens
DPPFVMGVNHDKYDNSLKIISNASCKGAPAFSMVVKAPRGLH

SEQ ID NO: 948660 - protein, 42 aa, Homo sapiens
ALDGSHQLLTIKCCGVRCGRMNGTVSSPLGDALGWALVVGGA

SEQ ID NO: 948661 - protein, 89 aa, Homo sapiens
RITVRAVPDVTSRYPERSYSWSLPPWINVLMISSFLAWRRSSRRFGYFWLRPAASAWSARSFLRALSASQFVDVSHENPALLMNTFPFT

SEQ ID NO: 948662 - protein, 56 aa, Homo sapiens
LKHLKTSTGNGLEHGPGETLELQISDAVCAANIYGAEARKESRGAHDRKDYKVRID

SEQ ID NO: 948663 - protein, 69 aa, Homo sapiens
SNLVIQLSPVQTSVNEPYRIEFCICRLSGCVIVAKYSGSQQETEIILARNKYFLNILGLFNKKKTEDCP

SEQ ID NO: 948664 - protein, 94 aa, Homo sapiens
MSSLYVMAFEVLPYREIAHNFKTTLLDRTKTWRGQICRLGNLQFVICNQERSAEAQGNKGSQKGCRGWCCAGLWEEGPAHERLISVVEQLPSGK

SEQ ID NO: 948665 - protein, 98 aa, Homo sapiens
IVSEWWTSLHRALPSPTRQPGAPERTRAALSNAKRRCTPSIYSLVPDGTCKDTAIVGNKDPPSICATVPVKTFLNITPAEVAVLVWAKDWSSFCHELC

SEQ ID NO: 948666 - protein, 164 aa, Homo sapiens
MRRGPLSPLLSPYFFSSGAYSVIPGAKGPMSHVTGVFLGHYIHHVVQGLAGVGDTAHGSGPECLLDRSCKELDAGKRWLEGPPTWRRGLVAPGSLHIGGEALNVLDPQGRYRCACSCWAFVPEHGWAPGTRPVLGLGGSFSGGLLSLFWFQLRHILVQLLLGFN

SEQ ID NO: 948667 - protein, 70 aa, Homo sapiens
ERWRAFLRLLLRAGCIGERASSREFLGGRSPLSFTVSTELAPRPIYLTAPVFRRLLVLPGLGLIPGPVSS

SEQ ID NO: 948668 - protein, 57 aa, Homo sapiens
VYLRIPEHVEARYVVVDVTLDMVTPAQTALVWRGGWTDVAEDPWPSPPAKRDTLDYC

SEQ ID NO: 948669 - protein, 88 aa, Homo sapiens
FLVFLKALTSWVRRSWSRKAPMAPPLCLLEDTGGTQALDGQLDLRVSVLTHLVVPLDILLNGLARGASRGSFSGLDCSHRHVRGTEAR

SEQ ID NO: 948670 - protein, 70 aa, Homo sapiens
MSRLAAGCSISSASLYCQAYRDGRPRLPQDRNSAKVYSWTIQSNSLPVENDIPMSVFDKNGSRKNPDAQF

SEQ ID NO: 948671 - protein, 164 aa, Homo sapiens
SRGSRNVVAICGTCVSVFLATTGDNSEDDVELSVPPMPCQHGGSCIDRRGPAIFCSVSRQEALGLLSRRLSEDDVLAQAHRVDSGPRCLHNGTCVDLVGGYRCTCPPGYTGLRCEANINECRSGALQAGKTRDCLRDPGGGSRCLCHAGYSGPRCQTVLSPWES

SEQ ID NO: 948672 - protein, 90 aa, Homo sapiens
MSRLSISSFIAYQKQKLIVFKENAEQGEVDMESHLECQRRASCSAYSFRDIEDCLAETCQALAAGLEQLPEVPPLRITCAEKPTIGGLSC

SEQ ID NO: 948673 - protein, 198 aa, Homo sapiens
GRRCSVEYIPYEAGTYSLNVSYGGHQEPGSPFQGSLCIDVDKMRPRVNVLCGPALSPVHVFVPTSSQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLGVQITDPEGSRRRPHSETMT

SEQ ID NO: 948674 - protein, 62 aa, Homo sapiens
MYCTPPALIVPLTIMNRKLMNTNDLEESGSSRRKIQGIWMPGNLIEKVMCVRIGLACLAAVR

SEQ ID NO: 948675 - protein, 114 aa, Homo sapiens
MASLVFQIPCLGRRCAWICQILYFRFVEGYFFAVLERCYLRCASDDAAVWRRNLNVNLRMMHELIACRFPFPHWTPDHVTGEGIDTVWAYDASTFRGREKRPCTSMHFQLPIQA

SEQ ID NO: 948676 - protein, 83 aa, Homo sapiens
AISELQPFSKSGTVIVERLVEVYLLPVEGWKLRLTGHRVYKLVEDTKHRPKENLELILTQSVESTARAEGLPLRLVRFGISFF

SEQ ID NO: 948677 - protein, 49 aa, Homo sapiens
SASVLQVHAARAHQSRTRSGQGKLALSMPVSNGGTNVLQYTSAVSDLTF

SEQ ID NO: 948678 - protein, 81 aa, Homo sapiens
CHILHYCKGLRALLHVFCYGARTNGRSEAGPAVGGDESLPPAGTTSEEAPGPVSPGGDPAVQPDVCLNATDFKQLTKETHC

SEQ ID NO: 948679 - protein, 149 aa, Homo sapiens
MESGRRVESHIVIQQMYAALYLHYYHNGSDHALTHRYDYLGAPVIGDVETTGAYGAPWSQGGTANSLPPGTVCALHTSAHLASSLGCEVSSESEFTNRIFSGLRSVCSQLVIMEELDSLAQLEGHVAHLVDGVGQVVVVFEELEGARAQ

SEQ ID NO: 948680 - protein, 40 aa, Homo sapiens
MLTLANEYAGFLMALGLNGHLTKLATLNIHDYLTKGHEMT

SEQ ID NO: 948681 - protein, 40 aa, Homo sapiens
NREVELEEFTLVIAIICIVVFRASLLDDYQLEIFGNSFGR

SEQ ID NO: 948682 - protein, 141 aa, Homo sapiens
EVQAVSLTELLFAHEELNMEIGQGYGQVSPPLVNGRRPTFHDLPCGASVILGNNGFIWIYPTPEHKEEEAGGFICKPESLSLLLVREVIYRLRNCIISLVTQRMMLYDTSILYCYEDIPFHIRSTTSYSQEIMEEIVMDTS

SEQ ID NO: 948683 - protein, 33 aa, Homo sapiens
QLIVPFCFKYSSNLVLVYVNTLMGQALPSNFCT

SEQ ID NO: 948684 - protein, 35 aa, Homo sapiens
MVNSSFTPSNSSSKTTSEDHNSQVEQCKLQFLCFV

SEQ ID NO: 948685 - protein, 74 aa, Homo sapiens
DPYVYHRLFPGAIRCQLKKRVSSFEESRVDLQDRDYSTETCENKSIAKIRKRKVTQKINHHDKINGKRKTARKQ

SEQ ID NO: 948686 - protein, 112 aa, Homo sapiens
HIRRVNVENLLHNRNFWILRLTPGSKGEIPYSAYNIRCYGCVVLYSKFGASWRNWQKELCKPRHEGQLKDAGPLLDYAISKIRKDAFSQIEQGKGALKISASHGPKDSRNVS

SEQ ID NO: 948687 - protein, 66 aa, Homo sapiens
EARVNRQLSPHKLFTEDRIRSASPDDCSTRVGVDNSPTLRLAQDEHGFGIAKLQAVSILNRIMAVI

SEQ ID NO: 948688 - protein, 195 aa, Homo sapiens
KYNPKLSRWELWSRWTTCGRLCMNGDMEISHGICRIAVALGKNHSRSLLDQVEHWQSFLALVNIIMSCTGIPSHYPVNETTSSLTITFWYTLQDDILSFEAEKQAVYQQVYRPVYFQLMDMLLHKAQFPSDEEYGFWSSDEKEQFRIYRVYISDTLMYVLEMLGAELLSNLYDKLGRWLTSSELSPTPGSTQKAL

SEQ ID NO: 948689 - protein, 149 aa, Homo sapiens
RNRTLDIGDTYLLRSRELQHRELLPLIPLEIPVLDFLPPDRCLSFFITIYWKSSNYINAALMDSYYTAFSFYSLPASFAKHSERLWETGPGLSLHIREILLNDVDPAQIVSTGIGQKTEYTDTGPSRLNLISADLEQAIISRNIPHLQC

SEQ ID NO: 948690 - protein, 136 aa, Homo sapiens
MPELFAITFSINSSLVTVLVILPLLLLPFFPFGHFCMYVLSFYNPICQTGRRKKDAMGQMRALDGSYALCMVLSQFFQIEAAFHVYHNTLIKIWRRSPKCRGMAIVKLMRPLSTPTTEVWQPLQNVGSTFVVHPLL

SEQ ID NO: 948691 - protein, 70 aa, Homo sapiens
SLLWMCEAYGRGSHQRRASSRGGLHHRRGLRLAGVGPELLRRTGSLFAPLVLSPACPVHLNLDNRILDTS

SEQ ID NO: 948692 - protein, 55 aa, Homo sapiens
MIVFKNSAPYIGFGEGDVGQHPKSINRGGGVRSLQGFTRSIPDYFAVNCTTHTVM

SEQ ID NO: 948693 - protein, 51 aa, Homo sapiens
YTEIAKALKFFSSSVMTLSFLLLMYVSDGHDRSGQLGGQFHVLQQNCLPSW

SEQ ID NO: 948694 - protein, 121 aa, Homo sapiens
WRMRQLLSKTQGNIDDSLIGGNAYAEGREGEGTESTVTTGVDIVMNHHLQETRCTKEAYKKYIREYMKAIKGILVEQRPERVKPFMTGAAEQIKHILANIKNYQFFIVENMNTDGMLALLD

SEQ ID NO: 948695 - protein, 54 aa, Homo sapiens
MSGSALFSPHSPGRAAEAALLQVYVSSQTPQQSPDALHDCSSQMGFMLLRTHRA

SEQ ID NO: 948696 - protein, 48 aa, Homo sapiens
INCVSRKEPLVRACRHARLLANEVIAWYSCCTCSVTLFRTQYSPQIHD

SEQ ID NO: 948697 - protein, 51 aa, Homo sapiens
NGTYDDGATKLNDEARRLIADLGSTSITNLGFRSTTGLLLWSGQGITDTKA

SEQ ID NO: 948698 - protein, 110 aa, Homo sapiens
TRAERGRTKGSKATERLKKKLSEQESLLLLMSPSMAFSGAHAATAMSYTVPASPLDYDACSSGRENILGAAARSVSRSFSLYIRVSCRMLDQLCVVKLSDCPHAFLLSIQ

SEQ ID NO: 948699 - protein, 66 aa, Homo sapiens
STCVLGSCHVLTPVCVCKNVNLCPVTVVPLFCSLRGSSVGLVACVVVLLGASCSGTSRHQGFRKPL

SEQ ID NO: 948700 - protein, 40 aa, Homo sapiens
QIPTYPVTTCPSIGFSYSLGEAACVYVGVTQPCPNLTSYW

SEQ ID NO: 948701 - protein, 54 aa, Homo sapiens
PKQGAGALALKNLSGVEWHWLGHYSYAGDVAPNKYGSKWLATELGYCSTDEASE

SEQ ID NO: 948702 - protein, 40 aa, Homo sapiens
RIHRILRHISISNLADELPELIKVALSLRCYSKFSDGSKM

SEQ ID NO: 948703 - protein, 32 aa, Homo sapiens
MMNGCVLFLLRASPRMTITVAMTTAGHHESND

SEQ ID NO: 948704 - protein, 39 aa, Homo sapiens
PEQKCSMLHTNSRVTSSNKMDRMELPYMSTTFWHSFDRD

SEQ ID NO: 948705 - protein, 153 aa, Homo sapiens
MEINLEKQCLTYVRETRIYLDLPQNFKIFVSGNSNECLQNSGFEYTICFLPPLVLNFELPPDYPSSSPPSFTLSGKWLSPTQLSALCKHLDNLWEEHRGSVVLFAWMQFLKEETLAYLNIVSPFELKIGSQKKVQRRTAQASPNTELRLLRRG

SEQ ID NO: 948706 - protein, 85 aa, Homo sapiens
TSIMYSSKSLELLSLNQSGLVHYVLSCFRGLVEPFFQGDLVIRLVYEEFSSAQFITAELVRAYHPPFPDVRTGYSFPPGGNRRRP

SEQ ID NO: 948707 - protein, 76 aa, Homo sapiens
ALNVEQASQTIARNALNQETEVELYNEYPEPIKLHKNERANGLLQKAAVAEGAVRVEHRVLHKPRTHLGLQHTNER

SEQ ID NO: 948708 - protein, 33 aa, Homo sapiens
TRYGYLEHNFFARQQNQKPDLAILTSKLGFPAA

SEQ ID NO: 948709 - protein, 120 aa, Homo sapiens
AVLTFLVCWNREIHSEVRSLDDLVSSSCTCSELTVIMLLLLETISTVHQESQNTILPEPSLPVSTEQVIASNLQDRKRSSHFTYCHVPLNTRPYKIGTSLNVMYMSPSKVRPLVFTSFEI

SEQ ID NO: 948710 - protein, 56 aa, Homo sapiens
ARYRSVAVHLATAILKNPEYWQAGSQDSLRLEAGLCLYGNDIDEHTTPVDGQPHVG

SEQ ID NO: 948711 - protein, 100 aa, Homo sapiens
LDRTSCVCWYVAPVLSAECTTLYGLGKAIAMLPVFEYDTMLYFAVHHYRAGIAALFTALPDKKSAISLPSQQVFSFVSVAASNIPCLLIMMGQIFIIFHQ

SEQ ID NO: 948712 - protein, 43 aa, Homo sapiens
KAPSLKMERYEARGHCRRPHQCCGGANSDPLANGSGVPHLLTI

SEQ ID NO: 948713 - protein, 105 aa, Homo sapiens
MNSPSLGLAETDDLFTLYATELTRACMEASAITSSAVNSFAKVVWVASGSGVVFAPGQDCYSCDFDRAAKMMSVADIANGGGVLPLAALWLLCNHWEQLDSPDLP

SEQ ID NO: 948714 - protein, 33 aa, Homo sapiens
MGIVSGFEKLDDEDEEDEEEDDDEEEGEHLRER

SEQ ID NO: 948715 - protein, 40 aa, Homo sapiens
TEMYGSSFDLAYDFQRDYYDRLYSYPARVPPPPPIARAVV

SEQ ID NO: 948716 - protein, 77 aa, Homo sapiens
SIIGHFHRYPPELLEKFRVEKDKYGAREEDPHPTLTSPSKAPSRPTSDLAPKFTYLPSCPLFFQGRLPGIGPSLSLP

SEQ ID NO: 948717 - protein, 90 aa, Homo sapiens
YHQIDVPGSQNQSFQYLRSCFFLTLTPAPLDPSPRISSSLEPLATVHVDSNSFHILRDAKRIVTVYHSFVKTHGVCSCELLQHLVVLRFW

SEQ ID NO: 948718 - protein, 119 aa, Homo sapiens
HTMVGKLSSSGCGRGVRVKYHHREVMPLTQPHDLGSSSWSHRCREMRSVSSCIIFLPMLQHVVLLEELVRQLRHAQGGVDLHSIEVVIAFPEVGTFENFWSKASEMLCAGSVEMIRTLS

SEQ ID NO: 948719 - protein, 157 aa, Homo sapiens
ADLYEDPPPRTERAHGFVDVEIRSRAKLRKFEQVYLKVSDLMVVKFGGEDESMEMSTEEILTVSVVNQSLFDTQGSPGLEDYFNDKSIKGEKLVPGAREVLTEIFKSLPIQSRRLSLTPAKHIRVSDIYLSKEPINSQTPGKTPPPLFHQCPAAKKG

SEQ ID NO: 948720 - protein, 42 aa, Homo sapiens
MARPLHGGLTRFTEVQKAGGPEITIDRPGPCRSMNLSEQTVS

SEQ ID NO: 948721 - protein, 102 aa, Homo sapiens
IIPLNSLLLGRVTLNSNESDFTMWPLLGSNSLLGNCKGREISRFCLALRSGFKGTCFLPPGNLPLLDNITSFLLFVANVSQARTSRANQHILFHFLAVWCMA

SEQ ID NO: 948722 - protein, 139 aa, Homo sapiens
MACPHSSDTSQITIPKLHRSLAVVKNPMGNGFYGMLQRIGIFSPCVSVCAIRVIQEASQATVRHLAAQVSIHQDVSGRQVPVNIIVITEVVHAMCYACSMATSCPGTSWSSRSLRKASRAPFSINSVMIMIGFRFVTTP

SEQ ID NO: 948723 - protein, 86 aa, Homo sapiens
MSLSSFLQSISFNCWTKPKLCHFTRKNLLRSPQKPPTLCTLSTGPGAFADHDWAKPFFLLAIFLIIQLWNMGNRFEILAIEEDNIL

SEQ ID NO: 948724 - protein, 77 aa, Homo sapiens
GSSVAVLFLPEPQFLLQLFVVYKKTNHLFGFKVSGLKYPPEITILLNLTLLLGSLQNAYSNAAFTDEPVHSNLLCLA

SEQ ID NO: 948725 - protein, 145 aa, Homo sapiens
YDILYNTLGLYRFERVVILYDICTERRARIFFVFLSVAVSNIISPTGFFEVRESSLHPGALSSYMSQFHLWVENKHKSHINCVLGQGYVTIFPESMHQAEESHHRVLNQRCYNPLLKAGHRKKSKITCMLGSDICHKNHCGAGIL

SEQ ID NO: 948726 - protein, 42 aa, Homo sapiens
IQCHRFLIIVFLHVWLLCFFQVLEIVITPVPSGPRSQEFLNH

SEQ ID NO: 948727 - protein, 228 aa, Homo sapiens
ASRSRLLLRKIRDADAEDGLTGSSLAGIEPQHVCRDGPLGGIGVLALLHLHRLLAGLAVVGHRGLYELFPVLLIPVIVTLITGGAGRGVAVKLLCHICPPLHRGWNDSSVSSPESSLLSVAFSSRILPSSFILSKYGIMLVLIRVSIFIVAWVHALFQSSVLDVELFRVDKIKQFPVLLPLNAAEGILSALLGLNFKVKGRVVVVHEQSGQGDSSKRVHGQGSLSGRG

SEQ ID NO: 948728 - protein, 68 aa, Homo sapiens
SKSQELLLFRKKDTSMVVYHLMAMAHMYVSIVLLMRSTPDLNIDHMSFHGNGGGSESRLRSNQITAIP

SEQ ID NO: 948729 - protein, 136 aa, Homo sapiens
APGLRHQESKLIILAMVGHGLVQIMRNYMFMKMLLWTTVCVLIGAILCVPRNNACHLWRLGGMHVPGVKHRDQTTAPCLMQNCTCGPLRTISDVATKQEGLESVLKDSGESAELWMSVHEFNCATGKLSKLTCRHS

SEQ ID NO: 948730 - protein, 42 aa, Homo sapiens
MTTCSGTSSCSVMSMSAPAEETAPVMYWGPCRPGTVGGGVRP

SEQ ID NO: 948731 - protein, 39 aa, Homo sapiens
RAVQVGGAVAVKGEQMANGVPGWSVNMNTSCCLDVGTEV

SEQ ID NO: 948732 - protein, 135 aa, Homo sapiens
HAERVKLINELRTPVTGESAGGEYKEMDKPCGCPPGVCDHGTGDRRDPWYSTVGLLPPVRAMSQRNLNAKTEQWPTGVTMTSNPITWGQIKKTTQEAEKLLERQAQAKTPDSMFLAMLAVVSCASIGSGEAPTGN

SEQ ID NO: 948733 - protein, 184 aa, Homo sapiens
LLYNIHPYLGFPVLCWTPYPGILRMYVHYPSCITFQWCKENKPSYIHYQPAQDRLQSHLVEMLIQLPRHISVTKVSIQFERALLKWTEYHQIPNHGFYFSPSVLSALVPSTVAVKPVDGNRVPSSISLFPVSDGSNYFVRLYIESRCCVNLPTPDFSMPYNVICLTCTVLAVCYGSFYNLHSLT

SEQ ID NO: 948734 - protein, 185 aa, Homo sapiens
CDGDSSMWKVRVSEIVEGCRSTRAPQVHVRQITVVGHAEVRCRQVHQQRLRVEPHKVVRAIRDWEQAVEEGTLFQSTGLAATMLGTRALRTDGADIESMVGSGVYSVHFSSCPLKLDGNLGDCVGRQLNQHLQEVGLQPVLGRLVVDVTWYEFSLPLEVMVRVCTYGRRYQGTVSSSSTGKARYG

SEQ ID NO: 948735 - protein, 42 aa, Homo sapiens
THPSRAYPVLASWTLYPGICGCICTPIIITSYGAKVEQTNVT

SEQ ID NO: 948736 - protein, 72 aa, Homo sapiens
MASRGIAQCFPSLYHPLQTAEWHSLLVGRTSSSKALKRGFQSLYTLPCLASGSQGLVHLAGPLRYPEQPSKG

SEQ ID NO: 948737 - protein, 74 aa, Homo sapiens
MAAHTTCYAVSDTRGTEVERQEKQAAMIWRYRRKNGTQQSWAGQPLLSARLLYLQSLLDNRWYRIYQSSSFSGK

SEQ ID NO: 948738 - protein, 104 aa, Homo sapiens
MHFLEVRRLASDPRRVDNVDLIPTVATCLPVTLPKYRGPVAKELNDTKLGGVGILIAVQWSLCNCSRRTCLHPANSPLIGRAVRLKGASIDWVVSFKWVCEEPR

SEQ ID NO: 948739 - protein, 46 aa, Homo sapiens
RSFDVVQFAQCRQVLMWMQQISRKITPLMSAFRKGHVKVVQYLVKA

SEQ ID NO: 948740 - protein, 37 aa, Homo sapiens
VDLNRYWAIRVAAQQVEVTPQLYQGNHGGEQSCMRRR

SEQ ID NO: 948741 - protein, 43 aa, Homo sapiens
GRFELSGIPPAPRSVPQIEATFDIDANWITERHGHGQEHRQAQ

SEQ ID NO: 948742 - protein, 69 aa, Homo sapiens
LKAALDLLVMVILLALPVLLSRGRDVQDAVGFDVEGHLDLGHAPGARRVAAQVRSAPTDCCLSVMAPLA

SEQ ID NO: 948743 - protein, 57 aa, Homo sapiens
SGVAEQCHILGSEMVHNNHQMQYYITFEVLELVLGMSYRNKVQQAQDKDHIIATRSL

SEQ ID NO: 948744 - protein, 34 aa, Homo sapiens
KLQQQQRELKQLQEDRTKLIDIQEKIQALQHGLS

SEQ ID NO: 948745 - protein, 37 aa, Homo sapiens
MAWSARTRLLPSCWRRLKRLAKSDPMVAVLHRGSRES

SEQ ID NO: 948746 - protein, 58 aa, Homo sapiens
HKAFEAIRESPVKRGPRGLPVLERDTTGLQGLAWYRWSRMVITGAPWLQWVLAGPQEP

SEQ ID NO: 948747 - protein, 178 aa, Homo sapiens
GGKDRLPAKLVEGLKRLAKSDPMVQCIIEESAESTSSQGAGEAAPGKSALKDLRGGPRLASPFKKICPGRLRTRDDGHVKYVERAQPLQVPPYKHNRVVHDRRWPFPRRPWPRDNRIKARMSSPIRKLKPAARDYLDRKDDEWDVAEARKDLVLWARRHPGPKSSPTSPRLLQYLNEM

SEQ ID NO: 948748 - protein, 39 aa, Homo sapiens
MVRQNLAALPKLVEGLKLAGQSPDPMVQCIIEESGEHII

SEQ ID NO: 948749 - protein, 154 aa, Homo sapiens
ALSRSLCWLVDTAALCEWIVKSLTRSSVAKLILVWLRAICAVLLVLVCTCSEWHARSTTSTLALADSMVRCADHAPWKETNMARNQISEDTWSCHRVTWTGRFKYVRVTDIDKSAEYAINMLPFFIGDWMRCLYGEGYPAVQPLEHLHGRGGAL

SEQ ID NO: 948750 - protein, 42 aa, Homo sapiens
RADSNMQIFVNDPHWSKPSPLRSSPDETIEASKRGTEARNSV

SEQ ID NO: 948751 - protein, 68 aa, Homo sapiens
NLLQKIVLHLCYGHPGTAQIGEGVEHSWGDLEDSETDDDEGSGDQAIILDGIKMDTGVEVSDIGNQGR

SEQ ID NO: 948752 - protein, 34 aa, Homo sapiens
QLSLSYGGNENQKQSSYSLHPYDKRGQQLNMESS

SEQ ID NO: 948753 - protein, 110 aa, Homo sapiens
NPMVDYENQKQSSYSQQPYHNQEQQQNMESSGSQGGQSTFSYNQPALWSTKIHIYQAVMAMTHTSMAHIDETVKFIDSACFDSYKSQTMQSISFTTGKTTATTHKMTVVM

SEQ ID NO: 948754 - protein, 109 aa, Homo sapiens
ITSRAHIAGNHIITQEQQQNMDSSVKPSWNSTFLITSHVNGQQDSYDQQLQAIINIKAHIMSSQIMISFFDSYSRNQQSYHSQREDYSHHTQDDRRDVSRSGVNHSEPA

SEQ ID NO: 948755 - protein, 87 aa, Homo sapiens
SANVALLPQCIQEAAAPSATDRGICLRPESYLGSPQHRPSIRSSPNRSLPSPGVLCGSDHPKTEDPPGEKMVAAKVKGEKKDTTLKK

SEQ ID NO: 948756 - protein, 55 aa, Homo sapiens
MSGNLHATRLYRSMNSQYLKLLSSQKYQILLYHGDVTWPCNFMVDEWLVDSLNQK

SEQ ID NO: 948757 - protein, 43 aa, Homo sapiens
MGYKQQLCKMISTSAQRQLCHSRLTTCPAFDGHLKLEYYSLIM

SEQ ID NO: 948758 - protein, 49 aa, Homo sapiens
MGASAPEGRKMVAAKKRISRWSRSTLGSNSIMNKWEVRFLGYNADLCKM

SEQ ID NO: 948759 - protein, 115 aa, Homo sapiens
GKNGVGRQNEGKCKQHDNTCSTFSIKVEGTGEIAKARIYRLVFFTHRCKKHCHSQVKEPRASWKCGAHTAVEHTCCGDSSVSAVRVVVEDLRYVAQVENGLRLHGGINDEIACSI

SEQ ID NO: 948760 - protein, 64 aa, Homo sapiens
SGVVLLQCTSGRFQVQLAGARDDVLSRLLDDALAPWGRTWPACFSPSTSLGRSAWVLGLHGHSD

SEQ ID NO: 948761 - protein, 86 aa, Homo sapiens
SCAELYALRSMLKKASNKTLASLQRFQDLQCDLPFSPRLDQVQHLAEADLVGQGLDGHAVQPLALLLVEVLELEHGQGAVPVEVNA

SEQ ID NO: 948762 - protein, 110 aa, Homo sapiens
NVTSRMIANKLEPDKEIVHDGDHMIIRTLSTFRNYIMDLQVGKEFEEDLTRIDDRTCMTTVSWHGDKLQCVQKGHKEAHGFTQCILDDELHLEIIVQGEARMEALKGQRS

SEQ ID NO: 948763 - protein, 72 aa, Homo sapiens
MLCTMCAKLLHEEAYSLRLRLSLTVWGQLCPVALGVGQHVGGRADEQEEAVLGLVWPLLGLQLGAHFKGHAG

SEQ ID NO: 948764 - protein, 50 aa, Homo sapiens
SGDAVRLMLPADGISLKANSARLGGDLVEALGDPDHGGMYLSSGQHLRFG

SEQ ID NO: 948765 - protein, 52 aa, Homo sapiens
EPDLSKRNAAQKTDTSQHDQDHPSFNKITPTMAEVRLQRYTGMLATLSRKQH

SEQ ID NO: 948766 - protein, 37 aa, Homo sapiens
YRLKRELSQVGVILSEGRVILIMVGCICLLGQHLRFG

SEQ ID NO: 948767 - protein, 35 aa, Homo sapiens
SAGTCCGDWLGHGRRLGFPPFCSEMGVVGSISALE

SEQ ID NO: 948768 - protein, 54 aa, Homo sapiens
GAERALTQADAKNEGGPLHAPGPEQVFLRFDMLLEHPLYSHDVLSAYLSCLRLS

SEQ ID NO: 948769 - protein, 69 aa, Homo sapiens
ACDSMRIPNMRTDSSGPFAVVNSQVAFDGSRVSTVNDDLYNMIIRRYSDKSGNMDFDNFISCYISPFAC

SEQ ID NO: 948770 - protein, 59 aa, Homo sapiens
VSRIPNLDSGAARNYMMKDCKHPNIVAYLGSYLRRDKLGIGMEFGGGGFFTGIFITVTG

SEQ ID NO: 948771 - protein, 65 aa, Homo sapiens
MRYAAKSVRALRRRLRGLVPGSLWPSPEQVRELEAEERDWYPEPGRPCSESLRGEAAWPEEQNAF

SEQ ID NO: 948772 - protein, 81 aa, Homo sapiens
LCCGRSRRFPMDNALRAQLIMPRLRGEASQALIEGFSVTIDGQTGQLAWGQWFLHSPSTRLDVTYIPRCRIVSIRDTRRFE

SEQ ID NO: 948773 - protein, 36 aa, Homo sapiens
RIYMDLRSRCAAPSPTLLLFGQLLHPAADSCMVCQA

SEQ ID NO: 948774 - protein, 61 aa, Homo sapiens
ARLSLWRVRYGVCTIHTITMSTSKKKKKHKPDNTQTSSHNGMTSKRKGQGMPCHVLRPDSC

SEQ ID NO: 948775 - protein, 94 aa, Homo sapiens
IAKTAARTPVVWCIYINSGLNSSADINLLRTGIGGEASGVVPYAHIGRSTSSCLSFSFTICLGNSIENLQDQKLFQPAGLLDVTRLHHLVRRKH

SEQ ID NO: 948776 - protein, 78 aa, Homo sapiens
SLAFLQWNPSVHDEAREKMLTQKKKPEEQHNKSVHVAGTVMEYSRGSDTDLSCKRRRKRVADIKEMVESRCTIARFRA

SEQ ID NO: 948777 - protein, 167 aa, Homo sapiens
KDNTNQATIGIDYQYKNYVLRRIEQNDGNNGTQQVKSGTGARSLATYRDSTVAVVVHRYHKCKLIPANYKVDADVRPERGRDVIIMLVGHTPDLADKRQVSIEEGERKAKELNVMLMETSAKAGYNVKPDRSLPTVAQAEVQRHHLGYTATYAPGYQAVLLPQVSHI

SEQ ID NO: 948778 - protein, 173 aa, Homo sapiens
SLVRTQFYRWLENAIGLLVTDIAARVGAEMLQCTALAEIMPALGDNWVWEALATDKTLEWYSLIIATHFIVVILIDTISDPNQAHVRSATHACNLNGHEGICSYLRSRRSQSLGSPYRCRAVNPSARWHVDPRALGWGPFLTIPEEALPHDVSYGSMSLCYMLIPDTCIGPEL

SEQ ID NO: 948779 - protein, 44 aa, Homo sapiens
MSLGAVLFSRVHVLAVQGLLWTCSRLLRIRRQCRMVAGLYYGYR

SEQ ID NO: 948780 - protein, 89 aa, Homo sapiens
EDTSIEATDYDSCATLKSRTTTRLRPFLFLKVSRKNPARTCRWLRDSATQSGAAGYYWIDPNQGCTRDAIKAIAVISLLGESCFRGLYE

SEQ ID NO: 948781 - protein, 137 aa, Homo sapiens
EATDHYIFVERSFTAECRTGLLRGTFRNRSSSLLGFLKVNPEVLILCYAGDISVEHGYVKAPRFLQVHQVKEDACISEITGFGPGPADYGTVIAMGVVFIGEQHDPLMTHLELDINKEVGTEPQNFTELSSQIRGLY

SEQ ID NO: 948782 - protein, 68 aa, Homo sapiens
RPAFSLRVLWLPHPLLTPIGLNILSSASSYTSGAASIHGSFLYSAHLHHRHYPPACTFSNSLHRLCPP

SEQ ID NO: 948783 - protein, 63 aa, Homo sapiens
RKLHPDEIDTDSEYILFYEQQAIDYAPFLPKPDGKKMADTSSMDKDYESDYKKYCVYSKGYTP

SEQ ID NO: 948784 - protein, 121 aa, Homo sapiens
LRGHGITSLRWGGALLHCALGYSVVTLWVLEATQRSLCYQHSDSGEWVMSHDDLEHRPGSYDPAGMMGAVHKEMGRGSTCLFFHRKDCEVYEFTVTLGLLTSFMPRVTSCISVMHIPYPAE

SEQ ID NO: 948785 - protein, 83 aa, Homo sapiens
FVLACCRFVSACQFVSATGLRHSSPGTSPCSGPCPGRGWLQPISVGWQLGILADAQAMELASGLVQHAVIGPQCEIGSPSGRM

SEQ ID NO: 948786 - protein, 50 aa, Homo sapiens
APADFSSGVYLTLRTTGCCTNQRQLHVLRVGIIPSATQQKLAATIPYQDP

SEQ ID NO: 948787 - protein, 44 aa, Homo sapiens
IHGISSQSLHAGIYTALRARTCRLVPVQHPLLATGAVWASIAFA

SEQ ID NO: 948788 - protein, 48 aa, Homo sapiens
LSPFFQSSAATRSMLVTAKVVVPCLGSCRDAQVRYFSQASSCDPCSQR

SEQ ID NO: 948789 - protein, 111 aa, Homo sapiens
YTFVALLPGRGTTWKLSKGRFRLPTEDTDGQGMCRLKRDRPSNGQSVFHVSHQCLEGPPAKEQNWSVPASSLSFNALRGSVKGGHLMSFSTEADVNIAEEDVHEVMSCLLC

SEQ ID NO: 948790 - protein, 48 aa, Homo sapiens
MASFKGLYRKSTRTPYKKLKDAMEEKITMAEVVNKINRAKWEEYISGF

SEQ ID NO: 948791 - protein, 91 aa, Homo sapiens
IVDLLGPIIDMSSSVLQKNPTAMEGTLRDVIRHAGCWQWKLSSWDEAAISGLHGWLRVVRVQVDKLLNNVADEVVGAVRLPSDDAQGLGDH

SEQ ID NO: 948792 - protein, 80 aa, Homo sapiens
VSPLPRNGLGPTKTKTAGPDHTEITLEGFSTTVEYVDRVYYSESKRRESASSFRLQLPYIESPLRTAFTDVDIDTIQIAW

SEQ ID NO: 948793 - protein, 48 aa, Homo sapiens
DPSWKTNNRIYKTLAEPPETLSIANTRVFTNVWKGLAHIAFRTVNSKR

SEQ ID NO: 948794 - protein, 69 aa, Homo sapiens
ADSEDSFGSICLGSKIYRGGINWVSTRERHYRYLGMQYIVLPFTRVDIDWYIQSYDMIPWLPQLGDRSI

SEQ ID NO: 948795 - protein, 82 aa, Homo sapiens
MVSLRILVVGLAGIANGTGFTPRSAAVVTAPAPLASKACAGANGTEIFLLPLFSYVVCLPIIITRCLMRVTLEFSFSVPKTC

SEQ ID NO: 948796 - protein, 102 aa, Homo sapiens
MHLDITARPRSVLLDLRGAAPFPLVAGGRPHEKPPSREVHTAAEMGSAILCITAGPWRAKRPKAPRGEEAHLPPVSDLTVEFDKLNLQNIGRSVSETPDQHT

SEQ ID NO: 948797 - protein, 91 aa, Homo sapiens
HILGTEKENSSVTPHEGNVLLMMENDTTTVSRTVAEGISRCLLLLRYALDASVAVCCDNGLQTWWVKPGLRRRYWPSLHTVFSEIPSENKH

SEQ ID NO: 948798 - protein, 181 aa, Homo sapiens
MPSSVSCGILLSGRLVLPWSLSPWLMSPQGDAAQNDWYSPTMIRITHSSSRSPPSWMSSASDLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKK

SEQ ID NO: 948799 - protein, 45 aa, Homo sapiens
LFFTDSGLMQPVRRNDSSSCRVMLLVAQQMGCKMANLVLEHMWQN

SEQ ID NO: 948800 - protein, 118 aa, Homo sapiens
WPVKRFEASRLTAGRRSRERQKRRDVWTPRDVWLGAVRAESSPWAAQLQGKITFPLHPSPPFQLPIHPAESHFHHSIKPRIHPSSPCVTRFFLDSGKELGIQKAVPWSFALVKKQKVH

SEQ ID NO: 948801 - protein, 122 aa, Homo sapiens
DIPMAGEEIRGKPSDGKNDVAEEDRRGGTSRHREMFGSGQSELESSPWAAQLQGKITFPLHPSPPFQLPIHPAESHFHHSIKPRIHPSSPCVTRFFLDSGKELGIQKAVPWSFALVKKQKVH

SEQ ID NO: 948802 - protein, 33 aa, Homo sapiens
MWQVMVGFDGALQGHAVPADGHDGIANVLFTGH

SEQ ID NO: 948803 - protein, 51 aa, Homo sapiens
MDERLSWILRAGHSLLALKESSFLTPGLLWLQLLSSKHQASTTTLYFHATF

SEQ ID NO: 948804 - protein, 85 aa, Homo sapiens
ADLEDPITWYCDLFNEDCDSELKEIRESYDADDIQESISQSLKLWCCCAPQADMIYDPSCHHPPPLIPYYSKMVFETGQFDDAED

SEQ ID NO: 948805 - protein, 206 aa, Homo sapiens
ITSVLGCWRRRWKNADLPEWRSSRWWSAALQVGVRKTHLSFRTVSPAGRLSTSLVPHAPRSSSVLGEAVLAFSPALAEVTRGIGRGRMVILRSYHEEEADSTAKALLTEMCLGEEDSLQLEPRKGLASLPASRNPGGSLSFAESANLNLSIHFGCSRPAIFTIKDSWLDGHFGLGTLSETDSHSQDRGSPEGHQPGPQLQVTGTPP

SEQ ID NO: 948806 - protein, 69 aa, Homo sapiens
MPSVEEQRYTCHVQHEGLMYLVSLRWEPSSEPTIPIVSIVGGLDVLSVLSVLGAVMAVVMCRRKSSAKS

SEQ ID NO: 948807 - protein, 51 aa, Homo sapiens
TIITITIITTIIAIIITITIITITLLNLYFYLTPNLLHLIITITIITIITI

SEQ ID NO: 948808 - protein, 71 aa, Homo sapiens
LEDFKYSREEKRKEKKEKKRKEKIVSMPANTTSILQPMSQGVILTFKSYYLKNIFLKTIAAINNDFSAGYL

SEQ ID NO: 948809 - protein, 87 aa, Homo sapiens
MSSQVSAETEKIREEKRREEKRREEKRREKKRKEKKRKEKIVSMPANTTSILQPMSQGVILTFKSYYLKNIFLKTIAAINNDFSAGY

SEQ ID NO: 948810 - protein, 93 aa, Homo sapiens
MAEDVLQILNSSKRAIDNQLKNAPDSPQEEQNQHENAVSSSSPIHVFFNHVIPHLGHSNSLKTTSDLNGIRQADERFPPVSLFGSLMIKLPTL

SEQ ID NO: 948811 - protein, 60 aa, Homo sapiens
HLLLIFNASKMIEVYYIEDAEAKVFPVSFLNLGSSAFSAGYLGYRSSHIRHIHGPSAVSQ

SEQ ID NO: 948812 - protein, 51 aa, Homo sapiens
SDSIVFVMMLETNCWLSWDAPSFEEATTTMNFCHSLDMKLRTLGFNTEGYR

SEQ ID NO: 948813 - protein, 47 aa, Homo sapiens
MFFHFETVRFKHESNGTYPSGEMLCCCLICQIILRSRLSTGYDWFML

SEQ ID NO: 948814 - protein, 43 aa, Homo sapiens
SLGYYCLCPVERSFWVLYAPSDSYLNAPSTNVSISTPRLLSSS

SEQ ID NO: 948815 - protein, 69 aa, Homo sapiens
LDVSRHVSLSHESRETLHCSRPQTIGAASRIPGVTAAAIINLLRLVKTTQRRLSAINESSKTDQYSCTA

SEQ ID NO: 948816 - protein, 165 aa, Homo sapiens
MQLPLSFMLSVPCAGTPSPRFSQISPPEPLSSLTLVITCALPNYCLFLIPNHSSFLVMILGVVANLLIIGIPFENIRSVNQPESYAQHTVGAHDTFTELMCLPRTFRVPRSVAVYPSPLLSVGCRNLVYPQLTPAIRPFLQTISMGLMSFGATTNAHETGLSESK

SEQ ID NO: 948817 - protein, 33 aa, Homo sapiens
MYCCFSLYGLIQVPLLFRWLQTCYQSDAHASLV

SEQ ID NO: 948818 - protein, 73 aa, Homo sapiens
SFPQYDIKVVTLCCTQLDCHLLRMQTCRPHIFDDPFSINSGKKMTTSADHLKRGTILDCNTCKFATITCNLTS

SEQ ID NO: 948819 - protein, 35 aa, Homo sapiens
GWAQIKMSINGDNFQKHQVCDRTQRRHNHQYHDIG

SEQ ID NO: 948820 - protein, 74 aa, Homo sapiens
TAYGAAAAVRPTVESDYGNGFGGFGSFSQSQSSYGPIKSGGGGGGGGSSWGGRSNSGPYRGGYGGGGGYGGSSF

SEQ ID NO: 948821 - protein, 40 aa, Homo sapiens
YSVLAVYLISQSTLVRGIPGHYQHYARISLIISASSPRAP

SEQ ID NO: 948822 - protein, 46 aa, Homo sapiens
QLTVLQTKYVEAKVLSERAEQEQRGERITRPTDEFYVCPWEAMDEW

SEQ ID NO: 948823 - protein, 177 aa, Homo sapiens
GVQLCESVANKLAGKVMAAVSTVTFHMSSTALQESLVQILQPQRRVDMLRDIMDAQRRQRPYVVTFCGVNGSGDIISLNLATDFLLVVQQHMASVSSLLPVIPFRAGAVEQLRTHNRRWQCPTPSREAWWPHHGAVCLNRAMATAAAGIAMEAIDLCRTPGFDVCWWTRRPNADNAP

SEQ ID NO: 948824 - protein, 37 aa, Homo sapiens
RGTLLSVMMLIHLGTSVPFLFIRSVISSIPAAILVQS

SEQ ID NO: 948825 - protein, 211 aa, Homo sapiens
LHYVLLMHRLLDPHKYRCDNVQHICEEWYRRVTSTYRSGSISEYLSQDTVSVPCQSAVVSLCPGRCISGEAGLWGGTKQPGIAFIAAKYDGILGMDYPRISVNNVLPVFENLMQQKLEDQNIFSFYQSRDPDAQPGGELMLGGTDSKYYKGSLSYLNVTRKAYWQVHLDQCGGGPAGLTCARRAVGHCGPQAFLMVGRCMRCASDRPRAVR

SEQ ID NO: 948826 - protein, 92 aa, Homo sapiens
LIETSEDVVIKYSRSISTRCEMHDGGRHTAEIWPLQCQLLMQTRLENKAVPSPWVCGSEVSALYPRDVSALHRLRAPEWGDTGRLGQGSRLQ

SEQ ID NO: 948827 - protein, 47 aa, Homo sapiens
LYGLGQFQYCSKSALLQFSDTDIYLNSFGLRLTVSTNPLRSLSISSV

SEQ ID NO: 948828 - protein, 87 aa, Homo sapiens
DCVASEILALGGRPRHYFLDRCDLTLCDADRAHVLSLQDTCVAVAEQKAMKSFSTWVLSTASSSRFSDDCAEATSNGLLDDTHLGCA

SEQ ID NO: 948829 - protein, 126 aa, Homo sapiens
SHGRMCCTLKFDVELAQIARQTIVMENMYFPVCRGLTLRITVTFKDMRPLSLAPKTGRAERPRHRESWNVSWPAYHVEGRDIKAKAPKVKMPDVDISVPKIEGDLKGPKVQANLGAPDILIWGPSL

SEQ ID NO: 948830 - protein, 52 aa, Homo sapiens
SWSSRLGPDKMKIARSADRSLARELSGALNEILGYCQSVCCNVDGRHPHDII

SEQ ID NO: 948831 - protein, 75 aa, Homo sapiens
SPRGHSYDSYLYYLFIFFFDLPYFFNLIIAYFFITFLLHHKSNEISNKLENVSSQSPLFFVPPSTQIWSTVRHNR

SEQ ID NO: 948832 - protein, 90 aa, Homo sapiens
LRTGNERAARERENMDTDMKGNTKISRKILKKMMQFEQMSTFTDDSVHPCWKVTPIMKEHLELVWLICFKTFIFPKMPLVNKVHQCLRPE

SEQ ID NO: 948833 - protein, 105 aa, Homo sapiens
CYDSNVNTHNVLSPEKEKQMSEPLDQKIIRSDHNEHDEKACVLQVVCNGLQESNNAINIPYNVEFLHLGKVWIPDYLRKRLYIDLHAVVRITPVEVTPKIPRSLR

SEQ ID NO: 948834 - protein, 40 aa, Homo sapiens
EGCLTLLLRLSHRGSSLEFWHLAFSTSAVSLWLMRFSSLI

SEQ ID NO: 948835 - protein, 68 aa, Homo sapiens
LLNTAAEGVLRRGLLWYSSLGVGSCGSSAGNVRHSNSSPKPQASFLPCLACAIQSRRLEQVLNRPHPK

SEQ ID NO: 948836 - protein, 95 aa, Homo sapiens
MYRNIPTLLDPHESTHWLSRQVQTTSFPVCPSRALTAPLFLYQNKRMVVPDALKVVLSDAYKKGESQLTLQTSTWEITGLLTDLGTWSLAADVLI

SEQ ID NO: 948837 - protein, 87 aa, Homo sapiens
TDYLPYYLLFYNMLLQVGQSKRHTKVSLYYLQAVQHNNSRTRTWESAYRAVHQIQSSDSCTAPLCPGCYDSIAMRKVSAYVCIDGGN

SEQ ID NO: 948838 - protein, 71 aa, Homo sapiens
CALVRCSQTKGSTIHPVVPDWSPSTADLFPSHGSDSVPQSTENALDQVDDGEVPLRETEKNVRSVLNCMMQ

SEQ ID NO: 948839 - protein, 76 aa, Homo sapiens
MHARMFGTGGKICESFTFLTFLMSMLCWVDSEGNNDLVVIGDIGLVIVQFRGLILTPAYAEENGFHVTYTNISSSI

SEQ ID NO: 948840 - protein, 63 aa, Homo sapiens
MSEGALPFDKETGFHRGLGRFSFFRRRTRNALQQENHIIDGVKVQVHTRRAKLPQTSDDEKKD

SEQ ID NO: 948841 - protein, 54 aa, Homo sapiens
MHAGYVPKAMSKPMLGHSTCCSTLKTRRLCIIRLNSFSTPDKDINERGNGYELE

SEQ ID NO: 948842 - protein, 43 aa, Homo sapiens
HLRTRTLGPKDVLSGGEQRICEVVAVYVQSVVRPGIGAKSRCV

SEQ ID NO: 948843 - protein, 81 aa, Homo sapiens
VFKSYPRGYVTVSAALGIFNGTLHADLLRTTLLNERVSVPLLNTLDHVLTHGCFDLFITEEDEALLYMTSFPIHAYSAHVL

SEQ ID NO: 948844 - protein, 50 aa, Homo sapiens
PGSRNNGVQYVGVEDESAGVVVYSQVQYQLVANSILMVSGEDRLHLWSVI

SEQ ID NO: 948845 - protein, 59 aa, Homo sapiens
VRGSEVSSTKADSSNTLTCRMLSPLSQSLKENISGRDPDTETDKCFHSISFANSSVLIQ

SEQ ID NO: 948846 - protein, 85 aa, Homo sapiens
EQRQNTEKGSYGFYVDQFYSSWKKNHSNKQRVLGHCSFVKLERLCFPHHSQPPIFGRWLRIQEIITTNFQVTNSLQYIDERMMES

SEQ ID NO: 948847 - protein, 32 aa, Homo sapiens
MQAASVTSASKSWHPARLTAWVPSVTEYRLRT

SEQ ID NO: 948848 - protein, 43 aa, Homo sapiens
FPCYAALRLQDWFFPQPTELWLVWWLEVSDIDTSILEAGRPPR

SEQ ID NO: 948849 - protein, 119 aa, Homo sapiens
DVSCITTAAYIRGPAYRAVPVSPAGQSIEVVQLKSVWPPYIAARSQSGPGIIADWESCAPGVAVIEVVADAKRYSQSTGTRKSTPYADIGAVGLRALPLLSWHISLDLICIAEFLLTVS

SEQ ID NO: 948850 - protein, 53 aa, Homo sapiens
LRLFLMDPSLVGRPLGTVQPSERQIEGVRALDHMHLGALGFTVARRSVAEVKA

SEQ ID NO: 948851 - protein, 64 aa, Homo sapiens
QLAALPLPAQEFRLTASSLDVGMDVSPSETPYGNSSPIFRRIFRVKSEPSSPVLFRPRLIFFVF

SEQ ID NO: 948852 - protein, 48 aa, Homo sapiens
FHRQPDTANTEKKGKRFQRRSSIRAYARAVLALVGSVLPDLLTLRLLQ

SEQ ID NO: 948853 - protein, 192 aa, Homo sapiens
MKSSRNDEPIKDKNGESKNLASFEFMTSDISAKEELVWHPVKSSTSLDFLELNYSLDKNADTTMKWQTKAFPIVGEPLQKHHSWDWGSLLLEGCTNSQPVNAAGRYFNSKVPITRTKSTPFELIQQRETKEVDSKENFSYWESQPHDSCFVEMPAQQVMHVSSTELNYSLAYDSNTRIRTASTVTPHDSSAL

SEQ ID NO: 948854 - protein, 97 aa, Homo sapiens
WLAEGCPHAFSTRSWQTRMCPTFHVMKAMQSLKFPRLRELNSLPGGHFYSDAYQIMGIQVSPVITIHLPPVDCACHPYAVIRPDDWTGLEPNRSWRV

SEQ ID NO: 948855 - protein, 159 aa, Homo sapiens
TSFVGLTRLSTSESAKVLPVEDASTPSSLLEQLTEQFNWVSRLANLMHSEDQYYLRVTRWIPTLLIRTFLPVSLDVVVNFKDPCSPFTVTVPVEVSRKNPKFMETVAEKALQEYRKKHREERDVDVAFAPTGASESSSPQDELQPSRESSARHQVTKPE

SEQ ID NO: 948856 - protein, 55 aa, Homo sapiens
YGKHLNVQSPPPQIPKDTLVALELSLRASDDCPGGGSQPQSWQLVEAVWWSQSTT

SEQ ID NO: 948857 - protein, 39 aa, Homo sapiens
AKQDKFLSLCRYELPTDDDTYEEHRRDKARKQQQQPRAG

SEQ ID NO: 948858 - protein, 47 aa, Homo sapiens
SAGLLMSENGEQDADNEVHDRRGRMWGRKSGGGQKKVIVRKRMAIKI

SEQ ID NO: 948859 - protein, 94 aa, Homo sapiens
CDDPDETEMRTTKNAHLPYSPETDTQPHAPWNASCFLVLPTEEFCQPDFWRNWLYEKILVTKFSLLPRISPAEVCGLQVFVMLLAPIPLIGLTS

SEQ ID NO: 948860 - protein, 92 aa, Homo sapiens
TIISLQRCMSAKILQDIIIVSDSLDADEGVPIFCALWYISSVAKVAARYSKPSFCCFSFQKLVPEVGDIIILSTFRSTVLRLEHDSTLRKKC

SEQ ID NO: 948861 - protein, 82 aa, Homo sapiens
SSPKRHASILAVVEYSTSKLICSWERRRLSLPWMVSPLASGVKEDDGFEVGILIVIDLQRLEGQHPALQPKDLTLQLEDFSL

SEQ ID NO: 948862 - protein, 113 aa, Homo sapiens
SPVIQLQREQASNDAHDGDGGLGILAPISGLSGLAANPHAAHGSVYLLLRVQQGSHHSLPHFLEVFLSLCMACVSYDAPVSVWSGRSPIPARYVLVIGGDPTQSLTLHGIAML

SEQ ID NO: 948863 - protein, 63 aa, Homo sapiens
GLNRVTARLPDSGHNFPILVCVLEGLDQTQSLIHGSVHRQIITVSEKDTFHDDKEALQHAYCF

SEQ ID NO: 948864 - protein, 43 aa, Homo sapiens
TSCKSWSSENPMHKRQTFKPHWRLISQEMNFGQKLSISHSLKI

SEQ ID NO: 948865 - protein, 78 aa, Homo sapiens
MSLSVQETSSASYKLILCVSLSRFQCDSAHRCSVSDLCSLYRLSSAVTRIIPFTSISKVTINLRRPHEEQEEFQSDQM

SEQ ID NO: 948866 - protein, 39 aa, Homo sapiens
PPDYDVTSPSFLLPHQNQHLQFQVMSIRLFLFFFFYYFL

SEQ ID NO: 948867 - protein, 39 aa, Homo sapiens
MFLLLWPPRCNKLAVYLDLCLIFLLLRFSLRIRFFLHFA

SEQ ID NO: 948868 - protein, 55 aa, Homo sapiens
MRRRTYRAHGRINPYISSPCHIEMILTEKEQIVPKPEEEVAQNKIISHKKLKIQK

SEQ ID NO: 948869 - protein, 108 aa, Homo sapiens
AQLKRKKKDRQGPSKPLACCIVEATGAETWNARRWGCWYKLCHCMLLSKACLNASRTSSPPDRRSPLIPTLLIHKMPMLVLYPGPVTFCTISVFIHGTMYYHHVTTYN

SEQ ID NO: 948870 - protein, 49 aa, Homo sapiens
PQQIGVRKYVSCHFVNKTSRGESVSTACNHPLQLHVTAHFLPHRTMYNH

SEQ ID NO: 948871 - protein, 69 aa, Homo sapiens
FREQCDVSALPYIDHGVDEHSNSKSLVNIIPYIQLGYYIDHQALCHIKTTKPLVINSRHHLKTPHFIAC

SEQ ID NO: 948872 - protein, 41 aa, Homo sapiens
RGPPGLDVTFEIDVNGILRVTAEDRVHVTNNKITITNDQNR

SEQ ID NO: 948873 - protein, 55 aa, Homo sapiens
DTITCIAVQNVPRMTWSVDADIFFHEIDTESDPQRYGRLAVSIAQKDDKSSRAIS

SEQ ID NO: 948874 - protein, 50 aa, Homo sapiens
DRRITKKSIASSSATIIASITLLNLYFYLRLIYSSLQSHILSRYHNKRKR

SEQ ID NO: 948875 - protein, 32 aa, Homo sapiens
VISEELNSSMGTINTTLGNMAYRKHEKGVKFL

SEQ ID NO: 948876 - protein, 76 aa, Homo sapiens
GIYKACYLGIPLLGQDLLLLNRDAGYSVYSLTLSTIRLPFTSVLPFIIADLQQSNSYCLHETGSNNPLGITSHSDK

SEQ ID NO: 948877 - protein, 71 aa, Homo sapiens
IRLQRQGDQVKKLFLSNDLVMNRLISSFATCPLVSEEDKHAIIVEPEKRGKYVVCFDPLDGSSNIDRLGVV

SEQ ID NO: 948878 - protein, 30 aa, Homo sapiens
MLRRNTDKKGKPEIACENPHSTVVPMKQPT

SEQ ID NO: 948879 - protein, 33 aa, Homo sapiens
YLLDEILDFGYPQNSETGALKTFIEAVGDAVVG

SEQ ID NO: 948880 - protein, 75 aa, Homo sapiens
SHGRQHTNEIHDDVQVSPERIYIDGRPFLWIRKDDVNLWYTVLVSLDETDTSALLDKKASRTLKASCSNGVVSTH

SEQ ID NO: 948881 - protein, 55 aa, Homo sapiens
DWRDVGLEEENGQMMSCTCLGNGTGDFKCDPHEATCHDDGKTYHVGEQWTKDYLG

SEQ ID NO: 948882 - protein, 79 aa, Homo sapiens
GDLRTPSVSGWGCQVVRIRLLYEIPSELEDDERVNDYYARNAWVIQIKINTKHPKYRDDSSVVTKQRYHLSDCLCRNRG

SEQ ID NO: 948883 - protein, 77 aa, Homo sapiens
TKGNGMKARAPESSVRHDAVHSAARVEAGSGDELDTANDDLGKGVDQALEGFRWGPHVLMDPAPGRGSAHTASCTQT

SEQ ID NO: 948884 - protein, 33 aa, Homo sapiens
TASQRAYDTLIHRDHVLKATLGNWVDPIDSTYQ

SEQ ID NO: 948885 - protein, 31 aa, Homo sapiens
MSKYYVKRGFGYSPFLSITDGNMPGQAASAM

SEQ ID NO: 948886 - protein, 84 aa, Homo sapiens
PLDVAEAEMEVGMDKPCLSLALHGSVLRLFLQFDMRPGPSVNHVGPHLLPVCCSECGALRVQSMLWSPFSSVGHQMLSGPRALT

SEQ ID NO: 948887 - protein, 45 aa, Homo sapiens
SHDSPYAPGNDGRQLDGQDPAQPPGQGWLIQCGAHRPEEGGCRAL

SEQ ID NO: 948888 - protein, 50 aa, Homo sapiens
AVVMSAPRIRRQKEIPSTVLREMDPLRAQQLAAELEVEMMAVFSNRLTSA

SEQ ID NO: 948889 - protein, 54 aa, Homo sapiens
YGGADGDVCSRDEEAEGDPSAVLREMDPLSAQQLAADVGVGDDGRYVQQIDHCL

SEQ ID NO: 948890 - protein, 43 aa, Homo sapiens
MYIRCASTLSGYNLKTPSERQFTTLPPYSSTLSMMIISMTPAE

SEQ ID NO: 948891 - protein, 67 aa, Homo sapiens
PARCPVYLDPRRCRALCEWLRALMLASLGAGGPRFLRGDWRRDSLDPCVHFLIVFGLEEVLIAIIES

SEQ ID NO: 948892 - protein, 315 aa, Homo sapiens
ELRAYQVFRDSVGSAAYTACQAPRAFQDPQVLHIHGDPGFPGPPAAKTVTHSTQRHHPSTALAARPPTTPNPAPPRPPGKRGPPGTPGLQGVPRHHPPFPPPPAPTLTDRPPPPSFALPPSPPPPPPPPYTPSASPANPAPPAPTHLPPPPAAALLLPLAAGAPGAGLGVFWSPRQKKGPGGEPRLHGGTLDPPGRWATEAPRDPRETQDSLVPPGLWEPRDCRNPQNIAVQPGTVGPRGGEAPWGTGGDGAQGPPENQVFVGLHGKLPPPPPPRRSCPQLPGEMKDHRHQGQIGQEGAQAVQGSPACRVSRPHV

SEQ ID NO: 948893 - protein, 35 aa, Homo sapiens
RVAAWSSIGQPTNEDFETPRQYHEQEETPDMMAAR

SEQ ID NO: 948894 - protein, 35 aa, Homo sapiens
DDLDTIDVSNLNRQFCFTKKHVGRSKAQVATGTVY

SEQ ID NO: 948895 - protein, 114 aa, Homo sapiens
VTRCSAREPWDVTQVDVTSRVAAWSAWAADQGGLIEKPRQYHEQEETPEMMAARIDRDVQILNHILDDIEFIITKLQKAAEAFSELSNRKRNTKGTRNGPGAGVFNAAGTTSTS

SEQ ID NO: 948896 - protein, 67 aa, Homo sapiens
LNKAVIGSFSSGRVSTTRSYKRPKALRIDTRFDQGKETFALKVELQIHVVDLTQLQTTELNLGARVD

SEQ ID NO: 948897 - protein, 51 aa, Homo sapiens
RSAGDNSGIPRSAPVIDQVERLAKALPRPAVHVIALIKMQVTAVHRQPLST

SEQ ID NO: 948898 - protein, 41 aa, Homo sapiens
HLGEMTELTPLLSDEELEKDFDVEFMCKETYDMVCKENRRR

SEQ ID NO: 948899 - protein, 86 aa, Homo sapiens
IRDRVDRCTSGSATPSSLTRLRTVVKFCLMEYSRISASLAGVIAKTQYRLLAEVGRYNVEIVEVLANQRTGLFTGIRVSKAQLDVD

SEQ ID NO: 948900 - protein, 124 aa, Homo sapiens
IPGVYNDICLVRLTLLSQALLSMVLIGLPLSQALLPMVMNNLPLSQALLPMVLNDLPLSQALLSMVLIGLPLSQALSPMVLDNLPLSQALLPRLLMDLLIISISGLFTVSSLFNKMLNFNFWVD

SEQ ID NO: 948901 - protein, 85 aa, Homo sapiens
MTTAVAKPRAIEASPGLFQNLKQTTKNAHRWGGERLEDGAPPEVRQPAAPAAGADKIYVTWGRKQKPEKPTPPLTATRHLRPLGT

SEQ ID NO: 948902 - protein, 43 aa, Homo sapiens
PLDQRMRGLLSPVMHAAHCSCWLLILLGVISIHMGFSSFSLQD

SEQ ID NO: 948903 - protein, 61 aa, Homo sapiens
YRGSRQPDPPDTMSLLWPRCTPVNNLKFARIVSPGNAGIREKLAWAKEKYSIGEPTVPSTL

SEQ ID NO: 948904 - protein, 71 aa, Homo sapiens
LQRTPMTAAVSWRNLYKRSNEFDYPSVVQLAHKLAENNIQPIFAETSRMVKTYEKLTEIIPKSAVGVSGCL

SEQ ID NO: 948905 - protein, 53 aa, Homo sapiens
HLRQLVHRGATNSTTHRWAAAHNVCENNQPIFAVTSSMVKTYEKLTDIIPKSA

SEQ ID NO: 948906 - protein, 72 aa, Homo sapiens
PQPDPNEGAVPEDNLYHDGALNSTIASGGQSAAQCVVENNHQPIFAEISRMVKTYEKPPEIIPKSAVGFRLS

SEQ ID NO: 948907 - protein, 48 aa, Homo sapiens
PLLSCLAFCLQLLDHPWDPGVHRIPAFQGVPLCQLHHPYQVRLGLRLS

SEQ ID NO: 948908 - protein, 60 aa, Homo sapiens
RSGPPDSGSERRLMVLLTSVVRERGLERRTALILHRLRLADGEVDRHAAQRGRNRVFLGF

SEQ ID NO: 948909 - protein, 57 aa, Homo sapiens
PQTAGPPIQTRVFSGWERCSLTRRAALGRTQLRNSYSTSGGPEKRPRGRCQWGVGLS

SEQ ID NO: 948910 - protein, 35 aa, Homo sapiens
GTCYQSPSLSRWLLAAVAHAQSLVEAQPNVDKLVE

SEQ ID NO: 948911 - protein, 49 aa, Homo sapiens
MTHQEEDQMLKLDKENAIDRAEQAERDKKQAEDLLQQLEEEQQALQKKL

SEQ ID NO: 948912 - protein, 52 aa, Homo sapiens
DSEDPSDSGPPRTVGDRTACDLKREALKKKFTRLHDAELPPMKTAMTGAGCL

SEQ ID NO: 948913 - protein, 52 aa, Homo sapiens
VKTVVRANAAHRHPLDATAMHMRLPPSCSVGLLNASSESQGCLGPSLVGGPA

SEQ ID NO: 948914 - protein, 57 aa, Homo sapiens
MENGNMECVPGPSQKPHWQLPGKFQAKGSSSLGDGLLSCTDLASREKERLEQKQREA

SEQ ID NO: 948915 - protein, 30 aa, Homo sapiens
MTQPGPVRAQTVRSHKKVLKVGVRLSKGYP

SEQ ID NO: 948916 - protein, 81 aa, Homo sapiens
MPFLSNPTVSQVISRFEIRNVSTHIVVCKVVSVVIKAALGGVLPSASIAIGERLFAYLVSAGVLGTSRYGSRGSPPVLRVP

SEQ ID NO: 948917 - protein, 40 aa, Homo sapiens
MLMMTEGAGACRSCGSAAVSRTPCTESGLVLCTRQLIHRP

SEQ ID NO: 948918 - protein, 39 aa, Homo sapiens
TDCGGRVVADGCTLAGVRLLSRLDTLFTGQAWGGGGPAV

SEQ ID NO: 948919 - protein, 49 aa, Homo sapiens
MRSHGSSGPAAPLPLPPSLGSPPIRRLPAGLRTRRNCWVLWPSSLTLST

SEQ ID NO: 948920 - protein, 82 aa, Homo sapiens
DHSVAPCDMVHDGCGPRCEYISLIYTKLIQAGMDDYVKALRLPLKPFETLLSLNQGGQTFIVGDQISFADYHLLDFLATPVI

SEQ ID NO: 948921 - protein, 106 aa, Homo sapiens
MDLSDRPSSSSFFLHGIGDTRSPCSIDELICQATQQVVLNVPEDSLRSACARQPDGLYTLAQGGQIHSLSSHSPLGRPNGVWSPSRGPLVDVCRSPRNPAEGSIAC

SEQ ID NO: 948922 - protein, 105 aa, Homo sapiens
QVHRLRSGESNFQEMVMPPISESLKRNKKVPSLLVDEQVVVLLLIHKTKDGPIIPCGGLWCFFNTSITPFKLCQKVSVPARKVLPVEPGTGHGQATVVLQVGLIL

SEQ ID NO: 948923 - protein, 69 aa, Homo sapiens
YLSHSKLNSTKGDGCLYSKVKGSPEGEHQGCMVGTAKGIKVKEAAGLLVGFGPGFISRAGIRSSDRPAL

SEQ ID NO: 948924 - protein, 70 aa, Homo sapiens
STGSPMPVCLLADPGLSSDNYRPPFRITDVVVVVAKHGTCFGDEKQHTARVRPLSAGLRRACLHCQLPMR

SEQ ID NO: 948925 - protein, 32 aa, Homo sapiens
MSPSCLELNGATRWPSQRRPGLGVSVDQLPAL

SEQ ID NO: 948926 - protein, 85 aa, Homo sapiens
MHNGCPPGDDGTAPQLLCQGAGVLDLLVAVCLNFMLDPSVSFFLDGSLEGGITSFVLYKGAQTGAPEDKHHDPPILLSLGLHSVA

SEQ ID NO: 948927 - protein, 60 aa, Homo sapiens
MTLIGGLPFVFGLHTRQAELGPIRYSLRPGKALMDHTISLSSGTHLTLPTVVLNLGESAS

SEQ ID NO: 948928 - protein, 33 aa, Homo sapiens
MERHPPLLEAWGQRDLGGRLDTSAHSLRCPEIP

SEQ ID NO: 948929 - protein, 48 aa, Homo sapiens
WLPNEVVSPRGPTPGCLIVIVPDTAGVGPVAGHARASSRGDTGFVERG

SEQ ID NO: 948930 - protein, 31 aa, Homo sapiens
MYQEPRPSRARCYTMSEVIEHITQSSGHHRG

SEQ ID NO: 948931 - protein, 143 aa, Homo sapiens
RPEEVDVPNVCLKVQKDQTNILIYICCPDSLYLGGQGWPSPGGRSPPGLLTPFYLPLTQPGALEGPKLPSQPSCLPRVARLPVPSCTGQLGPTLSVEAPGVSSTGPARWPLLGDGGAKSASLPVYQEKPLSPMGRTEAFGPQP

SEQ ID NO: 948932 - protein, 44 aa, Homo sapiens
QPDRKRQKNVVLTNPQISLLNTGVQEYETSKVPHTDAALICCIC

SEQ ID NO: 948933 - protein, 74 aa, Homo sapiens
VILISNRGGWCFCMEVAEDLDVIAVTGLSGSVPVYAFTALDALADGGVKIGTSNGRHGMSWPRWPMAHPGWLAN

SEQ ID NO: 948934 - protein, 114 aa, Homo sapiens
AHSNDNLRDSQQEPARSEVSEGPVEPSNWDLNVQSMETQIDKAQAFTQPVPLANKPVPAPSTFPSKTGGMEGGTAVATSSLTADNDFNPVGIGLPHSENNQDKGLPRPDNRDNR

SEQ ID NO: 948935 - protein, 88 aa, Homo sapiens
MVTSSFRSTFSPVMANRCVKPLLESAAALEDGVKREVEQGPELGKLVLERCCRQQQVTGCHIMRFEHLRKLALVVLHAVTFVHNHVIP

SEQ ID NO: 948936 - protein, 65 aa, Homo sapiens
MSSAGPQKPPDKSFVEKVMQEQVNHPKFQKPKQLKDNADFWIIHYAGKVTSTHGEVLARSSQERW

SEQ ID NO: 948937 - protein, 34 aa, Homo sapiens
CITFATKLLSVALGNHHSSSSMARMPGGAAGFSI

SEQ ID NO: 948938 - protein, 125 aa, Homo sapiens
NAKEAPERLRGLISAAVITSQNESHRFSLTGAETESSRIGVQIRIAPLAELPSWPNAEIIGLLFCLPQLVASLNGCKCLLSIATSDEPVVVPLDSEVDGALLISPKVENLCVSSDRVMRPGIFPM

SEQ ID NO: 948939 - protein, 74 aa, Homo sapiens
MLSPSRAETVISENLAEWEQTAPPQQEHAHGEAFPEHEQGPPKAVGNVREAAVDEEASASGARWGGRKVQGMTR

SEQ ID NO: 948940 - protein, 57 aa, Homo sapiens
APMYVMGVNHEKYDDRLKINQQMPPAPPTAEHPWNKVIHDNFGIVEGLMTTRTPSSF

SEQ ID NO: 948941 - protein, 63 aa, Homo sapiens
MRFPGRLNQSTFHLLHDRGVYYVSSALKSCGANQSFMAIVLELIPLKIFEKGPYLAYRTLLFW

SEQ ID NO: 948942 - protein, 46 aa, Homo sapiens
MRFCPWLVEMRYNVGCHKGVGLFHSDRSKLQKGGHVIQNRRRAGTS

SEQ ID NO: 948943 - protein, 92 aa, Homo sapiens
VSSLIQESAAKCFFGDRCRFCTTGRYLETKPADLGPRCVLFETFCRCPYAVTCRFVWAHLRPEEQNLVQEELAARGTQAPPSIRNCLGQRPL

SEQ ID NO: 948944 - protein, 42 aa, Homo sapiens
DIEILCDAIDQSNAHFAELGYTACPDTPAAPVNHSQWIANVV

SEQ ID NO: 948945 - protein, 40 aa, Homo sapiens
WADDQRKIRLSGTSLTRVSYSSAAQNPTRESQNFTIELRA

SEQ ID NO: 948946 - protein, 34 aa, Homo sapiens
HDNQSQDKAKRHVAHPYSRTPRDPAPTRVEPELH

SEQ ID NO: 948947 - protein, 92 aa, Homo sapiens
SIFIYQSSSSSSSIISFIHPHRFIVFLIFSFFVLLLLHPHHSTSASESGASWSSRSQLLSVVKLGQELEDTLSVVIQVGNLTVKEVQAFQTF

SEQ ID NO: 948948 - protein, 31 aa, Homo sapiens
MHLPFQDGIHNGPLVSGSTNCTQALDDEDCA

SEQ ID NO: 948949 - protein, 40 aa, Homo sapiens
RSDSEAMMEPPITPSTCALWVLMILIFMCAGRQVGDLLLH

SEQ ID NO: 948950 - protein, 48 aa, Homo sapiens
THPTMSAYTPLHVSLHSLHTPPCQPTLPSMSAYTPLHVSLHTPKCRRR

SEQ ID NO: 948951 - protein, 83 aa, Homo sapiens
MASVRAVPNPEINHYQTAPPSGYFMAANRQTQNRAAYYPPSPIGQVWPSPRWTAQGARPHPFHCVPGAFRPAAPRSPSAFEGI

SEQ ID NO: 948952 - protein, 175 aa, Homo sapiens
CNLGRAGQRGCDMLWEEEKGLVESGRWEIGLLAWREQRQRYYPRLSAGNDLEAGSIADELVQGIDNLGEFGPEVPVPHPAVQHELVQCCGTVHGWWQPVILLHGIDELGRRQGNPEGATAMIPSQHPPSQPLWRSLTHILVAHVPVGSLSIAHELPHDNSVAPDITSRSGLPIGY

SEQ ID NO: 948953 - protein, 70 aa, Homo sapiens
DEEEKEAQLGMKSVDKKVESAKESIKFGRTDVAESEKEGLLTKSAHETVKPSGFIFFIIKQAKNSFGSRL

SEQ ID NO: 948954 - protein, 66 aa, Homo sapiens
YRCLTDSDSGKSTPSNNGKKGLKHWTSVRTWEKDFDLDMTEEEVQMALSKVDASGELEDVEWEDWE

SEQ ID NO: 948955 - protein, 54 aa, Homo sapiens
GPPHSLPGIQAGITHIVREVDRPGSKANKNEVVEAVTIVETPPNVVMGIVGYVE

SEQ ID NO: 948956 - protein, 94 aa, Homo sapiens
VAPLIPYPLITKEGINAIEMEEDQRDLISREISKFKTIIVRYTLGEMKEKMLRAAREKGRVTYKGKTIRLTAELSAETLQARREWVPIFNILKE

SEQ ID NO: 948957 - protein, 74 aa, Homo sapiens
SIIPVSSVSVTQDTTPSSIWGPGTSPCYRVVGGPAQTEVSRVGKKCTIVHPTIQLELAYMRRYKRVLVDKVERW

SEQ ID NO: 948958 - protein, 138 aa, Homo sapiens
MSAGPGVLESQLCLFQQLLLFAQSHQCVHCREKPHTTFLAAHPTSRSSVDPECPLCTSSGTLEAGDALPDGLGHRTVSAAGALTITRNGLPAALPSGSSTRRMLSHLPTASAPKAEMKQGPLLGVLSPTPKHENKGKS

SEQ ID NO: 948959 - protein, 45 aa, Homo sapiens
MDISGNKLCLSEFVVTHCTAPPESMWFYICKVIGLRNSYTVCSKH

SEQ ID NO: 948960 - protein, 95 aa, Homo sapiens
ILDLGNNIHQWCGSNSNRYERLKATTVSKGIRDNERSGRARVHVSDEGTEPEAMLQALGPNPDLPVGTEDTAKEDAANCMLDKLYKVYQMVQRPY

SEQ ID NO: 948961 - protein, 46 aa, Homo sapiens
MALKQPVLESLEEYQDVEQVRAYLVAFQASEVVFLVQRASFHPLAS

SEQ ID NO: 948962 - protein, 81 aa, Homo sapiens
VKLVQMLLGQHQPVSLSKPAAQEKVTLPMYTVSSCCSSLDLRKADEWKVAKSVGTVSPGLLKYCLLEDLILELLDGVTQGL

SEQ ID NO: 948963 - protein, 40 aa, Homo sapiens
SSQNWKWKQGFKHSSHAVFEITDSPVCIIDGGGFSMWVCV

SEQ ID NO: 948964 - protein, 120 aa, Homo sapiens
HEGEQKQTLQGYWDLESPLPAPHGNTGQPHTPSPPGLLWIRKRARLPGPETGTRNRGYFVTQKTNLCRRSVSGSRLRMRGPPYPGGGVVRPRHVTGSALRSHVTLVRNLCCLRGAPFRLT

SEQ ID NO: 948965 - protein, 85 aa, Homo sapiens
IWKPTSCPTRGYRGSTTLPSRPAYCGIRKRARLPGPETRTRNPGYFVYHTKNHVVGQCHAPRGHAGRPSGGWLAASRDGLSVPVT

SEQ ID NO: 948966 - protein, 85 aa, Homo sapiens
ASPTAGAGAPRGTPGNVRNPESTLGHCVLPAGRAVIYKDSGGLAGVGAVRSRRPGALEFLQKNFAYQATYFSSHQFDQRQDEKYA

SEQ ID NO: 948967 - protein, 32 aa, Homo sapiens
ISSTHASDFLVRNKSNTRTVQAAASTSWVPCK

SEQ ID NO: 948968 - protein, 124 aa, Homo sapiens
LTSTLLFPPTLAGTCARPKTHTQTQAHKQMHSLVHPAGASMTAGHCWENPFHLRDLPRARAGWSLLDHATAGGVLAGFTFPWDGHGSQNLALTIFSFNSQEDEGYEDEGAKEENSQNDGGDEEH

SEQ ID NO: 948969 - protein, 192 aa, Homo sapiens
RDPLESKDYKLILCKLATEEPVHEEHEDDDCQVSNPSTGDLLDLSSLSGMGVIQAAYSEKELVYMSICGENENCPPGVGACLDRPGFSVGKANKRLRYVDQVLQLVYKDGSPCPSKSGLSYKSVISFVCRPEAGPTNRPMLISLDKQTCTLFFSWHTPLACEQATECSVRNGSSIVDLSPLIHRTGGYEAYD

SEQ ID NO: 948970 - protein, 147 aa, Homo sapiens
DPIGAGLCMIMGVDYSSYWLNIVCRCTELKFEWRGWQEKVGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKDGKR

SEQ ID NO: 948971 - protein, 37 aa, Homo sapiens
LEIHRGLLKPKIFMKFLIPLLKSMKMKDNESMQDGKR

SEQ ID NO: 948972 - protein, 183 aa, Homo sapiens
YRQALVHVLDNSQTSISRWNALVYVYQRKMEDVQLRATSPESTSRSSSKTGRDDSSKMEKLSIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYDINATPKGWSCHWDR

SEQ ID NO: 948973 - protein, 67 aa, Homo sapiens
KSDRKLYDAGLQLSPSEHTRSLGAGVDRGGELSNQKHPFHVEYVKNKSVVLHQLTYGSHFITEVGFP

SEQ ID NO: 948974 - protein, 96 aa, Homo sapiens
DTLALEEENQMECFCVDDDENHIKKENILSSSDTLPMMVATQQESNIECAAYNPEPYLNNESQPDSFSTAHAFLWVRCVYLVLVQSFTENQRSLSV

SEQ ID NO: 948975 - protein, 41 aa, Homo sapiens
RLPTDDGGCTGIKGVRSCQLVQVRDSSRVVVLEFKLSSRNA

SEQ ID NO: 948976 - protein, 68 aa, Homo sapiens
SESGALYNEHKSCAAKSVQNTSIRVAGFGNATFDHEHHATIVGDPVTITRLRCSLSCGWAQPIAVWSI

SEQ ID NO: 948977 - protein, 35 aa, Homo sapiens
MQKEITASGAQHHEDQGSSHPQKRKYSVVDRFAPL

SEQ ID NO: 948978 - protein, 110 aa, Homo sapiens
MEDTGAILSWHSWPGHHTCFSGIRQERYARSIIIGGKHINTLIFALKLIIYIEYFLLILDCLTTKLCYIEYFKSMFHHLSIIFVSFSKLFKWMSLCKRHTVKTYRHTFLS

SEQ ID NO: 948979 - protein, 116 aa, Homo sapiens
MWGSTWKPIMRAGPRHVCSHRATHWAMYLTPIAIWDELLFSHHVFKFISIELGEAPLLGGVDLLAARKLELGPAQGLNHMLLVLQLGADGHDNLANVNPGHSALGLSKGTSHACLE

SEQ ID NO: 948980 - protein, 46 aa, Homo sapiens
MRTASITCSLFCSLVRTGHDNLGQIVNPGPHVALGLSIGTSHACME

SEQ ID NO: 948981 - protein, 47 aa, Homo sapiens
SLFRIRINVTIMTRQPPDRQHGGNGPWNNNNENLCFIFMPGEDQGVA

SEQ ID NO: 948982 - protein, 40 aa, Homo sapiens
VLTRTPLLQLGAYGHDNLANVNPGHKCPGAFQRHLACLYG

SEQ ID NO: 948983 - protein, 54 aa, Homo sapiens
PTGNRGAFVISPMLLCQCHIEQVIMSLPRSSCRTRSMSLMPMRLAEFKFPGRQK

SEQ ID NO: 948984 - protein, 47 aa, Homo sapiens
YAAADLFSARHFRPHPSWPQFSICKADGSLVDSKGFDEYVKELGEAP

SEQ ID NO: 948985 - protein, 42 aa, Homo sapiens
KRADSEARIAPPIHIRDTCALWVLCIFIFIVLGARSVISFCI

SEQ ID NO: 948986 - protein, 41 aa, Homo sapiens
MLKEEHRWMSVLAWRPTTLLPDVHRDPHPQRDLRAPPCRQV

SEQ ID NO: 948987 - protein, 43 aa, Homo sapiens
SQRSHHLMSSHLPSDTSATHSSLKSLGEAGAVSQRMSAANCVF

SEQ ID NO: 948988 - protein, 51 aa, Homo sapiens
VENVLARTQRQMDLLFPEDQAHQNPPSSEWRKTDQNERGLSVTDNLKVIIG

SEQ ID NO: 948989 - protein, 121 aa, Homo sapiens
VEYCLLPLCISRILSNISLHSMTPSDMLSIVARDSEIPNTSIAHVLQVIQRKDVRATTENTWSRSHPMLPIVGAWLRTHCTDPVAVLVCAALPAERVRGLRTRTDPGVGKQGVAHLIGQVG

SEQ ID NO: 948990 - protein, 41 aa, Homo sapiens
LRWPDVWWFQDGGIKNKSPATPQATPDGFIATAADKEERLI

SEQ ID NO: 948991 - protein, 76 aa, Homo sapiens
AEDKVGSRTENAPKAGLVVRDSLKMADPDNMDKSSEMKSKRVQTNFLFKVLLRKKAGPGKLGFFFPPLLQILMVWV

SEQ ID NO: 948992 - protein, 55 aa, Homo sapiens
APGSARMETAGSASERLPSVEEAEVPKPLPQPPKIGDEDIQSILRTRQERRQRRQ

SEQ ID NO: 948993 - protein, 42 aa, Homo sapiens
EACLTVETESSSLGYLSELFFLHITAATTGSSDHSSKDNKAA

SEQ ID NO: 948994 - protein, 175 aa, Homo sapiens
HRHPGPKLGRVLRPQSSVQGTVSGSVVQSSGERTRIRPSSPVPGCVLGQQSQVQSYSLTGDSSAATYSLFRYLPKARRQSQGQGTGVQLKVFHQDNFKSSDCFIPIASSATNTAATAPSQGCASAGTTSPGSLSDPVTGCGSDTGSAKWCAPANQTPVTYPNSAKQCCADSPDSE

SEQ ID NO: 948995 - protein, 106 aa, Homo sapiens
MPSDQNSLKVPYGTPEFVAPEVIQYEPIGYATDMWSIGVQCYILISGLSPFMGPNDNETLANGTSATCDFDDEAFDAISEDAQDFISNLLKTDMKTRLHCSSDFSI

SEQ ID NO: 948996 - protein, 48 aa, Homo sapiens
ESLNTHGLAMNHIMNGIITRLQQFRVIFQLFTQNGDQSSPSAHHTCMR

SEQ ID NO: 948997 - protein, 105 aa, Homo sapiens
TRYSTLSILSVSGPGEVSRGWRMCKTGSKRFFTRTRLSYFYKSCCGLHTYLTLCTTWLLYGHCLLGTCRYTLVANGYTTPQRLLKHIYGCLDTQHNPPPKRTSTH

SEQ ID NO: 948998 - protein, 43 aa, Homo sapiens
MAYPWPESTDTPKPVALGQIYIFHLRGDFLCQSCMKEVVMVDR

SEQ ID NO: 948999 - protein, 84 aa, Homo sapiens
MVSRRKKSEVGRERSEGWLGHARSLKMADPNNMYKKYKMWIKRYKQMSFLSTFKKKSRAVEVWVLFSSPVANSHGLGWVVEMCE

SEQ ID NO: 949000 - protein, 115 aa, Homo sapiens
EEENMERKLNCCVTIVTEDENALSELAEENRLLRWKRDWMSWNERLAEAKEENVGFIRTLDQTLQELKLYMSKDQKSLVPTETLELRGSFSSLVRSSFRYCHLRFAGNVKQIMNT

SEQ ID NO: 949001 - protein, 34 aa, Homo sapiens
GDYNKCRELVRRPLKWGENTEKTIDRPKHMLEAT

SEQ ID NO: 949002 - protein, 64 aa, Homo sapiens
LDCCASSTLTALTNSVLKNNLCPSGSHLISNLFKEDCQQKIDDLFSGKLYHIGIAAIVIAVIMI

SEQ ID NO: 949003 - protein, 72 aa, Homo sapiens
NGKTPVIHKSREHHTNLTKAQEPYRSLKQVPCTFIIKLYRIKLYMSSLQKSQLYKILYTHLKNSQHSHQYIT

SEQ ID NO: 949004 - protein, 52 aa, Homo sapiens
NLESSGQPVPRDTGILYMSAASYKYMPDVSEKLRDPRIYYINSAASFFAFIR

SEQ ID NO: 949005 - protein, 33 aa, Homo sapiens
PVQRPLHTKEDLEAVRRSCGGVDEPVTDLKSYR

SEQ ID NO: 949006 - protein, 42 aa, Homo sapiens
RDSVDRVVGSLSAQARQGKKLSEIMEKGQLVPLETVLDMLRD

SEQ ID NO: 949007 - protein, 69 aa, Homo sapiens
GGDQVRLTPEYQSWVSPPTTTTHTTTTIHQSALQCETSVAVRVTAGVLSSRLILTHGLRRSKLDLLLVR

SEQ ID NO: 949008 - protein, 37 aa, Homo sapiens
TAAAVAPNLRGLEIVALHVWVGLGNGCLNPGSWPEPG

SEQ ID NO: 949009 - protein, 83 aa, Homo sapiens
MAPLVLDLLLAPALDNHVTLLQVEHEVPHHVHNLVFSSFVHQIRLRQDSDGPVSLGVQLLGHAESLCGGDVHITGDHHQADLS

SEQ ID NO: 949010 - protein, 64 aa, Homo sapiens
VTERHSQDAEGCAEVMYPRDSAHLQVFLDAQWPDGSGSSSFLMCTVSPFQEAQRGVVGAVGAQG

SEQ ID NO: 949011 - protein, 64 aa, Homo sapiens
MTDAPSCLRQTDLKSLIAYAAIGHMALVVTGMLIQSPVRLHRRRQFSVIRPGAYILITMLPQVE

SEQ ID NO: 949012 - protein, 77 aa, Homo sapiens
CYPFFVVSLCGIIMSVLICLRQTDLKSLIAYAAIGHMALASNRHADPEPLEASPAQALSVYRPGVYILIHYCASEES

SEQ ID NO: 949013 - protein, 71 aa, Homo sapiens
IPVRDHYEQAPSAYDKQDLKSLIAYAAIGHIALVVTGILIRRPPWSFTGAVNSLYIGQGLTSSFTIVPQVE

SEQ ID NO: 949014 - protein, 70 aa, Homo sapiens
IPMRDNYDVLPSAYDKQDLKSLIAYSASGHMALVVTGILIQEPREASPAQSFSSFGQGSYILITILPQVE

SEQ ID NO: 949015 - protein, 96 aa, Homo sapiens
EEDVRQSLVAVIGGISCKERNDDLNEAGVGEGHDRAKWAYAVGQVNSFHSHVSKLTIVEIIHARISMSASKEEASMSDSCVRHGQHRGEGALPVVI

SEQ ID NO: 949016 - protein, 45 aa, Homo sapiens
MAVCGTLLSGWAGSSPTMTGLFSGESNLVPYRNPRRILGSFVGSP

SEQ ID NO: 949017 - protein, 39 aa, Homo sapiens
MEMSLPEDEGHTEDTDTAKEMEITEVEPPRRLDSSTQDR

SEQ ID NO: 949018 - protein, 49 aa, Homo sapiens
SLIWDKNLKFVMLHKLEQFNGEVHSYDLGMNHLGDMTREEVMSLMSSLR

SEQ ID NO: 949019 - protein, 76 aa, Homo sapiens
MVSSDYQVLTLRALQIVSLPPRPLPQEIASLFINIFFLPFPESSQYNVSEAPFAQVFSNSDMLYFFFFEKGLRYTP

SEQ ID NO: 949020 - protein, 98 aa, Homo sapiens
RNTKLGWYLFVKHLKVPQIGFKVPGAAASHEDPTEGEQPSPDCCAHQTKTHYIFFSDYLRDCICFSYKEHQGPSCFDLFKPHNIPVRQTKFRNTSMPH

SEQ ID NO: 949021 - protein, 42 aa, Homo sapiens
PHALLYDVTLPPQHHFLLLEVAPLLLVYHHQFEVIAHRELLV

SEQ ID NO: 949022 - protein, 45 aa, Homo sapiens
MRNTVGRSKIMLCCNYLKIAQDLEMDGINYFETKNKKGTDLWLGV

SEQ ID NO: 949023 - protein, 77 aa, Homo sapiens
LPTCRGFNMEVGQYIFDNCPFISLLEWHTFTLTSAPDEDCFSIHIRAAGDWTDNLKGLSNNNINQFPGLKWMVPLAQ

SEQ ID NO: 949024 - protein, 88 aa, Homo sapiens
DEIEKEEQAAAEKAVTKMELHGEWTAPAPEFTDTQPEVADWSEGVQVPSVPIQQIPTEDKSSQHATEDWSTAPTAQATEWVGATTEWS

SEQ ID NO: 949025 - protein, 86 aa, Homo sapiens
RATSPSDFTPTTLAVLHDDVVHRFGQHICPPIDGTQSCKTLGRSPKPERRYKIWGFCHTWARDSLYNLEAVDGLQGRPVQVVLNAG

SEQ ID NO: 949026 - protein, 36 aa, Homo sapiens
QSVQHEASSTTLQISPVSSYAESENELMVCPADSRR

SEQ ID NO: 949027 - protein, 84 aa, Homo sapiens
NIFYELKGECSGNVLFGRSGREMSEAADSSSADRQTRMEGAEINKSLLALRECIRSLGQNKAHTPFRDSKLTQVLRDSLHWGEL

SEQ ID NO: 949028 - protein, 93 aa, Homo sapiens
SFVRVLPSSRKITRICLERQSCKSEACDRRNSYRFCSVRLWNGRFEGRNSRNRAGWDGMGWDGMGSEERLGNGATRGCRVCCDIEQDHKKAYL

SEQ ID NO: 949029 - protein, 81 aa, Homo sapiens
MESSSLSNKLELEVTIQRGEQSGSLTTAPVPLFRISPFLFSMYPACSSSRADRKTLGQRQSMKTSAYHPGPRLELLEPLTL

SEQ ID NO: 949030 - protein, 182 aa, Homo sapiens
ATFAEEWHGMAELWDKHVTSEQEWNMYCHYVAGLIGIGLSRLYSASELEDPLVGEDTERATSMGLFLAENKTSSVTIWKTSKEEEMSRASEVGSRYVKKLGDWAKPENIDLAGRALNDLITNALQHIPDVITYLSRLRNQSVSNFCAMPQVMAIAIWAACSNTQQVCKGAVKIRKGQAVTLM

SEQ ID NO: 949031 - protein, 96 aa, Homo sapiens
AAIQFWCRYFQVWTFGAKMVDRVCRAGGLYISSLSYPLTPQNIQHCVVAHEMTISRGDRKAFVRELLHKGLHPLPYYSHSACRSAPGVGSCQSPEQ

SEQ ID NO: 949032 - protein, 77 aa, Homo sapiens
GQNFSEVHLYYGTHPGSSRTSTMLEKPKNAIHTFVQSGSHLAGKVRMANLVMAEGPDTSAVEAIEFIQCNPAHLLDR

SEQ ID NO: 949033 - protein, 80 aa, Homo sapiens
PLAGSTPTGPSWPSPAIPVRDLRCSIQLLPFPLLLSPLADGLRLLGQPVSLGGCVASRTVGLLSISVGRSVMARRVGNQE

SEQ ID NO: 949034 - protein, 34 aa, Homo sapiens
KRDSRTYWWNFTSSSSTDLLYAAARVCQTRTLSV

SEQ ID NO: 949035 - protein, 153 aa, Homo sapiens
RGPIPEESGDEDADDPYKRISICSSDRTIACEDEFSEPEEEGEGGRRTLPTSNKARESQQGMNKRKDQRRRKNPRRGENQGGEARRQRGQGGGQVGLNGPLQLWIPAESLTYLPQTRQILYFLFLCVFILKFIKYKYPPGQKPRPRDQGSCAG

SEQ ID NO: 949036 - protein, 35 aa, Homo sapiens
RCTRYEREEWRGMVAPGKAHPGRGALSSGPWFSCP

SEQ ID NO: 949037 - protein, 104 aa, Homo sapiens
LRTPSLLESGDEDRYTTLTKRISICSSVQTQLRCEARVLRVLNEEGEGGRQELFQRSKKAKTVKDRRMKTERDPEREEQKSPNEEKTKEEKPEAKGVKEEVKLA

SEQ ID NO: 949038 - protein, 75 aa, Homo sapiens
CCFLMYPHAAAIAELACYTVRTPVPVESGDADAYEPDKAQSRVRPRSRALCLPFNRQLTLPPPFLAAHSLQAPQL

SEQ ID NO: 949039 - protein, 46 aa, Homo sapiens
AAQLLLVACSICLASLVGDTNNSHPTQAASKGRLVPLPFSILSMTI

SEQ ID NO: 949040 - protein, 116 aa, Homo sapiens
ILEYETIQCFLDGVLFAHCALKARRNNFEILQIMSLGGRHFLSYEVRLISWESLPPALILIDRPGAGLGHSAARLIKGEACYGVGGPSWETRSRWQGANPPCGVPQSRLERVGLAS

SEQ ID NO: 949041 - protein, 100 aa, Homo sapiens
RFCGRIPEESADDGRTTTLTRRISICSSDKRLACEAESPILEEEGEGGRKNSSNFKKAKRVKTEDEKEKDPEEKKEVTEEEKTKEEKPEAKGVKEEVKLA

SEQ ID NO: 949042 - protein, 72 aa, Homo sapiens
WRIDYSAAVIYELLGVDDINGDRIQDVLFLYKNTKQQQQFQPILCGRRLFLSLHLCSCCVGGQREDALEETC

SEQ ID NO: 949043 - protein, 66 aa, Homo sapiens
RWAESVGLTAAVDSDVPSTTGMTGIPCTRVHDPWYVRTEAPLDAPTGAWGSEGVLVASSPPEGLTG

SEQ ID NO: 949044 - protein, 36 aa, Homo sapiens
MAEREVLVVLYSFHLLPQAPVYSAAIDSDAVPTVTG

SEQ ID NO: 949045 - protein, 40 aa, Homo sapiens
LQNRAMAWNETADLDYDIGAQENPLDIARMILAAVHLMPL

SEQ ID NO: 949046 - protein, 178 aa, Homo sapiens
LLAKMLIVRQSPSLDVSRCQSSSMPKYARAMRPDGPRPPFSTMRPASSQVPRVMSTQHVANTSTQTMGPRPAAASLSNYSCCPHRSTVEICGRSARILSNICNAASHRLQCNRLRSMYKVRKLRLIPCGHLPLLKSKSECWVNGWFLFIQAMHPTLAGKITGMLLEIDNSELLHMLES

SEQ ID NO: 949047 - protein, 95 aa, Homo sapiens
RRPLVSGKGPLSRLLWEISLFGAPHEKNYMGTAPFQKIYEKLRLYGRNTRFTPPTGPQTAIAGATCLHSPLATRGVLPPVEARPLTASRSQSRAR

SEQ ID NO: 949048 - protein, 45 aa, Homo sapiens
MARLVLLDERALTGTSGMWPPCDPSAYGVVPVTWGSPRSSDEDLS

SEQ ID NO: 949049 - protein, 103 aa, Homo sapiens
MTKSIEGRGGNEAGKGKKMLICLLLLSFFKCGQGFYSIFSLIFLVIDKDRTVHCPAEAASTLLLAGLILQWICVSGCCRTTLRAGRPLTQRCSIGLLCGGESR

SEQ ID NO: 949050 - protein, 87 aa, Homo sapiens
DQLYSIRNSPFLPWLQAESLTLSTGFQVIKKKLYSIVNSLLIEELLNFKLRGPTVRSKTETIELLGWRLEAGAEGLIPVVGKPEAAT

SEQ ID NO: 949051 - protein, 216 aa, Homo sapiens
CAGNHLLDERKGAASVAMSSLKTAYESEISSSCLLPVWQPPGPQLCQAPVLRGIYRLVLMWDPKPRHSSIPAILSCLLGDRALQLLPARRADTGACVGQKTHRLLSSGSPRSSLGSDIHGLWHLCVGPLLLRLPILQAACQLPGQEGRPHLPQLPLLPALLHLLDVASKQGFQWGNQLGHCWKVSKADLHVVTGNSHFLAEVGAEEGDLGIALAEV

SEQ ID NO: 949052 - protein, 47 aa, Homo sapiens
GALPNMAVGHGDPQWSRWCPYGNAPGTKCQWQVGVQVASMENRCALD

SEQ ID NO: 949053 - protein, 44 aa, Homo sapiens
ALLIIVLLMSGVLCFFQVLEIVIIPCPILGTASPGILLRASSVC

SEQ ID NO: 949054 - protein, 78 aa, Homo sapiens
LNVAKCKERWRTFSRKPGNAEEKAKKAITDAAYCLAEELKKEQDTSAQLERMKKNMEQTVKDSGSSVLDEAEQLALKG

SEQ ID NO: 949055 - protein, 40 aa, Homo sapiens
KLSSLPFQKIQHSINAQDHQPTPDSCIISMDVGQLKADED

SEQ ID NO: 949056 - protein, 109 aa, Homo sapiens
MVAITPISSWQAVKGTKQKFKVHFCMASSKQPGTAIDHHNMSARPYSNNHPVHTQASAGHLATRESHTTSITQGRQHLAATPCQPCFTLILAQGHSLFTAPITQVTGTI

SEQ ID NO: 949057 - protein, 150 aa, Homo sapiens
AVLYVLIFYDSNTVKQKHLSFTPPEKDGFPSGTPAQNAKGTKAPVVVTEEEDDDKETAPLVIAPRTVHTKSIYTRSVIDPVPAPVGDSHVDGAAKSLDKQKKKTKMTDEEIMEKLRTIVSIGDPKKKYTRYETIGPGASGTVVTATDVAL

SEQ ID NO: 949058 - protein, 71 aa, Homo sapiens
MGKPRPPFKIVILYEAHSMTSPAHATFKTYHVPSDRKPPDSVLSVTISLPLIDPLTSPCSKFRFQPLSAPL

SEQ ID NO: 949059 - protein, 147 aa, Homo sapiens
MRPRTLALIVAAPGLSYEKPDYRLPSGKLLYTDLLSTAVGYVVSTNRVTTRAREALAGPPIGTVHTDLALPSLQLRDKTQPHSKNQALNYHQRGARIADDPTARPIPTPRSQRLAEVGGRPMKPNAASTFKRRKRKSLAATQVTLGA

SEQ ID NO: 949060 - protein, 134 aa, Homo sapiens
MGGPRGRGISRLRVGHTPGVLAEGRDSMQGVEMSRMPSVSSRGQLSLLLFTLLCARVHTGVGGAGLRLRCCCVRGWLVSRWVRVSLTWDRLGSTSRRIFPILIGPLYRLYLRSTVVSCELHHLFNLVECIDKGK

SEQ ID NO: 949061 - protein, 68 aa, Homo sapiens
TRDPTEVELDDQIVYCDLEQISGDEDRATETCLDSVIETSVYTVVVPLVYSGYDQNGGNSLNPGCRLS

SEQ ID NO: 949062 - protein, 126 aa, Homo sapiens
SALKSSRTECLPACLALWCCGRGSGKVFAGISSSSSSSSSCDSCSSSLASIHFLLPCAHGAHCVPHVPGHSAVPESRPTPHGDSDTGAEGHKAPTVRITRAVTVRALGSVKNRSPPWKSSLRMVRT

SEQ ID NO: 949063 - protein, 45 aa, Homo sapiens
MSLFPVTTFRTNVYVVIITFLGLSGYMRSSYTIQFHLTLTGRLNF

SEQ ID NO: 949064 - protein, 35 aa, Homo sapiens
LIFCVRSSVTILLFFFLIRTNIFNLQVCLPTSFSI

SEQ ID NO: 949065 - protein, 203 aa, Homo sapiens
GILNCSESSFLSCCVTLEAQHRASVHFQLHLQVHEPWPPGFWICFFPPFSASCSASSRRCCRSFTVCSRFFFIRSRWALVSCSFFSSSAIMAASVMAFLAFSSALRASWMMSSTSPWIWEMSVSSFFLVLIRLVFWVCRSLNTLTGIQELLFCDFPAPLRLFQSGPQLLDLSLQQVGSALHHSQLFLQVLLGPESIIQVELVP

SEQ ID NO: 949066 - protein, 69 aa, Homo sapiens
MGDEIESEAKKNPFSRKIGTNFLRTGGTKTRKPKKPAEEEARKRLEEEKGAFEEARGAMVNAVEDGPAR

SEQ ID NO: 949067 - protein, 67 aa, Homo sapiens
LSDRWILQKGFLKEEDLKEKEALVGGTSCVHGAGPVMPLVGLCSLTDHAVGTPNRRSFLGARGFRTK

SEQ ID NO: 949068 - protein, 58 aa, Homo sapiens
MRTVGVATVGPQLQQHGGLVVLESRRPRILPILVCPRSIGPIPSWLAGRCQLAYQHCS

SEQ ID NO: 949069 - protein, 34 aa, Homo sapiens
RGLNGLDANGRYTADGQEEQEYLGNPTNNPVSIR

SEQ ID NO: 949070 - protein, 52 aa, Homo sapiens
TGMDVNGRYTAERAQRCWSIQGNPANYPVSIRFGRPRLTSNEELTLGLQHMP

SEQ ID NO: 949071 - protein, 96 aa, Homo sapiens
THHYCVCCTEPRRAHRVSQSGSIHIWELKTEHNEQMIPEPEVSITYAHIDPEASYMAAVNSTVNCYVWNLSGGIGDEVNQLIPKTKIPAHTRWPTH

SEQ ID NO: 949072 - protein, 62 aa, Homo sapiens
RVQELGLSAPMTLLPNITSVHTIEILREKGFDHAPVVYEAGVILRMVTRGKMVSSLDSGKVQ

SEQ ID NO: 949073 - protein, 76 aa, Homo sapiens
IKTEKLEEPAEDSPPVEEVRTVIRFVNNKTDKHVNRPVVSLPSTSEAASAFAFLGLVRLGQDLLFNVAKRLPTAHA

SEQ ID NO: 949074 - protein, 50 aa, Homo sapiens
KQLIHDYTVKCYAKPNEGAIVEVALGRVLQVTMLFDTAGTSVFENWRGER

SEQ ID NO: 949075 - protein, 43 aa, Homo sapiens
LEVPKQKHWVQLLRVPPHPDYSNLIDTYHSVLQLTCWLADHTR

SEQ ID NO: 949076 - protein, 48 aa, Homo sapiens
YSEESLAVVDIWYSRSPCVGGTPVGVSGGFLERVLAPAGLILLLISTL

SEQ ID NO: 949077 - protein, 47 aa, Homo sapiens
LCAAVVEWWGACGYMLGSAMSRPIIHFGSTKDRYYRENMHRYPKQEC

SEQ ID NO: 949078 - protein, 68 aa, Homo sapiens
EIFEHHCSIDLGLGGILNDEQMGLPVYVLQLAVQEHWVSDTRISFGRLRLGRNIRINTRGATWDLTQE

SEQ ID NO: 949079 - protein, 137 aa, Homo sapiens
RFLSEGGEVSNISSDGHKCVGVYNFCPTPFQVCEQLSQQLLQVLDPVRGWHRTLPGGPGACTISFRMRQRNLLLPTDCSSLKAYGDAQSIQASQQLREGTMPDRGNLTVEQDRDMLMKCWASCIEQRLYLTGFSEQK

SEQ ID NO: 949080 - protein, 41 aa, Homo sapiens
MLQCDGYIKIYDVQHAILAGTLSGHASWVLNVAFCPDFHLA

SEQ ID NO: 949081 - protein, 44 aa, Homo sapiens
NWLDQLKCTSRAEIAKRLNTIYSTDHAFPCHNEHQTAGWRMACE

SEQ ID NO: 949082 - protein, 56 aa, Homo sapiens
KSGHALRHTYVQTVDPPPVLEYCRLPREVPLHSRWKLDQPVQPHQYSLDDRRQWVH

SEQ ID NO: 949083 - protein, 71 aa, Homo sapiens
MDWLVLPTTALSSSWGLCLSLARYAWHSRGNGGAEGCGAIPACQSHAPNSSASKSGVSGQRMLLLLISTLQ

SEQ ID NO: 949084 - protein, 80 aa, Homo sapiens
RLLPLGELCLLVPRFPDGYDCQVSEHESRSPYTVDPFTTGERAQQTRSPPSLLPELKLLTIWPWMYRVFPHLPRVPKLDI

SEQ ID NO: 949085 - protein, 68 aa, Homo sapiens
MAGHGSRPVHGALLVLDRSSGKHGVVERYTDAVKLSPELDTAYYRCLCILISTLPGSTAHSFQSSWIT

SEQ ID NO: 949086 - protein, 91 aa, Homo sapiens
RNRPYKMTLVSNRKDLPVVIGSRGLKLLYGGITSISAAIEDIRMNDSIMGVNRKEREVNQRWTDGSTDTDRHEQSSRNSQESRTRQSQREK

SEQ ID NO: 949087 - protein, 106 aa, Homo sapiens
WTRRMFSAAGAQPLRAVHGSLPFHPPTVSWAVPEPAAHWWEGQAWPGGVAMGPGGARSYFMRILRAMARSSSSRSCSRQGYEDVASASTHPSPQPSLSHFTCRSCS

SEQ ID NO: 949088 - protein, 84 aa, Homo sapiens
SIRCSSIVFFIWLLIKLPTKDGTLENNSKIIFWQGFLIGVILGNSFFPRLCFIHGTHTVMGRLSISWTLRLVFQKLGTMTKRDF

SEQ ID NO: 949089 - protein, 155 aa, Homo sapiens
MSLDPLIQHVSPMRSGAPAKKPATPAEDGRGLIDIGPCLAVTIEEEDKEAAQLAGVSGYGSYRKKANEALHVVCQVLLSVLDVQALGDDERTIGPAWMALVVRSIRAWTWAGPGGASKAGCPVGLRVSEKLQYSVCGDRTTSVGTCLAWIQRIAV

SEQ ID NO: 949090 - protein, 35 aa, Homo sapiens
LKDIARIHCCVPDIIERAGYSLEKVFGIQLMEASR

SEQ ID NO: 949091 - protein, 97 aa, Homo sapiens
GRRINRIWSVPKASGVPVVRAHESAVTGLSLPATAEYLLRSSDAQYCAISDIQIRPVLTTVTHEPSGCSLTCAQFHPDGLIFGTGPMDSPITIWDLL

SEQ ID NO: 949092 - protein, 82 aa, Homo sapiens
EKPCLYKKIQNYTGVVARAGNPEWLGLQVHEIGTFKFAVDGSVAHMRDASINRVHDPCGVVRYRYFFPELEAKVDALMEASR

SEQ ID NO: 949093 - protein, 44 aa, Homo sapiens
PPPITAERYFLFAYTILRSVPNKLGGVLARLLSILILAIIAGHE

SEQ ID NO: 949094 - protein, 52 aa, Homo sapiens
SLLFTDTYLRYRLGLPPGDVPPQSLTSRPPHARTNFHSTMTSPLLGFSLDLW

SEQ ID NO: 949095 - protein, 32 aa, Homo sapiens
LLFYSSQGQESAAFFTGQNQGVSRAASLLSSS

SEQ ID NO: 949096 - protein, 129 aa, Homo sapiens
MPAIVHLLADRLGSLQLRDLRTGPLPGLPCRSASEVRGMPSLSGRCLSCVVYHIQAAVLRPHPWNQYSDREGRKSRLRYWDPRDKGMWVLEGKGILGRVLGPNGMLEQEVVLGSSPEATGVRMLKSGSH

SEQ ID NO: 949097 - protein, 111 aa, Homo sapiens
ETESHSIVQAGVQWRDLGSLQPLPPGFKQFSCLSLPSSWNYRHTLPRPANFLYFLVETGFHCVAQAGLKLLSSGNLPALASQSARITGMSHHARLAVVFFKALLSYSRRRI

SEQ ID NO: 949098 - protein, 111 aa, Homo sapiens
MVPSSLHFTFASCKICETWRFSDLVIFAKFALDESNMSVMPSTFSGSFKSVGAPAVNLGRITCSLLGTRMLIQLSMDLVQMVEMMADSVSGALSRKCKQHADAIPVIGEYN

SEQ ID NO: 949099 - protein, 84 aa, Homo sapiens
CTDKYIALDEWAVLRLEAEKDIDKDLVIYIHSFHTYRILSLTLPFVFPPVFKIVWTGLYVLPWSSKVANHTIYSDITLKRMLTN

SEQ ID NO: 949100 - protein, 163 aa, Homo sapiens
MSSSVISRMAIGGSTGLWQGRYIRLKQDVFSALVGQGQIYVHLNDGIWSLIKSGGSALYASRLYLSRYQDTQPERLAKHTPGGPWIRGNVYIHPNAKVAPSAVLEPNVSIGKGVNVGEGVRLRESIVLQGATLQEHTCVLHSIVGWGSTVGRWARVEGTPVTL

SEQ ID NO: 949101 - protein, 72 aa, Homo sapiens
ENTCPSTDSSTLMFEIAAGTTTSLRGFPDSNAIHPGILALRQAAVSSDLLLQPCLYVTQHLVPHSSASDGDS

SEQ ID NO: 949102 - protein, 58 aa, Homo sapiens
IGDTINLPGRPGLRGSGAPLEIPGLKGFFGEKGTEGDFGFPGITGVTGVHGPPGIGLS

SEQ ID NO: 949103 - protein, 86 aa, Homo sapiens
QKEVQQELPVFQSGFQCSLCLGEGASQPQGLLIDQARAMLGLLGLGYQLIAQPRDEWRQLPPDDNTSNGHSMLDNYRHLVSLAYDY

SEQ ID NO: 949104 - protein, 61 aa, Homo sapiens
EERWRVLALQQAAEGGDLLLQARLHIQQDLVLLVLLLHLAAKLGQLLLQAANHLLGLGYQG

SEQ ID NO: 949105 - protein, 43 aa, Homo sapiens
TDFLDPVVPGDKGKDGLPGTTTAFPDLRESPCPVLLPGTWAIK

SEQ ID NO: 949106 - protein, 73 aa, Homo sapiens
ANYSEERAVRASSESTVHRNKRGAASALTGGPYFRGKGHVVLAPQPIPSHLGAPPPHSLHLLGLGYQGDSVLE

SEQ ID NO: 949107 - protein, 47 aa, Homo sapiens
ACRDASQHLFPCTEWVVPLPAHAQKWWPLRHTLPGLTQAVPQGGGVP

SEQ ID NO: 949108 - protein, 52 aa, Homo sapiens
GPPEMCYRTFLDARGLLDDYTERTGLTRDNNGLPGSKGITLPCIIPGTWAIT

SEQ ID NO: 949109 - protein, 61 aa, Homo sapiens
MSAFCQVLSDILQVGNARRLDDDISELDALERHGLSPHLGARSIDQSPVLINNIYNRRSRD

SEQ ID NO: 949110 - protein, 56 aa, Homo sapiens
GTPQSIPLHAIEEEEVVVRRVPLRQALHNFLCQISLQPPAHTRGHSRENAVPAHKS

SEQ ID NO: 949111 - protein, 102 aa, Homo sapiens
MTFAELLALRSDRLFIIHSSEMLGTGSTVETLPQVLCSALRVERLFEGGRVFLKIIDPENESVGRARWLTSVILALWEAEAGGSRGQEIETILANTVKPRLS

SEQ ID NO: 949112 - protein, 95 aa, Homo sapiens
ETRQCTLDIPASLSLRVSPHRFAGDSGADNTQHYRLCMLKTVDDFIASWAFHIHDSTTWGSAPGLFFSCFLFSSSGEGLRRSFVERSCSRALRTL

SEQ ID NO: 949113 - protein, 59 aa, Homo sapiens
MALSNCLEEAISIRLRCCTLASSDSQQVLISCTRSSREEEVVHTNLTLELLPPPATLSG

SEQ ID NO: 949114 - protein, 86 aa, Homo sapiens
RKALPGQWTLCSSHRSQELPRPQTQPSHTAVIAKHMLPLQQHGLLKSTRCRRQHACHGIRAFSPVLCRAEGYKLSCKRNSVFPLGL

SEQ ID NO: 949115 - protein, 82 aa, Homo sapiens
LLRSSLLYPLTICRHGENPGPLALHAVGGMPPFHKPILLQREPVFATPIVLGCRLLSEQSPGSSGNCTPVHWPGLAFPYSRF

SEQ ID NO: 949116 - protein, 75 aa, Homo sapiens
CAAMPHKPTALRMLCGSIFSCMENRHSQFSDMLLVGMAHSPATFSVTTLTGAGPTMPFVGLHIDAWTGLPSVELP

SEQ ID NO: 949117 - protein, 48 aa, Homo sapiens
SGTSVLDCRRELTDVIFMSVPELDPRSVQCVDPALSDISIDGLQSSLE

SEQ ID NO: 949118 - protein, 39 aa, Homo sapiens
PVMLYMPLGCSSPETEAHRLVGPEMPYPKASPCPPLRTY

SEQ ID NO: 949119 - protein, 91 aa, Homo sapiens
MMEISDPRKHFEHGASSEIGTEDAEDVGVEQLLRNIPYTTVGTLAHLASTNACPWFERELEMPSVCISRSSPGIPVAMCELSIFPHILSQL

SEQ ID NO: 949120 - protein, 122 aa, Homo sapiens
YSYLSLGFYIDRDDVRLWNCVSHFFRELAEEESLRANSVSCRFKSSVASALSSSDIKKPAADEWVYNPNAMKCCHGPVAKAEAGPFGSSMPWVLSARTPISVTSWRLTFLDAEVKLIRKDEA

SEQ ID NO: 949121 - protein, 35 aa, Homo sapiens
QIRIQYKALKPEVDKLNIMAAKRQHGSGSSSFALC

SEQ ID NO: 949122 - protein, 58 aa, Homo sapiens
MGRRKAKPFHSVMHAGNDQPAVQFLKMWIHQNCFANCVTVHSIWMARVLPTIVQRSDG

SEQ ID NO: 949123 - protein, 123 aa, Homo sapiens
MPVFPHLLLQGWLLVTRSCHPVIQDSNFQLKVSLLFENLVVAAPPGFQSGYKRQRHTYPCQRVGRVAAQLTPRSSRIAPSGHGVAFYKLSVASVLLLLPLLQLLHECLHFCLKLGGMMKGPSS

SEQ ID NO: 949124 - protein, 209 aa, Homo sapiens
ITTYPDRYNRQEDGGIVCGNHTVTDRCDHHWASDGYYAMVGRVHGGLTVAVIQRAMVKACPHVWFERSEVKDRHLVATRLTEACARYSKRSILIFPEGTCINEYIGDDVQIGKLRIGATVYPDAIKYDPQLGDAVWNSSKYGMVTYLLRMMTRLGHCLQRVVPASHDREADEDAVQFANRVKSAIARQGGLVDLLWDGGPEEVGMMKDG

SEQ ID NO: 949125 - protein, 73 aa, Homo sapiens
LHHTYLVVSAFPYSLLIFVYDERKEKLITQATPWRAGWRRKPSISPPSCTLLKHQATHSASDTHPLLVYFSLG

SEQ ID NO: 949126 - protein, 80 aa, Homo sapiens
EHEDRVTLPSGSQKVLSSANSAVRWCGGRQVADIDEPILKAGRAYHNYKAERKCWPQVRGVAIKSGARILFGGGQATRHI

SEQ ID NO: 949127 - protein, 46 aa, Homo sapiens
SRWFNGTLLNSPDRARAAAQPMGEQRCNRLLTPTQFFLARSKSTAA

SEQ ID NO: 949128 - protein, 47 aa, Homo sapiens
HSSGGQLMHAYYLNKLECRDEEFKSDQDVDVGEENSLLTTSKLPANR

SEQ ID NO: 949129 - protein, 41 aa, Homo sapiens
MHAYHILTSFECRDEESNLTKMLMLDKRILCSPPSKLPAYS

SEQ ID NO: 949130 - protein, 53 aa, Homo sapiens
TSTDPYRLAGTYARLYILTSFDVREIEDSNLSQDVDVGYENSLLPTSKLPANR

SEQ ID NO: 949131 - protein, 48 aa, Homo sapiens
LTVPSIGGPLCTLTILTGLSAEIEESNLTKMLVLAKRILCSPPLSCPP

SEQ ID NO: 949132 - protein, 52 aa, Homo sapiens
DSTDPFDWRALMHAYHLNKLRVQEMKSSNLSKMLMLDKRILCSPHSKLPANR

SEQ ID NO: 949133 - protein, 50 aa, Homo sapiens
RIFSIGGHLCTLNYLNKLEVPEIEEFKSDKDVDVDKRIRLLPTTKLPANR

SEQ ID NO: 949134 - protein, 41 aa, Homo sapiens
RIRRAFMPLTILTSFECKRLKTFNLTKMLMLDKRILCVPTS

SEQ ID NO: 949135 - protein, 44 aa, Homo sapiens
HAYYLQEACSASSIDSSPTSAPSMLMWDKRILCSPPLSARQSKG

SEQ ID NO: 949136 - protein, 51 aa, Homo sapiens
DISTSHHGSTFRGGSDGYGSASWKMSTWTFPQVTGSTFMNSVCHDSMGYRS

SEQ ID NO: 949137 - protein, 61 aa, Homo sapiens
MDVVREDGRRWLSPKHSKYSFWAWMAFSLFSGYLAWRFSFIFSILFIELLRTVFLLNADIG

SEQ ID NO: 949138 - protein, 52 aa, Homo sapiens
GGNQDMNEDQICGKQKLSSAAARDDCKDAGRKCRIADPGAGIGDRRGLLGQP

SEQ ID NO: 949139 - protein, 82 aa, Homo sapiens
TAKYGTEKDGNRGEQSHLAQEHAGACGCPESMEATLLKWTQCRPLMSVGRCGGGRCTGPREVLTLEDEVISRSPVNTHHLPK

SEQ ID NO: 949140 - protein, 172 aa, Homo sapiens
SGLLITTYPDAHLWVKNCRDLLQLQLQQTALGSTFRGFNLAEEFHNLQIARFLEPGHNTVEERHKMQLGTCARKELNEAKFYRVCFTYLVTVDGINALWGRNHSKKRRSKPDCPPMKFSTCSQLEENDAQMIRHGGAIMSALSQTGSLFKPRKAYLPQEFAGKGGIICPGSL

SEQ ID NO: 949141 - protein, 62 aa, Homo sapiens
IESLKEELAQLKKNHEEEINALRGQVGGDVNVEMDAAPGVYLSRILNEMRDSWKCPPAYGIK

SEQ ID NO: 949142 - protein, 90 aa, Homo sapiens
RSSRFSRWGVVDGVATRRRCRTPLPSLSPPRPASRLSSSLSVSFHLPGPPAQCLVATCPRGHSARQFDPFCAICVPMCPTPGHPLTSHCR

SEQ ID NO: 949143 - protein, 36 aa, Homo sapiens
MSAASSQQTSGNEGMNLQTLLLEIFKQASAVFHWLP

SEQ ID NO: 949144 - protein, 40 aa, Homo sapiens
FTWLAAHHSIFLSSQWSGVGRSYCSVFTFRISTEKQRHHV

SEQ ID NO: 949145 - protein, 112 aa, Homo sapiens
FPCAHFHVTLHFFLPKKVGPTMSFNSLGWQSIIGMETGVSAYILTRSALNNPEMVEGLVVINVNPFWKGWMDWAASKISGWTQALADIGWCPTFLGKEELQSSVKLIHTYRQ

SEQ ID NO: 949146 - protein, 47 aa, Homo sapiens
TSSVLRAAIHHAPHHPSYLAEGSLRLCRATHLILPLDGLVLLILNFS

SEQ ID NO: 949147 - protein, 82 aa, Homo sapiens
HSAGCTFDCIVPMMEAVPEGDWSCTVCLAQQVEGEFTQKPWFPKAWPESGTSGYYAELLSRVIGLPNADLLVRDGLRNVPAS

SEQ ID NO: 949148 - protein, 53 aa, Homo sapiens
MLLLGHNIDVNIFLRFLLVALSQWSGAEGPRSARWRECGPSMPTGRPIVAAIP

SEQ ID NO: 949149 - protein, 34 aa, Homo sapiens
YLTSILQTQQKVNESVIVSKAVSWNSEWWSMTEY

SEQ ID NO: 949150 - protein, 88 aa, Homo sapiens
MSSLYPGCSVIEGGTLTQYEGNTESVEEMAQVPISTCRRVQFCIKVQTIEYKQPMDFSCSHVKRLQEQNAIDMELMVNAKTWLEATEA

SEQ ID NO: 949151 - protein, 56 aa, Homo sapiens
SEITHYSHYVVIIISIFIFFPFFLTLQSRVGSGGLLLLLLLLPVKLLTGSPLLPLL

SEQ ID NO: 949152 - protein, 59 aa, Homo sapiens
MTRAIESRLEPEREQCLLRLPVCWSMYATLYLQWYGDVLGGLVWTSGAVKVSLDCHIRQ

SEQ ID NO: 949153 - protein, 127 aa, Homo sapiens
MQEGRGTLSKLYGDHKALYDVRPGQWSGTLDLVETLELQNLMLCALQTIYGAEARKESRGAHARKDYKVRMDEYDYSKPIQGQQKKALLRKHWRKHTLSYVDREAPGKVTLEYRPVIDKDFEHGYRD

SEQ ID NO: 949154 - protein, 114 aa, Homo sapiens
LYESELPSANVHIGQGVLSASAPQRASSVSPVDGLGVIVLINPHLVVFPGMLRPVTPSVPLLREIVCSAHSIRFCSSRVSTRSVSQTIPRSNVFRCLRSPESLLIYQQTFLQQR

SEQ ID NO: 949155 - protein, 45 aa, Homo sapiens
SHRILILEGTILTASAGMCVDVNECSATPACCCGHNVREHAGLLP

SEQ ID NO: 949156 - protein, 76 aa, Homo sapiens
SVTFRHSGETDDPVKPMVHWWPLGQSGLLNLGQTDFVFYVGGYPMYLHAPVPWFRFPPGYPGAWVGGSNAGLPRLE

SEQ ID NO: 949157 - protein, 61 aa, Homo sapiens
MTNFAWPCLIIFRVCLYPRTYFPLFITSWSLELIDSSDFFVFLAATIFLPEERDGPQPTAA

SEQ ID NO: 949158 - protein, 73 aa, Homo sapiens
WGPVRHLRQDDCGRKEYEKVVESINSRLQLVMKSGTYVLGYRPTLKMIRQGKAKLVILANNCPALRKSEIEYY

SEQ ID NO: 949159 - protein, 75 aa, Homo sapiens
WGPARNLRQEDSGRKENEKSRVDINATLGSNSFMKSGKYVRGLQADSEDDQTRQSEIGHSRYTTAQLCRNSEIEY

SEQ ID NO: 949160 - protein, 83 aa, Homo sapiens
MPGVDRGLGEGGVRNDILWVDLVFLKITKMEGSDTLFTQLIIEGVVQPSLGGGRTIGGIGPVRNSPTSTRARNIRVESACRIG

SEQ ID NO: 949161 - protein, 39 aa, Homo sapiens
ATCPVLHHQYKVSISVSNALGHNATAITFDESPLSLILQ

SEQ ID NO: 949162 - protein, 70 aa, Homo sapiens
LASLVARSLFFAAFSSTTCCRTEIACSAAASHASFASSRAAVCSAAFFLTASLHSFCTSTWAIFQRLLIP

SEQ ID NO: 949163 - protein, 63 aa, Homo sapiens
SPTTAVCCLLWVVAVLLEHGLHILPHSLGALLLQQGPLGVQNLVLLLQEPHLVADGGKLLVEG

SEQ ID NO: 949164 - protein, 58 aa, Homo sapiens
LEGEEERLKLSPQAILRVTVSKSHLSSSGSLSVTGRLGRSTRKRLEVEEPLGSGPSVL

SEQ ID NO: 949165 - protein, 85 aa, Homo sapiens
INPSTKNTYGHHSAIHSSKDRSTWLPINSGLDKENVVHINHGVLGSHKKNKIMSFAASHMDAAGSHNLSKLRTENQVLHVLTNGS

SEQ ID NO: 949166 - protein, 91 aa, Homo sapiens
MESRRQATVSWDSGGSDEAPPKPSRPGYPSPRSSEGFLSQPHSTWYKPFITRFLATLVHLESQPWLAASIPGQGFSFGPNSFMRSQTSGDS

SEQ ID NO: 949167 - protein, 81 aa, Homo sapiens
SGYGVSLSSSSISSEDILAVLQREMTCVSTLRQYFDGPSGSAKATQEPVDIGSLLVFMDLCQTLKKSAFLQLTLYEFWGYS

SEQ ID NO: 949168 - protein, 70 aa, Homo sapiens
QEMQQSSEKRYISSGHSTTKVIPVEKDGGVSFIFEDNAGVIVNNKGEMKGSAITGPVAKECADLWPRIAS

SEQ ID NO: 949169 - protein, 157 aa, Homo sapiens
VGLECSVSSMLVMVRVCSPSLLAPQLCLSFVVLAVWCVFRSSSFCCGGSVSLGASCCLLLLVWFCGVRLLFVLLFVSPLPVFSRRCSWSFALSLSSACVGGWWVLLRRGLRLAVVYAWEAVGGFRVVRLCVLAVAGFCVVRGGGCALFAVAGCVSGV

SEQ ID NO: 949170 - protein, 116 aa, Homo sapiens
PPHSTVLSRVCWALVMSGRCLGPRELMYGSRTCLAKGVSVCCVHACARSRGMCFIHAAVSQPRLGPGGLRWSKTGTGQMQWLMPVVPALWEGKAGGSPEVREFEISLTNVEKPCLY

SEQ ID NO: 949171 - protein, 55 aa, Homo sapiens
CACFHQVCMFLSSDVSAALFPHDAVMLPPELLLMYLLVCDLYVSDRACACNACAR

SEQ ID NO: 949172 - protein, 40 aa, Homo sapiens
VVDPANGFLPKWAIIEESQKTMACSQIFMPFQMDLDGSVR

SEQ ID NO: 949173 - protein, 39 aa, Homo sapiens
KARSAGGRGPPCCRGPVLLSCKERTMKYMQRRGVSMAKR

SEQ ID NO: 949174 - protein, 112 aa, Homo sapiens
QERDAGPTYLIIQLNTNSIIGDGPIVRKEIEYRMARGPWAEVHAVSLQTYKLWHLDPDTEYEISVLLTRPGDGGTGRPGPPLISRTKCAEPMRAPKAWLLLRSRPVSISALE

SEQ ID NO: 949175 - protein, 69 aa, Homo sapiens
RSDLAGSPFQTRQIGGHDHRYRIRNQWAFMAVCIDDQPSATIWMTTWTPGVHPSEQALAAIHLSLQEQC

SEQ ID NO: 949176 - protein, 40 aa, Homo sapiens
FPKRDADPHRTTTLPVELECPDGEVMNEEHDVHQDLCLPL

SEQ ID NO: 949177 - protein, 42 aa, Homo sapiens
MVSIITSMGIMGVACCLVRRGSGLGHFESSERKPIITAPAHK

SEQ ID NO: 949178 - protein, 35 aa, Homo sapiens
SSLYPKYVELINQACPAQWLCRIAGDSLAVYVRDT

SEQ ID NO: 949179 - protein, 49 aa, Homo sapiens
SRASPITIAEPSEGREGMTCYYLTHVKAVGAVTLHVQVGLGVSVLHHHD

SEQ ID NO: 949180 - protein, 67 aa, Homo sapiens
SKRSTKGFFDPNTHENLTYLQLLQRATLDPETGAPISFSLSTVTVLPPCSFLQTLGEVEAYFVCLGL

SEQ ID NO: 949181 - protein, 70 aa, Homo sapiens
TTYRSVATKLTANSRVALSPNTANTHSDEAVDKAFTLAFENTWFKYKIANAFGNLELKEKNKKIWAITLF

SEQ ID NO: 949182 - protein, 43 aa, Homo sapiens
NQHLNLNPHKGSVRAREANREAGLSSQEKHPESSHSGVTHPML

SEQ ID NO: 949183 - protein, 73 aa, Homo sapiens
VTSYAIIYSTKKTLSVCSKSKTDLGEIYGASPQSKKSRNSKNCGYYWNGIGHQPKNRKNLAEVGGFNMHIMEG

SEQ ID NO: 949184 - protein, 84 aa, Homo sapiens
CSPRTACRLRPRRLTTQHTQRVHVAGLSWVRLAQYRLSVKQRTPWRLKDGESSAPCTFLLDSGLVQADQWQKDCLKSKNCVNND

SEQ ID NO: 949185 - protein, 109 aa, Homo sapiens
MYDYTSLHHNSSLNNLSFDLTHWGVKRLLTLPQLRQLHLWKERAHRLQIELDELILTAEGVSTPKVCNTARVIKEGAVSVKPRMLLFESLVQSARTLSVSALILKLNLG

SEQ ID NO: 949186 - protein, 67 aa, Homo sapiens
FIVGHAKSYFLQGGPSFHFQLHPPHTLTEFTVAKDLRQHQRFWHRLADVFGSTRQITAQQGVRGLYE

SEQ ID NO: 949187 - protein, 96 aa, Homo sapiens
GEVYQCFGAYLYSLSQIRCQLLNPMVACTMTVGKLAVTDQKDKNAEVHGYMDTLHQAKKQLLYADGSDKTLGISKIPALSVLVSTNRIEIIKQHFN

SEQ ID NO: 949188 - protein, 82 aa, Homo sapiens
MLLIDNLPAHHISLAVDHSLTAGHLNLVDHRLAGHRKVLFHLGFLIIPCFAAIPGYYMVAGYISSAYDSHKHHRTVNNLTDL

SEQ ID NO: 949189 - protein, 57 aa, Homo sapiens
HPFVNDRTAGNDAGIMLLNHNMTAHHLSLDVDHSLTAGHMNLVDHRLAGHRQVLFQL

SEQ ID NO: 949190 - protein, 62 aa, Homo sapiens
MGLLALTTGLMLLYHYLTAHHMSLDVNHSLTAGHMNLVEHSLAGHRKVLFHLGFLMIPCKAA

SEQ ID NO: 949191 - protein, 55 aa, Homo sapiens
MSQKGLWRTTHSVKHNVSSRRKLILYDMKMINIMHCYNYYMYAVLQRHSIKFALI

SEQ ID NO: 949192 - protein, 150 aa, Homo sapiens
AGDIKPDYSANSAMIPQMHKGGRYPFRIMIVASVMSPESYLGSPQNSPSIRSISKLESLPSPGVLCGSEPIQKLTILLERRWTQQKKTGEKMDKEADKKWSKTRQQPLGTDRRRGRSRRLLLVSAKSWKKKNEALKERADSLAKEIQLLE

SEQ ID NO: 949193 - protein, 41 aa, Homo sapiens
MCLMKIYGVTDLTSITSWRTLSYSFQSHLKIVSALFESEVR

SEQ ID NO: 949194 - protein, 121 aa, Homo sapiens
CLPPRSSSSSAYSMCRPAPAAFYVDPLPFNDSYLYFLFLMIYYITFSLAYFIVGISCIIHITRKICVNLLYMLSERNMVNSKLFGSHDLADPRIVSSPKPHVQGSAVDIIDGPTSSFQNII

SEQ ID NO: 949195 - protein, 48 aa, Homo sapiens
NDMVCGDIPFRAYEEIIRQVFVQAEGLFRNVSISLDGALAVRPSDRPT

SEQ ID NO: 949196 - protein, 84 aa, Homo sapiens
IRRKRSVLVLAKASTEGQPFFTTAGELWWKTVLHMHTYTCGVKLRGEDDVVMLADLADEAALGAQVAVINMLGGKYNQGLKESF

SEQ ID NO: 949197 - protein, 39 aa, Homo sapiens
TPRYSQMRDIADEGYWLIEEYAMSDFRSVSRKQMELVII

SEQ ID NO: 949198 - protein, 37 aa, Homo sapiens
LTRYRPGTVALRDHFTVTPTRPPEPSDFAKLPFHASG

SEQ ID NO: 949199 - protein, 100 aa, Homo sapiens
MRPTHFLVIPKKHISFISAAEDDGESFLGHLMILAKKCAAELGLNMGYRMVVNEGSDSEQSIYQIISMPLEAGKCSGLLAKHVFVYNIMSYPQHHIDRND

SEQ ID NO: 949200 - protein, 40 aa, Homo sapiens
RDLTQMADEMRRNLELKEKGRHVELGAIENKLESTGNFTY

SEQ ID NO: 949201 - protein, 51 aa, Homo sapiens
MLSSHSSPQLLATGLQYPQLLLAPLKPCTEPVVAASARPAGDSVNKDSMNA

SEQ ID NO: 949202 - protein, 61 aa, Homo sapiens
RLSCAASAFTFSHYAMNWIRQDPRKALQWVQQFVLVVKNADYADSADGPLHHTPRDEFPRI

SEQ ID NO: 949203 - protein, 77 aa, Homo sapiens
FNWVLEYVPEARAENGRQLALSAADACGGCRRSAQQVGDRRLYSAGSPELLQWEPGVVMEQVIFHPHPRRPQPELKD

SEQ ID NO: 949204 - protein, 52 aa, Homo sapiens
MFQKRVGRFITVAAAPWARSNQGVGPEASPCVQWVLLVCEKSNFWAQVMKAD

SEQ ID NO: 949205 - protein, 88 aa, Homo sapiens
MMTGVIYSVQPYTKEVCSHSRLDEIIRHYQLLTEENIPENPLCFLYPRIPRDEAFGCYYQKKVNLQERRKYLKHRLIVVSNRQVDELQ

SEQ ID NO: 949206 - protein, 93 aa, Homo sapiens
GERSERDGFRFNGVLDRDCAYGAVSMSCKEKGNKALKPVGTLMMPYRCYSEAIKLGSRTNHCAVQQPVSAAYAKKKGGDYQKAYEDGCKTVEP

SEQ ID NO: 949207 - protein, 93 aa, Homo sapiens
MMKCVILSLLTYTEGAAHSAYVIICDIGCSLWRIYLKNPWGFFYPRIPRDEAFGGYYQEQVNLQERRKYLKHRLIVVSNRQVDELEKTAFERR

SEQ ID NO: 949208 - protein, 118 aa, Homo sapiens
GAYPGINKNPKYKKLKDAIEEKIIIAEVVNKINPCYWEEYISGFSFYNKQKSPLADPKVLDNINVSRFPLAGMGPKVSDELTKLMASSPSTLKEGSEAASKGDFLFSSDHLIEMVANP

SEQ ID NO: 949209 - protein, 58 aa, Homo sapiens
CHNQEATDKSLQACKISDICLFSSSTSIEVSFPGAHSKFTSKHKAINQQGFIFHTASG

SEQ ID NO: 949210 - protein, 34 aa, Homo sapiens
ASYLNQIYLNPVLLSESREKYKAIRLIFVIMAIW

SEQ ID NO: 949211 - protein, 100 aa, Homo sapiens
CIPTHCNIVDLYVQDHNSDTGLNYGPQSRRSQVYAETTHKPFITSNNSNPVQDEDAVALTCEPEIQNTTYLWWVNNQSLPVSPRLQLSNDNRTPSLYSVS

SEQ ID NO: 949212 - protein, 62 aa, Homo sapiens
TIAQQRGESKALSLPPLWAGTLAWDDDYWSVEPYGQGPWLEAGCHEEGQGPPNVHQVTCLYG

SEQ ID NO: 949213 - protein, 56 aa, Homo sapiens
MARAEAALELKKKGSTWCWVHREQGESKGIHLRAQERACREEKGPAVRGIGVGDTI

SEQ ID NO: 949214 - protein, 102 aa, Homo sapiens
MGMSHQRASVFPTGMLPKGQCCAVGETLQGAGGSKDRAFKAAAEAWDVEISVYSPIPDGSSRAKHTALDSALQAIHINSKLLGFLHVPIRKAKHTTKYTLSH

SEQ ID NO: 949215 - protein, 50 aa, Homo sapiens
RRCHIAQEPLEFSISVKQRPGQQVATGVRLLGRNSNSKRLLSYVATLKDN

SEQ ID NO: 949216 - protein, 115 aa, Homo sapiens
IPYLSQHHVPSLNLFRTMGCATGRGDAVGEIVGIITRHNVTYEFLQGRLRQHYQTILTAQPTLSWCCLGEANHAHSGGHSWLGLFRGMEDSQSPTHSESRESSDTLLVRGPGGGF

SEQ ID NO: 949217 - protein, 53 aa, Homo sapiens
EVSWSASDSALKARTGPHGGWAVARPSGGTSFGVSNVCSLRAGTFLNIKMGVF

SEQ ID NO: 949218 - protein, 122 aa, Homo sapiens
MIIATHRNTDERVISLEKSDELRGYIYFTRSFSEKAEEESERLLRELYLVDVLRADRTTGCHGLELRGHFYDHRFSSYYLSLAPEMRIPKNGIEKHLLRETFEDSNLIPKEILWGAKEAFSV

SEQ ID NO: 949219 - protein, 34 aa, Homo sapiens
MYVDTAQGSRIRPSKYAGDSAGAPGDMGQQALSH

SEQ ID NO: 949220 - protein, 89 aa, Homo sapiens
VLLSWHVTVQRKRKDIAMASCRCSTSHTDMVETLCMHVTTRDAGKTDVTGHVDVTHIKLSPQDRPGENGQFTQDGDDVTHRHSDNTHHD

SEQ ID NO: 949221 - protein, 95 aa, Homo sapiens
YELHDEDIRLKYTFDQATGGTAPFETHSDTHALGLLNVTSEQLMVDEGMAREVINRIQKLREKCNQVSTDEIPVYYKTKSEGSYLNSVIERHPEI

SEQ ID NO: 949222 - protein, 85 aa, Homo sapiens
QQCISAGSSGTIVSLLLEVAGGRKLKSKPALGVTSVDQEVQWGPGVTNRTSITTCDLRFLEWHGDPSTSLTLHGYAMLVLLACLF

SEQ ID NO: 949223 - protein, 43 aa, Homo sapiens
SWYEVQVGFRNGWIQVIMFLTVMIRAQFVIRPLCVEVAVDIRP

SEQ ID NO: 949224 - protein, 109 aa, Homo sapiens
SRFLVDTSTLTIIATDTRMGAYYFCQASHDTTVGVRRVYPADRPGITPKAAPSVSSVPALLCGASANKATLVCLISHFYPGSVTVDSLADSSPVKAGVETTTPSKPSNP

SEQ ID NO: 949225 - protein, 33 aa, Homo sapiens
TVCHGYLLQRKKEPSESSSVHGELAIEEEGAVG

SEQ ID NO: 949226 - protein, 52 aa, Homo sapiens
MIAHAPNTVFLMLHMPSAEPGCPHTGTVVATYTLHRRSYLLPQKFFSSERWS

SEQ ID NO: 949227 - protein, 38 aa, Homo sapiens
LRFLAGAEQDQALGALLCHSSDLGRLEGGIVMYGGAMN

SEQ ID NO: 949228 - protein, 40 aa, Homo sapiens
PRLDRLFTCRWSEECPPMLDATQQQQQQVAACEGRAFDNE

SEQ ID NO: 949229 - protein, 54 aa, Homo sapiens
MTLRTEEQILTATVDTANVFLQIDNALSGLLDDFLHQCMSTELTVRTAVWKPDT

SEQ ID NO: 949230 - protein, 137 aa, Homo sapiens
LLVGWREVYGRTTSDFIWRRHIIGCGIHLGYEDIRVFAELLAKYFILGLQVLTVTTPRGIKFKQHIFIYIIHYFIKILCYQYLHRPIIALWDRSRLPVSLQIGIKVIMQEPLKSLPITRELLLHDKLISFNSSDSNN

SEQ ID NO: 949231 - protein, 105 aa, Homo sapiens
KHKAKEKRPRSIFEQLTESERVRRAHLNDLENIIPLLGMGLLYSVSGPERSTDMLHFRLSVGARIYHTIAYLTPPPQPNRASRSFVGYGVTLSMAYRLLKCTLYL

SEQ ID NO: 949232 - protein, 61 aa, Homo sapiens
MAVDGSGPLKPYRRPSSKKCTNTFKVIQVGSAYTFYPVICSKILLDLFSFAQCYTVFWIGK

SEQ ID NO: 949233 - protein, 38 aa, Homo sapiens
SQIEHISSLIKLSKADVKRKLSQMVLDRKFHGILDQGE

SEQ ID NO: 949234 - protein, 44 aa, Homo sapiens
SFFSLGQQATEVSPEQACDQQPGRSPGPGVACTPVSAGPCVDKS

SEQ ID NO: 949235 - protein, 51 aa, Homo sapiens
ARIVCTPQPAQEPVLGRGRGEIMALEAHKIQRECSMYKDCPKHTWTVINGA

SEQ ID NO: 949236 - protein, 123 aa, Homo sapiens
SSTSSSEFVFIVKVMESVLSTITSLGCFITRISGRAMNLPRLLHSSAPLWCCPAQIPAFGPGLPGCEGSAQQPWQGHQLESLPHCSPVALLLPWPLKLSSLSCQPQKLKPVDYEYREEVHWAT

SEQ ID NO: 949237 - protein, 63 aa, Homo sapiens
EPSHVCRFFVLVNAYASVFFLQSPHLMVPTLHHPPPPGRGYPEGAPLGSSVSSWGLAVDELTG

SEQ ID NO: 949238 - protein, 40 aa, Homo sapiens
TLERSHHRDRHLGLIPPSPLKGPEEGVRDVSCVELGERQK

SEQ ID NO: 949239 - protein, 58 aa, Homo sapiens
PYERNVSSCKSSGADIDAVDIEERASPLIHAVTTALHVQLLLQHGANVNAQMYSGSSA

SEQ ID NO: 949240 - protein, 57 aa, Homo sapiens
LIRGSRADTTVRGKAVAEKVVYVGSDPAVLLTIPDFHLWPRQEADEDYICDRSTQLT

SEQ ID NO: 949241 - protein, 77 aa, Homo sapiens
MCMSGVEHECAAYYTIAAYYKSTAASTIDPDDGGFDMGLRASEVESVNSRSLYIINSSLCQRQSSSSCRLRRFDSTR

SEQ ID NO: 949242 - protein, 87 aa, Homo sapiens
SVITVSPDTVLGDKTNPSPQQCKAVLDMSWNVCWAHSTYSPTAEGRPPSDDKQTLANTLYSSREGDKTHMHEETLTPVSNGIGMLEL

SEQ ID NO: 949243 - protein, 67 aa, Homo sapiens
HTGVVGDRVSCTPRARYTVARLGMAWAAPAGICLVFQLRNTTFDRGLACRGIKEEVVIWSKVPGLVR

SEQ ID NO: 949244 - protein, 49 aa, Homo sapiens
LIGNGDDLACQAARELFSSEELEAAVAISCSKSSDDVAQLSPLYVTALI

SEQ ID NO: 949245 - protein, 52 aa, Homo sapiens
MGALIQKKLQEEVEKYQQLQKDLRKSMSGRQKFEAQLTENNIVKEKLALLNG

SEQ ID NO: 949246 - protein, 99 aa, Homo sapiens
VRVLDRVNLTERLLPKEYYFTPSGVQSLSIQMSVYILDKKADADRIVYENPDPSDGYVLIPDLKWNQQQLDYLYLIAICHRRGIRSIRDLTPEHLPLLR

SEQ ID NO: 949247 - protein, 137 aa, Homo sapiens
MRKIAQLIIGGWETPGMCITSYGLDVLMATADGLRQRSGGLERPVCPGQVSCSLDPSGFGAVWTGDNYCRAESNVRKSSIRYVSSSLELGGTCLSVGRMSGGFYKNPEPELLVRWYQMGAYQPFFRAHAHLDTGRRE

SEQ ID NO: 949248 - protein, 192 aa, Homo sapiens
MPVSGENLVEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGNVAGRVCQGSQLQGQKDRAVSSSPKTAWP

SEQ ID NO: 949249 - protein, 145 aa, Homo sapiens
KIYQRELGVYHLSKMSEPLLAGYPQIPVVSFTILGGQAMLKVVTGDCLLPSLPGSVCRAVAEQCSTTLRCAWGLPRPLGPDKEGKRQLTGPNASHTEGLPCGAGTAGVQGVGKPPLYQGRLAESGLQIEQLRWLRRGRGKKQKRI

SEQ ID NO: 949250 - protein, 76 aa, Homo sapiens
SSRFLRIPALDPSYCEQLVSVELGTTHVPVVQKKRSHNNGSVKSSRGGSVLFLLRGLLFVGLLLCYRLFCVALVFC

SEQ ID NO: 949251 - protein, 89 aa, Homo sapiens
PWMRPIVAENPEYFSEISLKPGAVLPPPPYRHRNTVVKLSCGFLGGETHLLQFPHPPLFLWWSSFYPKASSFDTSQWKIQRCNDSYVLT

SEQ ID NO: 949252 - protein, 81 aa, Homo sapiens
IGVGECQLTDCISRLLNHCLDHCSSSAFVSKGYLCKNFFFYARNSIREAQMSPLNNRALNTHIEQQLCWSVCAVNHIKESA

SEQ ID NO: 949253 - protein, 54 aa, Homo sapiens
LKGGDDAEKVENDKLEGASKQREKKIKVQCISSTRLRTRSVSTCDHFMGVGAQP

SEQ ID NO: 949254 - protein, 104 aa, Homo sapiens
ASSSGHCLQVAVAPPPMSCSIEAARVCRCAAVSSNCTRTPSGSWQARLRPHHHPSARPERNVGWKVRGLEQPCSLFGLLLEAVPFAVILVDSCQVSPGHLHPPI

SEQ ID NO: 949255 - protein, 34 aa, Homo sapiens
TLPSGDPLGEKWDAPNWRSRVIKSNFKPSLLADE

SEQ ID NO: 949256 - protein, 128 aa, Homo sapiens
HVPDSDYWRAVHESLGVGGAVDRPLPSACGSSSLSHGNIFFTSSSLRGRIHLKNSLYINLLGSFHINTQSYLFHCRLWRHFIHFPLPVSIFHCTFPIICTSLMVLHSLWVPVGLTGAQGYQHGHASLK

SEQ ID NO: 949257 - protein, 32 aa, Homo sapiens
SHSPRPFTETLTESMLDSAELKEQIQALMREN

SEQ ID NO: 949258 - protein, 58 aa, Homo sapiens
WFHEYSYCLSRRRRQAGLREKPLSDLAVSPTWHIGQSVILEYLYHHHDEAISIKAISR

SEQ ID NO: 949259 - protein, 159 aa, Homo sapiens
KDPCIDGSLLTADQVRPSRTLLSPYDGRTWAGLEVVRSPCGAALSCSNTRSLLSPLGHQSFQFDEDDGDGEDEEDVHDEEDVDEDAHDSEAVASLRGMELQGCAGTQVESENNQEEQKQVRLPESRLTPWEVWFIGKEKEERDRLQLKALEELNHQLEK

SEQ ID NO: 949260 - protein, 81 aa, Homo sapiens
MEGVYRKQTEANVEAEFLVWGTNVQGGHIDDGQAGGLGGFVFNHCLAPGSGVTRAAIDSDAVGEAAVALGADLDLVGALEE

SEQ ID NO: 949261 - protein, 128 aa, Homo sapiens
TGTLTGSNFNREGKSYSFLHHEVEAEMETPHSHLSGTGKMIGEGAQVSVGRGSWWTWGWGGLPTSSHYAYKNTDTCRCLCRNKARVLQVTKGRAGTTLASQSHTRQLSHTLQAVRDTSEPWALSLLAA

SEQ ID NO: 949262 - protein, 146 aa, Homo sapiens
PRIQISTVLCELINALYPFWQAPVKKIQACTISFKQMEQISQFLQAAERYGINTTDIFQTVDLWEGKNMACVQRTLMNLGGLTVARDDGLFSGDPNWFPKKSKENPRNFSDNQLQEGKNVIGLQMGTNRGASQAGMTGYGMPRQIL

SEQ ID NO: 949263 - protein, 127 aa, Homo sapiens
MLTGSGTVFPAAYVQSYPSYLSQMACPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSG

SEQ ID NO: 949264 - protein, 70 aa, Homo sapiens
GGVTVAGDYFQYIPLIHIPILFIGSKYLCLQILFCWLLGNQSTSCSFFLLAVEPEEDAIYTRITILKNSM

SEQ ID NO: 949265 - protein, 74 aa, Homo sapiens
CPAICRLHAAETLYSERCCWTSQLRRGILSTWTILGKSSEVHAEVPSKQQARQKPALNIFLDIKDNLQPKVNNK

SEQ ID NO: 949266 - protein, 105 aa, Homo sapiens
EGGQDELPTCPPPPGLFRRDFGSFEHILQKRLSISFSGLLLSISLVTSFTRNSHTLQETSDFAETSRFLMGSTSSRAGMTFLEATLAGTRVCMGISFTSSQNPTS

SEQ ID NO: 949267 - protein, 81 aa, Homo sapiens
MRLTLILTRPARRTENYYPSERLKYHSPHQARDDMPDAATQFSESGPYKLGGVLALLLPILILAIIPILHISEQQSIIFRP

SEQ ID NO: 949268 - protein, 65 aa, Homo sapiens
MLYCKEWKKKYVEQEVVSQRTFNQNTAFEFKIQYTGLWGIGVATQKVNLNPIPLGQRYAQSGDEK

SEQ ID NO: 949269 - protein, 162 aa, Homo sapiens
MRINKRIGSEYCDRNTQIFKTNTQTYRESCESARYYNQSEAGLTIIQRMYGCDLGPDGRLLRRHDQSAYDGKDYIRPELRTLSSLDRGVHRGSDHPAQVGGAPVWRSSGEAYPGGPVRGVGSRRYLENGKETLQRGEPPKDNVTPPAGLLGPIECHPEVLGP

SEQ ID NO: 949270 - protein, 112 aa, Homo sapiens
MGRESRVTVRARGSSAQSAQASLVYPPPWSQGCGGHPQWILYPPRQPRSGVGVGGICSLKWAEDHSGSEAWGPVHQIPSRHSRAGGGAGHAGVPPSGTACEVAVDGSSKVDE

SEQ ID NO: 949271 - protein, 63 aa, Homo sapiens
EDLWGEVEHGGQWIVLVSSTAMGGSQPLPNSAEPSTWDSNCSSWPMKLTVGRDDASPLLHKLK

SEQ ID NO: 949272 - protein, 117 aa, Homo sapiens
QPHLQEQHDSMHRFAGMLIALGPRFMPGTLCAERKLLEGNHELQNSFMARGNPLWEVQLNKAQSLQFLLSAETVVIILAAQFKVKALKVLSNAFWCHSIGDQPQVPLHGDTGSGTGL

SEQ ID NO: 949273 - protein, 84 aa, Homo sapiens
HTIDSAWIVHPRGTVCKCEECGLGLQSECRLAAPSAESILDKTPYECDICDKDFRLPYQVVTYHQNAPYGYKALEMRSVLPTFV

SEQ ID NO: 949274 - protein, 39 aa, Homo sapiens
RGALENNQLWRNCCHISWGNVGFVVSPQEALTDDQWTCC

SEQ ID NO: 949275 - protein, 148 aa, Homo sapiens
MHTIYQKLAAIASIRLMDEKQSCMSSDHHQYSTTEFDHLSPRNGADFDIIGIKELLEGLDHSVHLEENLTARAYCSRRCCLCFTNQSTSPLTAHSWYSCLMASWRESAELCMMKKQMCCFDDTIFQIFNKRNCLSLKDKPKVIIVQAC

SEQ ID NO: 949276 - protein, 38 aa, Homo sapiens
GNKAEVIVQVSKDVFELTDDSFDKNVLDSEDVWMVEFY

SEQ ID NO: 949277 - protein, 32 aa, Homo sapiens
AEVIVQKKDVIELTDDSLIRSLEVKMFGWLSS

SEQ ID NO: 949278 - protein, 167 aa, Homo sapiens
AAHHINGTEKVSFRNKSKLRNSFKFLVGVADLFLVPGKNTAFDGCERHSGFVLTIPGLFSIGLYSLCFLYTRREITVTNMAKQPTEIRALFAILKGEAGSLSGTGIRVLVKARLVSSPRVRFTQYVPDPLKVRLTVSRHISSTSTGLQTVFWVISQVGSEMMVQTSV

SEQ ID NO: 949279 - protein, 67 aa, Homo sapiens
IVFYASDSVATEKAVELAANKRVICFIAQAPMNAIIYNNNEDFQVGQAKVVLKSMDDQVTVIGAVVT

SEQ ID NO: 949280 - protein, 34 aa, Homo sapiens
GIITRITDGHCHCQPCELQRWIQGGFHLMWLRCY

SEQ ID NO: 949281 - protein, 128 aa, Homo sapiens
QQRSNINENLLNPSLGLQGWQWAVGSVISDESIQGNTLDLVQLKQNEAAFSVAVCRFSNTGEDWYVLVGVAKDLILNPRSVAGGFVYTYKLVNNGEKLEFWHKTPVEEVPAAIAPFQGRVLIDVAALL

SEQ ID NO: 949282 - protein, 62 aa, Homo sapiens
MSSVCTGRDCRRSSSSRARRCSDARSGAAPVGAQGPLTLKEVEELEQLTQQIMQDMELRLLR

SEQ ID NO: 949283 - protein, 97 aa, Homo sapiens
MSDPYLIKRNGCSMATYWHEKGGYEDVENLGCRLYNISDQHAAPWVVSGCHQLLISKRSSRALSFQAAKAIQLNSNESSGSAHFKGAALQATIGRIQ

SEQ ID NO: 949284 - protein, 126 aa, Homo sapiens
SRISLGCGYLRLRIEIRTGFAADTVSHTLAHSCILRQTDGPGIPQGLNAVSDRAMQTKVNFLMWAAVTVLLVLTGFVAGRYFLSTSRYTPARTFRSSQSVWHCDRTGVCGMSNIATAVVMACRTCH

SEQ ID NO: 949285 - protein, 60 aa, Homo sapiens
MSDDELSLVLGTEKENSGVNLMRQRVMMMVRHTSVREQWQKGISRMRICYLSMLLEASGA

SEQ ID NO: 949286 - protein, 57 aa, Homo sapiens
MFGGCDKSYLSGCLNAVGMNDKIVLKEGKGTADETSKSGKQSIAIDDCPSTVCATHS

SEQ ID NO: 949287 - protein, 92 aa, Homo sapiens
KRMIFITCLKKTKRDEADMKNPEVPRIKSVLGFKASEAERRMEHSLVTCRVNLVPVDPVDPEVSRKPSMNSDMGKVSKNDTEEESNKSATTD

SEQ ID NO: 949288 - protein, 62 aa, Homo sapiens
MTLRTSLPGPQIVCPDLTLPNRAVRGTVHAACRAKYVLPAGRSERLGEQNFHKGRCFVEHVT

SEQ ID NO: 949289 - protein, 58 aa, Homo sapiens
MYGLGKSRFPQEKPTIFPCTDDNTDLQQNLEKRQQIPKEAPSSTTQEDPSQKGGFPPP

SEQ ID NO: 949290 - protein, 97 aa, Homo sapiens
AVTLEVPDFDAFSSMIGADGFREKCLQQDQRTESEIAFLGVMTIVYKNSIDLFLYVVGSSYENELMLMSVLTCLFESLNHMLRKNVEKRWLQENASK

SEQ ID NO: 949291 - protein, 198 aa, Homo sapiens
EIPADTLKREVQPRNIVHMYDGSVAAFLCVQTISPTWLSTLGWSSYRQCCEEWVCDEDSQDPMDQDGLLGKELGFGASEVELTRNNELIAVGKGSSLKRLPVFGMEPRILYNPLQGQKCIVQTTSWSQCSKTCGTGISTRVTSDNPECRLVKETRICEVRPCGQPVYSSLKKGRNAARPRNPRTSQVYLRWMFECDTG

SEQ ID NO: 949292 - protein, 30 aa, Homo sapiens
MNLLVTLAYGVVWSRVVPEAIGEINFYEAS

SEQ ID NO: 949293 - protein, 140 aa, Homo sapiens
NSAHCIDGAWLHSSVSQELSLPNWAVPPLGWSQYPGSAAEEWVCDEDSIKDPMEDQDGLLGKELGYDASEVELTRNNELLAGWTRQLTEAAPCLWNRRLESYTTLYKARYVLVSHNFMVPVLTDLLDLVSPHESPMTILS

SEQ ID NO: 949294 - protein, 108 aa, Homo sapiens
YRHRKSAKEKAIAIYNVKDTPSFIMDPKELDKVFKSLHSQFHDLLLLKIGMQVFNYLMAGSLPDQLRKAPNRDQWSMTPPIVNAYYSPPKNEIVVPAGILQAAFLIRS

SEQ ID NO: 949295 - protein, 41 aa, Homo sapiens
DGDRNPKEVGLTKFNADESEDMVAEKGLIPDVCGVTYIPMS

SEQ ID NO: 949296 - protein, 36 aa, Homo sapiens
SKQASRCLWKAPVHCGQVHIGQVIMSIRTAAETRKH

SEQ ID NO: 949297 - protein, 34 aa, Homo sapiens
MALTGSKQACSAWKAPGTVARFTFGQVIMSIRTK

SEQ ID NO: 949298 - protein, 58 aa, Homo sapiens
LVSYDGGRTFGSPHECRPATCPEGHVGDVLTPQPSGQVAGPAFLGSGVRFGILVLSCS

SEQ ID NO: 949299 - protein, 56 aa, Homo sapiens
HVVPRPVDWWGLGVLLYEMQVGESPFPGDDEEEVFDGIVNDRVSLTPRFLYSTFKW

SEQ ID NO: 949300 - protein, 46 aa, Homo sapiens
PRYRGSPFPSGYSGLITSPPVDIKGDNAILDEITPKRIGDCPNTYD

SEQ ID NO: 949301 - protein, 48 aa, Homo sapiens
AICFTVDDKEHSIQGQRSEGSTAGTWSIEVSPISTPNSHTIKVGTKSK

SEQ ID NO: 949302 - protein, 40 aa, Homo sapiens
MSIRTKLQNKGACDLSALRRANVQVSCAARKIHYLNRQWW

SEQ ID NO: 949303 - protein, 63 aa, Homo sapiens
VLTVWDRKMNSIYKLLPSCELWHVVRSHQRCKALEKTLAMTLTPLYKPWVLLWLVLVRHLSTG

SEQ ID NO: 949304 - protein, 49 aa, Homo sapiens
QEVGVANLVVEIAVKDLFLIIPWEWGLANQHLVEQHTQSPPVHSSRVRR

SEQ ID NO: 949305 - protein, 74 aa, Homo sapiens
PLTVLTETRLSHPFSIDVFKDYIYVFNFFNNRVFKIQKVWPQPLVNLTGGLSHASYVLLYHQHKQPEVTNPCNR

SEQ ID NO: 949306 - protein, 72 aa, Homo sapiens
LTVRQAQTGIELLCTAWTVPGYHIGQVIMSSRTKLQNQEHVIEALLLRQVQDSWPPEDPHLIEVALSPMFTC

SEQ ID NO: 949307 - protein, 77 aa, Homo sapiens
HIGSLMSAAPPLARGHEWGCTWPQWHLYQPLLMPPLSTNSSAFNFVKPHFFKMCIFWRTGILRTCACAGVQSHAPCT

SEQ ID NO: 949308 - protein, 38 aa, Homo sapiens
MSISSKLQNKEHVIEALDSLTGFLDVLPPLLILTNKFY

SEQ ID NO: 949309 - protein, 44 aa, Homo sapiens
ADRCEMLGRSVHVLWILQSLFRIKGPTQCLQNASGAHKEGETVT

SEQ ID NO: 949310 - protein, 127 aa, Homo sapiens
LNGAEQEENLLVRKEGGSTLEALMSAGPAIMSRRATTGDVLDPTAIWDEPLFSHHVFKFISIELGEAPLLLDVDLLAARKLELGPAQGLNHMLLVLQLGADGLDNLANVNPGHSALGFSKGTSLACL

SEQ ID NO: 949311 - protein, 45 aa, Homo sapiens
TGGGFSASESCRSLLLGPASASSVENLISPTDSTPALLSAIVSPF

SEQ ID NO: 949312 - protein, 126 aa, Homo sapiens
SPDSKKNYGEYKEGGSTLAALMSAGPETCPEWPRLGMYLTPQPSGMSRYEATMSSNTSALNLVKPHFFEMWIFWRPGNLNLALRRASNHMLLVLQLGRAGHDTLAIVNPGHGALGLAKGPSHAYLK

SEQ ID NO: 949313 - protein, 55 aa, Homo sapiens
NVLTDDATTGPVLDLVSEMEIIEDDRENKNIINLLCACTQGGPLYVLVEYAAKVN

SEQ ID NO: 949314 - protein, 192 aa, Homo sapiens
MPPCMVLTGLKKGELVIEPVSSRPIPRWIMIRWNRSDHVWNRFLILISSVSVLRFRLLLHPLPEGLGASADRKKDPAFGGKLDAPSSPIPGPPCGVDQNASPSKLSQEALIQSMDRVDREIAEVEQQILKAEDGNNNSLKKRQVNLLSLRSPLSPPPVVQNHRRYSPSGFIDETSANKQKTLIKILEGLWPK

SEQ ID NO: 949315 - protein, 71 aa, Homo sapiens
LQNRHEVAEKAPGTVARLTLAKLSCPFRTKLQNKEHVIEALRWAKYKFPGRQKIHISKKWGFTNVQVLSEF

SEQ ID NO: 949316 - protein, 53 aa, Homo sapiens
GVEDPPFPTVIYVVTHERDGKKYKLFYGMSSEMAMKKKAGGVREVQEPQTGKT

SEQ ID NO: 949317 - protein, 67 aa, Homo sapiens
SEYGSSGTGMPDTGSLLLEGVVGLPSSDRRGTGFHQIPAKRLLTGDCKFWYKSCNYEFNNLFQFIKN

SEQ ID NO: 949318 - protein, 75 aa, Homo sapiens
HFYNCKQVVDSSNYKYLYKYIHSACEEPSVLELVTPVPSPDERRGSPTAAFQSAASRVSWHSLVPLLPPFTVVEG

SEQ ID NO: 949319 - protein, 39 aa, Homo sapiens
VLVKKTEHSMFDENGLPTIDMECKELSKEAAKKLKKLFE

SEQ ID NO: 949320 - protein, 67 aa, Homo sapiens
KGEAAETVECQTQARCCWNGGVETSIPLSGEAQVSPVPAKGSSQALEFWYKSCIYRTQQLVAILIKI

SEQ ID NO: 949321 - protein, 62 aa, Homo sapiens
MPNKLAVSVCSRLYDYLVLSVVLSQDVKTRIQSRYNSSYVSERGQGVPEPGSGAALLTVGEG

SEQ ID NO: 949322 - protein, 47 aa, Homo sapiens
RLRWILHEATRRDDNSAGTQLRKLNKNEMMQSSVKVRWHTNMSLLRE

SEQ ID NO: 949323 - protein, 36 aa, Homo sapiens
ITPSHVGETCFSTQGTNGFYSQRIRYTITSLFRMEV

SEQ ID NO: 949324 - protein, 101 aa, Homo sapiens
PLAPIVSDFLKNSFTTNKRCLNRSAFVKHYGWYMFATDSCYLAGKITHVTKFGIHFQLLLVSCVLRNVYCMKNLKILMNEKCLRKKIAIFMQLCTVSLWRR

SEQ ID NO: 949325 - protein, 31 aa, Homo sapiens
MVLVSLVLVGIEDPFVFVYEQARSPPHCGGG

SEQ ID NO: 949326 - protein, 38 aa, Homo sapiens
HVVWSLFNTLFMNPCCLGFISIRYSVKSRDEEKMVGDV

SEQ ID NO: 949327 - protein, 68 aa, Homo sapiens
YLFLTGFYSRDHIIDPAYISYTNACSLSITLIATTLTSAYYTRGILLTLTGQARFPSLSNINDHTPTL

SEQ ID NO: 949328 - protein, 36 aa, Homo sapiens
EEVLGGLEGQVKVQVTKKGVIYGAKVTAIVPSNRVP

SEQ ID NO: 949329 - protein, 61 aa, Homo sapiens
ILEPPAQSQAASDPNDTGPSLIHQMSQGMMKVPYECGIQKRNSVLTTDDPGHPDMSSMCPR

SEQ ID NO: 949330 - protein, 45 aa, Homo sapiens
ICDKYLQQIFESQQYEVFRDVFKMMQAEETPKTPSQKSMDRLGKQ

SEQ ID NO: 949331 - protein, 55 aa, Homo sapiens
ELLTVCVCRPTTGGGGAYNSCSSADSAGPAHEVVIWFLFLDSALESSPSLHSPAD

SEQ ID NO: 949332 - protein, 38 aa, Homo sapiens
LEDSLALSSTATKVHQDCCERNASEEYLLCFSHMGLYV

SEQ ID NO: 949333 - protein, 79 aa, Homo sapiens
FPDALLSSSLCKAVIILGPMKDRVNDDLDLRNFQHKISDLCGATIQSPGKAQEDVTACVPWRIVCSTCFIGTRSRDHDS

SEQ ID NO: 949334 - protein, 68 aa, Homo sapiens
HICITLHSCELLTLTLTICLIENNLKPNNSMHCLLQFYLVSLLLPLPTMRSDVPSGVPDALTFCNSLC

SEQ ID NO: 949335 - protein, 34 aa, Homo sapiens
GDSKDPVQGAVHLELRLAAFAVRHSCRCLLAASS

SEQ ID NO: 949336 - protein, 37 aa, Homo sapiens
RISAMVATEDTQGSAEDMWVKTEGLGFSLTLEVEGYR

SEQ ID NO: 949337 - protein, 32 aa, Homo sapiens
DLSRLQPRGSSSSNSSAWRKVLHSCGNASSKA

SEQ ID NO: 949338 - protein, 34 aa, Homo sapiens
LEDPCLLEAGGCFFYQLTLFSSQDDIIDDVESFV

SEQ ID NO: 949339 - protein, 85 aa, Homo sapiens
MSVHMHVQHEGLRSPSPLRWEPSSQSTIPIVGIVAGLAVLAVLGAVIAVVMCMRKSSSASGGSCSHAESTYSAHGSDYSLILLYA

SEQ ID NO: 949340 - protein, 61 aa, Homo sapiens
SPPRISSVTRYRVFAIIIHIFQSDDVGVLAITAEESQSLLVVNGLFAQAKVSEFDVALLIQ

SEQ ID NO: 949341 - protein, 54 aa, Homo sapiens
SSVPHCYVPLLRAEETSSPVIGELWLFSRRHHHSCPLLEGSVSYWTCSRLDLIS

SEQ ID NO: 949342 - protein, 42 aa, Homo sapiens
ARVFPGTIARCLPGTIARNSPGTNAGIFPTIIATITLLNLYF

SEQ ID NO: 949343 - protein, 80 aa, Homo sapiens
HSTTTETTSHRTPSFTSSITTTETTSHRTPSFTSSITITETIITQYSQILDTDSAGSSESTPAVLEGLTLCAGSQRDDGE

SEQ ID NO: 949344 - protein, 77 aa, Homo sapiens
CYTFMLLQACRSVVLHIHAVAGMQVGGVTFTLLQEYRSVVLHTFMLLCSYHLHLQRCLVVRSGLGIFNLRAKTYNHC

SEQ ID NO: 949345 - protein, 58 aa, Homo sapiens
MAHLAKKPVSVCRPPRERRVDGIKGASHVSSFQGPDSNSVCDSEDQLSSRNAVVVRII

SEQ ID NO: 949346 - protein, 46 aa, Homo sapiens
MCLSPCFDITREEGVLTLWRGCIPTMARAVVVNAAQLASYSQSKQF

SEQ ID NO: 949347 - protein, 87 aa, Homo sapiens
RTPPTFGDASDIALELLNSEYEFDEGSIILNENNSVLSYKTDEKPILSLNTVTKVCQHKLSMTDIDADGACKITKNNNLANIIYYSL

SEQ ID NO: 949348 - protein, 92 aa, Homo sapiens
GVSLRRFTQNPAGEVLLVPLTWLMKDYEFCQSPRGQSSGEEDTVWFGKDGYTEPHLPSVHGGREAAKSLNKPNIFGEKDHLGDIIQGALGPV

SEQ ID NO: 949349 - protein, 34 aa, Homo sapiens
ATTPEDQRLLAHVTLELQHYHQLLEKVRIRDALR

SEQ ID NO: 949350 - protein, 97 aa, Homo sapiens
MRKGKINYNRNSSEITSYQNIISEFCSSPRTYAGFHMGTSQGTCHGRSRSRWNTGTQQHTSGMVLSCSIWASVSCNSSTVFTEPTIAMVFSVATHHH

SEQ ID NO: 949351 - protein, 104 aa, Homo sapiens
LGSPVGIKSVSLLHGTLAALVQLVPTEPLILDSEALLPASKAAVQHLAILFGLCIQCHTHLFHSLQSHVSPAPASVPHPKSNCSKVLSSAHLCHHSIAVPVHFL

SEQ ID NO: 949352 - protein, 119 aa, Homo sapiens
PKAQAPSVFRHTADAQLCNHQTCHMTAASILNYQNNSFRRRTHLTVAAARKNIPCAAVSPNSSKCARNTVADVDEKASAALYDFSVPSSETVICRSQPAPVSPTTEVSVGLINLKYLQG

SEQ ID NO: 949353 - protein, 103 aa, Homo sapiens
KFTILDCKYLRARMEEIWLACGTVCEKKFEEIRKLSCSENGEYMTVKQVGLRELNVEESYLNDDRMKTDENQPERLWGLNLWDAFLFRVSVEAYLEAVAAQVV

SEQ ID NO: 949354 - protein, 62 aa, Homo sapiens
RSGLIKVNAAAVEMIVAGTLVVQAAGASSASRRGAIWCVVHSCRVQGGGHVAEIYAIRQSIS

SEQ ID NO: 949355 - protein, 107 aa, Homo sapiens
GPVILDEDVIMISFLEASYHDDILGNRPPGLWQHGLTDSINLGHVDLTPLYTDTAVYTSESPLAREAELGSSSLTVACAVNHLQGPPVHLDETIAAYAVRHSCRCLL

SEQ ID NO: 949356 - protein, 99 aa, Homo sapiens
GRLPAPFSMSLSLLLFLKQQRSSALNPCIHKAQCKRHPLRGFSGPPGSKHQYPQAHSLTAFISFFLEMESRSVAQANEDFVSEKKKKEKEKLYLREKTM

SEQ ID NO: 949357 - protein, 153 aa, Homo sapiens
QSDSRPTPISPDYIMFQTPHHTYSKIDHIVGSKALLSKCNKKEIITNYLSDHSAIKLELRIKNLAQSRSTTWKLNNHENTYGNNFFKGGFWGSHGNNQDSSDSDNEADEASDDEDNDGNEGDNEGSDDDGNEGDNEGSDDDDRDIEYYEKVIE

SEQ ID NO: 949358 - protein, 60 aa, Homo sapiens
DIAVYHWTSMSKVTSNLRNASGCRRYACKYKLAKQVVILWYMARYALHKPRIQHTQARYV

SEQ ID NO: 949359 - protein, 210 aa, Homo sapiens
MSSDSLIFPVKAHPGVQAIGNLHSYQNFSMIFPENAGKNIYHSIAKDEHRQAWWLMPVIPALGEAEVGVSQGQEIETILANTAKPCLYYKYKKISRVWWRVPVVPATWEAEEENVVNPGGEACSELVITPVHSSLGDRARLHLKETIDERWVEGCECTAVLMRWLLAEASTVIENRAMKDEDKMEIQEMQLKEATHFAGKADRKYEEVTG

SEQ ID NO: 949360 - protein, 64 aa, Homo sapiens
MQVLEEENTQLTKIWGEKKAVLAGDLTSFCSIYSSGTNLEIQLFIFFFNPSLLKTLSAWVNFRS

SEQ ID NO: 949361 - protein, 132 aa, Homo sapiens
SYDVPDGALCNVDAYGTFQLRSLHRLTNPDCAFYYTRLQGKSKYRYGGLAPPPRATVTGYFSPHDHNVVSMPKAACVKQTYTYGILSDMEKYRMQSIRRESRARQKVTGPVMSQYDNMTPAVQDDLGGIYVI

SEQ ID NO: 949362 - protein, 34 aa, Homo sapiens
MVGRAGRPAYRSVKRVIWLDTNKSLRPSFPSGGT

SEQ ID NO: 949363 - protein, 72 aa, Homo sapiens
RGVIALVPTRMLYYKDWPANEALQHRPLEVSPIVDPQLYHVPPSSELAHNNISVYHNSQILREPESVKVGYS

SEQ ID NO: 949364 - protein, 76 aa, Homo sapiens
GIPFLAGFYSTYQLIDNPEYILHKRLTPIYYSHRYLPNKRLQHSNHSSDPNITRRTIPYLGLLTRQNLSLLLLDLT

SEQ ID NO: 949365 - protein, 75 aa, Homo sapiens
TDEAVQREMAVDLMVMRPLLLVLPGSVKRVSPGPGPEADMPALHTRKSVSVDLPVVHVGYEDILRMLAFFYGFVG

SEQ ID NO: 949366 - protein, 109 aa, Homo sapiens
RQKTKGNQRLKEVAKTVWDWELMNPIKPILQRPSEEVEEDEYKAFYKSFTKESDDPMDYITLLLKGKVNFKSILFVPTSAPSGQFDEYRSEKSDYIKLYMRRVIHHRRL

SEQ ID NO: 949367 - protein, 57 aa, Homo sapiens
MPPEKESKAERVVSSALLLGAQNPLSQADRAPQLFADPRPPPSAPVPVVSSLGSRAS

SEQ ID NO: 949368 - protein, 60 aa, Homo sapiens
LLVTIYSASHSSTVGRLGPLALNAHFVPLLSWYDTAFGSSTRVVDLIAHMASKEKNPKAP

SEQ ID NO: 949369 - protein, 37 aa, Homo sapiens
MPCLLVRIGGGLFGHTRGGTVYYTSQPPAYLLKDLIV

SEQ ID NO: 949370 - protein, 47 aa, Homo sapiens
CILRIPHSFGLPSSSRDSSPGFSKELAAALAAVPGFECVRSWIGARA

SEQ ID NO: 949371 - protein, 80 aa, Homo sapiens
EYPFYGHMLLPSAAQALMDSMGEASVVSAVSTVLVHLVLVALPGERGAAGTPSSKGDKGEPGLRGQIGNPGRDCARGAPG

SEQ ID NO: 949372 - protein, 86 aa, Homo sapiens
RVPLVCDVFCAPRVTSSRLPKRQCYRPYCWEKQRSAEVDLERVRVWYKLDELYEQERNVAHSHAKPTMGLLTLMLHQTIKNNPLTT

SEQ ID NO: 949373 - protein, 48 aa, Homo sapiens
AVQWNGACKQRRQWQGVVGDGGLTREWTKAQLLAQNQMPLGPEVFSIT

SEQ ID NO: 949374 - protein, 73 aa, Homo sapiens
CTSPKQVPAGCLCNLMGTSRVTTLRVLALPIFSAFGMELKPGLLYRVPFKAKDQAALEDGKPQDRQAAPVGVI

SEQ ID NO: 949375 - protein, 68 aa, Homo sapiens
VLLQFSCCNRDARYSVQADTALVKTPCFMGTLVCLPTTDSDHSTLPFFTQCVSGHFCGHTLLRESTVA

SEQ ID NO: 949376 - protein, 53 aa, Homo sapiens
RLRTVHSSPAVGRVIQAPDAPLTGQQQSALPGSPHGFRLRTFSSSIGLLCWIP

SEQ ID NO: 949377 - protein, 98 aa, Homo sapiens
FRRIRYPQRRACPVENYRVWLAHFAIFIAFVMIIDKLCKKDISSSMTISSVASRPPVTLRLVVPASQCGSLIGRGGCKIKEIRVSTGAQVQVAGDMLP

SEQ ID NO: 949378 - protein, 107 aa, Homo sapiens
MLSLPVSETHSRQLDAPRYPEMSGKLRRQLYGKLDKTPLIADVYYIVWWHVPPGGGGHHEETEMAPADIWPLDPLNGAVVSELRTNNDHWTASPKEDDRRKSAITAL

SEQ ID NO: 949379 - protein, 134 aa, Homo sapiens
KLFRVVSYRQPIIISIVLQSPQQLSGIHAVYYYSTGIFKDAGVQEPIYTTIGASMVHTIFTVVSLSLVERAGRRTLHIIGLGGKAFCSTLMTVSLLLKDNYNGMSFVCIGAILVFVAFFDIGPGPIPWFIVAEL

SEQ ID NO: 949380 - protein, 93 aa, Homo sapiens
PDIEHAEHEGPIANIISTWNTEDLRNRDHYLKQKRAKLMSMRKAMRTNQIQNMEQKGQPTGEVAEMTEQPEHDYAEEQQTLLKRRSLAEQVRL

SEQ ID NO: 949381 - protein, 91 aa, Homo sapiens
STGSPTSCPSYLNSDNNNKLGRYTEENSITLSTCSEAESTKYPEAVGCREILVVLQPMMAAGLATVEGKLTEGFLTQVFVPQDFSVDLQST

SEQ ID NO: 949382 - protein, 47 aa, Homo sapiens
GSEGQLKSLVGQRLELGSPQSLRLPRWPALLPSSAEAPPGFTAPNCF

SEQ ID NO: 949383 - protein, 64 aa, Homo sapiens
LRRVVRVTLVTVILVLHENVDALSNSTSRSLNAVTINYQILVSHCTYIISVSTLFDSPLIFNQS

SEQ ID NO: 949384 - protein, 71 aa, Homo sapiens
QLAYVLPVFHVCHGCEPQPPHYAAGALPIFSAAYGTQGPICPSVAVWPEWVPSSPTFVLAQTFWQVVWGLT

SEQ ID NO: 949385 - protein, 133 aa, Homo sapiens
PTSCPSYRNSNNNNVLKNNRRELKKLFRHVVRQSLPSTLKQLGAANPGGASANDGSKAGHRGRQVTEGFLTQVSVPQDYSVDLQSSGVTARENPPDHLRLALPGSLSNALRARSSEQSLCFSFPNSDNSSGTE

SEQ ID NO: 949386 - protein, 68 aa, Homo sapiens
DVVLCFPSLAMCSPCACLPFPPAPPGPTRNPCSAVTEACAQPPWSFFGSQGSRRIVFREKYISKFLDL

SEQ ID NO: 949387 - protein, 51 aa, Homo sapiens
FQGQAGCHMHPIMPQAPYPSSGSLWDAGPILSLGRRVAGGGSVVPNSRARS

SEQ ID NO: 949388 - protein, 73 aa, Homo sapiens
YNAQEVIQQFIDVPSVAVKKRVLCLTRDENLIATEVWNTCDRTANVAILFSGGIASMVHSPPLLTVIIPFTCN

SEQ ID NO: 949389 - protein, 39 aa, Homo sapiens
EPDRDIHRKVMVYEDSGFIAPSFICFICVNSSSSLKRNR

SEQ ID NO: 949390 - protein, 55 aa, Homo sapiens
LYEDPLAGNGLEPGGKCTRLACFGDKGKGPGRMSQTVQPGVYIVLDLWEEEVSSL

SEQ ID NO: 949391 - protein, 205 aa, Homo sapiens
MSETEILDVRMDVATSELHGNSWRSSQIFRVKVWAIFPLLFLLPQLRVKRFSAEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKAPLQAQNCSANHCSNAIRAA

SEQ ID NO: 949392 - protein, 81 aa, Homo sapiens
AIRPTRDDFHLYQQTLSALLPWCRRLRLSQGLFLRGGLLGLRTQYPRLGSCIFPVLASERDLVLHFGGAQILARLMFLAKI

SEQ ID NO: 949393 - protein, 75 aa, Homo sapiens
PFPSQEKVVPLRDIITPNQFEAELLSGRKIHSQEEALGVMDAALLCGPDHRVVITKLLTCPPQGEKLPDLCCRSQ

SEQ ID NO: 949394 - protein, 36 aa, Homo sapiens
MAKAPFPGLVLHTGWSSAERWCKRHGLLTGHLEVIG

SEQ ID NO: 949395 - protein, 32 aa, Homo sapiens
MQNETWRRAKLQVLRCQVKGVHSWILFTSGDG

SEQ ID NO: 949396 - protein, 149 aa, Homo sapiens
KTPSVYKEKVVPLEDIITPNQFEAELLSGRKIHSQEGALGVMDMLRSMGPETVVITSSDLPSPQGRNYLIVLGSSEEEESGGSVVLERIRMDIRKVDAVFLWALGDLFAAMFLAVTHKHPNNLKVACEKIVSTLHQVLQRTIQCAKAQA

SEQ ID NO: 949397 - protein, 49 aa, Homo sapiens
MELADLTLPRTQYELTLESVTVHEKKFRKSEVRVTLFMLLNGQDGEQKS

SEQ ID NO: 949398 - protein, 41 aa, Homo sapiens
APWAQMGIKMTVVRGTQAEGSYGIYHGLEAALSRLGCSDRQ

SEQ ID NO: 949399 - protein, 102 aa, Homo sapiens
HSASAMTVYALVGGVFFLITGGIIYDVIVEPPSVGSMTDEHGHQRPVAFLDYRVNGQYIMEGLASSFLFTMGGLGFIILDRSNAPNIPKLNRFLLLFYGFVG

SEQ ID NO: 949400 - protein, 105 aa, Homo sapiens
SNRNRTSLTCAVYHMEPDHPAAGLSSSEPVRLVYFRGNCGDSSSMYSLEGNMVEHSVPVVPGAADLVEECDPALNPDWLQRGLTDTPRLKRCAADWGPAPAPCAG

SEQ ID NO: 949401 - protein, 96 aa, Homo sapiens
SLYSHRKRGLEDVMEFAPSNGGAEMVTATVSWPGGVTGMLLGELQITASPSTRAGCGGDSPKRHSNSSSSLRAGRGLTVSCTSPWARRLMFYGFVG

SEQ ID NO: 949402 - protein, 74 aa, Homo sapiens
PHHSVAAFLWEGLGPRALGWPVGCHRFILGPADNHDIISMKLFQLMVEHTPKRERASSVDQRSEPSGQSSFKFA

SEQ ID NO: 949403 - protein, 66 aa, Homo sapiens
GHVTRSHKPGRSAGELAGYIQAVWPSSHQNPENRKYGITRKDRGKPIHCVTQGQRTFGPIDVPGHQ

SEQ ID NO: 949404 - protein, 62 aa, Homo sapiens
RVPAYAVKSQFPFIFRTSVVNVFKRLGLIQEEVPKLCVPSLPVDLDSPMNPSRVLDSVSLTV

SEQ ID NO: 949405 - protein, 39 aa, Homo sapiens
TEELLSPSNYSLGCKASHDDSGPAWSTFEHCSTTRIGPG

SEQ ID NO: 949406 - protein, 42 aa, Homo sapiens
REFFPFSKQVRERAELSGKIHRRNVIITEISDESARGRMNAL

SEQ ID NO: 949407 - protein, 54 aa, Homo sapiens
SKEEGGLSTMEGLELPEDEEEKKKIAEEARQEFENLRKAHEEKSLIREVEKRDN

SEQ ID NO: 949408 - protein, 93 aa, Homo sapiens
LADLRTLCSARSGWLYAALYVTPLILSSYRRKGDSRPHLQPFFEHPDCCQQTYSGTSLVLVQDRNLQLVCCYQQDYRHHPVLPQHLDSSVLIQ

SEQ ID NO: 949409 - protein, 100 aa, Homo sapiens
TDRFPEAGLCHYAAVGARGFPDPGMVLSWSGAFMSPRVWLTHSTAYSCRPRSGPACGPASSGNHVVSPANGAIKCRAWTLSEFEKVTNSSTSSSYNSGDA

SEQ ID NO: 949410 - protein, 36 aa, Homo sapiens
MIPERGEVVGQDSSSRCQWLKTAPPPASGAQEPLPA

SEQ ID NO: 949411 - protein, 80 aa, Homo sapiens
VLEVPFSAHWSPRLVTRCGPEAAGLGADAIAPTAPGVHGVSVKLEWEQDNMRAALDLCEEALRGYEDFPNGCGLINAGTI

SEQ ID NO: 949412 - protein, 123 aa, Homo sapiens
NRLLSRIPRKRKGGPEYWDGETGNVKAHSQTHRVDLGTLRWYYKQEARPGSHTPDGCTGCDVVGLGASSCGYHQYAVRRLVITSALTRGPALYGPAVGLLAASEPTKAQSREGGPMLAEQFEK

SEQ ID NO: 949413 - protein, 44 aa, Homo sapiens
MDRRKKALIRLLETLRGLLSWRRRSISCRRLSKERGAPLSDELG

SEQ ID NO: 949414 - protein, 62 aa, Homo sapiens
IEDPSKEKGGLVMSQTQEQEVMLLTQVNTALDNKASLLHINAYSLLFDALRDYNSHITSSDK

SEQ ID NO: 949415 - protein, 142 aa, Homo sapiens
DGFRVVNALRYDVEYCHIFERSCPLCYDTRLGQWQKSILAVGIAGMMTTEEAGTAMKTDMTDGMIGRGAPELIPLGMIIGVMIEVPPKTKLNLKPRSPPKDDDSSAQYLTVHSKLILSLEEQSLLTQLLEKERSKHVIEEPI

SEQ ID NO: 949416 - protein, 132 aa, Homo sapiens
MNPRKSKVVLGKSLPWYSCEETSAAVDASDEEMGDAGQPPIECPFGDFTCRHQLVLDHHVTWLGGTRLSSAQIVLTGARTDRRSPGTGVCTLGKTLNSVTSAHYTYADPSRLRYHMRIHKEEGISLCPECGY

SEQ ID NO: 949417 - protein, 50 aa, Homo sapiens
YTNTKNIPKTWRRSIMEYFEEAMTYYAQSSRRYNGPRTLGMLGISKRGCS

SEQ ID NO: 949418 - protein, 158 aa, Homo sapiens
SLRNVLSPSVLFFMELIAACSRMQRNEQTPVQALLLPSKKRVVEVVAEVGAPVADGLVVCGVEDLGGKRGPVGCRRRQREKMKEESVAHLLILHVVDHLTRPPAGSQRNHEQQHQRANAQQVGTVGEGHQDDCHEVVYHLLLEILALDIMGSLISSDE

SEQ ID NO: 949419 - protein, 54 aa, Homo sapiens
EDPFSAYLVSEVSLAPFFALSYSYINGFVAHFYRSFLLLWVAYLLSPFQHMPGA

SEQ ID NO: 949420 - protein, 50 aa, Homo sapiens
MPSLRDACDSDGNTLASPNSETGPGQPNSGDEDIDSLQRMVQELRKDIET

SEQ ID NO: 949421 - protein, 41 aa, Homo sapiens
ANLRAGGCRGRRVIGHTRLQASSSVKVHCMKLMKGSAPGEV

SEQ ID NO: 949422 - protein, 106 aa, Homo sapiens
PRSRPTLLMVPLFPGQVVFFRSLHWTLSLSPLLSHSAASGGVCCASLTLVECGFNVLTLSRVAYLHKLLGILHGIFVSYLYILHFICIKTHNIILRPLYFFLQLPL

SEQ ID NO: 949423 - protein, 46 aa, Homo sapiens
ISTGLGSSILRSSVASKYWKDESINLRLSQTRHFLMRDRYLLVREN

SEQ ID NO: 949424 - protein, 84 aa, Homo sapiens
RIARPTLRVLTPGRPRAGTVCSGRLCQSLVPWMRHGIKSSVQSFQRVTLSPKFGSSCKGFMFCDGEHKKKPLPHSERSYSRMAA

SEQ ID NO: 949425 - protein, 54 aa, Homo sapiens
STNDDVLGSLNDRPSFPLLHGLLGTNIDRRPSSQIATYTAFLGNLPYHVIEEPI

SEQ ID NO: 949426 - protein, 75 aa, Homo sapiens
MIVLLGRDSNRDSDKTDTGLEGLVLLQTALMTTHLEEVMNAFGDKYRDRNDSDRYRDGYRDGYRDGPARIWIDIV

SEQ ID NO: 949427 - protein, 106 aa, Homo sapiens
LSGLVSSILRSSVASKFWKLVLNLRFPSKNFLSEQILLVEEQDHRDGAQPSVVPDALNEFRSLLQSLGLFVLRVDHLVAAAGRHVNIMAVTSLKHWIHLRAYIALA

SEQ ID NO: 949428 - protein, 40 aa, Homo sapiens
MKLRISETQKHETSKSPEKDVSQWIEKKSKKPKKKEKKHK

SEQ ID NO: 949429 - protein, 48 aa, Homo sapiens
NSVALIWCAKIHSCDEECLAYKHYKVDDIIIVTVIIIKPSRAEQNMTG

SEQ ID NO: 949430 - protein, 32 aa, Homo sapiens
TLKRIPADVTVPSTSCDKIDVIKQADYMPERS

SEQ ID NO: 949431 - protein, 68 aa, Homo sapiens
LDHPLTFTPMAPQYNLIWPLPTHRDEAYNKRIISTTPATCNTSGIIPPCLQPIATSLHRATVPPADGQ

SEQ ID NO: 949432 - protein, 73 aa, Homo sapiens
LRIPTRTAGSNAGDSCRNAIPEESGDEDEDDPYKGHLDLLLLQTNCLLEEFSDIFKRRERGAAKKLFQLQKRP

SEQ ID NO: 949433 - protein, 69 aa, Homo sapiens
FSSLVFFLFGDFFLLLLVFLFFILCFDSLGFLEVGRVLAAPSPSSSESENSSSQAIRLAEEQIQMRLSG

SEQ ID NO: 949434 - protein, 109 aa, Homo sapiens
APRVQMQAIHEDAIPEESGDEDEDDRVEGASQICSSDKRIACEEEFSDSEEEGEGGPARNSSKFKKAKRVKTEDEKEKDPEEKKEVTEEEKTKEEKPEAKGVKEEVKLA

SEQ ID NO: 949435 - protein, 52 aa, Homo sapiens
PTLHAVQMQRFLRTHPEESGDEEKHDLGGAHLDLLSDKRIAVRKSSPILKRR

SEQ ID NO: 949436 - protein, 37 aa, Homo sapiens
MCTVHTNEQFINWPWSEFFRTLIAALLYLITSIVVLV

SEQ ID NO: 949437 - protein, 115 aa, Homo sapiens
SSRSLIAFVSRKPPEYEGLSRPQSHPVKVGTLAQEEQREGEELRFTRLESFLHDSWRQKHDKVCLRRLEVKPHTLESPDKHSLDFVVRVERIDGVSLRVRRAIARLKPKNAAYSM

SEQ ID NO: 949438 - protein, 49 aa, Homo sapiens
LQWETLLDGNAMSMEASRTGFCCYHASCYFSQEPRKFHLMLNHAEGSWG

SEQ ID NO: 949439 - protein, 74 aa, Homo sapiens
MNSETSSAARPSGLQEESQHHGSEQQPATYAQGLRSPQAAMTPGIPIFSPMMPYGTGLTPQPIQNNNSLSILAE

SEQ ID NO: 949440 - protein, 47 aa, Homo sapiens
SDQAVIRLTVKAMQSPNEGAIVEVALEWYYKDKLFDQREFVFEIGEG

SEQ ID NO: 949441 - protein, 44 aa, Homo sapiens
MSHAWSQDCLQGLFPEIGSSSYQDKPPVSVWAFAGHSLHENMAV

SEQ ID NO: 949442 - protein, 137 aa, Homo sapiens
QAVKYRLNISLSHTGQHTSRCPMKHETGSWKSHWIWAAPPSALIFLQEQFCLFCMPGSVTEELKHFLTLKYKTFGTDSPVTGYLGIPHPQQKKKIQGQISGMFGKISGGLNFVGKRHYEIFLTLKGHFSLRLTEPHL

SEQ ID NO: 949443 - protein, 167 aa, Homo sapiens
LLRRVKFIHFTTDRWLWVSSAQCPFQKHSALAAYAEVTMVDSHTVSPPSCIGTVIAAGGLRRATFIDVLASSTELFILEAGGTHALVAPQGVVTGGSSADVSAEAFVFINTLVPLVVLEVALGAAAPVAPNDVLAVMLAAVVNLTLVHVFTAGAGSDQVRIPVGIHR

SEQ ID NO: 949444 - protein, 39 aa, Homo sapiens
AVIQTQVVIDAGAFAVFPSLLTNRKTNIQKEATWTMSNI

SEQ ID NO: 949445 - protein, 77 aa, Homo sapiens
LKIPEMQLMQSDTKMEEHYVVAVQEWNCRMVKKEVEIVAQLPLGVVAPEMIIEEESSTSSQISKKEKVLSQPEQVPF

SEQ ID NO: 949446 - protein, 41 aa, Homo sapiens
KQINTDSVLCLDAGELAVLPSRVTNPKTNISEGSYVDDVKH

SEQ ID NO: 949447 - protein, 32 aa, Homo sapiens
MGKLRIEIGTLGKADTSMRSLTKSGNKPSEKK

SEQ ID NO: 949448 - protein, 94 aa, Homo sapiens
MAEYLISLSCFPLNVSGDPDPIIMTTEHAYASLMPLFYMGGNLNSYSMRGYTCAYLVLQFKFLGSQKSLLGSDYVIGTRASHFRFCHKISGNPK

SEQ ID NO: 949449 - protein, 68 aa, Homo sapiens
KQLIQTHQATDLSSTMHVLTYSHDSPKATPVLKGLDFNDMSGVETNSQGDRLLSIQVSNSATGSTIQC

SEQ ID NO: 949450 - protein, 70 aa, Homo sapiens
HRMPKRPSSSRRSPSWIGDGESTTPSDKVVKKGKKDKKIKKTFLEELAVKDNRAGKEEKVLKEKEQQQQQ

SEQ ID NO: 949451 - protein, 90 aa, Homo sapiens
HIRLRVSDRKELYCHGMPKRPKQQRDAELIGEGESRTPSDKVVKKGRRARRIKKRFLEELAEKDNRAGKKENVLREDGSRSRRNSTSLPC

SEQ ID NO: 949452 - protein, 81 aa, Homo sapiens
MRRQRETPRKRERDREREREGESERERERKRSKPTHHLLDVSQGVSGLEERTYSDNAVCGPVLFFFFFFSYYNWGVSLYKV

SEQ ID NO: 949453 - protein, 78 aa, Homo sapiens
FRCSSSLSPRGGSVETGNEDMKSSDRDAAETLKLFPEGLHCLDQGHHLLLHPGLEPACHRGLQPLKHGLEPSHDLCTQ

SEQ ID NO: 949454 - protein, 72 aa, Homo sapiens
CLCASSNLTCDREEYVQQIADALQYLQNVSGDLFSQVGSATHPSPDERAILVLARIPVNTASESIPLAGLPF

SEQ ID NO: 949455 - protein, 83 aa, Homo sapiens
RATGHWVQQQSIAFLRAHGLALRLLVVMVKDHVRGVLRPPVRLTKVLLAKLMDLEDTIIDVGDTIDVILKDVDADGVTEASFA

SEQ ID NO: 949456 - protein, 72 aa, Homo sapiens
ARPSLTFLITRPTGYALQVSDYPCCISCERKSNGKLLKKGRYDCEQRVRTISIVLPTPLCNFIPDTSQCHLV

SEQ ID NO: 949457 - protein, 63 aa, Homo sapiens
LFVSADYCANHIEQIAAASIHCVWITNAAILWLWSTHYRVNTRFACTPSEDPQFPLVQWSARE

SEQ ID NO: 949458 - protein, 42 aa, Homo sapiens
RIEYRLRRERNNIAVRKSRDNGPSSCNVRDAADKVLAADHVT

SEQ ID NO: 949459 - protein, 90 aa, Homo sapiens
CLFMWQAATKFTGCPLHLCELGVLAGGTCQASIDPFLDCPQQEDSGVGTPHPVHGGGSHLLEVASAVSAAEEVVHVASDGWEDLLGLAIC

SEQ ID NO: 949460 - protein, 44 aa, Homo sapiens
MSDDRLSRPGDDASPEPWFSCIQNKPLYFADRLYDSMEGQVGQR

SEQ ID NO: 949461 - protein, 171 aa, Homo sapiens
MCPYTRIYLVTMVPSLRLGTTLGHNDKHTGRRVKHDPIDVCKIGSKVCARDKIIGVKVLGILAMIDEGETDWKVIAINVDDPDAANYNDINDVKRLKPGYLEATVDFRRYKVPDGKPENEFAFNAEFKDKDLAIDIIKSTHDHWKALVTKKTTGKGISCMNTTLSESPFKC

SEQ ID NO: 949462 - protein, 68 aa, Homo sapiens
AAGKEGCDINAIIFHTKKKLSSVRNSKTDLGEIYGSVSYSKKVKNMYNCGLSRNGIGHSPRTERTLQG

SEQ ID NO: 949463 - protein, 29 aa, Homo sapiens
GDIVTVGECRPEQDSAASTVLKCHQWLPG

SEQ ID NO: 949464 - protein, 73 aa, Homo sapiens
AAHGTFFKMFATVALVDVGPTVYVVMTSVLAVPPVPELVGRGRQLRVLSFQGFHFFLQPGDSLHFGLQSSVEA

SEQ ID NO: 949465 - protein, 40 aa, Homo sapiens
YTFCNEIFSRFSVSKMAAMGSGVSDDVFSSSRHESVSKIS

SEQ ID NO: 949466 - protein, 82 aa, Homo sapiens
TLQRNFEQIDHVWGKHTKIAYERDLETRAYIGDTYCHFQKMLVVLLQGNQGRRNNVMGRGPWYNEDGPGPNTKAGARVPKLR

SEQ ID NO: 949467 - protein, 43 aa, Homo sapiens
SRGSRKVIKAEVSSVIFSLRNIITSMCLTEAPCVLVHCNTVST

SEQ ID NO: 949468 - protein, 40 aa, Homo sapiens
YRHYAKQKTFFLKEEEEEDMILHRGPNTEWWELEVAGGHG

SEQ ID NO: 949469 - protein, 57 aa, Homo sapiens
MKLVGYTCPGCTKCPEVFEDVQRCHFTRPRKLEDAQAGSGTIGRLVSSVEGPLEDPE

SEQ ID NO: 949470 - protein, 48 aa, Homo sapiens
WHRFLTLAIWQIVDPLHRDIETFAKEGPKEDIDVSILPQLEHCRSSKM

SEQ ID NO: 949471 - protein, 51 aa, Homo sapiens
FPSGDADQVALNPQNTVFDAKRLSGRKFGEPGGAVATCKHWPFQADQLTET

SEQ ID NO: 949472 - protein, 83 aa, Homo sapiens
FPRANAVLLLLGLRQVEGRRCGKVGGHVPRTWYLYPVCAAQYADRSKEVGVLSAVSTDCMEGHDAVRFVTNAPIPDLVSELRA

SEQ ID NO: 949473 - protein, 48 aa, Homo sapiens
MRCPWACKKGAKLTPRRRRDIYTKNDAKKIQKKYDERKKNDKISSLLE

SEQ ID NO: 949474 - protein, 147 aa, Homo sapiens
TKRSTIHSCFGMISKQDNGIPCASTYDHFPIMPATINKHISSYSISSPELVKTFSVCDYFLEVMTHTLFYMSRLSCGHSDFRMQQIMGSQFKMVWAVWSSSFPELTELRLPAWLEMALTMTDVLRCRSGRPVHRVSGSSLIVGYYAC

SEQ ID NO: 949475 - protein, 104 aa, Homo sapiens
MTSLEILSGHGDPGWTPWSLHAPVCAQWPHEYTCARCCSQCVVGLRCPGQVPVRSWCRHVEEVGYWTQSVYLHIAQAVRQAGYGWQVWCMCPGGCREGPSEASF

SEQ ID NO: 949476 - protein, 101 aa, Homo sapiens
ALADYISATKEVTPFKKVRDLAENHHSVDRSKRNIIGYSEQQDSDKYRVIDRVANIWHDDCAFLSAFGDVSKPERYRGDNIIYKPTGHSAPDMVYLGTTLR

SEQ ID NO: 949477 - protein, 64 aa, Homo sapiens
DVSKNLHLQSFCQSPYGKTCDADVVLWNRIIPNCPACGGQNRILPTWCSFMVVITARLGYLRFG

SEQ ID NO: 949478 - protein, 51 aa, Homo sapiens
MNGCYYEGLCVSDEEYANELILGLFVVRTIELVIIMPHMDSTRKGYNRRSR

SEQ ID NO: 949479 - protein, 53 aa, Homo sapiens
GGSDRARYQDLSQSKKELSATEGMEPIAVRANPLSLGGKQLGLTSFYIIAGHE

SEQ ID NO: 949480 - protein, 104 aa, Homo sapiens
EAVIELVYPRDGDYHSFTGFGIGGGVRGNVLRAGDGSQKYILKGGENDKETFLRVGEIAKYIDQQGGAETNHNGGMSSVKALFAYFVDLQLLQAIWMYNRRSRD

SEQ ID NO: 949481 - protein, 65 aa, Homo sapiens
SPRLNHRGHGHEVRLSQSRCLSEHAQLPAPERHSEFVTSVQGTGRGERAATLHQGQCHDDVTMEG

SEQ ID NO: 949482 - protein, 50 aa, Homo sapiens
YARSIIEARRRRSLCLELVLRSTLRSTDVQLRHPLLVSSKATVTSVGLKI

SEQ ID NO: 949483 - protein, 98 aa, Homo sapiens
SRGSDIVSQWVRTQNMRRLAAKYSSGYAACPQAWQVVDTNALWLKDNICMSLHLARLHLDALTWAIVVVLKELYTLLNENYVEDSLTNIVRLDYSPGV

SEQ ID NO: 949484 - protein, 44 aa, Homo sapiens
RKIDQPIPSRIPGLAGCQPQPKRNEQRIELFQILRPDEHICKLA

SEQ ID NO: 949485 - protein, 118 aa, Homo sapiens
MRRQQAEYSSRIRSRPKLASGNTIARGAEGHIRRALHLPRVHWDVWTWAIVCAKRTLHPLELRTIVKIDDNISDPDIPGVHIVGFRATGCSPQCTVAYECLKSEIGWFISAIPAKHSI

SEQ ID NO: 949486 - protein, 67 aa, Homo sapiens
AIVSYLANHQRQGHLLFLTHISYTYYFYVNATAKKQNTTKNSICHLWPNTDEYARALTCLQLACAWH

SEQ ID NO: 949487 - protein, 55 aa, Homo sapiens
TVDGHKDIQMPDGIRREEYVQWVELLPETQTPSWMGLSNNVERVLLTTQGVYVIS

SEQ ID NO: 949488 - protein, 75 aa, Homo sapiens
MSLVRMETVTQECQRQRAAQEDHLFRKFHYLPFLPSTEDVYDCRMEHWGSDEPILKHWELDAPSSLPETTENVVC

SEQ ID NO: 949489 - protein, 51 aa, Homo sapiens
LPRRCCVCCLTCRRPVLLLPQSCQLSDNVVPPSRAAAAPAQQQQHRDAVAA

SEQ ID NO: 949490 - protein, 89 aa, Homo sapiens
GFQAYEDMMSSDSRAQKLWKLFPEGLHCIGPRPPPSPSPHGQIAPVPPGLQPLQHGLEPSHALVTEALPRLLDSGILNIRDRGSVASAP

SEQ ID NO: 949491 - protein, 52 aa, Homo sapiens
RGFQAYEVGLSSVVQSFLAPWLSVSLQALTSSSFKRPTMTLGRHQVQQQSWR

SEQ ID NO: 949492 - protein, 47 aa, Homo sapiens
DGGAVGVSTVSTGWTEDSALMVTRPSWNGLPVSMASTCYWRYHESIS

SEQ ID NO: 949493 - protein, 55 aa, Homo sapiens
MVSKCPLYTRITIMQSQYPVLSASHFTKTTYFLLFLFGRHMELTDVADQFYSTTP

SEQ ID NO: 949494 - protein, 95 aa, Homo sapiens
MEYLLQKKLPGEVENYQQLQKDLSKSMSGRQKLEAQLTENSIVKEELALVDEYNVVFKLLGPVLVKQELGEARATEEKRLDYITAEIKRYESQLR

SEQ ID NO: 949495 - protein, 125 aa, Homo sapiens
RFLHFFKKIVLYMLRFIYAGHELKTDSRKAVPTREGPEVTTPAWPGKHGCSDPSFLLPTGVAHLGTHCELLRGTLVGSSHRLSQCLRPLHCLPGDLAPLAPVPPAVRAVALKVVDGQGAQPLGHG

SEQ ID NO: 949496 - protein, 134 aa, Homo sapiens
PGLGSCTSMPSFSSRGMAWRSSTGWILADGTYSRGPRMSQWSPAWCETFSSSSPSSRGCRALSSSPCCSDSTYTSWMPCSSCSPGWRKKDFSPLTTRFLPQLILAIRSDRDENHAVVVGAQGGDGHNPQHLLVD

SEQ ID NO: 949497 - protein, 78 aa, Homo sapiens
FACSGSLTVDVKVRTGSTLIPDWFMAVISIDTTGEPFRLIYDTKGRFAVHRLYTLGGQVQVVQSETDLGGHKRNPVIW

SEQ ID NO: 949498 - protein, 164 aa, Homo sapiens
MADYYCQAWDSTSGVAFGGGTRLTVLGQPKAAPSVTLFPPSSEELQANKATLVCLIRDFYPGAVTVAWKADSSPVKAGVETTTPSKQSNKQVRGQQAILSLGRLSSGSPTRSYSCQVTHEGSTVEKTVAPTECHRVSTITPSRENELRIPGRGSPPPRNQLGTS

SEQ ID NO: 949499 - protein, 92 aa, Homo sapiens
MDLLGALTRTLGICLRRKMLLLDCNPEGDGLKHVLKTVASFNAPPYPCKQSPVHLAAGSGLACFLLWQLQTGADLNQQDVLGEAPLHKAAKV

SEQ ID NO: 949500 - protein, 111 aa, Homo sapiens
MMPGALRNLAKASQPQSITLWLRHMSMCGSRTWASVPQGSCGTTVHQLCFPFLPCCSATGWRKSLPVSRVPAGPTHPTVEIGPQSWAVMGVQGLARLGSLVLKRDLPEASM

SEQ ID NO: 949501 - protein, 143 aa, Homo sapiens
GDSDYHRDSCADTESSKRHAVASKAFATDFHDKAAAKKLINDYVKNGTRGKITDLIKDLDSQTMMVLVNYIFFKAKWEMPFDPQDTHQSRFYLSKKKWVMVPMMSMHHLTIPYFRDEELSCTVVELKYTGNARALFILPDQDK

SEQ ID NO: 949502 - protein, 61 aa, Homo sapiens
LVLLSKHTSSAESERSYKKSKKHRGTVRRGDIKSDSPESDAEREKDRQEKDRESENDRTRQ

SEQ ID NO: 949503 - protein, 50 aa, Homo sapiens
MFTYICHITTSLYRAQQIIQLNIQASPKVRLSLANEALLPTLICDLLADE

SEQ ID NO: 949504 - protein, 145 aa, Homo sapiens
QGISQQCQLLVQPLYLMSTEPLGVTETDICNAAEKTKELVGISYENGTMIQTPKAVQDSGMEVVVETKTNLDHRKNVKRFALLCSPNPEHQCDGNLSVGGQHHIPLEEEGVSHRQLVSVEAPGVDSPHCIILCFDLHSNSRGTSC

SEQ ID NO: 949505 - protein, 117 aa, Homo sapiens
MNHVAHGLLDLEGVHDDSGTRSIRKDVEQSVRTADVIERHLQLVHCLQEQPITLELQVIRREGYPFDQVKVPNEWLRIKKPMARHYQTFLHLGSTQVKGALVVGTGHGGQIEVTHPV

SEQ ID NO: 949506 - protein, 53 aa, Homo sapiens
LPFSEGITGMRHSVGLRVPGRLYGSCRSARTPPPPAADTKLLVHLLQENASKS

SEQ ID NO: 949507 - protein, 97 aa, Homo sapiens
GAGSDIWASIGLSGVHWAKVTDAAGILTCAAGPFPRVLGLSEGATTEEVHRSYQELVKVWHPEHKLDQTEEAQRHFLEIQAAYKVLSQTRKPWGSRR

SEQ ID NO: 949508 - protein, 79 aa, Homo sapiens
IPLRIGGLVEDEIPLSEGKSSTRGCQSRTGPSGDPLQNHMGLDLAYSPQTGFKAVVHKAWYLTFIKISCLKYSTLPQMI

SEQ ID NO: 949509 - protein, 89 aa, Homo sapiens
TVLRDATLSDIKAPIRKHEAFESDLAAHQDRVEQIAAIAQELNELDYYDSHDVNTRCQKICDQWDALGSLTHSRSVALEKTEKQLEAID

SEQ ID NO: 949510 - protein, 119 aa, Homo sapiens
SREYIVGMSLEYRTDKAAQRDSRTAEAASSEMAAYFTHSKPADLLHIILVLRTALNLYFNAQELQDRCQLCYGAYYNSGPSLRLAHKTRTLLVCLLEESHRIANQLNIDMHYLFDICAA

SEQ ID NO: 949511 - protein, 82 aa, Homo sapiens
NWFFDDGGKEGNWVKLSGWAGGQGTGEDILEAAVGVCVGRGPAKTLTPSGSAASPPSASAGPGRSWHCSYTGLPRSVIEEPI

SEQ ID NO: 949512 - protein, 91 aa, Homo sapiens
VPISLTPGGEKTARVFAKRQWVTLFSAPNYCGELTMRGAMMMCGQRPFMCSFPVSSKPARQRTSGKYWAVPVAVNPWSVAADWEIHLDVDR

SEQ ID NO: 949513 - protein, 33 aa, Homo sapiens
MPKSAGQSDINTLPKAENSELARQSPWSVNVFR

SEQ ID NO: 949514 - protein, 41 aa, Homo sapiens
GYEFLCQAELVTLFSAPNYGGEFDKCVAAMMSVDRDPLCAL

SEQ ID NO: 949515 - protein, 34 aa, Homo sapiens
PPLTAPLQSLPKLFHGLLALDGGPLLHIPPNLYG

SEQ ID NO: 949516 - protein, 92 aa, Homo sapiens
MFLLLALLLRTQLPASPDAGGRAALPGCQEVCMPTVLPCLSPQPGSACSTEEHRGCMGGLEQGGSPLAWRSHVCTSSALSPCLVGSVHQGAS

SEQ ID NO: 949517 - protein, 55 aa, Homo sapiens
RKATAGFLVEGGMLKGLLGVDWMLRCGGWKLCAHLGTHASVHWLPGDSKQSQRSL

SEQ ID NO: 949518 - protein, 185 aa, Homo sapiens
RRKGSKWCRPCKEKILMWKQLTQRETALGGYFLKQESGNLVLTVVMDFPGPLNIETKSNALDIIFQTDQQGKKKGWKLRYHGDPMPCPKEDTPNSVWEPAKAKYVFRDVVQITCLDGFEVVEGRVGATSFYSTCQSNGKWSNSKLKCPPVDCGIPESIENGKVEDPESTLFGSVIRYTLEEPYYH

SEQ ID NO: 949519 - protein, 46 aa, Homo sapiens
ADDPECYQLQNFTLEQEQCLVDGYSPNRNEPLTGNSDLPFWAVILI

SEQ ID NO: 949520 - protein, 55 aa, Homo sapiens
LTYIVSTCQRLFTCQRRGHLSRVSYGRSGLYSLSSVVTVPSSSLGTQTYICNVNH

SEQ ID NO: 949521 - protein, 47 aa, Homo sapiens
MRHSERIPEPNDADSPKFKTTVGSVKWVPENSEIVWSTKSRSLNAAS

SEQ ID NO: 949522 - protein, 30 aa, Homo sapiens
MAVMAVTAMTSSTGYLPSLVVLRRSLNAAS

SEQ ID NO: 949523 - protein, 40 aa, Homo sapiens
MRSSMVPFHQHAAGTTSNLAVVLPVKLVCHLDPNPCKFAQ

SEQ ID NO: 949524 - protein, 72 aa, Homo sapiens
FSLVAIWCVPPNPWLLVCRRIHGSWAHIPIQHGAGIGRGERRCRSGAPSANNSLNDFEEQPGQAQPTDIFTS

SEQ ID NO: 949525 - protein, 77 aa, Homo sapiens
RRRLEDFHSLRSNQARVEGARVEKEKCPLGDRGGPQHGRPPKPHQRSFHLSSVGCIIWERPSKNFGYTLSGECTDTE

SEQ ID NO: 949526 - protein, 40 aa, Homo sapiens
MLGNKACHRSHLLFMRSPLFLHVSVFYWDLYGANLATNAW

SEQ ID NO: 949527 - protein, 45 aa, Homo sapiens
GVGEAPKGYSPGVTCWCSSCHKFSGQYWEACCRFLISGLLMGGKM

SEQ ID NO: 949528 - protein, 36 aa, Homo sapiens
RTTGPKNQKRGKPSEQDTKRRHGRQKIRVEGPSNVR

SEQ ID NO: 949529 - protein, 62 aa, Homo sapiens
KLNERISINGGYLSILEWILEKKDAMWIGSLNRTVLENSTSYEESKNLLDKNKILDPDYFIL

SEQ ID NO: 949530 - protein, 39 aa, Homo sapiens
LHSVTAMSVTCTYSPALNKMYLPTGQDLRLLQLVGMIPH

SEQ ID NO: 949531 - protein, 70 aa, Homo sapiens
KVQCTEHKDSLWGPGAMESTLMEPTTPGYPQTTCTEKIRVEGPERTCSGVDALSMDNGTPDVQADILDDS

SEQ ID NO: 949532 - protein, 107 aa, Homo sapiens
MRQSSALELLNSGYEYDAGSIIFNQFRSVISYKTEERPIFSLNTVASADRMSESNNDIDADVLQNYQEYNLANIIYYSLKESTTSEQSARMTAMDNASKHASETIAQ

SEQ ID NO: 949533 - protein, 39 aa, Homo sapiens
NQQRSNTSRRSWGPPSPLGHVANFFSNSLIKSHYLSVHG

SEQ ID NO: 949534 - protein, 65 aa, Homo sapiens
MALLLQVWVAKSVHTYHSVVAVTVPAGSQTDYVNDSKGGKESISDEQLQVVPEQCVPSFLSRCLG

SEQ ID NO: 949535 - protein, 57 aa, Homo sapiens
YRRLRLDCGATRKRPCCASVSRGTPISRHCHEAQAVLGVLLRLRGPRWTRCAYQHMP

SEQ ID NO: 949536 - protein, 179 aa, Homo sapiens
YEVELVPACAVSQSVGRRRCPMRERLRQLYAAHWRAQSRTDCPGPEGLRAGLEGYFRLAQTPKVMRELDEWLRHRLRAVQLKQWRRGGNGLPGTVPVGRERGPGSAGLQHMPACAVGQRRPVVVCLRFTAPSRGPKSCCVAQAARLEWSGMISADGNLCLPGSSNCPASASRIAGLQHM

SEQ ID NO: 949537 - protein, 96 aa, Homo sapiens
GRPGDNLISACLRRLGLGIFIGVGVTEVGDQLVVEYRMVSCSICIFMLIQFLLGSGGDAVFKLVGNSSYAGIQDLKNIFKPFLNTNKGLMILTSEI

SEQ ID NO: 949538 - protein, 61 aa, Homo sapiens
PYSIRDPAEAHQEGVIAVESLVKADYQVPPSGTIQVPYVILIRRCLLCYMTYEIFAGSADR

SEQ ID NO: 949539 - protein, 52 aa, Homo sapiens
LRGLYQQRSDLARGGSALKWNAELILCGLQVLPQLQHPQLAGPYDTFIEHLP

SEQ ID NO: 949540 - protein, 182 aa, Homo sapiens
SSREGAGVLLITQPTGSQVLSTPVSTGRTQALVKVVLLLALCCVLTLLLWTAVAGGQGFLGGGQGCPQPSPELGQDDVTLDNLFRVHEHTGEVGVVQGRSQLLQHQGLAKLRTCAPHVPGWCSPPTVAWEVLNEGTIAQPVEDAEVGGKRMQATQDKLSVPFSGTSTSGQVTSLMDNLGSEL

SEQ ID NO: 949541 - protein, 57 aa, Homo sapiens
LHHTYPFIIPTTVGDVRLCEKLLRDAGGQGAVAEDEKQKAETVQAALEEAQGATGVL

SEQ ID NO: 949542 - protein, 43 aa, Homo sapiens
FYGGEQSILLYNSTSCVRFELFNLLHSKLVNDSEAVHKYARNR

SEQ ID NO: 949543 - protein, 33 aa, Homo sapiens
MPRVPHSVALSLPFQAEQRVMSRVHSLELRLLR

SEQ ID NO: 949544 - protein, 54 aa, Homo sapiens
MLAGSRRAHNSVQYRQLQVSAGENGTQVAGPRCSPGHRVNESDIKLQQRNVICP

SEQ ID NO: 949545 - protein, 32 aa, Homo sapiens
INILSDFELFNLLHSKLVKIVKVHKLPAKSNG

SEQ ID NO: 949546 - protein, 44 aa, Homo sapiens
MRVVEQRILLIQHQHLVSRFELFNLLHSKLVKIVQRALVARQSE

SEQ ID NO: 949547 - protein, 49 aa, Homo sapiens
IFAFEESGCSWITVACSTRMRSRKLVTFVYTPGTSYLSTGPMPQPDDAH

SEQ ID NO: 949548 - protein, 51 aa, Homo sapiens
FDCRALIKDGKLIKNNASTDYTYLDKSINPLGCFVHYGERDPLTLVWLKGL

SEQ ID NO: 949549 - protein, 56 aa, Homo sapiens
TFDWRALMHLTILTALSAEIEEFKSDQMLCWIREFSAPHLLVARQIEGVPEARNSV

SEQ ID NO: 949550 - protein, 45 aa, Homo sapiens
ETFASGDTFIDEHRRSYVRVSYTLLHNIAVTFVLTQYKYIATRSL

SEQ ID NO: 949551 - protein, 48 aa, Homo sapiens
CVNDPLRTAEINGNYNAEKPRWTDLLRCASFLGSHCMQSAEAQSTIMQ

SEQ ID NO: 949552 - protein, 44 aa, Homo sapiens
LSDVLHDPLRTDEINGNVQAKSEQDGPSKMCQLPGISLQQSVRP

SEQ ID NO: 949553 - protein, 98 aa, Homo sapiens
MEAAEALEGAILITRDMTLGASQNTSDKANDFQRCLSLYFLHYHLSRKSSALSWTTSVRPMMQWSPESEITESSIGTSATPSLSAVTLQHVSHCNTVS

SEQ ID NO: 949554 - protein, 52 aa, Homo sapiens
MRSATPESPGIGLGFPLQQSRGAAPTLCLRILSQNDGRFTPMLIADLKEVLL

SEQ ID NO: 949555 - protein, 78 aa, Homo sapiens
ITQSVMVIAPFEFSSGYWFSEARVSRAVSPLDSHSSSPEELRPLWPENTFTEDGRFTPSSSQISKKFSSVTSSGALAE

SEQ ID NO: 949556 - protein, 41 aa, Homo sapiens
MQKSPVDSGVGSMAGYRGIHLFSSLPFASEILLETIATRSL

SEQ ID NO: 949557 - protein, 104 aa, Homo sapiens
VCSVSADNEWCALSASFERFCDLTLQETIASLGAHWWFMTNADYLGKGGNEDSTKKETLEVVGLVVYLGSPNKHSLGCSLRPLNSSVILLAVEMYPDKHCNTVS

SEQ ID NO: 949558 - protein, 110 aa, Homo sapiens
MSSRRRHPCTVALAPPVTAVVLGSRVGGRCPISQLLSVVQKFNCPASQKLLSITLIDHQSLVSVLCIWDKHPFVFSCAFCDLLCGESSGPRGAVALVPSLSETLIATRSL

SEQ ID NO: 949559 - protein, 95 aa, Homo sapiens
MGVEGCTKCIKYLLFAFNFVVWLAGGVILGVALWFRSDPADNKPPVSSWQTSRGQKPSNVGYLTSSIAGGPWSRIAPVGFLGLATGANPRESPGA

SEQ ID NO: 949560 - protein, 48 aa, Homo sapiens
MWRPGRNLQHTVMALMSSLDAEKAQGQKKVEALEGEIITLNHKLQDAS

SEQ ID NO: 949561 - protein, 65 aa, Homo sapiens
KPSDGLMASTSPVPEPQDLRLTVKMDLSSQGTVSSFVAKLFIFVSAEFLSTRFRVAGSPFLLVSL

SEQ ID NO: 949562 - protein, 67 aa, Homo sapiens
HYHAERSDQGVSSTDPRGSVMGTRTEVSEVNVEVLLLGSSCVKRCLPLSFKEDVIHHDHDRFGTRSL

SEQ ID NO: 949563 - protein, 42 aa, Homo sapiens
RGTKKEELLKQLDDLKVELSQVRVHKVTGRSGPLKLSRDPRS

SEQ ID NO: 949564 - protein, 43 aa, Homo sapiens
LREHRWLKTRDLGSSSEERDHLRSQKDSEPDERGIDLPHGGEG

SEQ ID NO: 949565 - protein, 65 aa, Homo sapiens
TRPRAATEGGCSSVVLRDLTGTPSPRSMLLSVVSALMAATMAELVYWVVLPNHESSVTLTRGEPF

SEQ ID NO: 949566 - protein, 76 aa, Homo sapiens
RGAPWWRAALCECRRWWGFTTSVVLGRRTSPLGSLSTSDIHLINLLRLEKYRSFSRHRSWAQQEAQAPHWRRTYRK

SEQ ID NO: 949567 - protein, 61 aa, Homo sapiens
TKDILDTSIKHGAEHGALINVTLEDALYAIGIYHGNCFPLSGGYLRPSGEMDSVSRSPHIW

SEQ ID NO: 949568 - protein, 49 aa, Homo sapiens
HEGFLCPLAMCLSVYPLIIYTKFGCIGEAWSHVKFWELQQQVSSYDPSP

SEQ ID NO: 949569 - protein, 40 aa, Homo sapiens
TRIMLTSKHLKYQDLDIIAPDWVLSHTPVILAHFNSQRTQ

SEQ ID NO: 949570 - protein, 73 aa, Homo sapiens
MGKENTHITIVIIGHVNSGTSTTTGDLIYKCGGIDNTIIDKFDKEAVEMGKGSFKYAWVLAKLKADRECGITI

SEQ ID NO: 949571 - protein, 81 aa, Homo sapiens
TRIFIDGHVVARKSNITDHLLKQCGRSDRPITIISLKKTLLSLYLHLSSLPGSDIDLYYSANVMQHFDLIITVWNSEVIGP

SEQ ID NO: 949572 - protein, 113 aa, Homo sapiens
HEANAHFYNIPASSSAGPGATLEPMDRKAARRHNDSCPEPSAPPWAEINARTSHPNHPMLKKQLLLLTLPTESACPSQNTSISLGAADLHSYPSPLLPTCKTKPKAEHQWMNG

SEQ ID NO: 949573 - protein, 67 aa, Homo sapiens
IRDKAPSRFSAGRKWEEEIAAPVIDNGTGMCKAGFAGDHSPRAVFPSIVGRPITPGRHGGHRAKGLL

SEQ ID NO: 949574 - protein, 76 aa, Homo sapiens
RGEIPWPTLTLPKPNSHGPTPCNIVFLETSDRSNPIFLFMCSVDSAARTHPVSHVLVLMKGLPGGHPSLPRYLRIS

SEQ ID NO: 949575 - protein, 47 aa, Homo sapiens
RGVIQPNLLMIDKEAEQSNKLMTGSEDSKLSTDQIESTGLRFHNGKI

SEQ ID NO: 949576 - protein, 116 aa, Homo sapiens
RGLSPELELAESCAEAQDGELDGLWPIITIVIILFLLSVCNSATITFFKVKWIFPPVVDLKQTIIPDYMKMIGQGAYGHPLRGVQGRPYPSTAAMGHSSSITQAIPGPDLTALKPM

SEQ ID NO: 949577 - protein, 42 aa, Homo sapiens
MMASDRSGRSWAARVESRVGACGLSVHHGRWLGLAGPLAASR

SEQ ID NO: 949578 - protein, 50 aa, Homo sapiens
RGLSKSAHVGLTLPNSTHIYINKGFYSIYNLDRGKRDMEERKEITGEKYT

SEQ ID NO: 949579 - protein, 76 aa, Homo sapiens
HEVDGSPSSNHKGIVNYLWTLNVGTPSTWEVLNHSEHHPILFLSNLHEGTYSFHLKVTDAHGESDTYRTTVEVKPD

SEQ ID NO: 949580 - protein, 62 aa, Homo sapiens
RGGAEVQLGFLRHPSPSGASPNLPPGGPTPPYYPLRREPGVAPSVPHQLPIMGSHSSKAPRG

SEQ ID NO: 949581 - protein, 122 aa, Homo sapiens
DPRTPTSNPGHPNTPEKVDLDLKAYLMMMVEDIKKEFNNSLKEIQENTAKELQVLKEKQENTAKELQVLKEKQEGTTKQVEVLIEKQENTTEHLKELNKTMQDLKRNRNKKEVGRRGREFSS

SEQ ID NO: 949582 - protein, 111 aa, Homo sapiens
GSPPLGYLLRSPPSRVSSASLPGLPGTTSPSCPLHSALDLCGPSHRLPPITLSDPPLRPHARWEPCPTNFFFLANHVLSHRVHWTACSGCHTATGLRSLIFKSPPIPPAGD

SEQ ID NO: 949583 - protein, 36 aa, Homo sapiens
KRLQTQGGDPAHCCCFLSPSFSPPLSPISPLHPLGK

SEQ ID NO: 949584 - protein, 88 aa, Homo sapiens
AARGGPSVRVSPTPGAQRLCRLSVWIWSVIHLLQMGQVWYIRTMYLGIQRRKEHQRRFYWAMMEYAVNMLRLLTFLEAPQLVLQLYII

SEQ ID NO: 949585 - protein, 53 aa, Homo sapiens
MCPWVLEIMEWSSLLPIRHVCQYLFIKAPLAPPGIHVTLMDTPHPESTRLGSR

SEQ ID NO: 949586 - protein, 31 aa, Homo sapiens
MKYPSVIFRSHCSERPIGHSLTSGDNSLDCW

SEQ ID NO: 949587 - protein, 66 aa, Homo sapiens
MDSGLMDSGLINSGLMDSGLMDSGLINSGLINLKVKMGFHHVGQAGLKPLTSSDPPALVSKVLGLA

SEQ ID NO: 949588 - protein, 74 aa, Homo sapiens
GCHVSKLDFVLYDPKRLKEEPQVKSDGKDCSTKLNSDDFPKDSHRSSLGKKRAHYCKIQTFEPSSCQGDKGSGR

SEQ ID NO: 949589 - protein, 73 aa, Homo sapiens
HEGQCSFLRAALTGPDSADLARERMGFESTADCIPECLYLNHGMELSCTGSRDRCKSIVPAVSRKAPVPPRSC

SEQ ID NO: 949590 - protein, 48 aa, Homo sapiens
HEAADRPRVSLTPSLLLRPRQEPYVFKPAVHPGLVLGSTSQGPCRGGG

SEQ ID NO: 949591 - protein, 47 aa, Homo sapiens
HEELSGLLTLRVCAALALHALRSGPGPAPAMENTELSEKAKLADQAE

SEQ ID NO: 949592 - protein, 131 aa, Homo sapiens
LFDLNHQVYADPKISNSYKELKRNYVFYLQYIAIIVSYVAALQIISVRPCWDDTNLLPENINTKHIGSPFHGSEQHTAYHNVLNNGQIYCLENINTKHIGSPFHGSGQYTAYHNVLNNGQVVDAAANLVIV

SEQ ID NO: 949593 - protein, 71 aa, Homo sapiens
TRKDTAAQAFLAEASVMTQLRHNNLVQLLGVIVEDKGGLYIVTEYMAKGSLVDYLRSKGRSVLGGDCLLKF

SEQ ID NO: 949594 - protein, 46 aa, Homo sapiens
MGFSTLVLALGVCKMNIEEVKSTTMTQCIASHSHVKGLGLVHSGLV

SEQ ID NO: 949595 - protein, 40 aa, Homo sapiens
HEGNSKPEEWEMPSHSSDTVATKPDDWDDYIGVYWEPTLI

SEQ ID NO: 949596 - protein, 49 aa, Homo sapiens
YEGHSGGVTAVCKPGAVVKGVPLYRHNSHFVDNSEVILPVPAFNVTNGG

SEQ ID NO: 949597 - protein, 94 aa, Homo sapiens
TTSATEGPVWATLSHVSMDDQIEPCHLELADITPANNAGLNRHTTGNSIYHPLRRKYDGSNAVIKYSNHTKVVDNSNQSNRHIPLRQSIIRIDV

SEQ ID NO: 949598 - protein, 72 aa, Homo sapiens
HEGDPCFPELLVREERTWRLALDLLQVDKGGDPPLIRETQDMRFKDPGLLDQLVNAHSEWRRCKFRAHNLNN

SEQ ID NO: 949599 - protein, 51 aa, Homo sapiens
RGEAEKRAPDIREEKTSCQYQVQTERQLIQTEFDQLIIILNNEEQRELQRL

SEQ ID NO: 949600 - protein, 37 aa, Homo sapiens
RGLYMYRAPWRAFKALISAQYSGAHVRVLSAPPHFHF

SEQ ID NO: 949601 - protein, 160 aa, Homo sapiens
PEMPGSTTTIHFRPCRLKVLSVTQPKPPNSKQCRCRSTVARKNSLERPKPRKKPREEPGYVGWPVLFWLCRVEIITEHGQDVKMFINYQHGQNNNKAEQLKLEQQHSQVDWGQQGVIMSGSPGAWSYGSGPQKERIRESICGVASYLLAVPGGDYNRTST

SEQ ID NO: 949602 - protein, 46 aa, Homo sapiens
HEATSRFSASERTATGTELDDGSLLTPDRGRHRFQMLMSRLAFCGN

SEQ ID NO: 949603 - protein, 42 aa, Homo sapiens
TRAAQDDFYRIGGVLNMNELNLLHTIWKGEFGDVMLGDNRGN

SEQ ID NO: 949604 - protein, 80 aa, Homo sapiens
GHCHAWSRLDAFRGSVAIKAWRAWAGLTMPDRVGGFAFYTQRCLGMAKWMDNEYNCKQHCTVVSQEAGTVRPMLLLTHPT

SEQ ID NO: 949605 - protein, 119 aa, Homo sapiens
GGFDFARIHPIEFYAVFPDEERARRAAGKFRGESLNAQVSVRDDGAWYLELSKVMYATYGGIGDFEQNFGAVVEPLGGTIEGWGVKHPVRALNECTSSFNQQRLTQGLAVFVYHAQKVD

SEQ ID NO: 949606 - protein, 35 aa, Homo sapiens
RGHLLPPASSASSSPPWKSGRRNLNFAIVKNGDTW

SEQ ID NO: 949607 - protein, 135 aa, Homo sapiens
MVHGDGGGCLNLHAWQDAQDYLAWIVESGQMEQALYQALQVFGVPWIEDRFERLEGHTIVTAGQKRISADLFVGADGARSGLRSAAGIEHQGREYGDAGLVAHFNVERPHQQVALQWFTGDSILGRRGREFSSSR

SEQ ID NO: 949608 - protein, 38 aa, Homo sapiens
RGGKEKTHINIVVIGQVHSGKSTTTWPSASIYAVASTQ

SEQ ID NO: 949609 - protein, 148 aa, Homo sapiens
RRRLQAAHELRIGQALGPDTGVDALDPQTTEGPLLNLAVAIRILTGLFDGLARDADGVLATAIIALRLFQNPLMLRLGGRAPLDACHIFLPFQKSVQAVRRPGLHGLGVGIGQDRGAAVLADILAVMADQAVALAGHTVLELAGRGST

SEQ ID NO: 949610 - protein, 36 aa, Homo sapiens
ERPGVGLGDLKGTKLCWEMGRRVTVVSLCWEWAAVA

SEQ ID NO: 949611 - protein, 68 aa, Homo sapiens
RGRSARYVGGLLSDRTFLLGLRKTPFGVRPWRGEPCSQGGDTADYPPCAFRWLLRGERGLAGGCGREG

SEQ ID NO: 949612 - protein, 45 aa, Homo sapiens
RGKHQMADDPGAAGGPGGPGGPGMGNRCGFRRGFGTGIRGRGPRR

SEQ ID NO: 949613 - protein, 51 aa, Homo sapiens
RGVLLTTKCLLIHPNPDSALNKDVGRLLLENYEEYAVRASLLTEIHGGACG

SEQ ID NO: 949614 - protein, 46 aa, Homo sapiens
TRSFSKPSSAILVAVATHALAAAMIEQMTLRCILKGHNGWVTQIAI

SEQ ID NO: 949615 - protein, 96 aa, Homo sapiens
HEVKDYFTAKANTCRIMGPGSGDLLLTGTTMATSIWVSSVPRLCPPASVGTSSFLCSHHRAQRLLGDNYQKLPHCPLHSDMPLPLCAVTPHPRTHR

SEQ ID NO: 949616 - protein, 39 aa, Homo sapiens
RSHPGQGRSGESVEEVPLYGNLHYLQTGRLSQDPEPDQQ

SEQ ID NO: 949617 - protein, 48 aa, Homo sapiens
TREPENSLQEVQVISLGHQADGRPIVFGDSQNVVSVNDTFDEVINLSG

SEQ ID NO: 949618 - protein, 65 aa, Homo sapiens
MHLKRVAAPKHWMLDKLTGVFAPRPSTGPHKLRECLPLIVFLRNRLTYALTGDEVNYICLQRFIK

SEQ ID NO: 949619 - protein, 56 aa, Homo sapiens
TTTIFDPQSALTHITVLKHNLTIVINRSNSTAATTDVPEATVFSKSPVILGQPNIL

SEQ ID NO: 949620 - protein, 77 aa, Homo sapiens
YEAYSLLPYGAGILISTYQAAVTPPSPPIPATPLSAGSSGFKSVGPLRGLFAVCYALGLWSHTAGIRMAFVPASTGL

SEQ ID NO: 949621 - protein, 98 aa, Homo sapiens
TRCIDRCVCSTWNHPSPQVDIVSPPQQLPEEQTSVCPDTTKLNQTCIQRFIKNHGKGRNEINYPAGVMGVITTDNTGNNFHLIYGTNGRFAVHHNRPE

SEQ ID NO: 949622 - protein, 59 aa, Homo sapiens
MAYPENWRAFKALIAAQYIGAQVRMFTAPYKLDFGQTNRTPKFHRKFPAGKVPSFEGDD

SEQ ID NO: 949623 - protein, 36 aa, Homo sapiens
HQDDSKNVHFVFDAVISYTITNKLKERCLFCGTSGP

SEQ ID NO: 949624 - protein, 54 aa, Homo sapiens
HEGNQYERKRDKAPKLTVTIRALLHNLKEKIALLKDFIANSCVNTSDNTALKGT

SEQ ID NO: 949625 - protein, 40 aa, Homo sapiens
YEDEHIFWAALFVAQFPLIGRVSSPHPPFPLHSRPGSRRH

SEQ ID NO: 949626 - protein, 53 aa, Homo sapiens
HEASRGYFWRWRGSKKGIPCIIFHLLLIEGNMSESRAKSNQPLVSKHVKDGTE

SEQ ID NO: 949627 - protein, 50 aa, Homo sapiens
HEGGVRPSMERSWPSEVTGSYDRDRTPQLVVTMGFTGFGVGNKAHIFALV

SEQ ID NO: 949628 - protein, 74 aa, Homo sapiens
HEALRRNRRPGRPKAQIPREPHLSFVDETGPCGVRVEPRRNEGPRVSSECGTGWSGVPPKAAEHKPRITPSAAG

SEQ ID NO: 949629 - protein, 63 aa, Homo sapiens
YEENYTLTMTDDQCLLLSEIAGDLFRGPATFSQLVWQSVEGTFFINMTEIEDFPRVPHHGLVV

SEQ ID NO: 949630 - protein, 71 aa, Homo sapiens
MEDAETVADKIRDVLARPVTMDGHDLTVGASICIARWPENGDSAKDLLLIADAAMYAATGGAEGSPLSARS

SEQ ID NO: 949631 - protein, 191 aa, Homo sapiens
RSQGGWRTGTGGEEMSHVGADLTQAVLARLDSCSDPRFKAVMSALVAHLHAFMREIDLTPDEWMAGIDFLTETGRTCDAQRQEFILLSDTLGASMLVVALQQARALGSGQGATEATEATVQGPYYLDGAPDRPLGADIGEGVPGEPTFYAGRVTDTEGNPVAGALLDAWSGDGEGVCDMAAGGRRGMPARG

SEQ ID NO: 949632 - protein, 100 aa, Homo sapiens
TRLTNIYCLVAIGGSDNFYSVFLGELSDIISVVHASIAGCRIIRCMCVGNRHVSPGTQQYHRPGAVTHSTKFPDTVQIRRVVERLSTLGNVTTCTDYVGL

SEQ ID NO: 949633 - protein, 91 aa, Homo sapiens
HEGGGSGRKRISRLREAGLTRSQDNKFSLFHHQNSLYPGEQPPTGFFQSLRGDGNRYVHPDIAYGSTTHAFKFQHGVIATLVSPVSTGSYI

SEQ ID NO: 949634 - protein, 73 aa, Homo sapiens
TRGPTSAIFNAFDIIIVMLVWSTGAHVQMVRDMSPNSPEGSITNAGIPHSIINCVKQISVARLENLSQSPPKG

SEQ ID NO: 949635 - protein, 60 aa, Homo sapiens
MPEAKKVDAGAKVKKGNLKVKKPTQGKPHCIRNPVLVIGIGRYSRSAMYSIKAMFMRKYS

SEQ ID NO: 949636 - protein, 45 aa, Homo sapiens
TRRTHTEPYVLNHTFSSSCHAESHKLILNFEDTIIYQCRVCVSKE

SEQ ID NO: 949637 - protein, 93 aa, Homo sapiens
MVNMATSQSNYFLMINHIVDNYLRCLIGRGDIVGTKQMEQIFMSLHVNVVELLGIKTIKHIVIRWQLENCPALAKQSPHSLGNVRFVFNTVVL

SEQ ID NO: 949638 - protein, 40 aa, Homo sapiens
MTEKAPEPHVGEDDHHYLDSKLNEKPPPQKSLRELQEMDK

SEQ ID NO: 949639 - protein, 71 aa, Homo sapiens
RVQVLVLDGPCQLLGRLPAIVSNKVLLGRHVMILLCQRINISGIFFFHHFLYLAFLRRRVNITPSRGSYHF

SEQ ID NO: 949640 - protein, 74 aa, Homo sapiens
MTSLRSGHKVLTQNEGMNGIPLPPPKQELVLVPTPSMLASRLKAWFPNVDVSIIPQGKEATEPSCPVGEASHSC

SEQ ID NO: 949641 - protein, 86 aa, Homo sapiens
MRSFDQRPQNAKLAEFPHYPHMMSHEKVKHTSQVLKAARISAKNYKAKGIRGLYYRFSFCVNGTIIYRAAKFCLVQRVKGTIHESK

SEQ ID NO: 949642 - protein, 41 aa, Homo sapiens
YEGTLSTYPDNWRAFKALIAVQYSGAQVRVLSAPPHFHFWH

SEQ ID NO: 949643 - protein, 117 aa, Homo sapiens
TRSIARAFGGPLSHLFSSRDIPASSWILRGTGGHPDHPPQSEPLSMCPSSYVVARNQIMCTEQTGSGRVIAKWGPGGSQRGVLRSTRPRGLFREKPNSPETWWPHSPQHCEKQLCFT

SEQ ID NO: 949644 - protein, 75 aa, Homo sapiens
RGKLIREVGLQVDDSRGHSVIVRGPPVACAALGAGVAMNVLSPQSLVGGKQGPIPGPQGGAVTHSRFPASWGSDS

SEQ ID NO: 949645 - protein, 43 aa, Homo sapiens
TREGSMYTQIGRVYFLDSSALDKVLMISSFIGLEALFTALACF

SEQ ID NO: 949646 - protein, 36 aa, Homo sapiens
HEEHSSYPDSEGAPDSLWDWTVAPPVPATPYEAFDP

SEQ ID NO: 949647 - protein, 35 aa, Homo sapiens
MATISTKSDGEMVLPGFPDADSFVKFALGSVVAVT

SEQ ID NO: 949648 - protein, 74 aa, Homo sapiens
HEVSLCVAVVGNCNNPGHLYQVKIQIFSKTPIGKTITLEVVPNDTIKYFTAKIHYNEGIPPDHQRLIFAGKQLE

SEQ ID NO: 949649 - protein, 41 aa, Homo sapiens
MTSTPGILEKDGGTSVQAEASLPRNRLFKYATNIELGYWCD

SEQ ID NO: 949650 - protein, 93 aa, Homo sapiens
MAVFTAVMKDLNSELCARLQLQKSHYLFLGPTRGHYYGGSLPNVKHIVSGTMVLPFQTPFYSSGLETNLPTRDHGLVDMVYLERGRIDFTNRR

SEQ ID NO: 949651 - protein, 76 aa, Homo sapiens
HEGRAGFAGDDSPRAVFPSIVGRPIQHGVMLGMGHLDSYLGDDAHGKRGILTLKYPIGHGIVTNWDDMATIWHHTF

SEQ ID NO: 949652 - protein, 59 aa, Homo sapiens
RGGRLSYNSLRISSDSPDFESVHGGLDPSTPLGHTSPFLSASLAQQGKYCEAPRFGANW

SEQ ID NO: 949653 - protein, 61 aa, Homo sapiens
MSGAHYASKPHHQGVVSQFLGAKGNEKTCRETDLGNPAGNKLAKPEDKRLRLDDGQTADGQ

SEQ ID NO: 949654 - protein, 36 aa, Homo sapiens
TRWLSRGYGDNHMTLPDTPWLCLCTMRVTINCQSIQ

SEQ ID NO: 949655 - protein, 200 aa, Homo sapiens
EGQEIFRLAGEEADHGAALEQPAGVALADEGGEVSAEEHVEDAVRPALGERADGGAGIDAEGRELLGDHLESRHRRAHQALEGGDRRLAVLVVGRHDGPALHALPLGGIDQHLGLHVGAGADAERVGVAAAHGERVCERLGGEIEHLLLVGEVGEREAHIRQEGAGDEGDVLAGDELLGDAHRVTGGRAVVAEDDFERAA

SEQ ID NO: 949656 - protein, 37 aa, Homo sapiens
MRAPQTLLLLLSGALDRTDTCACSHSMRYFYTAVSRP

SEQ ID NO: 949657 - protein, 61 aa, Homo sapiens
HEGYPPNWEKKSRISTLHVIGHVNSGTSITNGQPIDKCHGSYTCPIKYFCTDAADMGTGSF

SEQ ID NO: 949658 - protein, 75 aa, Homo sapiens
HEAWGNFHSLAEGINWAGVCINDTDQVKAEYVPRSLTTSSGGTNKLNHCPHLGGYSHKYIGDIMMTYMHCPDIFI

SEQ ID NO: 949659 - protein, 38 aa, Homo sapiens
TRGNGYGIPRNSTCLRVTPGNLNINMQAKSPPPMNLGM

SEQ ID NO: 949660 - protein, 94 aa, Homo sapiens
EFWILGGGTTRTTLNHALCATSYVMTHITASTSIISPHWWVNGLGTIRSLLLPCQWVCTASTGRNERESVDVSVKCVSREGVDLRFEWYFYLDM

SEQ ID NO: 949661 - protein, 78 aa, Homo sapiens
GNSPGPVQSRKDSIINPWVLSKKWFLSKDLREVQSEPCRCCETVAQDSAKSHGRSLPETLEDQKGAIWERLEMTEVVT

SEQ ID NO: 949662 - protein, 216 aa, Homo sapiens
MTRFPTTPNTARYVPAPEVINAESAQAMRTVCRRIQDGEYAKMFISEGATGYPSMTAKRRNNAAHGIEIIGEQLRSMMPWIGANKIVDKAKNESTLNRLPGPSGLSAGQAAPKRPDLSGRFVLSHKAFMSDVEQFQVKDVIYLHVRFFGGQMPRKKTADDKPLTGEKASSPAKTKTTADYVRDMRTRLRDAGLVKREFWILPENATALRGIEKAVD

SEQ ID NO: 949663 - protein, 115 aa, Homo sapiens
RRHQRGLHCSALPTHSSLRPPPTGQVAYPHQRGLQCSALPTHSSLGPPPTGQVAYSHQRGLQCSALPTHSSLHPPPTGQVAYPHQRGLQCSGLPTHSSLHPPPTGQVAYPHQRST

SEQ ID NO: 949664 - protein, 101 aa, Homo sapiens
ATLRILVAHSIKKLSNVACRVKLRHLSERPASLTHSLEKFWILPSYLLVYSYSYSPVSTSHKCPALVYTAGLHCFSKPSLISLGAIPKPPLLTLKVNNLCW

SEQ ID NO: 949665 - protein, 199 aa, Homo sapiens
MLAGSFVFWLASIACSWAPNLVMIIIRVIQGAAGAVLIPLSFQLIITELPPSIAMGMALFALSNSVAQAAGPSIGGWLTDAYSWRWIFYLQLAPGILLLLAVAWSIDAKPMQLSLLKSGDWGGILAMIVGLGGLQIVLEEGGRKDWFGSDFIVWVSLIAGVALVYFVLSQLYGRRSFINLRLLKSYNFGVASAAMFMST

SEQ ID NO: 949666 - protein, 72 aa, Homo sapiens
AFSKGPPPPGVRQALGSPENKTLASGIRKWGAGAKINGNNQGGGPIPLGDKWAGGQTNPFGRNLEEGPFPFI

SEQ ID NO: 949667 - protein, 79 aa, Homo sapiens
VVPPRKSLLGHFNRRALGKIDLQFIAAASKFGHGRFPTVEEKKAFMGPLNKGLIAKEEGGYCQEQILQLVGSPKKLFFP

SEQ ID NO: 949668 - protein, 73 aa, Homo sapiens
GHPALGVKEASALDFDVSSNPIYWTDISLKVGWARTCPRAAYMGKPSLWTCLKGFKHFVLKPYNIYCNPIPAN

SEQ ID NO: 949669 - protein, 123 aa, Homo sapiens
PRRPMTDITSLFSMTDVTSLFSMTDITSLFSMTDITPLFSMTDITPLFSMTDITPLFSMTDITSLFSMTDITSLFSMTDITPLSSMTDITPLFSMTDITPLFSMTDITSLFSMTDITSLFCRR

SEQ ID NO: 949670 - protein, 138 aa, Homo sapiens
RRQCEFGKTSLNYLGHIVGGGELKIDPSKVEIIVNWPKPKSATEVRSFFGAAQYWRKFISSFFLIAAPLHALTGLNKVFQWGGKQKKTFDTLKENISTTPVLALSDLQRPFKIQTDANDYAMGAVLTQHDKPICYNVD

SEQ ID NO: 949671 - protein, 79 aa, Homo sapiens
QGFLDQVAHKLPFAAKAVNRGTLKKMRKDPEERERNHQNPWTFEGIAPANMLGIRKVLRPYDLTPKGKYWGKFYMPQRV

SEQ ID NO: 949672 - protein, 115 aa, Homo sapiens
VDQYRDSLSAHLFTSLAASVKYLTASSAVMRIIPFGACDEVTKFKPVSIRNVVGEIDRLSADFELFKHVIARSYCHVATFIYAPCFAVRLSIYANLPVTSKASTGIASRCFDIRR

SEQ ID NO: 949673 - protein, 64 aa, Homo sapiens
MRLSKPDKYVELGHLIPTLVSAFGDSGSPPRLHTRITGGAETRCPKSNSRPIDPKPCPQGGFPL

SEQ ID NO: 949674 - protein, 86 aa, Homo sapiens
ILPPYLSRSSTSHFQVESDRTLHLNICPDVSSRLFVGISRTLLRMIVLPGVPMWPRQPQTGQLGAGTTANGYIHMTKAYLPLVFNK

SEQ ID NO: 949675 - protein, 35 aa, Homo sapiens
GEFGTRAEKMADDKDSLPKLKDLALLKNQLESLQR

SEQ ID NO: 949676 - protein, 71 aa, Homo sapiens
KGGFLSKAWDYIRELGQTNQGMQETFKKAERLQMDNELLRHQIEELKNENALFGAQLQQPNLEMVGEGPRQ

SEQ ID NO: 949677 - protein, 54 aa, Homo sapiens
MRLTRELDQGTWQTQSREELWIFEAVVAPSRNFPFTILFPKCPVLCSNLSPPPS

SEQ ID NO: 949678 - protein, 44 aa, Homo sapiens
PAGLLHHKLLLMWLQPHRRLPALTGSASGPWHWQSPLFKRQCVE

SEQ ID NO: 949679 - protein, 66 aa, Homo sapiens
MAETGFWQPGDPDAGLKVPFLGGGLSACGQNLQSGQDFQVDIFCPNLIACPCPSGKWGSLKETGPL

SEQ ID NO: 949680 - protein, 122 aa, Homo sapiens
GDHTRCKTVLTGKVGGLLAFAKRRKFCIGCRPVFSPQGAVCEFCQPREFELYQKKVSHLNALEERFLRLWTQCQPCQGSLHEDVICPNRDCPIFYMRKKVRKDLENQEQLLRRFGPPGPKAW

SEQ ID NO: 949681 - protein, 30 aa, Homo sapiens
PAEGRARGCWARAVYPYKNSTEKRQEDPYY

SEQ ID NO: 949682 - protein, 88 aa, Homo sapiens
GREAHPGKLRNPITEVLQGTLEPNDVPPKGCKVVIDIQYKDTITKKEWHTYLKKAPQYKERLGSQVITSTAKCMCHTVPRKHLLCLQV

SEQ ID NO: 949683 - protein, 98 aa, Homo sapiens
MKHIPVSYQQKRGGVHTGNIPSPPPKGTQFYCAGEFLLEFRPFCPGAQSIPGTFNPQGGPGRFLKFFPHGKKLGTTGEFSPHPFKPHKGFSSSLPVPL

SEQ ID NO: 949684 - protein, 99 aa, Homo sapiens
MPLPSSLGDRGRLLFHQNLTLTHAHTHSHTHSHTHTQTLSLSFSHIHPHTHLFTRSHTSSLSHPHYIPSSLITLPPTPHRNCFTYLTPHLHILTLKGRS

SEQ ID NO: 949685 - protein, 36 aa, Homo sapiens
ILPPYLSRSSSYHFQVEADRTVHLNPCPYCLVVTSM

SEQ ID NO: 949686 - protein, 47 aa, Homo sapiens
KWMEQGRNKVSPEETEEEEPGDTIPHDSSGTRTQARQHAQLTGTHGL

SEQ ID NO: 949687 - protein, 102 aa, Homo sapiens
LSFVQGDKNGSICIILHDTFQFTQHLFLKMLSFFPPLDGFSSFVKDQVTIGVWVHFWDFNSISLIYLSVAVPVPCSWFLFVCLFLFCFVFSQLQISQSARFY

SEQ ID NO: 949688 - protein, 84 aa, Homo sapiens
ELIEDKGCEPRIGSHQGLSEHELRKNDREQADQYWDSRRNRTNPPPGDGNGPSTGGLSPTLLNPPLFSAPGPPSAGGGSPPFSP

SEQ ID NO: 949689 - protein, 36 aa, Homo sapiens
HEENLQSFNEITAMTGDGVNDAPALKKAEIGIAMGS

SEQ ID NO: 949690 - protein, 63 aa, Homo sapiens
TRGNDAARSDKCKWIAIHMTRITPRNHANQKVRNFVVHFNNTRESAHDNNGMHIRTVTRYLKD

SEQ ID NO: 949691 - protein, 84 aa, Homo sapiens
HEGSSLVISPPVRTARVSSRLTSPRSPSTLSLRSESESVSATEDLAPESSQGEDNSGIEEVLEQEEFEKEGSEGSSSEEDEPLP

SEQ ID NO: 949692 - protein, 86 aa, Homo sapiens
HEAHHGNTLDLSSANLLSFTGRIATTVLDIYHVMIIVLLFIWHPVKVAHRMASCKIAQMGHITIGDRISSFRLITMLFIIIPNATG

SEQ ID NO: 949693 - protein, 166 aa, Homo sapiens
HEGDDQRQLHRRLQRPGDEEARRIGADAEIGGMAEGDDAAIADEQVQREGGEREDHDLDADLHLVGVAEDRDEQQGDGEADPHERLRSGEGLEVQDALRQHGAARGHLRLAEQAPGLHHQHHRHQQEDQHEGDLREDEDAEGLQHLDDQRRDEGARHRAHAADDGD

SEQ ID NO: 949694 - protein, 63 aa, Homo sapiens
MVTRENVLAGESLRERDRSQQSTAERGCTAGYPKKSQRQGYNPHHAKGYTRAQRSPKACHERC

SEQ ID NO: 949695 - protein, 137 aa, Homo sapiens
EFLVLVIGSCFEIYLMAVLSLGLVVSIVEERLGWDAIRVGSVYNGGREIVRVGAVGSVRVGIGRDREGSAENDGQSGFVFRVNDIDGDDGSDGGKDKVGLIFLFGIVVVWSYIVTTVFYCECRKRHVGRGEDESVTV

SEQ ID NO: 949696 - protein, 121 aa, Homo sapiens
HCMGDHIIVFTVWPISAQETMVTTKWLVHKDAVEGVDYDVTRMREVWDATNDQDRRLAEENQRGINSTAYQPGPYSKTYEFGVVNFVDWYSERLLSNLGAEPAPYLKGVPVHGYSKSFGRR

SEQ ID NO: 949697 - protein, 108 aa, Homo sapiens
HGAPTNATECLLLRHNRFRRLLLQSVLFDELCRYHTFTADQPIQLRARQSSGQQADTFFVVFFFLYGAQFEKLCTQSSKTLRQAQGADKQIAAQQFGNRLFKQLQTST

SEQ ID NO: 949698 - protein, 118 aa, Homo sapiens
MGIYDLLSSSLLDAMAAHFTFTPPRNPGHNTVGALQAMLKGDAKVLICLGGNLAPAAPDTMRTEKALSNLDLSVQISTKLNRSHLTPGREALILPTLGRTELDMQATGSQFITVEGRR

SEQ ID NO: 949699 - protein, 151 aa, Homo sapiens
LVRPKRRLGSPSVPPLDTRLDVARPRSFLQLHGRESLSPAQPARSLRGTLQKDRVSVIPPWPYPESLPRPTSLQALWRSPRLRAPGLLDTRRGLRSGHPERRRSEPPGGERAGPQVAAGRSPLLSEPSRPAPGLRSTPPADVKGKGAESRG

SEQ ID NO: 949700 - protein, 57 aa, Homo sapiens
ADHLKPFLDDSTLRFVDKLFGAFGEGRSFWPSKFSSDQEQKTGAKGWVLAIRGETLS

SEQ ID NO: 949701 - protein, 36 aa, Homo sapiens
HYLHKLCALQPANELLKRTVTLHIFNAYMSSFLLGT

SEQ ID NO: 949702 - protein, 99 aa, Homo sapiens
MGLGVDDDLCFLVHRSHAGIALNNAFARGHLGRFVIGAIGEAHGAFGTLAVFCVLVQPLAQLFGFFLQPRKLFGLTRRRGFIGGCGIGLTVFVQHLLGG

SEQ ID NO: 949703 - protein, 38 aa, Homo sapiens
RCRQGRTRSSQTKSAHGQTTLQPDRADQTAPMAERPRP

SEQ ID NO: 949704 - protein, 41 aa, Homo sapiens
PGETPDEEGGPPNMAVLGKTWVITNCVPWYMWVEKYGFKIC

SEQ ID NO: 949705 - protein, 70 aa, Homo sapiens
SPDAYHRGSNKALLRDARFHELKVSADEDCRVNPMEVCPRAGLYIFVLRGLRGSATGQRRGAGAAHAARG

SEQ ID NO: 949706 - protein, 43 aa, Homo sapiens
MGPTSGGGEGTGASMMSTTGLLTAIEDTMPPGTFDTRGYEGPW

SEQ ID NO: 949707 - protein, 151 aa, Homo sapiens
PVREVWACCGVCLRTQQPRSRHLPSAQVLSQESLRRKKQVDLVFRVQEPVPLVLFHHVFDLDATGPQCGHDVVGLRLDHTNIVGALHNQQRGADLIHPADGRAGEHVGFLLRHRGIADVAIPVVGQVRTDERGKGAHEVGQVGDAHVIDGG

SEQ ID NO: 949708 - protein, 95 aa, Homo sapiens
EQEGFLPGYQGLLVIEVKWTNYVSMLNPQAKIVNGGANLMSSAFREANSGSERAIRIPAANTFVDVCAHAEAGVRAPPAINARMPFNFFFPLECH

SEQ ID NO: 949709 - protein, 126 aa, Homo sapiens
PRIRHEEKDVVETLAGRVPAEGWNPAELSKEFGELEYRTMRDSVLDTKVRIDGRALDTVRPIAVKTGVLPRTHGSSLFTRGETQAIVTITLGTARDGQVIDAVAGEYKENFLFHYNFPPFSVGECG

SEQ ID NO: 949710 - protein, 120 aa, Homo sapiens
RETAASYTKSRKSCVPSCEQIPPFAQKLLTSTLSAPHGRPSSQAASRHASSLSCSPATSPSSARSPAARAPMPGAIAMKASGSREVRTRSTRSRRYSGLSCSGSPSANKDASAARLPCAA

SEQ ID NO: 949711 - protein, 36 aa, Homo sapiens
TCVENGKCLACRKPYPEDPAVHNPVSQAVLQRFPGE

SEQ ID NO: 949712 - protein, 72 aa, Homo sapiens
RLACDVIPTGRVDLKGDVGYCSHWHLSQMCQRFYAGQARSSAGRFAEHVPGGANQISPAQVQDESYGIKVAL

SEQ ID NO: 949713 - protein, 79 aa, Homo sapiens
RSDVMHKGVRKRRQRKGCGGMSMVPPGQRKERGIRWKGGSQGKWRSMPLVYRLKPDPKIEQECQVHQKWYSRGHGNGSD

SEQ ID NO: 949714 - protein, 103 aa, Homo sapiens
CTRKLPGRLLRTDLQPLSEYNLGRRIEICLEPLQKGENLGPQDVLLRTQVRIPGEWTYSPSLDLVWNATQGGTTGSLRQRVSDLSRLPVEKIETAKYFPENFE

SEQ ID NO: 949715 - protein, 42 aa, Homo sapiens
QREQDKQRNRRRANQVQQRQQILAPEQPAQRAAVIRADDVGG

SEQ ID NO: 949716 - protein, 56 aa, Homo sapiens
GKNMDANEIPPENKVKIFGISGVKSQVGKPCTQKCNPSFIAGQWKKAVQWVVSVLK

SEQ ID NO: 949717 - protein, 79 aa, Homo sapiens
PRIRHEDEMQTEADDYAGGLEGEMFHMGDGVRSTNVLVARLTCSMPCGQRMTVTFVPPSEEKSQMRVTPEHSGSGPKFF

SEQ ID NO: 949718 - protein, 82 aa, Homo sapiens
PAATVGHRRLLLSVIGDGPSCAGNRPPSGWSGPAQSLVYTQDLHEFSVWEVGQDHGEVSKKWRKHSLASAGKVHPATVSALH

SEQ ID NO: 949719 - protein, 39 aa, Homo sapiens
WTPQEIERVAERDETQLWTRTPVDDDCLERLNLPTPKKK

SEQ ID NO: 949720 - protein, 113 aa, Homo sapiens
MPPTTPQPPTTPQLPTTGSRPTQVWPMTGTSTTIGLSSTGPSPSNHTPASPTQTPLLPATLTSSKPTASSGGKEPPAEPMERAAAGGPRYTSGVGLGMALLPGSHLPLSRFPA

SEQ ID NO: 949721 - protein, 99 aa, Homo sapiens
QGRGVSGIDLCVGNNSLPVMVMSCFRIRDHPVLRILSQRTRKAGEGEQLDVDESACSVPSDPARVDSGVDLVLITVPPSRTWTCDVRTCPVKGHEFVSR

SEQ ID NO: 949722 - protein, 70 aa, Homo sapiens
LVGCMKPRKFLDHYGVVLRICEEAWTNVLETCAGSCFRPPKSGKRLGDPTSIEDPSQAQRKLLTPGILIK

SEQ ID NO: 949723 - protein, 36 aa, Homo sapiens
LGRTFSFPLSEKEPPEGFEQGRVLICWILNKDPPRN

SEQ ID NO: 949724 - protein, 117 aa, Homo sapiens
QNTCPFVRTPSPPVLYFASPEGGFPGALSDQPLGSPGLKLSPGPLTILARGACLTPGPSWGFPFCFPPGSPMFSGGGPLLGPLLCHHLKTPPPNTESPLGLPPWSPLGAVFDSTQLL

SEQ ID NO: 949725 - protein, 56 aa, Homo sapiens
ARGSWYLSASARRAAAEAMFESDFRTEFYEVVQSQRVLLFVASDEDALRACKILQA

SEQ ID NO: 949726 - protein, 146 aa, Homo sapiens
QDNDLGSQLPWRGLLMIVWGLIPDQEWRVMSPCDIMAGPFCPYCFSPTLFDFSLRGGGQRKSPVVLGTWDPKLKTLQLGLPCQCHKVPWPRKTGFFPFRPGHPVAILRVLPPPPGVTFENQKFVPVDFFWGMDHCPFPPSINFETC

SEQ ID NO: 949727 - protein, 117 aa, Homo sapiens
KKDFLKKSLQTQVFKVGLAKSIPHAWVLIPQPQIRVRKQVVKIPSFIVRLDSQKQMDFFLGSPYGGGPPGRVKRKNSKKGQGGAGVGTHKEEELSPPVPPGVVDCFVFPPKKQDQRF

SEQ ID NO: 949728 - protein, 106 aa, Homo sapiens
EPPGVKFNLSPNMGSFLVAYETPKEAPAPMEGPNGQDLMGHPLSVDWCFFRGPPKGKRKGGRKPPKSPDRRGCCQVLCCPGVFFKIPFGHPPLGKKGWGGTCGGYI

SEQ ID NO: 949729 - protein, 127 aa, Homo sapiens
PPPPPPFPGVLGNQVSDVVFQFGNFLALESLRGVWETHFPVASMQLQKICDAPEIKWERSSFFSILVEPAFIVPGKLWKKRGLCDLILWARTCILCFYPQAFLVFPTPTPLHGVFRTSNKNFFSGFG

SEQ ID NO: 949730 - protein, 45 aa, Homo sapiens
MPIYKGSIGPDVIDIRKLYGATGMFTYDPGFMSTAACNSSITYID

SEQ ID NO: 949731 - protein, 105 aa, Homo sapiens
QFQSHSRHLQPAQSQSCIYRRNAEIDAGGVCAHGVHHIMPAENGNTERTINTVDSEICAFFCLLYFFQAEIIVRTFAVCRCPASVRLLAQQRLIPEIKQHSVFRR

SEQ ID NO: 949732 - protein, 129 aa, Homo sapiens
LDTKLRALGLDTKLRAPGLDTKLRALGLDTKLRVLCNWIQDFLTGRTQAASIGNRTSSTLILNTGAPQGCVLSPLLYSLFTHNCVALQDTYSAKPKELIVDFRKQRRKHSRINFDVDAAASLVVVVVGG

SEQ ID NO: 949733 - protein, 30 aa, Homo sapiens
MRSYALHPCSVELPMINIPGQLAIRTISGR

SEQ ID NO: 949734 - protein, 82 aa, Homo sapiens
FRVKYNTHCSETRLAGEGELTEEKSGKEKDKESLLNHCLMTDFHISMHTHIYALTHTHSHKNTHTEKMVQPPESIHVTITCQ

SEQ ID NO: 949735 - protein, 137 aa, Homo sapiens
VDIVAIAPELLNGVYGGTKAFVLAFTQSLHHELSEKGVKVQAVLPGAISTEFWDIAGLPIQHLPGEIVMNSEDLVDAALAGLALGELVTIPSLPDIADWQAFEQARQALKPNLSHQVPAARYTVKGWPCNLPPDSVD

SEQ ID NO: 949736 - protein, 132 aa, Homo sapiens
MPQLPILSQRIVLVSRPQGALTPENFRLERVNLPELADGQVLLKTLYLSLDPYMRGRMSDAPSYAAPVEIDEVMTGGAVSRIEQSRNPKFAAGDLVVGSTGWQSHSISDGNNLIPLPKGLASPSMALGVLVD

SEQ ID NO: 949737 - protein, 60 aa, Homo sapiens
MVLRFTRTLLLDGLACGQRNILPEPEGDLPMNAKPDINEILAMTGRKSIYQPEQQGLICR

SEQ ID NO: 949738 - protein, 49 aa, Homo sapiens
MTWPYSNSFKLIKAYQKHSNTYQSCTNHKYKSVLLKKWTQDVMYDAAAN

SEQ ID NO: 949739 - protein, 101 aa, Homo sapiens
CTAHTFEGFQIMKKNWFGAALLGSLVLAGCGPLSQVDSEGHTENPVFPEVDKATFHTGSYPNIDNLRQVREGVTRDQLYDLLGRPHFAEGFKVREWDYRRR

SEQ ID NO: 949740 - protein, 131 aa, Homo sapiens
GAGLRCRFWVVDVAIVQMNRIYNLLTIGLSANKRGFPIAHKLVPFLCVILFSYTQPSVSVIPFSYTQPSVSYTQPSLSVIPFSYTQPSLRLIPFSYTQPSLKLIPFSYTQPSLRLIPISYTQPSGRLIPCR

SEQ ID NO: 949741 - protein, 151 aa, Homo sapiens
PDDGDILWQAQSIEQLKEDYTRHLLYLGHKPAVKSLLTPYENLLSYYQMHHKEPEGERIWQALEEVSLIGYEDVPVCQLSAGQQRRANLARLWLSEASLWILDEPFTAIDVAGVKRLTERFHQHAELGGIILFTSHQAMSGHFGSLKLTVD

SEQ ID NO: 949742 - protein, 141 aa, Homo sapiens
PLKHWKVGPGQKVGIVGIGGLGHMGIKIARAMGAHVVVFTTSLAKTEDAKRLGADEVVLSTDPEQMNRHAKSLHFILDCVSAQHNIDAYLNLLRVDGTLTLVGAPMDPLPVTSFSLILGRRNFAGSPIGGIAVDAAANLVV

SEQ ID NO: 949743 - protein, 135 aa, Homo sapiens
IQAQPATDVCGMGIRCTQHCSGGWNDRQPWVTLSRTVSSVLEIDSPSATLSAGRNMVITGQNFTNRYSVVSAANDLSITGENILNQAATGGSGSQSQEYGGTYKISKGQYNQMVAAVQAYNRAHPQGSPVDEGRR

SEQ ID NO: 949744 - protein, 101 aa, Homo sapiens
RKLVVIGRLGPAAQRRQETARADLVQTVLQMVDQPSVRLAPFDAAAHRLTRKTLEKSFLTIFILAQVRRYGPVRSCVRRRCSTPAHPDRKVFVTHRGIAVD

SEQ ID NO: 949745 - protein, 100 aa, Homo sapiens
YVSVNRVSSPLYVSVNRVSSPLYVSVNRVSSPLYVSVNRVSRPLYVSVNRVSSPLYVSVNRISSPLYVSVNRVSSPLYVSVNRVSMLKRETTVSSNRRST

SEQ ID NO: 949746 - protein, 78 aa, Homo sapiens
HSRIQGKSKLVKVLVPVFVLGPYIGSNHCLQGSIYSLSEIGLWVIGRGQLLPQVPSLAGLLKEIRDKLGTSIRQDVVD

SEQ ID NO: 949747 - protein, 114 aa, Homo sapiens
STFLIIRKTCVAYSVFQVNVPNRKYCSRTATAVQGPLSCSVCVSDGGRMLSSCILGLPFFFFFFFFFFFLTTVNLLCIRKLNLKTNSIVKRYFETCSAMNRDNISFVDAAANLV

SEQ ID NO: 949748 - protein, 56 aa, Homo sapiens
AVFKAGNIRQDGIDRRRETFQFVAARIKRLLILRKRIREMHHFRSGNSDRTSLQEC

SEQ ID NO: 949749 - protein, 82 aa, Homo sapiens
VDRHLEQRKHVGEIAWFKFEGLKLRLADNTFYTPDFVLMLSDGVMEAHEVKGFWMDDARAKIKIAADMYPFRFIAVKAQTST

SEQ ID NO: 949750 - protein, 121 aa, Homo sapiens
RRRDDFCPVMVTPVASKERSSFVKAMFAQDSVFQRKSCAVRCSFAGVVAFFSSNHDPMKGRAGGVFFIFYFENEIMRFWFFESRRKFFFRVSEYMLLFLAMTVSIDIAMAFCFSLPANTVD

SEQ ID NO: 949751 - protein, 67 aa, Homo sapiens
STWNLQFSFRELPNGVRTSHMVQPGKSCHWFLTIFESAVWEETKHATSQDLWVPCSAFRTTGCSADR

SEQ ID NO: 949752 - protein, 125 aa, Homo sapiens
MYCADRCGFASLQKPQKLKHLFEQYGEVGRIYCTPEGMLKTGSHYSGCASAGMVIMFGKRERGKRSMNCAMRDCLKRGAALHGYSGMCQQSLGQQPPRTHIDKQVCKQGSGEAWGTPEVDGPRST

SEQ ID NO: 949753 - protein, 109 aa, Homo sapiens
RRQGEGAQNQGKKGEGAQNQGKKGEGAQNQGKKGEGAQNQGKKGEGAQNQGKKGEGPQNQAKKGEGAQNQGKKEKGAQNQGKKGEGAQNQGKKAEGVQSQSKKGEGTRE

SEQ ID NO: 949754 - protein, 67 aa, Homo sapiens
LDGLLAPTDIPPHGPNILVPDLNVDPFPRPRWTTVITWTETNNAVQTGSDAPTRVHLFVHHMSMEKV

SEQ ID NO: 949755 - protein, 105 aa, Homo sapiens
RGLVPHLHEVHGRHHPALGEGIGQRADPGRQQHIGRHEAELEQRRPPRRTTLLHEQRDGDDQHRVVSQGRRELRADDEAKAPRQADRGRRGIRGLGDGGHMGVTV

SEQ ID NO: 949756 - protein, 56 aa, Homo sapiens
SKKDFYDCEIVYLMAVALLMLTYDKKVSYNSIESDYYLLNYFVTVCSVLLRNGPKK

SEQ ID NO: 949757 - protein, 40 aa, Homo sapiens
PGEAIEDDDDDYDEEGEEAAVGYQLFEEVKSCSKLFQRWL

SEQ ID NO: 949758 - protein, 34 aa, Homo sapiens
SGKKSRRGSKIEKVLLITLKKNSGSQSGTKMKAT

SEQ ID NO: 949759 - protein, 113 aa, Homo sapiens
MMKRRQPGKGAAEPQRNGSGRSRRKNPWEEVNRPGGDEMPQNSVPERGGPRPTTHLNTQLGKEECMRTVIPGSDLDYGDEERRQKRPSGGLLERQKEFDPTINRCKSVAKQKN

SEQ ID NO: 949760 - protein, 38 aa, Homo sapiens
QSPVSSPNAKAHLVRRKDDTVSCANSHTFNKLTTAVPK

SEQ ID NO: 949761 - protein, 155 aa, Homo sapiens
HEGNRRACQWYLRYHECREASPIPHDGISRGHIEDSCPQFLGRSPLVIPMDHSTDVTFQGIKLDTVMGSSLHVRSDLLKFSGAGDHAMKSGTFAFRTPKLSHHVIETLALHLYVKSSGNNIYSPLHVSLQICSFARSDCILLPGRISRLQVCVVR

SEQ ID NO: 949762 - protein, 47 aa, Homo sapiens
TRKLLTAATILADATAKMVQVAMGSAAHPDSEEHHQRLLEVSEGLRM

SEQ ID NO: 949763 - protein, 60 aa, Homo sapiens
RGWWERREGAERSVCTCGYTEGQARRRETLAPPPDSSPHSTLTVFVARIVPCPGYEVGLR

SEQ ID NO: 949764 - protein, 34 aa, Homo sapiens
MMHMSGVLRKVIDYIIYLQQVNHKLRQENMALKL

SEQ ID NO: 949765 - protein, 71 aa, Homo sapiens
YEASCRRLRRQEIGARSRRRATPSPSRSLHSDPRAHIWTQQSRDSPHVLMAGIGTLTSFRSLDNLEISLGN

SEQ ID NO: 949766 - protein, 137 aa, Homo sapiens
TRRPYVGAGTPERCRTLHRVSGGRGRFLDFDWVQDAIGFDQEIDLQKVFVAVEIKWRLFPPVPVTFQQLHHDPGLEYGSGEGPGFQALRAGPLGEVAAQARVQKVQLGCLDQAFGEIAVPRLQVHQSRSFENRKAAF

SEQ ID NO: 949767 - protein, 102 aa, Homo sapiens
MGDMVNYDDIKRFIRQEIIKLFDERMAYYTSRMQFPMEVAAAPGRPGPPGKDGAPWRPGAPGSPGLPGQIGREGRQGLPGMRGLPGTKGDKGDIGVGIAGEN

SEQ ID NO: 949768 - protein, 147 aa, Homo sapiens
TRAEKRKLPKAAATFSVARKRPTGVASPPAPSLSVRCTISVSNAQMARFMPPNDAPSPTSSTGSATEAGAIINPNIAAIAAPWAPIAIVRGGSRRDAAIHRGSVSDCDSVIVNSAGPAQLEIGMNRLAVKGERTLEQGHQRRLERDD

SEQ ID NO: 949769 - protein, 66 aa, Homo sapiens
TRLLLLALARRLHGEAEHRPGELERCEMDVVLVVAVVHHRVEMQLLDLGDGGDVAGNGLLDLDVLL

SEQ ID NO: 949770 - protein, 116 aa, Homo sapiens
QRGSQPLGVLVEHRVDDVHERLVAVEEPVPAGQQVPLEPALAEVLRQHLHHSAVRREVVVLGPHLGKPDPVSGVEHRIQPVGGRLVGPHQPEPVGVALDDVTQERAQHPGGLVGRG

SEQ ID NO: 949771 - protein, 35 aa, Homo sapiens
MIGLHSEGVEGGNSVTADLAGDRRPLQGDEGPLQL

SEQ ID NO: 949772 - protein, 40 aa, Homo sapiens
MLSRRNVIPGGEGAGLLVVWGRLLLVVEVFVVPPPAVFPV

SEQ ID NO: 949773 - protein, 123 aa, Homo sapiens
MGARGERHVDSGMTPYGGARVLQPPAPVGIGVGRVHVQGQGEHVRIVGEGLLHPVAMVGVQVQIQHPPSFRLKPQDRQHRIVEVAEAPGMVGPSVVHASCGIEGDPSGEHRLRRLEAPAGGGG

SEQ ID NO: 949774 - protein, 111 aa, Homo sapiens
HEDHRVLQVVGRDVGLHERRVDHARRERVDAHAEAAPLDRERAREADHAVLRGAVVRAARMAAEAVDRGHGDDRAAPALEHAPAHGLQRAEHAREVDVAAGPEFVGHRVGG

SEQ ID NO: 949775 - protein, 79 aa, Homo sapiens
MSLPSRRSRRVLVPGWLAAAGIALSRSAVRRRQEGEMPLVRFETRESVAIVTIDRPDVRNAVDGPTAAELAAAFRRFED

SEQ ID NO: 949776 - protein, 42 aa, Homo sapiens
YEHRVIQEINFQKRFTNHLRTLVAREEVAIRLMHLWEFVSAL

SEQ ID NO: 949777 - protein, 62 aa, Homo sapiens
HEAKRAAKRYIVSRQVQKLSAGSVLALGQSGHRTLEGVRVQVGDAGQRPAAVGGGGDKGGGG

SEQ ID NO: 949778 - protein, 53 aa, Homo sapiens
HEDVVYEFTGVVPSSIVPVSSPIISSSSSRVSTSRSLVGSSITTRLVGCANSL

SEQ ID NO: 949779 - protein, 71 aa, Homo sapiens
VFQELADCQEASCKSSVLLIHALILVGGRRVDSSWSSTVTCINQLKGDTYKPDANLQRKTEPLESQTEAKL

SEQ ID NO: 949780 - protein, 42 aa, Homo sapiens
HEECFERSEPIHRKRQLTHSRPLTPSCSSSCPVLQSKEPAYL

SEQ ID NO: 949781 - protein, 97 aa, Homo sapiens
TRPVQSPTFALVNEYETTTGDVVYHFDFYRIKSEIEALDLGVEEYFDSGHFCFVEWPSKIPNLWPEKHLKFTLATQPDGSRVVTAGISGISIRNGLR

SEQ ID NO: 949782 - protein, 109 aa, Homo sapiens
RGEMFAEIKMDLGDRGAQGNHTDVVTLDATLLGIETTDSQHVASVRFSGMIRENEGEAAQPFAEVWNLAKPASGAGGWVLAGIQQEPEFADELLIEPKRGCGVMCPALA

SEQ ID NO: 949783 - protein, 44 aa, Homo sapiens
HEDDGSTSGNIGTLITIPTAAPPSSTGVRKGWHEYVTQELRSHL

SEQ ID NO: 949784 - protein, 72 aa, Homo sapiens
SRPRIRHYEFSDHSDVPNNNVNALINGFVYGWHGQVCYMDIMTATPMKVGLLPPFPNIVLSLLSELNISDIH

SEQ ID NO: 949785 - protein, 54 aa, Homo sapiens
HEEDSRLQSQLKSQLTSVCVTNLTVSSRNNRGSLCSIRGSLCSTQCSLSSVSFS

SEQ ID NO: 949786 - protein, 122 aa, Homo sapiens
HAGMVRTRQLNGKLARALQKHERTGSRHLRLPHLQSRIRLAEFMLHSDMEPDLDVITEAARDALAMSNVQLGEELARFALDRGGGLPAALVLAEAVSWQGRGEEAGFVLAHAEPDGDDDWLI

SEQ ID NO: 949787 - protein, 107 aa, Homo sapiens
MPWATKRCRSCAVSTPRSSMPRSRSMATRKSILSARAMARSVRLEARTSKMKVPSRLPENITTLFAGARSINVVHGLGIAVDVLHGVDFELGAGVREAQHRHRSHRG

SEQ ID NO: 949788 - protein, 153 aa, Homo sapiens
MLSHLPGSPSPHFPRLTRTLRSNPELQRLESRRLLRLVAIHAMEHIVEKTHCLDDEWSFVEHHAFSALRHGRIGYFRPAGCSFFHHAGQDLGRPDDRHMGRLAEPQDVLLDFADPLETKFDRQISSRDHDRQWLLPGAMHDQIRKVPDSKRGF

SEQ ID NO: 949789 - protein, 168 aa, Homo sapiens
TRCQPPYGRRVKLFHGGAKASPAPVKRFYLCTEGGCYGACSSKGAEPEPRPKGLHLLGDLYGCKGEDRYFFSADLLREHCLRLVAEAGLTPVGDYFHQFGTDGGVTGMVVLAESHLSVHTWPEKRYVTVDVFVCNYTSDNRHKAHKLFDALVDTFRPDEPRVRSVERE

SEQ ID NO: 949790 - protein, 145 aa, Homo sapiens
HEAGATVHRLRIRGSRCTGVEYTTAEGRQVTAAAREIILCAGAIGSPHLLLASGIGPPNHLRSFGVDVALELPGVGANLQDHPIVPLVYRAARPVPAGRYNHGELLGLIRRHATGGPPEIQIFGVDSADVPGLGGADGYVLGVSV

SEQ ID NO: 949791 - protein, 69 aa, Homo sapiens
MADMVYVTQSAGRLMRVIFDIVLKRGWAQFRDKTLNLCKMIDTRMWQSMCPLRQFQKLPEDVLQKIEKK

SEQ ID NO: 949792 - protein, 37 aa, Homo sapiens
TRPDTSLNVIPHASSNSSSIPPHLEASPILDTALVFR

SEQ ID NO: 949793 - protein, 36 aa, Homo sapiens
RGDILSASPCCQARLTCKHCGNSVIDLRIGMHYFSE

SEQ ID NO: 949794 - protein, 135 aa, Homo sapiens
HEGENGAIPDLENQIYGARLPDAAGETGGEVSPERRRKPLLARQIDPPGGEAPGKGILDGADEKGQGGRGLDVLVGGDGIAGIESDLRLIEHGAGVHPFVDEMDGHARISGVSRGECPVAGILAAVLRGDTPRGS

SEQ ID NO: 949795 - protein, 123 aa, Homo sapiens
RGRSVFRLMLELNERLGTSYVIATHDPEIAAGAQRVLRLEEGVLVPAKAAYGAYGKWLTNHLPLFCSLLLGRVLDLQHAGLHRLGVPGFILEGLGDHEIGCRALDEARSDEARQEDQDPEPQL

SEQ ID NO: 949796 - protein, 42 aa, Homo sapiens
RGSHAKDKLVYVHTNGPKKKKVTLHIKWPKSVEVKRYAIKIM

SEQ ID NO: 949797 - protein, 36 aa, Homo sapiens
HEDVATPSAPALLILTILHLPEVPDWPAAIAALRVG

SEQ ID NO: 949798 - protein, 64 aa, Homo sapiens
RGEENRLDKNGLFNNLQVATVADLLRQHAEQVAEDRKKARVVVPRSHPKDSFLQVVASPDGKWA

SEQ ID NO: 949799 - protein, 40 aa, Homo sapiens
LEAKNSVRRRLRSDIHMGRHTNSLRAASTKLVTVPSAYNL

SEQ ID NO: 949800 - protein, 99 aa, Homo sapiens
TRGHTELDDAFYTIPIMYKIIRARRSIPPTYEEHLNAGGLMTQEEVSDTESSYYAKLIDHVCNMVHYRPPALNLQAHWRAWFIQKRKSPPGVQVCPSTS

SEQ ID NO: 949801 - protein, 107 aa, Homo sapiens
MPLSQIVYKFLSALVSTYATAACQPPSKFFVTPTFQSVKSVIVVVLHLLVTDVNVGDPRRHELVVRVLLISTQKRPTNPQDFHPNLTHVLTLTCCFVEEQETRSDRR

SEQ ID NO: 949802 - protein, 137 aa, Homo sapiens
TRGRAWSTLGRPLDPLTQDVCAFYQDHAVYDDFGGVVVELDEGQRIANALGPNKAVILQNHGLLTVGRTVDEAAWWFITMERSCQVQLLAEAAAARRTISDAAARQAYSIVGTAQAGWFQFQPLYARIVKEQPDLLD

SEQ ID NO: 949803 - protein, 138 aa, Homo sapiens
HEEDAHFPHRAVHFQGIGEGAALGQEGDVPGLEAGDAHVHRHLAVGFQPGHDHPRAGLHPDLPLGGQALLVHEAHEAAGAVAALFHFASVGVEDPVAEVHVRPGRRFHQEDLVAAHAVVPVGQAPQLIPGENDGLAHA

SEQ ID NO: 949804 - protein, 149 aa, Homo sapiens
MDVGQVVGERPDVVEVVLGPAGEVVALQLPFGPRLGERCVLGLTALDGVLQLGAELVAAQEFSHGSDPFDQLMSRNDEQQRMFRNDGGCETPRRCEVASAPATLASRPALRHGQHHPGCPRRRGMVHTASVTADRSGQRLEFGQDRRTD

SEQ ID NO: 949805 - protein, 36 aa, Homo sapiens
NEGDARSIHCTIRDIDGHLVCHIFLASCSAHREVID

SEQ ID NO: 949806 - protein, 95 aa, Homo sapiens
MRSWYHLWTPEVVCRSAQVDWSLQFRIEKSVRFRATSQIRKFPVVGAKLLTVDSNCFYCDEAVDSQLIRQFSSLTHMFTRFSRFADFVAGDSRHY

SEQ ID NO: 949807 - protein, 36 aa, Homo sapiens
TRWTEIHLDPRPPAIIPVTEGPLQAGNISKSLRRSR

SEQ ID NO: 949808 - protein, 119 aa, Homo sapiens
MQSSQRGSTRLTNISTGSRSSSGAIRCAHTARRAGLQHLAAASQPQRHRRQPGGAMGGGAATDLGEGAENAHAGPHRAAQCAMAAEQAQAGGHVERDGGGAEFLVQRDLRREAQQGQRG

SEQ ID NO: 949809 - protein, 71 aa, Homo sapiens
HEGDEDLYDRYEYTFETQFTTCEPMRRMYGMCLTESGLETGSSACSMILVQPTLNTSAEDDCCYTYQEKVS

SEQ ID NO: 949810 - protein, 39 aa, Homo sapiens
MDTTLIRLTYSEFGPLGQKFVSKKIRSRITESTSSLTSA

SEQ ID NO: 949811 - protein, 138 aa, Homo sapiens
MRGGADPRRATCSRTSRIPNPESQISLLSFHRDEAIDCRHPAPGRLMVPISFEFYPPKTDEQRAQLDKTAAKLKTKAPEYVSVTFGAGGSTLSHTPEAVQRLRSEFGLEAAPHITCMGGSREEIRNLLKLYRALGARR

SEQ ID NO: 949812 - protein, 139 aa, Homo sapiens
RGASACHDSSLSFVNEIRPAAIVNFSHDSGEHLVGAEPTKLLTDEHLYLTTVQGYSARWFSRDPETAYLPLRRRISMSPPEVDMTIAEMPGASVVTRSTGTPRRNPSQAASSIAGALPAADSTRADSTVLDVDPLLRLG

SEQ ID NO: 949813 - protein, 84 aa, Homo sapiens
MRQLMCSGRGATGTVPITIIPTSAIGVRNTRSYMTRVGMAVSCPLSVCGEYYYACSIDSVAQYTRSLPIGVEPKQCEQQRPIAA

SEQ ID NO: 949814 - protein, 123 aa, Homo sapiens
TRNIGESVASRIHFDWFTDETRHLVPDLTLAVAMTYKVQTTRLVAVLPRQLTVARAGEGLKKVRDSDEPTLGRSIKISSATELLTFSGLEVPALEVTATVKGIPLMLSDERPTSDFVGRTLMP

SEQ ID NO: 949815 - protein, 127 aa, Homo sapiens
RGLFFRPVGFKYRSLIQDLRWRYAWDWALFAGAVVPAFIFGAAFGNLLQGVPFHFDRDLRVFYTGSFFAQLNPFGLFCGLLSVALLVMHGTHYLQIKTAGAIYERARRAGWIAAVLMMALFPAGGFW

SEQ ID NO: 949816 - protein, 141 aa, Homo sapiens
TRAQLLRGAALLQAAQAGRLRLAAAFGQRFGEIGEQHGEPQPQRVGADEPGRRLALTGQRLQPQRADQHGAQPDHEHDRIAPLRGRIELDEGIAHRAAQQRGIKQTGSRARRVKGVRHDPENLSDTVDLLDHRAERQRGQV

SEQ ID NO: 949817 - protein, 44 aa, Homo sapiens
MRRFQLQPLLLTTVGPTVSSLTHAVHVEVSDARLIMPALHPGLE

SEQ ID NO: 949818 - protein, 119 aa, Homo sapiens
RGRGGAGFPTGMKWSFVPKDNPKPTYLVVNGDESEPGTCKDMPLMMVSPHTLVEGVIIASYAIMAKMAFIYIRGEVLHVVRRVQQAVREVYSAGYIGKNILGSGYDLDVVVHAGAGAYI

SEQ ID NO: 949819 - protein, 125 aa, Homo sapiens
HEAPRSLDKVALDPLEAGAVQRHRGDFARGMRHRGGRLGLPALGLVGTNLRAAIPGRAARGLAARMRDLHRDLDRRIGAHGLQHAGQRRFVVVRVQAEVVRRDPSLRRDRGRFENQHAGTGQREM

SEQ ID NO: 949820 - protein, 92 aa, Homo sapiens
TRLIDTSGTIRTLRSDLTGVSGMAFDIYTRLLVSDPNTNRILRIDLDTGVATRIAGGNGAGFTGDGGPATSARINSPGDIAVDSGGNIFFID

SEQ ID NO: 949821 - protein, 134 aa, Homo sapiens
HEAGDQGAVDGADGRARDPIGCEAVLLQRLIDARLVRTQRPAPLESEREPPDLRPGREQAPSFGVGTLLIPVRRRPHLRDPSLQAASPRLSPLKVSRAMAAGHPARSSTGSAGGGAPACSRNTSDEHGDETVLL

SEQ ID NO: 949822 - protein, 80 aa, Homo sapiens
TRVEGLKPKDLVGQPWRLAFALQDAGWWLRQDIIWHKPNPMPESVRDRCTKAHEYLFLLTKNERYYFDQDAIRTPYSAET

SEQ ID NO: 949823 - protein, 38 aa, Homo sapiens
HEVMFEMMQCIGRLQDPTPSSGDPVEHDPASTHISTRP

SEQ ID NO: 949824 - protein, 36 aa, Homo sapiens
HDDYGQHPQQDKRNYTQVIQNTIIAHIDNGAVKALC

SEQ ID NO: 949825 - protein, 42 aa, Homo sapiens
HEGHSDNIFSRQSYLWNFGVDLYKLFSYCDKRCSPTDVSLIP

SEQ ID NO: 949826 - protein, 142 aa, Homo sapiens
RGASTWRGRCSARCARNPLPGKGSPIVVRASVVAARPGCRARQRRWPATGPARCRRAGAPASPGSGSGRGGGFATRPNRSGAGRPSIWSSVVLSGPWSPTSQRWPHGVGIGATTRLPAKARAWAARPVGRPDTDHHPRPRAP

SEQ ID NO: 949827 - protein, 132 aa, Homo sapiens
RGAGIERARLYRLRDESLGAGLDPDDRFVIRPAHDRLARQCNALDGIGQPGQDGDRLPDRQRHGGPIGEPERQRYGAVRRLRPAPTNCSAPPSTLNAPSRIRVAKDASALCASTSNRADIDDLVKHVRSLDE

SEQ ID NO: 949828 - protein, 105 aa, Homo sapiens
RGLPANALVLGPDLGQVWFPQLVGEEIAAHRHRAGSVRHPDDRARVVGRDLEHRVHAGGGGPADEQRKLEALPLHLPGHVAHLLQRRRDQPREPDQVGLFLPRRL

SEQ ID NO: 949829 - protein, 156 aa, Homo sapiens
MRAGAGNGVATRNQRDTGQCEQRDQLFHDDLLCLARVRRVAATGKTDAAQGSVDGARHESSPAASLKPFGRTQDGAWAYSSITLEYLFELERLVKKIVGSRLGALTPVGGHLRMIGVDDPDARRLRLLDRPQYVDTVPLTQLQVDDDDLIPAAFQQ

SEQ ID NO: 949830 - protein, 44 aa, Homo sapiens
HEGHTNIHLLVTTYSLRDAPVDSVAYHARNGPPVPPEPHPNVQE

SEQ ID NO: 949831 - protein, 125 aa, Homo sapiens
RGDLENGPACRLELFGEGAVGGLGSENLLRACHIAQVGGQVHGIAKDVPPLLHQIPVMDPDVESHLLPGTGLARRLPLQDAGRAERLVRGGKDAQGGVPHRLDQPAAMLLGDPGAPLHEGFHHRA

SEQ ID NO: 949832 - protein, 65 aa, Homo sapiens
HEVEIKRAGEDEPVKGVRNWLENNRDVVQPWIEAAKEARQSSCRARGDRLRRIDRRRFLLGMGSA

SEQ ID NO: 949833 - protein, 69 aa, Homo sapiens
EGAFVADSFPLWAGLMDTMEVVDGAEPRVALTCESRLVDLERAEVRRYTDADQQAEYPGDRFFEFVPAL

SEQ ID NO: 949834 - protein, 74 aa, Homo sapiens
TRWFSCDHRNAASNATAMGSAIPPGTATVTEGWAPPLCMTQLSTSISLTTCLLLSLLMLLFLVLLGASYWYRVR

SEQ ID NO: 949835 - protein, 119 aa, Homo sapiens
TRGIEVLSHHCDSRITIPDDILLTVHVRMATIIKRIRDVNNLLLGAIQVICRMIMRSGLINILFRKLRIVDGLDGAGHDGDLFRPQPAHRTGLARWPDRTSTAPPSDPIGSQRYPCLHQ

SEQ ID NO: 949836 - protein, 134 aa, Homo sapiens
TRQPAKPPKTASQPAKPAKKPSQPSKPPAKPAKPASQQSQPTSQASQPAKPAKPASQPLKPSKQTSQPSQPSHRNIVALEHIQPAKPAKPVKPACQPNQPSHPAQASQATQPAKPAKPPSQPSWPSHSTSQASQ

SEQ ID NO: 949837 - protein, 147 aa, Homo sapiens
TRVVTEAGTPTSTTQTLKAWLAGLPDFELSGHESFSIPQWRWTGGAAKISAAMMQALRNPITIEVPKSDVANLDTANKTLSFTTAPIEEFFNRSPKICDDNGCQAWEEVLKRALTTNSTQHYEAIEDTGASYKITFWPDYDPARHIR

SEQ ID NO: 949838 - protein, 98 aa, Homo sapiens
TRRFRIAAIRWILLHIPDSACDPIKKRLLQIKEHFLTHSRYNPRILFQLLLDSAQFEFILREMFMQMLSEKQARWEHYKKEGSGRMTELADVFSGGET

SEQ ID NO: 949839 - protein, 166 aa, Homo sapiens
RGHRHTEFIKFLNTIDREVPQGLQVHLILDNYATHKHVEVTNWMKRHKRFHFHFTPTSSSWLNQVERWFRDLTDKNLRRGIFGSVPELIASIESYLNAHNADPKPYVWTATAESILAKVRRARTKLQQVVNQKLRHTTSAKGTSGLPALASDGRPSVGAGLQDQQI

SEQ ID NO: 949840 - protein, 66 aa, Homo sapiens
TRRHEGDEVAVVQDVVVRQRRALRRAGGAGGELDVHRVVELHRRLHRAQPLPRRLRRAEGGDALDG

SEQ ID NO: 949841 - protein, 35 aa, Homo sapiens
TRGQVLRCAFLLNAAQAGRLRLATGFGQWFCINWG

SEQ ID NO: 949842 - protein, 40 aa, Homo sapiens
TRITIDSDLFRYLAFVLSQESCPGVHAYALCALVGVPHLT

SEQ ID NO: 949843 - protein, 41 aa, Homo sapiens
HEEDLLQTDSCNTSLLLLHVCHAFLIWSPDTTWMCETSSTQ

SEQ ID NO: 949844 - protein, 115 aa, Homo sapiens
TRRTDRGFSFSSRISSWNASSGKAPSRLERTETSMMLLAGMCSSIHRKATSTTSVATVPISARPKKETPYSVPSAEVTHSEAAVVSPCTDRPWREITPPQRKPMPVRMPCAIRTG

SEQ ID NO: 949845 - protein, 95 aa, Homo sapiens
MGRGRTDKRHAIHRSDPTAMTSAQHPTVEIKILDPRLHQWGLPSYHSDMAAAIDLHACLDAPLTIEPGTPAQLVPAGIPVHMGNPYMAATIAPRS

SEQ ID NO: 949846 - protein, 77 aa, Homo sapiens
TRPRQTLRPVARAEDAAIGGDPLDEKLAGLGGRHGREVNGPLVAGCERDAKCNVRSRDFTPRNDILYKSVVAPGGME

SEQ ID NO: 949847 - protein, 67 aa, Homo sapiens
HEVELEPPAVLVQRAHAHTVGALDAMLDLGDRQGALFPDLAVATGPDDLGIDEHAQPVAGLRHVDHH

SEQ ID NO: 949848 - protein, 37 aa, Homo sapiens
LEAKNSVLRSLRFTLSSTLLVVLHRLGCKGPGRTQGM

SEQ ID NO: 949849 - protein, 130 aa, Homo sapiens
DEVDYYENKMYLTPIDKHMLLKVMGFGLYLMDGNVSNIYRLDANKRINLSTIDQFFKQLQVVPLFVDMQIELDRYIKTSAHYEENMSKWTCTQNSISPQYNISEQMVQIRHDHIRFISELARYINSEVVT

SEQ ID NO: 949850 - protein, 85 aa, Homo sapiens
MARIGAEPSQTAQRMHVAIARPVRMEQELRLGQPDMMLQLTGHGFAAQECADRESMSKIASIPSPIANVLQVLSGDDARPTMDEL

SEQ ID NO: 949851 - protein, 41 aa, Homo sapiens
HEGDDHWSPVVTHMRIRSGLTGHEARNILLFLQGSPEMTGL

SEQ ID NO: 949852 - protein, 46 aa, Homo sapiens
MAIPILSPSSFSLSLNESVALETAAELVQGHAIGNGIDSELVHAVD

SEQ ID NO: 949853 - protein, 100 aa, Homo sapiens
HEGDNVMKGYENNEKANAEAFTKQGWFRTGDQGVLSPEGYLSITGRLKEIINRGGEKISPREVDEVLMDHPAVSQCVTVAVPHDKLGEDVSAAIVLREGV

SEQ ID NO: 949854 - protein, 152 aa, Homo sapiens
AGATRRRRHRMAIEQHSIAVSRQRAVEEHVDATMIGAVQRADARFDLGQAQPAGIDVETMRGDTGDDAEPGGHTVAGLTSRRRQRIGDHGRVDFVGVAVEVEIGAAVAGSDQRYALGYRVAEQLVDIGVLGAAELPERQPRLCQEGARIFAA

SEQ ID NO: 949855 - protein, 114 aa, Homo sapiens
SSNHRALTFGIFAFLAHPTPTCTLTCMASAECGCCEGAPTSVSPTQPREPGHRQDVGAAEVPPLLCLPRSPGNLGPTGAKELQHRTKKLDLFSPTDKSPVLWSNSVLYIKEQLD

SEQ ID NO: 949856 - protein, 64 aa, Homo sapiens
PRTQVGGLTEAMPLAIKTCTDPCALTMLNATVGVSGTGNHSIMSLFQRGCPSGDANTMVVLPSK

SEQ ID NO: 949857 - protein, 148 aa, Homo sapiens
HEADAAVAAEAEPDAVVVDDDLRLTVAGPAYALHHVVAQRQRQQEDQHEASVVQGQSRRIGRIDHEIRITATIMPNDTTAMLRLCSTPKRTITGDTAISAALGAMAQQVVGQHHRHHRFGDRRAADADAGIVAALGAQLDLLAEAVDA

SEQ ID NO: 949858 - protein, 104 aa, Homo sapiens
WRRSLALSPRLECSGAISTHCNLRLPGSSNSPASASRVAGTTGACRHTWLLFCILVETGFHRVAQASLELLSSGSLAALASQSARITGESHRGPALGIFFYLRL

SEQ ID NO: 949859 - protein, 123 aa, Homo sapiens
TRRDALVLDVRDEGEYRAAHIPHSRHVPLSAIDSRIRELEKYRKRPILIICRSGNRSGAAANLLRKRGFEEVWVLKGGLVAWEQANLPIEKGSSVARVNMYCTAICPYCQMAEALLRQKGVLE

SEQ ID NO: 949860 - protein, 73 aa, Homo sapiens
TRPRADVLGVGGSPRFEFADIGLGGRRESGEVVFVHAEHNSAAAAQLGIRHTKRYSSCVLILARRVPLHRIHV

SEQ ID NO: 949861 - protein, 47 aa, Homo sapiens
HEANTHCHELWHLCLQGSLYITLIREDVMQAYKITDDLFTSLIGNGM

SEQ ID NO: 949862 - protein, 104 aa, Homo sapiens
MSSSTGGNSGRSADGGTGIGVRDLVHHAEIVAALERQLAGQQLVHHHAQRKDVGLVIERVFLDLLRAHVGRRTDARHLGFGGRYRHRGAEVRHLHIGAADRGAV

SEQ ID NO: 949863 - protein, 146 aa, Homo sapiens
RGVADALRRYLESHPNASDSLEGVMRWWLASERIEASQAMVRSALAHLVEDEVVEVRVLSDGTRVYLAGALRQVFAPIGDTAMSQLRVQLSSRTGKSFAGHRVVASFAQLVTIDAESAPREVPGEASKAVEDGGLALIELPGKDTL

SEQ ID NO: 949864 - protein, 41 aa, Homo sapiens
TRLAALCARHKVDLVSVGNGTGSRETDKLVAELIAKRPQLT

SEQ ID NO: 949865 - protein, 67 aa, Homo sapiens
TDGVLILCPLARPELRHPREEDRKYGKSVLKHMNGHLEEYHHAIWWSMDPQRRYMLMDEIITNNSGG

SEQ ID NO: 949866 - protein, 84 aa, Homo sapiens
RGAVQGGKGIRGDGCCMDSRIIGAVNAAVVYMGDPWSELIESVPPPGPEESDSTTGENDDDITLLVHDHYYLFLNTLIWSAVMD

SEQ ID NO: 949867 - protein, 41 aa, Homo sapiens
TRSIVASFLHLANIHFAAIDASNAQVTTENQLTYLTRLLSV

SEQ ID NO: 949868 - protein, 79 aa, Homo sapiens
TVMLKGSPKEEACVDPRGTPDQVRRTWKEYYLQADERGLEQILPSRHSEDAKPAILILDFQPPELRDNTLFLLFEPHSW

SEQ ID NO: 949869 - protein, 63 aa, Homo sapiens
HEAALDRLYRSHVGPGDRYALLDFPDHANVGDSAIWLGELAMLRAITGREPDYVCTWHDFDER

SEQ ID NO: 949870 - protein, 145 aa, Homo sapiens
HEAHGSNDAQNTMGIIALTLVAAQADGTLDNLPSWLAFLHPSPNALANNDIDAWIKVTCAIVMAAGTAAGGWRIIKTLGHKLVKLHPIHGFAAETSAASVILEASSLGIPVSTTHTISSAIMGVSTAMRFNAIRWTVVERMIWAW

SEQ ID NO: 949871 - protein, 151 aa, Homo sapiens
HEEVGAIGVILWIGGHDVLAGRLTAGELSAFVFYAAVVAGSAGAISEVVGDLQRGAGALERLMEILRTEPEIQRPARPVPLPEPPVGRVEMERVTFFYPSRPEHPALYDFTLRVEPGSRLALVGPSGAGKTTVFLLLLRFYDSAAGFIRVD

SEQ ID NO: 949872 - protein, 42 aa, Homo sapiens
HEEYIGLHIMPQALPKFLTHSTLSLAGDQKFDSSHLPNFKLG

SEQ ID NO: 949873 - protein, 60 aa, Homo sapiens
MHLGPGGSADTSQGRDEKATSYQEEVLKDALQCCHQCRARRRQNSTPCRTGQVLAALGML

SEQ ID NO: 949874 - protein, 116 aa, Homo sapiens
HEGDDQWKPVVTHMRIRAGLTGQEARDILLFLQGATEMRALAAVAIGGFLDGVGGTDLAASHGKSVYEQTCIAFMADGKGSVPGAPDLTRKSGPLAKPDDVLFKNVKNGFQTPGSP

SEQ ID NO: 949875 - protein, 81 aa, Homo sapiens
HEENKEVELASRENVRITEYELVDKDAEGDARFAPKITLQATTVGRAILSEILPQGLPFSVLNKTLKKKVISRLIITALRK

SEQ ID NO: 949876 - protein, 108 aa, Homo sapiens
DEGCSGISALKGCQLIAYLWSQFDLTVRVSTDDLIRFIYGGDGLNPAAIEGPYDTLGFNKVLGNISPSFPCPSQPAHRNTHWILTTDSIMVKSEFLCCQDSFLHEITT

SEQ ID NO: 949877 - protein, 75 aa, Homo sapiens
RGGTRPVGPPYHRDALGHLGRAQDHGADGRGPVGLAVLPVGQHFPVPGPHQHQVPPGADPAGERSGVHPPHGLPT

SEQ ID NO: 949878 - protein, 38 aa, Homo sapiens
MPDRELVSDLELGSNKAFSTSQHAQPPSNKDLMPGKRL

SEQ ID NO: 949879 - protein, 106 aa, Homo sapiens
MPARSPSVAISDDCPGYDLALFCLPNHYAVDLGNEFIPHGLIMDRTERLARDVMKDMGGHHIVALSVLKGGYEVFADLLNYIDALNRNSDRSIPMTVFIRLKSYCS

SEQ ID NO: 949880 - protein, 117 aa, Homo sapiens
TRVSARLKLLNPELEAVQILMSATSCIQLKTIRDGAASLIYRDLCGPCLVPFVHVDDNGFLGSGSMIGIPTIEMIAQEPFGVTQPIIDAVKVSPVSYLKVSRSPVLHTHKNEVLRVV

SEQ ID NO: 949881 - protein, 76 aa, Homo sapiens
MERAELLAQLQALTARVDELADRVRRLQDENRSLRQQQEQLVIERSALLAKNEQALQSRGGDDRPPDIAGAAYMTA

SEQ ID NO: 949882 - protein, 88 aa, Homo sapiens
TRDARLYRTGDRVRWRTDGSIAFVGRTDQQIKLRGFRIEPGEIEAALAALPGVNQAAVMLRTATDGERRLFGWASGDGLDGAAPAHTA

SEQ ID NO: 949883 - protein, 100 aa, Homo sapiens
TRVVPNTCAINSTDDPQVIFNSNYIDIHSNSDSGSTFVNVNEDSVPENTCKESLVLGQKQSTWVPESQSPNCMNCQVKFTFTKRRYHCRTCGKVFCGVCC

SEQ ID NO: 949884 - protein, 36 aa, Homo sapiens
YEQTVNQEINFQNSFNIHVRTLVVREEVVYRTDASV

SEQ ID NO: 949885 - protein, 88 aa, Homo sapiens
TRLDLSQDHEPDRVHRREQHERERRAQVEVAAGDPVAECVRKREIDRLHGDNEHVHEDVQGCPAPADSDRSRPHGPLTRGAVDDEPDR

SEQ ID NO: 949886 - protein, 93 aa, Homo sapiens
RGEWSNVTSSQYDWRQPLLKADEEPLNLDWGEDQDSALDDEEDDAVGLAMKTSYDMEKRYNNHITRPQTLTCYLIPQEEDDPEGDTDVDCACC

SEQ ID NO: 949887 - protein, 75 aa, Homo sapiens
HEVDLNSEMVYQLGQDHDLKAILHETELRPVKTFDSYILQAHIQDSVGISEGLLRCGKTTHVLQFNLYNFIQIDR

SEQ ID NO: 949888 - protein, 143 aa, Homo sapiens
LLDQLPGEVGIPVREDPRCDAEDMLAPEVVRIPLALIDERDASQHAGVLHRRLPEDADVAVGDEVLPGEQLHEGRLAGAVAPEQAVDPVLVGAERHVVNGGHPTETLGDGVDLDDGGHAPSVLIMSASSREPDAEIGRIVEQR

SEQ ID NO: 949889 - protein, 52 aa, Homo sapiens
HEAHPLLEGDRREPPLAQQKFVAFPGEPPVLVEGFDLLDHALTLDDLEHHTS

SEQ ID NO: 949890 - protein, 36 aa, Homo sapiens
HEVYPCLVFSGDSMATDYRAPSKELATSNLVSMNNM

SEQ ID NO: 949891 - protein, 76 aa, Homo sapiens
TRQIHKNTPCPDVTLGTNPGTEYIQVPIQEIPLGLDLKNLRIPKTIMSFDITYKSEVFSRFGIYLSTWLGFHTTRI

SEQ ID NO: 949892 - protein, 52 aa, Homo sapiens
HEAARGDTLTPSYGTAVGASGDRPAALSELVGILLSGGVQPYTETVRWLDFA

SEQ ID NO: 949893 - protein, 152 aa, Homo sapiens
PDADDRYAYESGFGAQRHPRPGMEPIMAALQRQDGWYRAYLANMTKAVSAPDLAELAALLSCEMPLDLAVQRGKTALMVAAELGHQAVVDMLLVHAEEHGMRQLNLGAADSGDTALMLAAFHGHVAVVERLLAASAATEVPSQCGDTALMAA

SEQ ID NO: 949894 - protein, 125 aa, Homo sapiens
TRPKKYLDDAPRLVHNPDGSDMWKFRDTVIPNVALNAVAGRPKEEYGIEPTGLDEIRPGCYNVDERVKDMNAGGILASICFPSFPGFAGRLFATEDNDFSIALVQAYNDWHIHEWCGAYPARFIP

SEQ ID NO: 949895 - protein, 82 aa, Homo sapiens
MADMPVEAGESRVSVNISGQIEIDRKKQALTLTAALLLAGCGTLTAPAPDVPASPQPPVVQTPAPAPTTGLQLADDTHAQDA

SEQ ID NO: 949896 - protein, 90 aa, Homo sapiens
MITPCYVIRLTNGALEFKPGGGKLFLKVTGFNKFLTFGGKGLPVFKEGSEPGFGRSALFKGVTGSKKRGNKRFTFKKGFKNKWGSFGGPK

SEQ ID NO: 949897 - protein, 80 aa, Homo sapiens
RGGLGVNCTTLRKPCTGEDRYTWLVLREGMVFTIEPLINQGGNAVLTVDAGCTVVTRDGQLPRNSSTPCAVTPKGVRVLT

SEQ ID NO: 949898 - protein, 40 aa, Homo sapiens
HEVERHRALELLASRETLKVRPSKSKPTLRVDEAQLFNTT

SEQ ID NO: 949899 - protein, 76 aa, Homo sapiens
TRGHQACLVRYFASSLSGNFIYRALPDQMRILPPMCASLTRADSEVNLTPIFCLKLQIVETHSELLQGVPDLTSPH

SEQ ID NO: 949900 - protein, 90 aa, Homo sapiens
HEELTGYQLTGMNWLANLYEQGINGILADEMALGKTVQSIALLAHLAERENIWGPVVIISPASTLNNWHQEFTTFVPKFKVLPYWRNPHD

SEQ ID NO: 949901 - protein, 41 aa, Homo sapiens
HEADDNHAHDAVLYVLGLIGTHFRFGGRNSVSGVDCSGMRE

SEQ ID NO: 949902 - protein, 162 aa, Homo sapiens
HEVHLAGQPVALLRRGGQSGCALQLVVGAPRGLRGHPDRHADRQFDDDGGVVPEVEREVVLDGEIGGHHRQARQHAAHRTELDGGRDGGIAGPQRRRPGLVVGRPVRARDEVVRPHQQHDDHQLGQHPRRPAAEAPQISQRAGRAPADQPGEKHPTQHGAKQ

SEQ ID NO: 949903 - protein, 108 aa, Homo sapiens
HEVLGDLFGGAPDQAQRREDLAGDDPRRDPGQQQPDSADDGHRADRLLDVGALGVDALPGDEIAVHQRVVAVDEGARPAQQARRGDGLAGVGDRGVEDLREHLLGDRR

SEQ ID NO: 949904 - protein, 131 aa, Homo sapiens
RGDEVEAQLVVEVVVEARTDVAGPGRQRDAHRGVLVQQRAPRVQRFRHQPTALITCCANRWISRYCLCDNDNWSGFGTSNSVTIMLRSSRSQVAPYMLEDLAHREVVGQHPRGEPLDARAPGRGYQRVHQK

SEQ ID NO: 949905 - protein, 129 aa, Homo sapiens
RGGESIFIATGSPISSAYTMASVALRATTVCAIGMRKAASSAFDSISVSTVRRSDSAVSITSRADSTDGGSRSCASEAGAWRSSCWLRQEEMWWNSSTAGSGERKVGMCAASNSERAARTWSQPIQQVI

SEQ ID NO: 949906 - protein, 159 aa, Homo sapiens
CVIALGRQQRQHAIDAGVGQNRFERRAVARIVGVADQVDRVGVRPGRRQRTVEHFQRFRRQLGERNAEVAARSAAITPGPPPLVTTASRLPAGLKPVNSALAAENIWPSVDSRTTPARRSAASNTSSAPTMAPVCESDRLGAGRMTADLDRQHRLDAGG

SEQ ID NO: 949907 - protein, 127 aa, Homo sapiens
HEGDCTGLLPLASVAAMQGRIAMYHALGEGVSPIRLRTVAATVFTRPEIAAVGVPQTMIDDGSVSARTIMLPLRTNARAKMSGLRQGFVKVFCRKSTGVVIGGVVVAPIASELILPIAVAVQNRITV

SEQ ID NO: 949908 - protein, 124 aa, Homo sapiens
TRAKVMGRSAAGQPRVVILGGGFAGLAAARALKGAPCRVTLVDRQNHHCFQPLLYQAATAALTANDVAWPIREILGRQANLDILMDEVEGLDPEARQVRLSGGTLDYDRLIVATGASHDYFGHD

SEQ ID NO: 949909 - protein, 118 aa, Homo sapiens
TRGQGTFRQEPGFHTKESTTMAGPQRKSVNKKKVVPIKTVHIGAVDYKDTALLRKFISERGKIRARRVTGLSVQDQRKVAIAIKNARNSHCSRTPRRLAEKGEDMKLILTAPVKLGVP

SEQ ID NO: 949910 - protein, 115 aa, Homo sapiens
MRGQLGLDADACLEGDACAALGHLQGQLHRTGFQRRLVPRASACEQRRQQVMDGKVALGQDERVLGAGGEADVPAFGQWMPRRDDGAQTEMTDAQLLQVGGTRQGEGQTDIRLAA

SEQ ID NO: 949911 - protein, 43 aa, Homo sapiens
HEVNTGLIEKNIKFFFSGSAIPIINEYPSLDSGVTVKTLGPMN

SEQ ID NO: 949912 - protein, 165 aa, Homo sapiens
AHTFGVLQYDDDVAGEDLASGGQAQAAGQSLEQRRADLVFELENLPVDRRGGNVEPARGFADRLAAAHHVEIVNGRRVDAQLAGQAFSAPLPVAESAALENDGDQIVAGKGEVRAGHPLAVDAADLVGEVGVVLRSGPDQEDQVHGVDRVHLAGGDPGVEYRGAA

SEQ ID NO: 949913 - protein, 129 aa, Homo sapiens
MAFSEKPADAMTASQMPRRASALLNILSSTEDGTEHAAHDFAADRAGDGARHRLGGGLGQTVTLTAARAGRAEHQILQPAEQAAVTVLARWSHRVVRPAQACRWRPDSRSLQRPAFRRRTRGPASVRSG

SEQ ID NO: 949914 - protein, 64 aa, Homo sapiens
RGFRTCFFDQLFATASSEASFTYMSACCCDKLQNPLQFQCHLFVITFINETASIKDNVVTSKLL

SEQ ID NO: 949915 - protein, 74 aa, Homo sapiens
RGECAYFICLYPDGVFYDLHIMHAFHQPDSKGAPDSLGDWTVDPPDPAIPYDTFYRQQPLLSTPMLPNSATNPP

SEQ ID NO: 949916 - protein, 103 aa, Homo sapiens
MEAASSLMRHGLSKTLSDACKPLKKRLSGFHGSIFSVLGLAKVHLLLQSLSENEVSDSPGDEPSESPSDSADDPQTDVTVSSKWSERGVTAMKEYVCQLLEKT

SEQ ID NO: 949917 - protein, 130 aa, Homo sapiens
LEAKQTPADLVEDQPDQGLGARDVGGRHDEIERRRPRSAYDVGDAPVAAPRDCGDDWIAIEAEKGHGGREHAWAFVVRFVQQLAGSGGDDGMRSGRAKVRGLHHGRERRLDRAFRVGQEGGDAGERLVSL

SEQ ID NO: 949918 - protein, 49 aa, Homo sapiens
TTAAIAVVIDFRSEGSSLRVREKLERLGFHIEAGVRCHEQFLLSVRRQH

SEQ ID NO: 949919 - protein, 151 aa, Homo sapiens
HEGKTSIKAAEEDGGPGVEFAYFLTEATLLITPVKVSNSTKSFLASAGYGEQELDANTALMELVKGLRSGKLGEQCETVVRFPRLFQKYPFPILINSAFLKLPDVFTVGNNFLRLCVLKVTQQSEKHLEKILNVDELVKRIFSVIHSNDPV

SEQ ID NO: 949920 - protein, 95 aa, Homo sapiens
MVPNGQLSGTLSEQDKLGHLNVNFNPQALVLKHIVTMFMTVRMNLWAASAPWYCTMSASATTRVSTVCSLVSRIAFLRSRQSREGLPHVGFFFSV

SEQ ID NO: 949921 - protein, 76 aa, Homo sapiens
QGTKDRGALYEKAKLPFISYAIVDGNLVAGQNPTSTKETAKKLASLLREISGYPKQPQPAERMTEAVRRALTPSAA

SEQ ID NO: 949922 - protein, 116 aa, Homo sapiens
HEVLFQQAMQWVTLGSDAGGFVHVGSISIGFFATAIAVRLLARRVIANESLARERGRDLAEQVRVNERVIRDMDDGVLVVDTLGHVRQANPQARRLLDPLMPRPVMLADYSPALAA

SEQ ID NO: 949923 - protein, 104 aa, Homo sapiens
RLVLSLYKLWFYKLACTRWLDHHTLTGSAYLHAHCGLYLVHLPARCSSVSPNEIRDGRVGLGGNGVCTHKCWGLGASILSKAGAVNMVGAALPTPSGGYERKHS

SEQ ID NO: 949924 - protein, 120 aa, Homo sapiens
TRQRHLNELPGHGSPSCRRRTGEFSAGVNGNILRPPSDTNHTLEPTVSLDSVSYLAGYPDSMTAPTIRVLDLFAGAGGLTAGFHTASSRFRSIAAVEMDPEAAASYRATFPKTEVYAGAI

SEQ ID NO: 949925 - protein, 33 aa, Homo sapiens
RGAELFFPHLAGGLTTCWYSSSDRRASCTNASD

SEQ ID NO: 949926 - protein, 82 aa, Homo sapiens
MVRLSTRSDDREADTQMARGGRGFQGTVLKALRAPEHKLTITAVRELAPYTELTVHCPSLLGTGAAMLPPTAWVRMWIPQGG

SEQ ID NO: 949927 - protein, 128 aa, Homo sapiens
RGERQKLGLPPLTSTTLSVCSTTLWVGQVGKKGTQQDLTNLFEKFGHIESINIIPPRGCAYVCMVHREDAFRALQKRQFCASYTIGSKVIKIAWPLDIGVKTEYLQFWDVDLGVTWIPRETVKVDDLE

SEQ ID NO: 949928 - protein, 77 aa, Homo sapiens
HEDNSYYVISFMKGSHYEFTSCGAPEQAAGLRQGGTGSHTMGSDPGHDAEGIQAVGRVRSERNPTWDVGVCDRVISV

SEQ ID NO: 949929 - protein, 52 aa, Homo sapiens
RGEVEAHLPEKVDYVIRCDMSALHRLLYRHMQAKGELLTDGSDNDKKGTGGT

SEQ ID NO: 949930 - protein, 38 aa, Homo sapiens
HEGGRAHAQAQCASASDGRDVGEATAPCLFGLWAVRTG

SEQ ID NO: 949931 - protein, 40 aa, Homo sapiens
RGVIPIKYRRHLYIHEYPLFSSHLSVQTCSNWPSVSASIY

SEQ ID NO: 949932 - protein, 43 aa, Homo sapiens
DVNRNASHILHSKLYSLSRRIFICWDCLSINTHPFCISRARHP

SEQ ID NO: 949933 - protein, 141 aa, Homo sapiens
HEEGSDDSSFSIGDNNGLQQAGKRRRRRLELGDWTPHSIKQLACLHQVIFPVSYIDKFYRDVLEVGELASLAYFNDIAVGAVCCMVDHSQNHKRLYIMPLGCLAPYRRLGIGTKMLNHVLNICEEDGTFDNIYLHVQISIE

SEQ ID NO: 949934 - protein, 166 aa, Homo sapiens
IKDKTGKTLASGISKEGDARDLTGTPPFKVVFGNAEAVESLAVGGATVDLQKYARNLRGTGHVALNRLVIGAVPVGSAPCLIMEISTPLDCAPALVGPLPRRNSRAAQIRWGDRVVHVGGDAPVCVQSMTNTDTSDAIGTAIQVKELARAGSELVRITVDTPAAAA

SEQ ID NO: 949935 - protein, 147 aa, Homo sapiens
TRVAAALVQTRMQGTGGHSSAPPADEAVKALDKRLAAGIEEVTAEIGILSGIVRELASVVAAQDGDIDRLKVQTQAQAQLQAQAAAKPAAPSRPASRPNPPEAVPPSPAAQEAAPMRLVPRTTPPAPRLSDPFETVADETPLIRAFD

SEQ ID NO: 949936 - protein, 65 aa, Homo sapiens
TRASYTLLSSVKPNSDSMCLHSFGLLMANWEIPVSSDGQHWWDYVDPTVTLELLDAPLHEFLDVL

SEQ ID NO: 949937 - protein, 44 aa, Homo sapiens
KRRAEGCGRDRADVSVNLWSEYTFTCAPGKHSVPGLIARLADPA

SEQ ID NO: 949938 - protein, 90 aa, Homo sapiens
RGFRTHFIANHDGRASSRISFRWKVSAAVQGWKSHCFPNVTCLAIFPSGEEPEALSGSSDPGFFETPAMSFSIQLVHVMHTLALAVKETL

SEQ ID NO: 949939 - protein, 35 aa, Homo sapiens
ACISLFHVTKLLIYFIFSVMYMRDCVWMLGNENCM

SEQ ID NO: 949940 - protein, 34 aa, Homo sapiens
GWIKEPTDLLSCPAIVQDLTNGNITWADVEASIL

SEQ ID NO: 949941 - protein, 32 aa, Homo sapiens
MPSGDLFTGLADTILETDCRSAAPITTTGTHF

SEQ ID NO: 949942 - protein, 117 aa, Homo sapiens
AAQRVERRRDPVAVECFDRLRPGCGVQVEGGRQRVLQQYEIAFLQCDAGLVRQRCRPHAGGVRQTVRQRVVRPQLHAGNVGAYRQAAGAPEPQAVDDRGRLFACDVDRVGVEQHLRF

SEQ ID NO: 949943 - protein, 37 aa, Homo sapiens
HEENPNSSLVCDMSSLFQELNSGHRPPQIPWMLLHLV

SEQ ID NO: 949944 - protein, 108 aa, Homo sapiens
IIPGGRAGAIRYHADPMNYEILLGLRYVRAKRRNGFISFISLISTFGLALGVAALITVLSVMNGFQKELRTRILGVASHIQVTGYDNELADWQQVADAVLKNPEVKAA

SEQ ID NO: 949945 - protein, 38 aa, Homo sapiens
HEGGADSIACGTFSRELHTPEKMSQGPTLFSCGNMEND

SEQ ID NO: 949946 - protein, 90 aa, Homo sapiens
TRGIVRPASLQVHSVLVTSSDSSVIIQEGVPSPTSSSVITQAPSSKRPIVPVPGPFPLLLHLPKGYSKPVAIPASITSSDVNVPDAFRLV

SEQ ID NO: 949947 - protein, 96 aa, Homo sapiens
HEAEAGPCGAVWLGQAVGCPEGQLRQPAGGVLIWRSKVLPSPEGPLGPLPARVWLGRRNKAELQFPGLDLAYGFSARARGRGSGSHVWILKRHVVF

SEQ ID NO: 949948 - protein, 105 aa, Homo sapiens
TRRYPDIHAAAFGTCLAASVVAPGSGRVLYAVFSRDSRRSGGPGAGLCLFPLGEADAKMEDSRNACYTGTRDARDIFYKPFHGDIQCGGHAPGSNKSFPCGSGHL

SEQ ID NO: 949949 - protein, 123 aa, Homo sapiens
MRGSAGCCGPWQGGSPGFMNSEPSLWGMEALSTGHVWSLQPVASKHGDWFQAQYGGEGDYGRNQGDSGVEEGSRRAVGGYIRSCGHGVQTRNPGRGARIPCTKRMVALGLLVQSISPTLGVWR

SEQ ID NO: 949950 - protein, 37 aa, Homo sapiens
MADLAAPSLQLASSLMTESALLAHATAVLKQIARNGQ

SEQ ID NO: 949951 - protein, 126 aa, Homo sapiens
RGQVRLREKNFTVLASHQQDLTSVLTLLCVHLRLQPRCFRVGLQLALMNNQMLLKQQERDGQYIEPVVPLTDLLEVSSGEENEQVVFSHRAKLYRYDKDVGQWKERGIGDIKILQNYDNKQVLIVM

SEQ ID NO: 949952 - protein, 121 aa, Homo sapiens
HEGDADLTGEEEGGLAGGGPVAFTQGGTEVGAAGPEGLGDLAVGGDEGDVGVGDGVEADHQAAGERPGLAAEVTHLAHPRPDLLVDLAQHTCLQRLAGLHDPEEHGIAGLRPAGLAGEQDL

SEQ ID NO: 949953 - protein, 49 aa, Homo sapiens
HEGHPHTDSISDRQLLHHGVFVFSISIALSGENMPMIQLLPASLVTDGN

SEQ ID NO: 949954 - protein, 59 aa, Homo sapiens
MGSVRRRCCTIKDRPSMPRSMLVAPVATQMCVPDGNNIVLDAFEQLCQCVGIGPVFIAA

SEQ ID NO: 949955 - protein, 163 aa, Homo sapiens
LEAKNSLTNLTLAQLYYKRREYSRAMPFIERVNGRGNPTAESLWLGARIARRLGDTSQQNAWSAQLQRRFPNAPEEAAFNEEPGMTDRDVASAADFSHGAAPVSNPPAAPSSERDDLREIAERLRAGRERQRLTVDDLATRLKVAPGKLLAVESADVSALPDM

SEQ ID NO: 949956 - protein, 55 aa, Homo sapiens
MQGKRRALNLNFADPPFKSTGWVTLNPIPRGVQNPHIEFGQQWLKNNSMNFLWIW

SEQ ID NO: 949957 - protein, 157 aa, Homo sapiens
LSEHLFEHRFGTAVGIADSISRLAGADGQRHAQRGQEKGVAQYACERAAAGDRGRAHPPTRSCWISQRPSRRTSVSVLVVLVFQADRLVVLAERGVGTVCGDRLHLHVLDADLDCARLGDARPALGFPGTAGFAVRYLEVGRVIAKVALHILARPGG

SEQ ID NO: 949958 - protein, 148 aa, Homo sapiens
RGEMQADTGDDRDAEGQHDGGTAAGERGEDADADDGREMVDADHRMADARQQALQERLGHLAAHDVVGPCRLRRHDHDDRKRAEPPGENTIASSVVASPKARMDAVSDGAPSSSPAAGEKRCLDPRCAPRDGSDAVFDGKFPGSRVFA

SEQ ID NO: 949959 - protein, 121 aa, Homo sapiens
HEAQHLVSIGQGLEEIASEVGYADAATVRSLLRRKLGRGVRELRSALAEVVGHDLFVSANGAIRKVSNWRVDSVNAQLLFFFHGPAHRRNSARSFDARRVASAFHAQASPQFERSAKGSYS

SEQ ID NO: 949960 - protein, 99 aa, Homo sapiens
RGLVLSMNFGSHLASVRKRDRALVLTLAVADLLGRSGERVGLLGLTEPTSSRRAASRIAEDIDSNSDAPQLASGRPSIARVRRFSRLILASDFLDPIET

SEQ ID NO: 949961 - protein, 101 aa, Homo sapiens
RGGELSSFFKRTEPHSPVGFLLDRAISWANLPLDEWLREVVSDDSVLNTVRDRSGSREAEPGRSSRRSGAGPTNGICRRMAVRLILAGTERSKTPGVEARA

SEQ ID NO: 949962 - protein, 46 aa, Homo sapiens
RGFPMSCIFCSHYGHCLEVTFKGGCNFIFGLHDHLGSGSYYYAISH

SEQ ID NO: 949963 - protein, 57 aa, Homo sapiens
YEGYPGIHKLAPQVHNTLSKQLNVSKSSSFDETASVSVSYKEALSFPHLHLRGQSND

SEQ ID NO: 949964 - protein, 155 aa, Homo sapiens
RGTLAVRHLLPADEHVEIGAEFHQPPEKVRRHHISIVRDHNQGARRARNELVLLAGDPALLRKLFRLYDQPGAIAAGLDRCPETLGTADQCFAAQPVGPPQRPDAVEECVQSRRVLAVVYDAEGHAIDRRRALRLRQQAEPRQDGAILRIEILQF

SEQ ID NO: 949965 - protein, 125 aa, Homo sapiens
TRMATLTLAAATVAMAAGVGVAHAADVIDNQNSVNAKGKPNSGPGVQGAPDTRTGPATRAPGGEESGTANEGASSGASGSGATTQPSQDSSGVEGMPGNKSGPAAKSPSTTNYRQSAEFPRDPRL

SEQ ID NO: 949966 - protein, 157 aa, Homo sapiens
TRSGESLWSKGQKAAVMHLLDYVASGDQADYADYRRNIGITLGDRRAREALDRPDPDRAAAAQGFLDGGNDVGDVPSLIRLFVWFRWAPPMRDAIDLWTEGDRLIGEIDAVARVAHGQISAGSLTADERAVLTLRVRQLDATLETVAVRFSWTLGDI

SEQ ID NO: 949967 - protein, 155 aa, Homo sapiens
RGSDTRGIGAARRWITAELTACSKAAGGRLQVEEQSFIEPAGNRVSQPTELVNVVATLPGRGASKSRVLVVSGHYDSRNSDVMDSLGEAPGANDDASGTAAVMELACVMARRQFDATLVFMAVPGEEQGLLGAAQWAREARAAGTVEAMITNDII

SEQ ID NO: 949968 - protein, 81 aa, Homo sapiens
MRSIYETTRLGMLKVTPAAILLVAQAVTGFLVDPVPNQRLYVHEDVYAAVTSPELHKQMLSAENAVIGYIDPYSASIISLF

SEQ ID NO: 949969 - protein, 107 aa, Homo sapiens
RGQLLCSDVKFTTLIHVLHPLQVKEDIESLSRLIDGNHIDEDPPSTFEIFRVTRIPQGHPMSITVDVMESSPFIPVLGASHKHPTHAHIMYNGSFPTLPQMLGRHFV

SEQ ID NO: 949970 - protein, 154 aa, Homo sapiens
RGRDTPSAAQCACSAAGGAPNVTLCTDSRLCAPVISAPVFDRDAEPFPERPEFGVQRVEVLADIGQQLRGIAEFSVPVAGVVGQVGPHRRLGLGRELAPAESVITPHGPNMIGDEVGVAQVQDARIVDQGIGHRVGDAGPGHLEVLLRLCVQVD

SEQ ID NO: 949971 - protein, 56 aa, Homo sapiens
RGGPRARYVDLLRPCGNHRSDPGLAHADFGAPLVTLAILSILFVPRPDAYQPYLPD

SEQ ID NO: 949972 - protein, 84 aa, Homo sapiens
NRDRQCRRGTPTVPPSTCRRAVGRSARDRRRRPGPPRRPGPAAGRRAAAGRPGTPRRMMNSRTIAAVDVDVAVRQIAGPDRGAA

SEQ ID NO: 949973 - protein, 147 aa, Homo sapiens
MVAEIAQRDARDEVGGLTPVAAGIRSKVHVRIRTHLRTPNRPVRAVSVASRSPVTQAICVGDCKGSVIVSHNSRAAGRPERARKNLPCRSGPNRETAGEHVLISCSAVRDRPWPDQCRVSTSTSSRSWASKTASTSVSVSAPYCPNT

SEQ ID NO: 949974 - protein, 84 aa, Homo sapiens
MSAVRSSRARSVAWAPPTPSSGGGRKARLVALRALLIDLPRRQMRLGAEALVAVGRDLGHQLVLADEVAEAVEDRLSLVELQPA

SEQ ID NO: 949975 - protein, 97 aa, Homo sapiens
TRDRREHGQHDDGAEGDRRRPGLYGGQATEIDERHQYRDDVDVEHGPAVDEFDDAEHPGALHDAAPPAELQRHGITTRTSMIFNSGTMLLAKKTTAD

SEQ ID NO: 949976 - protein, 45 aa, Homo sapiens
TRCTSLLPLEDVGSVVPHEDCITDVKKAYVNFLTHCYVDTEVEMK

SEQ ID NO: 949977 - protein, 116 aa, Homo sapiens
HEASRCLTGPPGRFWHNRNHRFSPDAARPRGVRLPGNPAMTHTITVIRGDGIGPEIMDATLHVLDAMQLGLSYEFVDAGLVALEKHGELLPAATLESIRRNRIALKSPLTTPVGEG

SEQ ID NO: 949978 - protein, 167 aa, Homo sapiens
HEGALLGESTISVTTLGAPFIRGLSGQFAIGQFGGRNVVLEWQEAQQNFVLRGGHPSRYSNATRNHDADCQANLDADAEACTDSSSLLPCVHHRKGVRQLLHLAKRHMPRRPRMRVQRVDVCGGLSSAGRPAGRPCAKNAASLGVKGVSLIFPYHGLRSARPRPEER

SEQ ID NO: 949979 - protein, 317 aa, Homo sapiens
WSSREAWLREASACNRKATVLKTWMRVATKSEEEMVEGNDYEEFGAFGGYGTLTMLLHPYPQSLLDVGVHCLRFLIELSPVELGKPLFLPIPFVDAFPVGYGNTFHDDGSPFSSNVARAACLQSVRLGSAAAAVPYSSFSHGGRYLTGVATPHVSCERITQPTTYAAEAQGPTPEPPLASPQTSQMLVTSKMAAPEAPANLRTAQTGSPAQEAATEGPSSACAFSQAPCAREVDANRPSTAFLGQNDVFDFTQPAGVSGMAFPRPKRPAPAQEAATEGPVLPLVCPDGTWQGGGSTRPRPQVGEALAKSVGELKFCA

SEQ ID NO: 949980 - protein, 111 aa, Homo sapiens
MGASDAVEGTGLSCGVTTTASAPGDVQPANQTHPSSNTALGFIGPQLGIAHGVSRTGQIIIQPFGTQGAGQEEWRVHVRHLDRLRQHHVHDLVRRRRWHVDAGAVIRDEQE

SEQ ID NO: 949981 - protein, 59 aa, Homo sapiens
TREESVCLTVGITDARAHHEPLLRITEIPSPNQMHHRTKKKHHRNPISWIGEAVETVWQ

SEQ ID NO: 949982 - protein, 50 aa, Homo sapiens
TTKVFLVGDYSSSAEFFTVAVFSFLYSMGALATYIFLQNKYRENKGPCWT

SEQ ID NO: 949983 - protein, 38 aa, Homo sapiens
MEQFRHLPMPFHWKQEELKFKTGLRRMQHRVGEIHLLR

SEQ ID NO: 949984 - protein, 62 aa, Homo sapiens
MEMGMPKSPMMRRALPPKKRLFLNFRRKKAMRKVPSMRMRDSRAVLGWFLGPGGPSVGGRAL

SEQ ID NO: 949985 - protein, 105 aa, Homo sapiens
GYNELKACAGLVCERAWVSQGQGPGQSHRAALAVAVVVPGTSLGCEEPAGPGAGLRLGPRCRSQGIGVSEGHHVGGSHGHVQLVVFILVLVKVWFSVFRVPAAAP

SEQ ID NO: 949986 - protein, 158 aa, Homo sapiens
TRWNPEKYHDEYRAELMNWIHKRIKAGELEHPPEPPEEPKDEHAPINFMEALKNSLAAVGKGGHKPAAGRAVTPTPPRTAKTNKKKPARKASAAGTAEGRVISAGRRKTARVMHFLRARSPGLLAVVLTILGTAACQPVRRDGPERSSAASALQEGWC

SEQ ID NO: 949987 - protein, 74 aa, Homo sapiens
MLVEPGRSWFNRETSPAFCFAVLLVGYRVPTSPEALYDFAPNDELLGFIIYLIDLYVYIVLGSVILSWVMAFGV

SEQ ID NO: 949988 - protein, 171 aa, Homo sapiens
HEVFAFGSVAVTAANVVTAVVTTTVPMAVTEAAMAVDMAPALSGDEGSWRCCGQYVASQSGHLFRQTLCRQLNIQEQTMKLNVLAAVAMTILATPALAGAGHCDADLKEIDGAMAKAKLSDADMATVKAARAKGEELHKAGKEEECEKSIADAQKLLGIQEQHKEIIIILE

SEQ ID NO: 949989 - protein, 119 aa, Homo sapiens
TRGILNLLSLAVTSLSARDRSPSSRAPSSLAPGASTSTSTLGRETSTSGAVTSTLGSFRSSLGPLMSISGPLRSTLGTLKLGICSLGRCPLRPAPSGTGPSGSFTSNWPAWSSRSVEGG

SEQ ID NO: 949990 - protein, 128 aa, Homo sapiens
PRGFNYRHTPSIEFARQLIADGRLGTVTNARAWLIADYASDPHGPLTWRYDRERAGAGVSLDLMGHGEDLVQELLKGGFTDVSSVSETFILQRRKARKEGIVLHRLGRLGQLGSVGNEDYCAVIARFE

SEQ ID NO: 949991 - protein, 155 aa, Homo sapiens
TRRLLHCRENSWRRDRTAMTKNVSEEERAMRFRDEFSQHMRRVAAASDARAGALALAGEERIADSWRRSMELYRVDPEVPAAPRILSAAEVRERCGRIESFLQLARLGVGKLHSQIKDAGYCVLMTDADGSTVDFRGLPNIDHEFKSRGFRVGAC

SEQ ID NO: 949992 - protein, 136 aa, Homo sapiens
HEEPADRDGPVAAKAAPTGNAPDLLPEPGQGILWEGSGPRQQPVSRPADRDGPFREGRSHSGNSPHLLPEPGPMPAHPAPKKDAAPARCVQARRERTLYQRMMSYEYVGLARNDGVHVDRLEELVEQHHQHAHAAF

SEQ ID NO: 949993 - protein, 107 aa, Homo sapiens
HEVELERLAVLVQRAHAHTVGALDAIVDLGDRQAALFPDLAGVAGPDDLGIDEDAQPVAGLRYVDHDDLLMHVDLGRRHADAGGFVHGFRHVLDQLLYAVVHLRDGL

SEQ ID NO: 949994 - protein, 180 aa, Homo sapiens
TRGHHVFGHGSTIDELREDQATSADRPPNEILADAFAAFVLMPTLGLREAFAKRGLDPNRATALDMYSIACNFGVGQATLVNHLAYGINMINQAQRDRLGRITPKMIRTELLGEVVSTPLTVADQHWNSPTLDTEQDALLLLPSGVVVDASMLVPERELAAGRLFRAAKCGITRAAIPGT

SEQ ID NO: 949995 - protein, 131 aa, Homo sapiens
MSASPMWLLPGQGMVQRHDQQRVEVVHRRIVEVVGHVEHRAHCQVDRIRAQQRQAVAAGHVLQRQLDLRVLLAEPTHQVGQQVEDRRTAGRHPQLARLDAAHAAAEFRVDTVDALHQRAREFVQRLPRVGE

SEQ ID NO: 949996 - protein, 181 aa, Homo sapiens
MVPSVDMNTVAGLPTSRPRSVAASMVTDDVTTWSPPSSVTFTTAITVPSSTSVMVPLSWFRVESRIARTSMSQRSGSAVSVALPGSARNGLGDFHLRERTGLVPGAEQSYGRIHGRFHDSSDRFSVFDRKCGQLPQPAEQDHGQRRGQRRKLRAAESGTGAQVDQQAGQQLQPAALHRARG

SEQ ID NO: 949997 - protein, 160 aa, Homo sapiens
HEGYQYLAESIRKHPPQDELKGMMETAGFARCRYRNLSGGIVAIHDGFKALSAGGAAVEPPRHFHPLRAAAPVVGAPARGPAGRDADCDERISAFPGALRRNVPCHSVVMQCLARHGASCRSALARDEALPGMPVARERAPAEADVRAGWRSEGRSCDPR

SEQ ID NO: 949998 - protein, 174 aa, Homo sapiens
QEMKMADSGMHTPGPVQLSVAVDDPAQREILSPEALSMLAELHRRFDPRRRQLLAARRQRQARFDAGELPDFRADTRAIREDDWRVAPLPDALVDRRVEITGPVERKMIINALNSGAKVFMADFEDSSSPRLDNMLAGQVNLRDAVRGTIDFTAPNGKHYTLNDSGLATLIVRP

SEQ ID NO: 949999 - protein, 160 aa, Homo sapiens
RGNAVVIAGYQAEGTRGDALLKGKRSLRIFGRDVPIACEVAQVEGLSAHADWKEILDWLRPVDRAPQRVFVTHGEPVAADSLRQKLEHELAWSAQVPEQDEEFTLTEPMPVDRDDSFAAVLQSRGGGSLISAQNTPICVTVRENWSKSTGFTTYALMPRP

SEQ ID NO: 950000 - protein, 154 aa, Homo sapiens
HEGGRPSTSSRTRAGLGAQTRNSVFCSVMVSLQQHDGQFGNNCAADVGPSTTLPVRASFQVPSGSGNTVLPQPFSASRTVQRVTATTMSAPRVKASTVIAGVPVGEQGGVVAVQEGIRMGPPHPQGGGDHPDLRMLQRLQRGAPRPVVDWAAIV

SEQ ID NO: 950001 - protein, 94 aa, Homo sapiens
MREISCHTSALACYPAARLRQSSNSEATVRSEDRSGDVPGLPLRRQKCIEPAIRVRARNGLQWHITLCARQNRLLWSLIELPDTAQRRGRYTGC

SEQ ID NO: 950002 - protein, 79 aa, Homo sapiens
MVCQDVFYSNTTLTIWMLILPIPMMSERYRYLHAQTFQVPLVMWMSHKTLITGTEDTLMHHLQCNTESRSDQYGDLFQN

SEQ ID NO: 950003 - protein, 138 aa, Homo sapiens
MARPADERHLDTGAAEHLGEFDPDIAAADNEQRARQFLEVERGRAGQIWHGLDPGDGGHRRPRTGGDDDLAGGNARAVHLDAAVDEMRRPVAIGDAVVSGEEVDVLGLAQLGNERVLLTDGPAPIGQFGFGVDAGKTG

SEQ ID NO: 950004 - protein, 106 aa, Homo sapiens
HEAPVELEGLTRTEGQGNEGAAAGCLLSHQALLLPEAGKGRNAVVGAGVAQGLQIGVHLLDGAPLLAIAARFCLEPARELQGEGIDLGWTDPLGIVRLGLACPQVL

SEQ ID NO: 950005 - protein, 134 aa, Homo sapiens
TRGWITVSDCINGQRHVVSSCRIAPAVFRQTRTPLDALPDQAQARQHRTGGRCGRCGGVAITASGLHHPFDRVRVASDESTGDTGRLAQRADVYQTRRRDAEVRQYAAPLFAQHAYFVRVVDHHQCVVALAERQ

SEQ ID NO: 950006 - protein, 127 aa, Homo sapiens
MTKVVAPTRANLMSSWCRSAKGRIGRGSRSNRGISEGHEEQVYGNTLPKVNLCRSPPVPVGPDAGRGRHDNICAVPRTPSDSRAPIVAMIGGGQLARMTHQAAIALGQTLRVLAAGPDDPAAQVTPD

SEQ ID NO: 950007 - protein, 126 aa, Homo sapiens
TRAAPQVGANEFSPDQRKAIEAIVKDYLVKNPEIFLEVQSSLEAKLAKDEADRTKAMVAEHAKEIYRAPNAPVAGNPDGDITVVEFFDYNCGYCKRGFGEIAKLVEKDKNVRVVFKEFPILRDESE

SEQ ID NO: 950008 - protein, 146 aa, Homo sapiens
TRINGALPVQRQVVAVLGGEHVGEQPGAGQPAHDRAAGGGRLHDGLAPAAGEFRAHVAHHPEAGRDVLELFGHVLAQVLERAAALRAVAAGWQMFHAAARQVIGQPVAAGVSRGGFDRDDLGECGEIDCCATGLAVFLLGRTQPEI

SEQ ID NO: 950009 - protein, 37 aa, Homo sapiens
TRIARILHSDFLEPASAGIGYRCNMKENDVIQVLKGH

SEQ ID NO: 950010 - protein, 65 aa, Homo sapiens
HEECWDHPVILHRRLHLMLRNVSFTGWNNGLNVTIVLTMEDGLKYYRMMETAGRMEVKGYQLYQQ

SEQ ID NO: 950011 - protein, 123 aa, Homo sapiens
MLRPMINAARRKNWVERLSPARRCLNRWDQVPGDSTMVWCACSTKVFEFDSTFASVAIALLPDAGDKRFVQAADAISRRLSQQAEYRMRCGAAFIAVAASAGVTMPVERYRHRLNLSLTWPPA

SEQ ID NO: 950012 - protein, 85 aa, Homo sapiens
MAVVGSGGYALNDAWEKLPSVMAGVPARREKSSPPPAPPICLRGRMRLSTVSEETVHNRMSLDKVLGITAQNSSGLTCDPGIGHV

SEQ ID NO: 950013 - protein, 157 aa, Homo sapiens
NEEARSLFEFGVQSLLGVTGQPPDNLVDLVFGAPLFLGLSHIVRIDAGDGYRIDTMLFHGASGQNSIDPLVAWLLIDPPMNRCICCADWMLLLTILEAQINAMPDRILTADIAGLVRDPSVDARIISEVIRIVMRSCKAGWIRFSELMPPSLRTCDA

SEQ ID NO: 950014 - protein, 36 aa, Homo sapiens
HEGYFASVRTIVLLPVHVSCEFVYHSKDFDNVCIVS

SEQ ID NO: 950015 - protein, 57 aa, Homo sapiens
HEACREGCVCDAGFLLSGDTCVPVGQCGCLHDVRFHPLGHTFYPGPGCDSLCRCRKV

SEQ ID NO: 950016 - protein, 54 aa, Homo sapiens
RGWVNVHPYPYTSPNRQMRPVDANLGYGSCIEGEVSKNWFRNLLSFSTIPYQSL

SEQ ID NO: 950017 - protein, 60 aa, Homo sapiens
RGLFKCDECAKLFSRIERLKQHVSYMHSRNEVDGEYRYRCGTCENTFRIESALVFHICRT

SEQ ID NO: 950018 - protein, 117 aa, Homo sapiens
RGQVLVATQEAASRFRHGAHDIGGRGATDVLAGVDRRFDRQHAIDAAIDLGLDRLHLGERELVEIDALVGGDADQPPGDVMGLAERQADLAHQPVGKIGRHRVVGRSDGAHALGVGL

SEQ ID NO: 950019 - protein, 135 aa, Homo sapiens
TRPRAEALPVGLAQLALQHLAGARERQRRVAEVDAARTLVPRDLAAAVLHDGIGRERDAALGHDDGVHALAPAFVGHADHGDLAHAGQQRDRVLDLGRVDVLAARDDHVLQPVDDVDEPFVVHVGAVARVVPAVL

SEQ ID NO: 950020 - protein, 46 aa, Homo sapiens
RGVVPIPFHYGSRSSRFSSLPAPERGSGVSRKSMLPGHLSPAIWLR

SEQ ID NO: 950021 - protein, 34 aa, Homo sapiens
MRENPGVTHQKRRAGNRPFTKCCRVDQVRIVGAS

SEQ ID NO: 950022 - protein, 153 aa, Homo sapiens
HEVFSMRDVTPSRENRTPTLMGSFVDTGLRPGDKKRDRYYQSLTARKRLTKIHSTLRPANTAGRKTGKKACTDVRIRQAFLFWFFAFVFSQFFAIFRIGQCRPVAQELPDVQPLKESAVIPIPRKGTPERHRLIQEHLECVKSMAGVAGFSVL

SEQ ID NO: 950023 - protein, 118 aa, Homo sapiens
MTNISRRAAKKFSRPISGGPEGRLEPRMNKLPSGPTQDEPPPTAAALTCRTKAGEPYCRHQSVEAEISVGRRQPHNRWPSREWRLQTLAHLIRLRSHDNDPEVLGRLTHTFLERVKPI

SEQ ID NO: 950024 - protein, 151 aa, Homo sapiens
RGQVRHFATRFASVSPPRLRLLRHSGLTPAAVGLSVGSGITLDAAARPGQAYSTTRGPSVTNAPAETSAPYTASTAIWIALIAGLTVIGSYGYACAAPLAAVAALAALKMNRRNGAILVGLAWIINQAVGFLLLNYPHTAETYAWGAGIGF

SEQ ID NO: 950025 - protein, 38 aa, Homo sapiens
RGGLVLSLYCPRLHTHLCTHPRTLLTGRAVTSPAGWLR

SEQ ID NO: 950026 - protein, 38 aa, Homo sapiens
MRGVPLSVFDRLTGLSAVNDILQYLSELSGRPVTSIYR

SEQ ID NO: 950027 - protein, 115 aa, Homo sapiens
HEGSRMLFNFAVRFIRLSTREKSWLSKALAPAFERLSSSLSIDCASKSQAAVMLRSPAPAPLSGGGTVPEDGVSAGLAAGFCDEADDLVDTGVEGSACAGVAAAGLACVDAGAWF

SEQ ID NO: 950028 - protein, 102 aa, Homo sapiens
MPTVAHSARISSDDLKRGPSGVGFIMRYHSSQTAPGMRPLRGQKSLPEGDELFSDPFVHVADIEKRDIRLAERGEHGLGVDNDVGRFWHDRECLRGRRRHFG

SEQ ID NO: 950029 - protein, 157 aa, Homo sapiens
RGLVPRARLVHDRILEVVDEADRALHLALGVAGQRPVAGDAQRAAQPGQPRIDADQQVVGDVAEQGDPAVVARDLVKVVAMHQPVAAAIGSLVDVLALQFDVAEHGAGVFAQRLVVIARDEDDLGALARAAQDLLHDGVLRRRPVYGAAHRPEIDDV

SEQ ID NO: 950030 - protein, 121 aa, Homo sapiens
HEGMAEHATPRADQWREAAPLEPCEKEQLFRCRELHAARAGEDAEDARFGCDAEAAEEAGAGRCGIARPPPRAVGYDVCDARVGKRAAAARMVACFENQKCAHASGHQSTALLAALPDRAI

SEQ ID NO: 950031 - protein, 128 aa, Homo sapiens
MNFRSHLASVTKRDRALVLTLAAAELLVRSGERVGLLGLTQPTSSRRAATRIAEAIASNSDAPQLASGKPSNARVSRFSGLILASDFLDPIETIRESVEVLAANGATGHMIQVLDPAEETLPYEGRTE

SEQ ID NO: 950032 - protein, 149 aa, Homo sapiens
LEAKLDLPADLGGDRHHPGERGSDVVRVGAVGLLGGGHVDGDAAVAHHHRSQLPVENAHHGAHAAFVGIGDGLQADQQLHAALEFDAVFVALGNPKNWLALSPEVSPYCSRCSSSSLVGPGNSSRFSAACRRAPGATNAASSSAVSGCS

SEQ ID NO: 950033 - protein, 37 aa, Homo sapiens
TRGNGSSLRIVIRDKAKFWGLTVFHEDPIESKISFRL

SEQ ID NO: 950034 - protein, 45 aa, Homo sapiens
HEGRIDAFAQMDLDTQSEDDTINGRLLTPRRPTVKKPPGSPPDVT

SEQ ID NO: 950035 - protein, 126 aa, Homo sapiens
RGGPSANSSASDGARAARERLAPRYQPSAGRRKAPSVADTLSKSRLTAAVFSERRSRLQAALDPPTAAIQALKGEDPGLSDLHGRHIGLIAQRLEVAGQALNAHGALPAVALGLHQFQPGLPALGQ

SEQ ID NO: 950036 - protein, 93 aa, Homo sapiens
TRNESYRYVRTDVPWAKSEDELRDIWRKRVKNDWLRLKLAGKDDAAIRETLGKRYDLALTNLNRAKSDDVFQLFMNAYAESIEPHTSYLGPRA

SEQ ID NO: 950037 - protein, 96 aa, Homo sapiens
HEDHVEDERVAATEPEEQPEPEEREPGPRAVMAAESLPFTLETVSSWELEAWYEDLQEVLSSDEIGGTYISSPGNEEEESKTFTTLDPASLAWLTE

SEQ ID NO: 950038 - protein, 97 aa, Homo sapiens
VTRTSQSPRSPDSSQSSMAQEEEEEEQGRTRKRKQSGQCPARPGKQRMKEKEQENERKVAQLAEENERLKQEIERLTREVETTRRALIDRMVSLHQA

SEQ ID NO: 950039 - protein, 101 aa, Homo sapiens
TRPFYARSELASRFAGEEVVAVQESLDMRRFASPLVQFMLPYRMPRRKGEAAPGRHGSVPPPDCLVVNPMVKFPRPEYGAAVRSCSATQGPDDNRQTTCGK

SEQ ID NO: 950040 - protein, 102 aa, Homo sapiens
RGVPYFGAGRPAAVSTSPKEPRSSARSMASGAVPTIGTPASARRCASPSGVCPPSCTMTPTTPGPPAPDCCSARNTSRTSSKVSGSKYSRSAVSYSGDTVSG

SEQ ID NO: 950041 - protein, 125 aa, Homo sapiens
TRPRAEAASRPFSKERDGFVMAEGAGALVLESYQSAVARGAEILGVVRGCGEKADDYHRTRSKPDGTAIIGAIRNALLDAGAAPEEIDYVNAHGTSTPENDKMEYLSLKAVLGDHLASTPVSSNK

SEQ ID NO: 950042 - protein, 107 aa, Homo sapiens
HEVVALPVEIDSRYRVDVRTVQRTEALQGYSARFRIHAALSLRKVINRLVAALLVARQDRYFMAGRRRVFIMLGIHRWLRAGLIFTLAGALGACSSRVPDAPEPLDL

SEQ ID NO: 950043 - protein, 172 aa, Homo sapiens
SRARSSCSGNPCSEGSTRSRRRRQPPLRVLSHRLPTLRRKSSRLLADLPSLSWKNSMSSVVIAAALSASQASKTMANSWVSAWRICSPRSSGGAGAATRPAASRGRVSSSMAKLQGTVREGWHAGDRGGTALRRNRLGAVRRPARPVRLRVAACAGDVMRGRDSLTAATGRG

SEQ ID NO: 950044 - protein, 114 aa, Homo sapiens
HEDGCASGERLIATVGARPDHAHNSSSRVRIMITLRQLYRYPVKGLSAEPLVRVELRAGEGMPLDRLYALTNGSWDFDAGSYQPRPKTDFIALMDHPALAALTTHLDDDARRLT

SEQ ID NO: 950045 - protein, 47 aa, Homo sapiens
TRPDCDANSAGGSVVPSECLNAMEEHDHGALLLLSCTTHPHGQSVIT

SEQ ID NO: 950046 - protein, 48 aa, Homo sapiens
MDVFCENHLKDVDFSENALKEDPLQLFQLDALMFLRLQGNHLVELPPH

SEQ ID NO: 950047 - protein, 143 aa, Homo sapiens
TRAGGKLPRAGNVLLSVRAADKPRVIEIARALASLGFGLMATKGTAAALEAAGLSVTPVNKLGEGRPNIVDYIKNGEINLIINTTDDSRAAIQDSYYLRREALQHRITYYTTVAGARAACLGMQHMPESKVYDLQGLHRALRA

SEQ ID NO: 950048 - protein, 133 aa, Homo sapiens
MAPKGSASMTAAAIVAAIALSAGKGGHDPGPAHSSILHLPRVWTQGTCPCIDLSQVLGQFTASTVEGMRLVRKGLRRGKEPRAWQRMLSGRRLDLLDPSPMDIEIEDIAHGLARVARWNGQTVGEHAFSVAQH

SEQ ID NO: 950049 - protein, 135 aa, Homo sapiens
HEGDDGAAAEGEQQHQRGRQAVVLTGSGCVHGGPHDGSVRTVARGNDLYNALASPASGWPVQVKQRYGAKPRRRIRRVRNAALRRIERCRSGFGVQHLTQKGNERGDPSRAALIGHIHHADCNAHRTRCHLVLRQ

SEQ ID NO: 950050 - protein, 60 aa, Homo sapiens
TRRAGYRAPAVDLGDLVLLHQVVDALDDPGADLVRTRVGRAVGHRRVTLDAVLGLVVGQR

SEQ ID NO: 950051 - protein, 109 aa, Homo sapiens
HEASCRDDARRIEAGGAHQQRRQPGMPVVGMHGGGHRQRRSARRDRGGGVRQRGEALRVVGKVAPGGIGVGRARAIVERRAVEQGDLHVAARQAAEHQPHLTVAGRQLQ

SEQ ID NO: 950052 - protein, 58 aa, Homo sapiens
TREISGTDDGQNHGMLTCLSSLTLPHTDHCLELVIPSLNAQIHGEAIGYHDYKLIINK

SEQ ID NO: 950053 - protein, 87 aa, Homo sapiens
SRPIALMVFSVLLVLIVELLNSAVEATVDRISLENHALAKRAKDIGSAAVMVSLLNLLLVWALVLIARFLDRLKGAAPAPVAGAPPR

SEQ ID NO: 950054 - protein, 144 aa, Homo sapiens
HEGSRRVKNPTERWRFRETLCATAGTTAEVSRAATRLLREIAPPPEREDGGRRILHGEKTTLSFTGPAAEMADIWATAKDNPLAWLTGSRAVAPSVTTNVIIELPDYLKVLRGEGSEVRLAMTNGATITGADLIRRTLAGAGLF

SEQ ID NO: 950055 - protein, 138 aa, Homo sapiens
HEALVVLNQDQAGKVTQLFPNSFSASTQAGKAREIIHAGETIEIPGSDQSFMLKASPPAARNTIIAIVAPPDAKIGDLVDPSKALQEIADPVALLTEITQRSNEADRSRGVDVVGAAKVGRAVKRSFDIVTNYQNVNT

SEQ ID NO: 950056 - protein, 85 aa, Homo sapiens
RGPDTGLGQCAQQSFQPARALVPPLPEQLGVEGGNDMRRPADAFGFLAQPAVHHADEIRDMLVIALSGRSGSYGALASEGTLRPV

SEQ ID NO: 950057 - protein, 57 aa, Homo sapiens
ERKSRTPIWRQDEVRVNDDAVYGPVYSVSRPAAEGVPFYPSPVVCGLTQEAISLKKL

SEQ ID NO: 950058 - protein, 98 aa, Homo sapiens
QQEYDNFSTSVHTLSPESRVTVRKRIRQRAPDRGGRRRDSVVADLAEMRIGFDCRPFLLGVEKGINLYSILDLWFVVGETRYVDKNTVGKIKMPILHL

SEQ ID NO: 950059 - protein, 70 aa, Homo sapiens
KNSARGVILLGRHSLFHPEDTGQVFQVSHSFPPPRVSSFGLSLSHPMSLAILDDSPPVEKRNQVKAAQFA

SEQ ID NO: 950060 - protein, 48 aa, Homo sapiens
MPIPKAGRVTPSGHLAPPYQFCDGYDARTTGSGRSGPNNIPFVSPFMN

SEQ ID NO: 950061 - protein, 39 aa, Homo sapiens
TLLHDADGVEPQYKREPVEDGRENLSVTCINNKIPGAAA

SEQ ID NO: 950062 - protein, 55 aa, Homo sapiens
CGVSEPSEEEQDHRKRASLSEKKSPFLSIAEGAVPKLVKEGKVLKNQKKQKHLRP

SEQ ID NO: 950063 - protein, 112 aa, Homo sapiens
PPPEDAARVPLPTAGAWSTGVKPLTGIAVGRGMPLATPAAAIAPAPPAGLGGPVWGVGAPAPGLMQPRALGMPPPPPPPTGAPTAAFGRGMPPVTAVRGYPPPPPPPPPGYR

SEQ ID NO: 950064 - protein, 104 aa, Homo sapiens
MSCLCVMIAASIYTDRREDIHDKNAKLYPVSREGSYGYSYILAWVALACTVFSGMMYLILRKRKESSGGGLFLVQNRIHFQISILYVTVFFEVFVANILFPFKA

SEQ ID NO: 950065 - protein, 40 aa, Homo sapiens
VKKNVEIMDFLDSSTVIRHREGCTSVRRVPAYKLYWPCSN

SEQ ID NO: 950066 - protein, 124 aa, Homo sapiens
DGPQGLGGPFGLRGGKGPTAQLFRVFGGRAPVFCLKTTGPFPSWGERSEGLGPSFLPTPPGPQNGASSQTDPCLGGQFFLPRRKGKKRACGWLRPKQAPGSTPAPPRVLPVPTFTNLIKSKSRF

SEQ ID NO: 950067 - protein, 51 aa, Homo sapiens
MGCAGSFSKAWCALACARDPGRGLSAEQGLRDVASAGLSPCRDDKVEAWAA

SEQ ID NO: 950068 - protein, 48 aa, Homo sapiens
MKLNDIHSNSNHRRPTVTTYRGAIPGGAKSDNREILNKQKVSKEIAIW

SEQ ID NO: 950069 - protein, 35 aa, Homo sapiens
DNIRKHYMSVKGIFRRGITALKSGQIKTYSAVIAS

SEQ ID NO: 950070 - protein, 41 aa, Homo sapiens
MSARYLSLLQPCQMRHARCRQQQRLQQLRLQPRAPVALARP

SEQ ID NO: 950071 - protein, 111 aa, Homo sapiens
MRLDQFGEGRANPLTFGIGKAVQEVAKALLSDQPSSSSALPCVTTRVRSSLLIIDESRLIEQCTQLVVGRGVNAMSGQSPSVEPGLGHRAPQQESGLVRRRRVMNGEPDAA

SEQ ID NO: 950072 - protein, 136 aa, Homo sapiens
RSRALYKLSIGGHSAVSKDHVCEPGFPVRKAFARDCGCLFCRPLPTGPPGVAERPTRVAGETEPGGGRVRLGGARGKTHGRRGHQVEAEGRDSPAEGQACEVCYEASTRGGAMREAPALSGETGSRPGVGKKGGGG

SEQ ID NO: 950073 - protein, 108 aa, Homo sapiens
VINCPMIALSRAKSNLTGPRWDSNPQSPAPEADALSIRPLGHHRIRLLTPSPYAMPSSRSRPRTSRSRTERQVIWQPPPAAAARACAILRPCRPRGLPARCTMGPERP

SEQ ID NO: 950074 - protein, 52 aa, Homo sapiens
AGQGVSCAVQSPSKGPGTGGGPSQSGVVCVEGKEVGASYREENQGPQRQINP

SEQ ID NO: 950075 - protein, 42 aa, Homo sapiens
MDLEPGWYLDPPGRCESKKFGGPWCPRSATRKPTDKPIVTQN

SEQ ID NO: 950076 - protein, 30 aa, Homo sapiens
KPRESAWAEHLQAEGAVAFGKGHKFHHTIR

SEQ ID NO: 950077 - protein, 50 aa, Homo sapiens
GGGPPGAGVEGGKNAQEGAQGGAGAGDDEEDEVHLSFLGCWILSLSCQIN

SEQ ID NO: 950078 - protein, 32 aa, Homo sapiens
VLEGKELEYLRKIKARKGKKILVVSITHVIKV

SEQ ID NO: 950079 - protein, 46 aa, Homo sapiens
DSTSKLCHGRFQTMEEKKAFLGPLKKDRIAKEEGAEYLAQIQFVGL

SEQ ID NO: 950080 - protein, 32 aa, Homo sapiens
GEREQIVLNPEEKFPQRKKISQKKLKNQNLMA

SEQ ID NO: 950081 - protein, 30 aa, Homo sapiens
ASRFATGPSGPAHWMLRLSKVPVEVLPRGY

SEQ ID NO: 950082 - protein, 47 aa, Homo sapiens
HEGFLDLPDQRTVLRSTQALGQFGHDQSQCMHRLPEVMVGGGDDTRL

SEQ ID NO: 950083 - protein, 137 aa, Homo sapiens
MGFFPVAALFDHAAVVGAVARRRFGHDDELHQAEAAGDDPVLRVRRLLSGICAGRQRERTEQRAQHAVHDFSSGSAQMRRLPGQTGPALPGSSSVPVRRVRRLPSTMRYSNSRHFERAIEQRRAPARLQLDQLREIR

SEQ ID NO: 950084 - protein, 146 aa, Homo sapiens
ARHQQQAVTHGALFRPEHGQIDEEARQIEQAGEPAGDENDVQGLGPEVTALHGRQGQEVVEGEFSAAASTASTSGRDSRTRSSRFMRRLSSTRDSPMKESVIGDSFCAASCTCDARRARQREGIGDAVEIVGHLEPGVVAGVVGAA

SEQ ID NO: 950085 - protein, 42 aa, Homo sapiens
HEDYAGTDIPTLTGDGCGGWANEDSRSAHLRIRAMRLEEQHT

SEQ ID NO: 950086 - protein, 129 aa, Homo sapiens
HEGHIIKRDPGPLNDPVNRRIEVYPQRLAVCDPILHAKRRLIFPPKIPNFHCMYGGTPSSECRERWYWLQMKSTTHRSNSVLVILAFFSGSSSPFEVCFDPVLPGRDSDILCKRSKESLNVPAVVGSLY

SEQ ID NO: 950087 - protein, 108 aa, Homo sapiens
TRRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFRHQCRR

SEQ ID NO: 950088 - protein, 49 aa, Homo sapiens
HEVFCFDSEIVNAPGVVTEGVTNNVPTIVREAVMEEQMALDIDRGRKLL

SEQ ID NO: 950089 - protein, 142 aa, Homo sapiens
TRLTPPRIVTECGRAMTAHHAVLIANVSEVERAPEGRVPPEQADEPAVIRHLREIHAELPSRPAVELFHEAQHFHSEGIAGYALGQLDLLQRARLDDLFYAIAHAVRQRLTYDEKSHRDLLDELNERLVDKYFVNFSVFESL

SEQ ID NO: 950090 - protein, 34 aa, Homo sapiens
MGVDLVLTSLVSYKLQATVMCLATHGRFLEIGKF

SEQ ID NO: 950091 - protein, 46 aa, Homo sapiens
TRGIQELSHHCDSLITIPTEKLITVLGRYATMIQGSAPPRLCSGGA

SEQ ID NO: 950092 - protein, 53 aa, Homo sapiens
RGSTPLIHHQGNSNGLSQGSCQILMIQISSPVGSPLRSAIADAPIEMPGDEVP

SEQ ID NO: 950093 - protein, 81 aa, Homo sapiens
HEAELLGDEVFQNRLYHLKLLLHVQIRQGTHLATCNTTKEEYTEVDDTTRDLKQEVCGYSTALREHFPTLLVVFDFFNAVP

SEQ ID NO: 950094 - protein, 42 aa, Homo sapiens
HEGHHGYGNSPLCLLFILSHQYDCNHTLENRMLSFAKDTTLR

SEQ ID NO: 950095 - protein, 94 aa, Homo sapiens
MAFHHTQATNDPPDVTVFPKEPVELGHSTTLICHIDQFFPPVLNVTWLCNGELVTEGVAERLFLPRTDNSFHKFHYLTFVPSAKDFYDCRVAHW

SEQ ID NO: 950096 - protein, 30 aa, Homo sapiens
MGNFHKKQHLERTKIWKSLSEDKESGSVRK

SEQ ID NO: 950097 - protein, 39 aa, Homo sapiens
RGRTALRIDSRQSLARPRSGHVLRKVWTRADYRSTMAVD

SEQ ID NO: 950098 - protein, 53 aa, Homo sapiens
PKATGKTVSFSQAHVKPGIMSDPAWDRECDQGCSCGHPVLVHDFGRIKLPVSL

SEQ ID NO: 950099 - protein, 114 aa, Homo sapiens
RNLVAKGARGGPFTFKFPFPLAGGFLGGTSSLPFLGFFQVFFLRFPFPGVFFFWVQIPFPVWIKFCPPFSRGAFSGVSPLGSFGLAPPGPPIFTFFLGIGPFFPSRGINLFLAP

SEQ ID NO: 950100 - protein, 33 aa, Homo sapiens
IKKKDELERVPKSNLDFPSCCPINLFALWGSPR

SEQ ID NO: 950101 - protein, 44 aa, Homo sapiens
GPNGGVTVLSEKGPATRGTVDGGDCGREPGPSHGSPQMRRALRP

SEQ ID NO: 950102 - protein, 50 aa, Homo sapiens
LCKKLRKDLEDQVQLMRRFGPPGPEVLLTLQASHGAGAGPGRIHKVLDFC

SEQ ID NO: 950103 - protein, 38 aa, Homo sapiens
KNWSRKTAQNVRAFYVKSPMGSPSAFVKALLPNLYYQL

SEQ ID NO: 950104 - protein, 78 aa, Homo sapiens
PLVEKVKPFLGNPSAFVTAAPVVGATTDGPAGDATPGKVESKEESEESDEDMGFGFFDYSPKSNQLSQFYLQNKEIKA

SEQ ID NO: 950105 - protein, 81 aa, Homo sapiens
ASLGHPTQTVVLPRIGPIAQQNLALQLAEKLGSLVENNERVFDPKQGPYGGYFRDQKDGYRKNEGYMRRGGYPQQQFQTAY

SEQ ID NO: 950106 - protein, 62 aa, Homo sapiens
IPSPRFGRENPPGPEGFGGSRLPQVPGGSRGQPPNFSGGPVPPPQAVSPPSFKSIFSPPAPA

SEQ ID NO: 950107 - protein, 79 aa, Homo sapiens
KESLLRFLKDRFELVTDCRFENFWTGSTLLLPNVITLQENLLSLTSMRMKETAQFHLSHQLLTLKDEWEEHCQEAHNVE

SEQ ID NO: 950108 - protein, 45 aa, Homo sapiens
HEGVHNDGHLGHELLISWDTPTSDSQDAGTARVGQCHQARCSFFR

SEQ ID NO: 950109 - protein, 45 aa, Homo sapiens
TRCPHSQMQPFLPGPRRKDCDDHLPGEVRKVIIRKMSVLHQVHDR

SEQ ID NO: 950110 - protein, 83 aa, Homo sapiens
IHSFFHFPTQLFQFKVVGDQSLSQQLSVQGRDHSGQDALPSQGTLTPHTHSDCDQTTNKPHLHIFGAWEETRVPRKLSDREDV

SEQ ID NO: 950111 - protein, 68 aa, Homo sapiens
TRDARMVAGNTLLVERKRYRGHRCLGVGMLVILGWFTQARSLTAIHKFLHFYNDDFSHKGNHVTISKL

SEQ ID NO: 950112 - protein, 83 aa, Homo sapiens
DKIILKILSGIDKSTVLLQFRRQTRVVQYTTMQATSALDVPNSLHMDSRPDMRNVPTIVLDEDSSSSTGRVDSATCPMITECG

SEQ ID NO: 950113 - protein, 36 aa, Homo sapiens
RIRETDLVSVVALEGNTTADPDEVPQQGKSSIAYAT

SEQ ID NO: 950114 - protein, 178 aa, Homo sapiens
VVMATVKGDVHDIGKNIVGVVLGCNGYDVIDLGVMVSCDRILQTAREHKADIIGLSGLITPSLEEMSHVASEMTREGFDIPLLIGGATTSRAHTAIKIAPHYASPVVYVPDASRAVGVATSLLSKDQRAAYAEEVAADYAKIREQHAAKKGQKLVSLNDARDNAYCCGWGSEVIPERP

SEQ ID NO: 950115 - protein, 104 aa, Homo sapiens
HEEETYLDYVIPCFVIVNSARTILQENGCLSDTDMFSQAGLRSEEANENLDFVLSFLKSNTLPISLQSIRSSLLLRFRTSMNINLWSEITVLLYKDGRYCQESR

SEQ ID NO: 950116 - protein, 134 aa, Homo sapiens
KSAPAEKSTYLPEFLASMVREFLWFTFFKKRPPGKVIYSLIATVTDLDLDRDRDLWCSTDTGDLDLLERTTFLASSTGHGKTYYQNVTCSGSGLRDPCFLTGCKICDYGNGIGYETRGTSGPGIEDLLLDLLVP

SEQ ID NO: 950117 - protein, 101 aa, Homo sapiens
TRQIFHRFGASRGLLVCIPPTPAYRMPQKIFVDLMAALIYKKERTTGMPLQSYVPPSSRPQEAQGDTGSLGWAQFITRQKGTVGRYYPKIFSENGRPRIGI

SEQ ID NO: 950118 - protein, 37 aa, Homo sapiens
DRDYLLSVSLVRVHLLSVPNKPSQPLLVIQGHIVQRL

SEQ ID NO: 950119 - protein, 106 aa, Homo sapiens
PPTVVHLDVLDTGGMEPLYGLDMICGWDKKGPGLYYVDEHWTRLSGNLFSTGSGNTYAYGVLDSGYRSNLSPDEAYDLGRSAIAYAIDRYSYSAGVVNMYHIVQRL

SEQ ID NO: 950120 - protein, 62 aa, Homo sapiens
KGTITRVTTSSPGGSRVFTHRHDRSSVVRSLGKYLCIHLTHRDVPVVIGSQTIALDTRPYLS

SEQ ID NO: 950121 - protein, 58 aa, Homo sapiens
FTTLKRTVCSSSARISHCDDIIDLGRSLNQGDRCTDLFLWRLSNRLYLLDVVHIVQRL

SEQ ID NO: 950122 - protein, 103 aa, Homo sapiens
MYTYTLYPHTSYYQIPSASLIQPISPESVRLIRLHYCMPRLLMHLFGIATLVNINHYSLPSTLIIITILILLTILEIAVALIQAYVFILLVSLYLHRYHIVQR

SEQ ID NO: 950123 - protein, 67 aa, Homo sapiens
TRGAWEVDNDQLRAIIELHETLQKNSALTIQTVIMVVQHSKHLGKVKWLDKWVPHELSGNQNKRFEV

SEQ ID NO: 950124 - protein, 37 aa, Homo sapiens
HEEEGHFAADDVKAMLHYLNQKWEVLKAKASHRREDL

SEQ ID NO: 950125 - protein, 49 aa, Homo sapiens
SSSVVIKTLLEQKETPNNHVSSFGSISPCMDTVKSRACIFSVSQSTFLR

SEQ ID NO: 950126 - protein, 169 aa, Homo sapiens
LRLAIVCAGAAEQGSDAEDDFHLPRRQRAQLGLGPWAGTWASRETRAGPVPLAAILGADGQARLRARPPPRSHPGPIRWAFRVRPNVRGLRRTWSRVEEPDEPEESWRRAGAVGSCLGIPGRAGGASAVSMVGPDAVHYLPRIRLRWWRRHCPRPARGCRGGHRALKRP

SEQ ID NO: 950127 - protein, 72 aa, Homo sapiens
LYERPIMVLRILEKTVELEVEFTNRITYKRTYILEKVCADLIRGAQETISKRQGPARMPTKTFANHYKKNSL

SEQ ID NO: 950128 - protein, 98 aa, Homo sapiens
KWSLALSPRLEYNGVISAHCNLHLPGSSDSPASASWVAGITGACHHARHEWNFSVKSLPGPFLHSQVPGKQLACVGDTDDPNPMHIDHDRNMDWVSTQ

SEQ ID NO: 950129 - protein, 67 aa, Homo sapiens
MRFDNTARDEGDSQGDWWSPSLYRFPLVVLLITVSCGTNPAIKLSLHHIPQVAYQYLYGSSTAVERR

SEQ ID NO: 950130 - protein, 58 aa, Homo sapiens
MPVLFLGYSTGLKNESNGEALKIHLSSETKAVLEELGGSELELRGDVEMKGKGTVRTY

SEQ ID NO: 950131 - protein, 84 aa, Homo sapiens
SKDPIARQSSSRTCFALFYIPRCSAETKLLRTAWSQKTVDLQGFPLDSILDAVLTVPKRQYRGIFSPTTPAHTGPVWMPMRKRS

SEQ ID NO: 950132 - protein, 45 aa, Homo sapiens
MESNGEALKIHLSSETKAVLEEFGGFELELRGDVEMKGKGKVRTY

SEQ ID NO: 950133 - protein, 64 aa, Homo sapiens
YWKSEAQKVKKADGTPGDRPGNEVKWLRCYEESPSAGLRSENMPLAPAHGWSPMAASYGCSLVV

SEQ ID NO: 950134 - protein, 114 aa, Homo sapiens
HEGDQDSSSVSDPEGPIAAKVLSFVRDDPDFESEGSGHTAEGDDFPVLDDPSDVTDEDEGPAEPPLAPKITRPAFILNNDSDLFGLELEEAGPIDSTEERNEGKTPSKDNTNTT

SEQ ID NO: 950135 - protein, 35 aa, Homo sapiens
MFNINIDDDYLPCLQGITRATFCNVYLEWIQHCAR

SEQ ID NO: 950136 - protein, 124 aa, Homo sapiens
TRLRITTTYMNGKPPFDSSICGDSAADVSQSIQIGQKSQTTAITNTKMNIKYYSLLVHGLVVTPLVSKISSPSDKKILAMNKSCPNTGRYTDQLLKHNVGDLVWAIVSGYPWRACMDSADILLH

SEQ ID NO: 950137 - protein, 35 aa, Homo sapiens
TRGGPIRDPAGGANSQVGHDRDQGIQSLICRQLGN

SEQ ID NO: 950138 - protein, 104 aa, Homo sapiens
MTHQTSPSLLGALRRYFFLMALYTHKNLRPLPSLWWPLLCVSFQGLSRSSPDRYSMEAVDMNTEDGFAFDEESDFNGNSHPSHTSELFSVNAQATRIHSLLGPS

SEQ ID NO: 950139 - protein, 77 aa, Homo sapiens
HEGCFKHTDLRTHVNMHRDQPFTPPHSQPSFDSQSSITHDFSMVSIYRTYFWPDQTIYHKSTSQGFYSTLLSLSPEL

SEQ ID NO: 950140 - protein, 69 aa, Homo sapiens
HEARVTFVDFTVNRRSLESQCLNEVHTAGRPDVDDKRSDLPKLQGEFQLRLASTWKNLYHKLLNEVKGG

SEQ ID NO: 950141 - protein, 41 aa, Homo sapiens
HEVSDPMCYIWRQCSVMFNYEIILHINVSSIEYISCSILPQ

SEQ ID NO: 950142 - protein, 70 aa, Homo sapiens
RGLFTCMGDNAPRQLVCFMGIAALDSCLRDLYQASLAAVNQHLAPRDGISQEGLRTQMVTAVHDISHLIE

SEQ ID NO: 950143 - protein, 131 aa, Homo sapiens
TRIPQKMQLKIYVGSGKQIINRSKDGTEDTFYSHTTSLQLIKSQIFLNKLVVLEEQDKEKILRPAYVFADTTFERRLLTTPAVDEEHALKVTGAHMMTIFISTWKMCNAPPLRKIMSCILSIGQGTTQDDS

SEQ ID NO: 950144 - protein, 65 aa, Homo sapiens
HEDYLSIQEIFLFKTAHPSDNLSPVSIKYAMYFIRLISTPGLASTSTLSTDNTAIFTETGDIFVW

SEQ ID NO: 950145 - protein, 122 aa, Homo sapiens
MAHFQGIRRQGQTCHGDSVHRGPAVPKRARHSAWIPSSLLRAPLLDGKLKACLGSVTLLMKKMFWVSVGDTDHQEGPVATHKGPCLHYCRKEGDLECGGSCCFCALLKIHEAQPYGSPGRLV

SEQ ID NO: 950146 - protein, 130 aa, Homo sapiens
HEVEDYIVVIEILATCDHPYIVNLLGDYYHDGKLWIMIDFCPGGVVDAIMLELARGLTEPQIQVACRHMLKSLNFLHSKRIIHRDLKAGNVLMTLDGDITLEMDPEVVMCETMKDTLYDYTHIWSLGITL

SEQ ID NO: 950147 - protein, 88 aa, Homo sapiens
MRGVLSPRFDKTGLSLKCSLNSIDTRIYMTERNEYMVTCLYKGACLAHEVLPEMNKTIYVYTSKYETWCYVIMIKGTQFMAFSLQNDD

SEQ ID NO: 950148 - protein, 31 aa, Homo sapiens
MLVILTGTLQPHRVNSSVSAAAGACARFARV

SEQ ID NO: 950149 - protein, 69 aa, Homo sapiens
HEADINIAEMIERLQKDCMEEINLFSEDKLQLKHMGDQLIKVSNISRAAEIDDTLNRINDRWQHLFDVI

SEQ ID NO: 950150 - protein, 52 aa, Homo sapiens
RGGFVLPNWVEFVGILCSPLVHISSGFQKGYSTDHPIGQNGCGDSDGLIDAS

SEQ ID NO: 950151 - protein, 94 aa, Homo sapiens
RGAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 950152 - protein, 86 aa, Homo sapiens
LEAKNSVRGGFILQCNAESDSTSWTCHVQTVLKIIYYRDDVKSFSRRINHLFFHIDHDGGFSNFMAWSEVTDPDKGFIDDDQVTFD

SEQ ID NO: 950153 - protein, 100 aa, Homo sapiens
TRVICVDVWVINIRHFADPAHGGSWMRGAVYYFKIAVALLVADIPDGLPDVITTWLALGTRCMASNNVIVRSLASVETLGCTAVICPDSDGHAHHQSDVC

SEQ ID NO: 950154 - protein, 72 aa, Homo sapiens
TRGHIQEAIAVINNLHPQLLATNRYLYIHLQQQNLVDLMRQRKTKAAPVFVHTHQVAEGDESRHRLTQMERT

SEQ ID NO: 950155 - protein, 85 aa, Homo sapiens
HEDVHTNPNFETLKCRCDNCDAFFTAQKRSRQDDARHTEPYGHQASKIGFIKFFASHVGKSLDEQLSHWSPTHGTLFPFLVHWGK

SEQ ID NO: 950156 - protein, 139 aa, Homo sapiens
LSPCSVTGCALTYCEPHKSRVCFCFSYRHVFPQMCGHQMFANRVSSYLSFGHIKPFQHHFCTYLYTQISPRLQQSFLWVHAHTCKGTVVIQCSLHTSTSSKHTRVLAGEPNASHAPFCHTAACLFKLWLIHRLVICQQT

SEQ ID NO: 950157 - protein, 48 aa, Homo sapiens
TRGRQTIDMRPERDSHHHDPRHAQRSLKHRQALFMRPSFNAGQCKILV

SEQ ID NO: 950158 - protein, 47 aa, Homo sapiens
RGRWRSGKRAIVWELTLDDELILCHDRISQVYTDEYKDGTEVVLKEN

SEQ ID NO: 950159 - protein, 41 aa, Homo sapiens
CVICYMSSGAGGTWMPEDEINFSEDLNETELTELQSQISDT

SEQ ID NO: 950160 - protein, 77 aa, Homo sapiens
DFFSPMSFRMSISRGLRKDLRFPLANSLGQAELLAQVCQELDRRSAWSVFVRCILIFVHREYGLIRVNDCSVRKARK

SEQ ID NO: 950161 - protein, 75 aa, Homo sapiens
HEDNHTKLECKYSGNMYVGDVGTKLATILNTTVEMDQVIKRDTSCKPFSSRFTFKFYSFLIRSIENSFSYCIRIW

SEQ ID NO: 950162 - protein, 35 aa, Homo sapiens
RKKSLFRNRTGIAVRICVHTLECILGGVRDNGNTL

SEQ ID NO: 950163 - protein, 62 aa, Homo sapiens
PTRHVQVAGSGRVHGGSCMVGLLRLLFFLCILRYWPIWAPPPVRGGRPPRERRVDGLQGVRH

SEQ ID NO: 950164 - protein, 68 aa, Homo sapiens
TRWTCTQRLEMTYSSMNTGYLDMILKEKATSSMAKRISEFNHIGVHRPKQSLQSSITSSGDLMSMTTL

SEQ ID NO: 950165 - protein, 54 aa, Homo sapiens
MTNTLNSIHLLSLGGLPPLTGLFAPMGHSRRIHTQNDSLIIPTIIATIILLNLY

SEQ ID NO: 950166 - protein, 96 aa, Homo sapiens
HEAEGYISTLPGSSVVFHWPRNDYDQLLCVRLTDVPKRIWSVGFELNTNNSFHNNMRDTFRNSIFLQVVITLRGAMYMISFSDTYQLPPPFRIDNF

SEQ ID NO: 950167 - protein, 38 aa, Homo sapiens
IQSELISVDNFGHDHRFTVSVITVNDPLLRTPSVLVII

SEQ ID NO: 950168 - protein, 106 aa, Homo sapiens
ICVLCISLALQRLEEQQMCLVPEKQQNRIEEKNSNEENRKWMRENVPENSRPATGLPLPPQFNESQYRGDYDAFFEARENNAVYAFLGLTAPPGSKEAEVQAKQQA

SEQ ID NO: 950169 - protein, 42 aa, Homo sapiens
IIIILQLFGAAGVMAIEHADSAGVEAYTLVKGGEIASTFDHP

SEQ ID NO: 950170 - protein, 62 aa, Homo sapiens
MTDVQSVGRLMTMTCAGNASGGLDDNWLLLPGLLWLTCHEYAHERFKGLFVVGRLELVLIMP

SEQ ID NO: 950171 - protein, 119 aa, Homo sapiens
FWINRWLLTISEILFLNKQDPLAEKVLPGKSNIEDYFPACARYTTPERCYSRARRRPTLTRAKYFIRDEFLRISTASGDGRHYCYSHYNSAVDNENIRRVYHDCRDIIQRMHLRQYELL

SEQ ID NO: 950172 - protein, 41 aa, Homo sapiens
HCGLEKTYACQDKAGSELRSAMKMTLWVIGKQYKDYTDASI

SEQ ID NO: 950173 - protein, 67 aa, Homo sapiens
SLPILRIPGGRSTQRDTAYNHALDDNRDSSVVSGRHIEHQMDITHQELTWNCPISQAYCSITVQQPA

SEQ ID NO: 950174 - protein, 44 aa, Homo sapiens
GPESFPALVVTWSPEEGTIMETSHCALVYPAEPLHMPLSLGIAR

SEQ ID NO: 950175 - protein, 54 aa, Homo sapiens
IEPLLCGLPLICRLLLAPVLCARLEEGSPPIVCQANASGIRRPAWYQNGVPSDL

SEQ ID NO: 950176 - protein, 134 aa, Homo sapiens
MTKVHALNDVTAVVEHTADILSVHSAGELRVAVVTPISTGSADPQTLISNEVLGPGHAWVLSGLGSSILRSSVASKFWKVVLNLRFPRKDFLSEQIYAVEDQGSQRCAQPSVVPDALEEVQSLLQAVGLVVSRM

SEQ ID NO: 950177 - protein, 80 aa, Homo sapiens
MHNSAFHLSIQDRTKPSSFFPPVTKLLAIGSHCNVGAPAIILTWTSHNVSSNILLLDYMSIIPYTLPIALEHTPHVALTL

SEQ ID NO: 950178 - protein, 115 aa, Homo sapiens
FPLFRRVTVALLVGLLRLLFYVTSSLLAHLSTPPVSGGRPPRERRVDGIQGVSHVSLFPVLRYVVRVVVLEFNVDVVGMRIVVRTTYYLVNITNGYVRVVREDPAIIHPMWVIDG

SEQ ID NO: 950179 - protein, 38 aa, Homo sapiens
TLAEIAKVELDNMPLRETQLRVRFCLPIVPSLYSSETY

SEQ ID NO: 950180 - protein, 42 aa, Homo sapiens
RREIRYRMTGVTPRMHALSDKTGHTGGKKKEVKEELLHSEKL

SEQ ID NO: 950181 - protein, 68 aa, Homo sapiens
EWPMNGLLPGPSRSYLVPMIQKLWGSTIRLLTSLRPKHNQENYERPGVVNSETGTLVAHTDTWAYGRH

SEQ ID NO: 950182 - protein, 34 aa, Homo sapiens
PINQSYSHKTLHQRALKPATSTITLYITAPVLLG

SEQ ID NO: 950183 - protein, 32 aa, Homo sapiens
MQTHKQIVPSKALSPRPTPQRTTASLLDRQQS

SEQ ID NO: 950184 - protein, 35 aa, Homo sapiens
GLPKRRVTQDRRTFNVNKRTFNSGCTIGMSYGRDG

SEQ ID NO: 950185 - protein, 34 aa, Homo sapiens
EDPLSFDDELHMLSHVWNSASIFTSEMSYVVMTL

SEQ ID NO: 950186 - protein, 52 aa, Homo sapiens
STFRVYDLDVDQDIPSGAAAIKGSCVQRLKSYVLTDTLCPNQQQSYVVIDTL

SEQ ID NO: 950187 - protein, 72 aa, Homo sapiens
ECHSRRRTILTDPITLPTGTRYPRDKSAILYLKSISTKGNDLDVGSGHPDGAVAIKGSFVQRLKSYGLIDTL

SEQ ID NO: 950188 - protein, 43 aa, Homo sapiens
RRIHAGGLVATTVHITDKLKSCEVRLRMLNCKMLGVSYVLIDT

SEQ ID NO: 950189 - protein, 66 aa, Homo sapiens
TKTRMALMGVVVGVCVPVGVGVGVTVVVVVMGVRLYFCVPVGVGVGVTVVVVVMGVTVVLFVLAVS

SEQ ID NO: 950190 - protein, 128 aa, Homo sapiens
SVIMTLRKLQLEAGAYSAEATPSPHASSQVHEDEHLRWRLERGLPLPARLWVPLPAEEEKRLSAESGLSEDSRPSASTVSEAEPEGPSAEAQGGSQQETKTAGGKGGAEEDYQEPTVPFADVRTAAPR

SEQ ID NO: 950191 - protein, 58 aa, Homo sapiens
SRPELLGFSMALLSWVRLVACTAIPQCHDSSFAGDNIITAQAMYKGLLDLICVTRSTG

SEQ ID NO: 950192 - protein, 39 aa, Homo sapiens
MGAFSLIISVVPVCYSCANCDTILTNRSELLSTRFHRRH

SEQ ID NO: 950193 - protein, 102 aa, Homo sapiens
QCPFPPSSGCVFFTAAQKFSPWTSAAGLDLLCRPPSLGSRLVQPLRGRWKSACLLANVLCFPLRLFWRSEEEEEGEKQDGDHQDPVSVPPSAFSDHCGELTL

SEQ ID NO: 950194 - protein, 105 aa, Homo sapiens
ESDLSWSAALGIERPAAAQAPAPPSMKCPTGPGKDTPAAGAYRLCHCLGDIAHQAVILRAQAICLEFATELVERGRQVRLLKRLLPQGHKLGAAGASSSSRYPSG

SEQ ID NO: 950195 - protein, 108 aa, Homo sapiens
EPVYPTAVESDARTSRRAEVDLTLDMTMADHLATGFGSLPALEVLDFTYNKLSENSLPGNFFYQNTLLHVYLSDNDIEILPPDIGKLTRLQILSLREYDLISLPKEIG

SEQ ID NO: 950196 - protein, 139 aa, Homo sapiens
QRALQSTTQEDPSQSPKEKTVRKLRIMLTINPYATTMRRNTILRQAQEITSSGWLRQLLQQRHYKPHQLRRLAVAGQKPVVGQKGKKAAVGVKKQKKPLVRKKAAATKITAPDKHSLRRRNLLQRRRSLLHKLLNLIIP

SEQ ID NO: 950197 - protein, 42 aa, Homo sapiens
MGLLVPYRGLAAVISLARAHGKACRLPLVLGTTYIAYTHYLM

SEQ ID NO: 950198 - protein, 63 aa, Homo sapiens
SIDSLAPSVGSVSTFQRIWLSKLEYDASGPSIVRRNASKRPLQLRSICCMGSLRIEDLPLENA

SEQ ID NO: 950199 - protein, 118 aa, Homo sapiens
MPFQISTGTQICHTHYFSLHPAVPLVPRSLRTPSKNRSHGTRAAYFLNASKGSPPFHLFFFLFMLTVFSENPFGWFILGFLETECSSVTQSAVQWRHTGTIRTSDSQDQAILVPKPLK

SEQ ID NO: 950200 - protein, 181 aa, Homo sapiens
LGARSFQVSNVGQCPPLITLLFSCLSREVATVSDFGGPQCLLCHVVVRAHASAVPGLSLLASGEYHLRSSDDQNYGLFSDIQTGRVLNKVKQMRPLADLSPVHSSTLTDYSTLEQGTMDSQIKIWDLQERTNVAKFPGHSGPILSIDFSENGYYLATAADDLLCPSSGICARLRTLRLAAG

SEQ ID NO: 950201 - protein, 44 aa, Homo sapiens
LSVGLSVSFPKALVCISQEPNLAFRLVSRALLASHNGIIHTPIG

SEQ ID NO: 950202 - protein, 40 aa, Homo sapiens
MSPYSKAYGFTPSEYASTCTITHNDPPITCPMATREREDT

SEQ ID NO: 950203 - protein, 69 aa, Homo sapiens
WPSRNCVIGSEASLTCTLTGLRDASGASFTWTPSSGKSAVQGPPERDLCGSYSESSVLPGLCPDHGPYE

SEQ ID NO: 950204 - protein, 85 aa, Homo sapiens
MSVIPRFSSGLPEVDFSLQGELGQNQERVQPGHVALPVADELGTQNVGEGRERHLFIIRGSNEHAEGVPVVGQFQDVVIRGHRAE

SEQ ID NO: 950205 - protein, 40 aa, Homo sapiens
MAFHAVVHGRLPLLYDRSRCCAMILYSQCGDVMSGPGPDN

SEQ ID NO: 950206 - protein, 74 aa, Homo sapiens
NKSTLDGTGTPDTETAVYGAAGPGGVLGTPTGRRPYTLRLAGARKLMASQTLRRMLPVDEYPPIMFDQHPNEQY

SEQ ID NO: 950207 - protein, 81 aa, Homo sapiens
VPLELVVNVDALVHGPPGLAGAPGESGREGAPGAEGPLDETVLLAPRVTVVRPAPLDPLVFLVLLVPLAPLALLARVVIVV

SEQ ID NO: 950208 - protein, 47 aa, Homo sapiens
MRASEAVAGARCSQLIVVPGQVLAIVGGLAAHKHVPITQDFRFAQPP

SEQ ID NO: 950209 - protein, 45 aa, Homo sapiens
SYRWIQFAYAGRHRRLLDVAIQLTFLRLMSSEASQNITYHCKNSV

SEQ ID NO: 950210 - protein, 57 aa, Homo sapiens
VLVYWYQFFWATWAWCKHAGLTSLHVAEDFDGIQVAALVGVNPDTLHSDWKSGEYWI

SEQ ID NO: 950211 - protein, 62 aa, Homo sapiens
ASYRGCPGDDVMLPICVHATLNLDRDKKYLRPSVNSEAPSGVVIMGVVPCTYVNDEYTTHTD

SEQ ID NO: 950212 - protein, 31 aa, Homo sapiens
MPRWPATMLWWRLWNRLHKDGIITEGSRQPV

SEQ ID NO: 950213 - protein, 141 aa, Homo sapiens
MNLYSGCRLSVYLTVMGLRSYRYLICKDDAARVAVGDVFLVGHRVLVGVPLLATLVLINRGHNLQDVVVGGQGVGGESVCSPESIESSVDVLDLERVPKGELVDDMRHVWVLWLGCGTECGHVEVAGDLVDAELPLEAAAW

SEQ ID NO: 950214 - protein, 41 aa, Homo sapiens
IAGTVELGNSSSDLAHSYNAFSILKQLTLMTFCEPSQALEF

SEQ ID NO: 950215 - protein, 70 aa, Homo sapiens
LTKRTPEYGSGYGPQKGELSTLLYNTHPYRAYPVLAAGHRYPGIQRLYSAHPTPYTYQGSRQNTTKYTYH

SEQ ID NO: 950216 - protein, 94 aa, Homo sapiens
TRGIPSTVFWKSSRCSYSHATLLRQIHHIQDCSTEVGQVSDGLHLDGVPILQRVVQDPRSVYKLNTANLVTESTLTHKLLVQHIPEVTHNTPNQ

SEQ ID NO: 950217 - protein, 45 aa, Homo sapiens
EDLQRNLWKTILDGSEKCRPWKENTADNEKECIMGGEKKPTDEEK

SEQ ID NO: 950218 - protein, 111 aa, Homo sapiens
MCLDPCFGVPLPSESNDLVKCIPFNENSEALECRRLSSFMVKENEQQPDHTSRGTTEALQLSQDILISKDTEPVELNCNFSCQGKEKVSCTICGHKFPRKSQWMEASRMGT

SEQ ID NO: 950219 - protein, 106 aa, Homo sapiens
KSNPRPISWVTKKEICSKKRAVASPEATVSQTDENTAESRRERVTLSSSKNLKPSSETKTQKGLFSDEEDSEDWFPISKGEEVRRCISAGGQAPQVGFPVGWKRRA

SEQ ID NO: 950220 - protein, 98 aa, Homo sapiens
SIFALEQRDLLRELISNSSEAWDKIRYGSVTDPSKLELGKELHIMPYTEQTRSNSHIVDTGMGMTEADLINNLGTIAKSGTKAFMEAWQAGADISMIG

SEQ ID NO: 950221 - protein, 72 aa, Homo sapiens
RGPMRDASIKNGDQETSSEPGSFFPAFFFWLLFLNKNQSIHRESHVPQCSYGVATLHMSSPRSNDLFGSKSL

SEQ ID NO: 950222 - protein, 96 aa, Homo sapiens
HAAGFMNSGLPTTEARVSSRGVRVAIDVSVIKGSTNIWAYRACLADGKIPVSASKDETADLAEQNPKEFDEVTKLQQIPHLQSIQSCAKTGQEIRR

SEQ ID NO: 950223 - protein, 47 aa, Homo sapiens
KISWTQCSEPGLVVSVCPVCVLREGRTGAGSQHPGRSVLLFLMEASR

SEQ ID NO: 950224 - protein, 67 aa, Homo sapiens
PVRTWHVLLAGSVSALPHRQVHNRGGKLATFSGVSPFLLLCVRVPSCTAASSFTTLVSALLMEASRM

SEQ ID NO: 950225 - protein, 35 aa, Homo sapiens
MGGLDSDGGLLSESRSSYLNPDRQKYKAIRLIFVI

SEQ ID NO: 950226 - protein, 100 aa, Homo sapiens
NRLLVNMLIVSSCFGESSNRATPDPALIRSERVWNPAISGVLEHVWYHSMPALLISLPPALRGVPEALWCGHAGVVPLPVRTFLLAEDAPHGHYHLPLGT

SEQ ID NO: 950227 - protein, 144 aa, Homo sapiens
TISMVACWAGLNEGTTHTYPGIGMAADEKVHIECVIGSGEGEKVNADILIKWVNPALLKVQTKTDFYFPASRHHNLISTKFTVSSAFNSMHIATKCMIPSKHNASRQQQQLHLHAGTSCNQRSNTPNSSSSQSIGAGIYSIYWM

SEQ ID NO: 950228 - protein, 115 aa, Homo sapiens
RFRAECLPSVLEEKQKSDAEEDGGTVSQEEEDRKPKAEVKERGHTFSFTKLKVHFCNREYFNTGSFTVAYGSHKILFKAQFCCKWAFFVDTRSVFLYCIIFTATIFNHQQVSVFS

SEQ ID NO: 950229 - protein, 51 aa, Homo sapiens
DKQDEGNGIVGGGYREVIPKGKTLILVFPLFPGLANRVRPEAHPLGQSRRI

SEQ ID NO: 950230 - protein, 48 aa, Homo sapiens
LQAQTGPRKDMAHHYTLQSEIVRFYRRGCFRYILIELCLHVCGQLSGT

SEQ ID NO: 950231 - protein, 101 aa, Homo sapiens
NGQRAGSVLRTAGACMMAGRSLGAGAVAPLLAGGGLHVQVLNVYALTWSCEELTKNLLSEPFMRALYLRVSDLVTSAQSVTGGTDSDLQTSIGRLPLVDVF

SEQ ID NO: 950232 - protein, 55 aa, Homo sapiens
RYRMYFIPLSLSSAAFSASSQLLQGCSQALLEPGPSSSSNQLNAAVQGGHICLRI

SEQ ID NO: 950233 - protein, 66 aa, Homo sapiens
SKIGVWQLILTNIYLTPRAPTCCVAHNQMGSASCELTLSVTEPSQGLQWPGSSRIGCAPCGASSQQ

SEQ ID NO: 950234 - protein, 61 aa, Homo sapiens
RQERVVVGRVLGSSHPVQRAAILPLAKAVVQVVLVYDVAPADVERTQTVSFIFWKKSLLQS

SEQ ID NO: 950235 - protein, 58 aa, Homo sapiens
QGTSEILSDVQRIKTGDEVGASEATLLNMLNISPFSCGRVIQQVFDDGSIYNPEDSWL

SEQ ID NO: 950236 - protein, 48 aa, Homo sapiens
LAAPPKGSKGAAVEHVQQRGFAGSHFVSSLDQLHITQAFNGAPEDLLV

SEQ ID NO: 950237 - protein, 108 aa, Homo sapiens
QLSFTGIGTLSSHFCSSSFSSSLTVMFLISEDNENTLKSSISFTVGYHQLVVTLHCIIGDVLLTGYTAQFCHLEVARLLVVLDQIVLVQHQDSCMNQIYSALVQQGIS

SEQ ID NO: 950238 - protein, 41 aa, Homo sapiens
VSNELYNPAETYNTELIALNFARGAGTDVAGGWSPESTYDT

SEQ ID NO: 950239 - protein, 87 aa, Homo sapiens
TSSTWQVYLCFCPEGTTSVAHLWKVPSPAGLVYSELRVLPLVLPIPLPGQCDLRRVEAHGPAPQGGFMVRDTAVSHMRFGGVRALQR

SEQ ID NO: 950240 - protein, 57 aa, Homo sapiens
IKHMEVDVYRVLYNLLAPSLNMPSPTFLPEYYIGGIVYYMRVGYNFFSFIMMIVRLM

SEQ ID NO: 950241 - protein, 60 aa, Homo sapiens
FTESVSAARARGVSSLQEASLGLHSQKVARIPRTSQTSILECCSLVIVTSIQASGVYIQY

SEQ ID NO: 950242 - protein, 48 aa, Homo sapiens
TCKISRVRTEPWYYYESPKGFVLQLTNGWNKCQSWSAIHDIHHMNSQS

SEQ ID NO: 950243 - protein, 53 aa, Homo sapiens
DPNNISTCIEGSLENNQLWRNCCLILGGMWALLFTKEDLTEIRYMLLANKVAA

SEQ ID NO: 950244 - protein, 99 aa, Homo sapiens
CTILSGRGHTCTWACCPVCLIQQWVPVVDTVHVHAGVQWFRAWAHLGGKNRHHRCAPQDPHGGGLSPGYVDHLAHSCSSRVRLQLRDIPGPEKKLSIQI

SEQ ID NO: 950245 - protein, 108 aa, Homo sapiens
MAEVIWRVCSSEAIHSTVWWDPMACGEIIVDAKIARLDFSLQKTKMKLGVQVVITYPEKPDQIIQIESDIPNERIHNILSTGANVILTTGGIDDMCMKYSWKADAMAH

SEQ ID NO: 950246 - protein, 51 aa, Homo sapiens
SSTWGNGTSTGSSWHLFVQQHVPDLNEGLLFEHKTHIPPDMRQKFLQSWVV

SEQ ID NO: 950247 - protein, 70 aa, Homo sapiens
KEEGTPKGVCKHKEKNVESVTTGTAQTATDKNDPHKCDFIETHNLNEQVKAIKEEGDHVTNLRKMGAPEY

SEQ ID NO: 950248 - protein, 97 aa, Homo sapiens
MRSRMEYGGTFACGGAALLGLAFVSTLRYLVLFPTLTILVILLVIAWRTPYDVDSVYNGYGSAAYFTALNWNTTRTRNICWLRTLFSFNNIKLHSLS

SEQ ID NO: 950249 - protein, 57 aa, Homo sapiens
LRRILVKIGKAGSPLYDMQLERRGLPYSLWTSKKKALRYQQPGLLGKGHRICVSCNA

SEQ ID NO: 950250 - protein, 32 aa, Homo sapiens
MWADWHCISKLITETSYYLTRTTVVAHFHYVL

SEQ ID NO: 950251 - protein, 40 aa, Homo sapiens
DAIVLMMVKGELTGCLRFRLNEEVCGEESIKSVSDQRKAP

SEQ ID NO: 950252 - protein, 47 aa, Homo sapiens
VVGSTSPVVASGQWRAALMSGFQCAAPLLILTNKFYFPPQLYKPATR

SEQ ID NO: 950253 - protein, 71 aa, Homo sapiens
SAHHMKLGLARGTNSRCPAFQSKKLLLEMDLTTATYLFLLSLLSDQLDPHVEQQRGPVKGCLQQDRCVGAC

SEQ ID NO: 950254 - protein, 125 aa, Homo sapiens
TVFSEFMIQSHEAAGRSCAAGPAPGGWPPQPGVPYLCRVVACLEPHDSPVLEVYVAICRKLILKLCILGTLCYHWLGAAGEPYLQGQCWADIVGQELDRYLVNGLSSPMLAGPAIVAGFRSLEIG

SEQ ID NO: 950255 - protein, 71 aa, Homo sapiens
LQLDGIQCGLFSGYVVFELYRLHLGRVELSNGSDLLTPSFHGDEGTVSGQSLRIAQPPKVTTFEVLVPTHL

SEQ ID NO: 950256 - protein, 85 aa, Homo sapiens
MIPKLHESRHTGEKPTSAPLPLCLWNLGNLKRHGRIHPCDKPSRCSLWNYSCNQSMNLKGHMLRHNRREALPLCHLGPIPGGTGT

SEQ ID NO: 950257 - protein, 50 aa, Homo sapiens
TCHCILSFNLWMQAGGMMPELSYRDVVQLLNTTRYSSCSSLGILGNKERY

SEQ ID NO: 950258 - protein, 72 aa, Homo sapiens
VAAGWGQMYRRGHVAGRWAVQEQHGMTSLRSTPTPVPTHVVYKSPSGSHWWSRVYSVELPRERGSPSSDPAF

SEQ ID NO: 950259 - protein, 43 aa, Homo sapiens
DKRGSNRKKTSRCWLNELATKEEPLRVVRRIEDVGLARRGCRA

SEQ ID NO: 950260 - protein, 94 aa, Homo sapiens
MHVGDHGRLSMVREPSATSSMSQALPATPPEWERVMSGPTGPIFLSGVSVQQELEIINERLEWVTQASHKAPREWGPPRRLTKTQEQHERQEER

SEQ ID NO: 950261 - protein, 47 aa, Homo sapiens
LVSCVTPHTESFKEVGIEFMDLYSQLVPVYDVEPLGEDNVMLTLGPS

SEQ ID NO: 950262 - protein, 31 aa, Homo sapiens
MYHMPRLPMEPEPDVEGVKTCDMRKSLRRED

SEQ ID NO: 950263 - protein, 88 aa, Homo sapiens
KRMRAQLSLTLTSEIDLAVKRLGMTQPDEKTYGALIYYWQQYLTPQVLNYQTWIKNFGWGDLGAESKLRAVHSEDFTSPSELLYSIDP

SEQ ID NO: 950264 - protein, 38 aa, Homo sapiens
MNHDGPWHLHNPPSGVVSILEGRFSAASPKDRACEQVW

SEQ ID NO: 950265 - protein, 72 aa, Homo sapiens
GSDLYLAGDQLTLRIAHCGVRRRYVRPTYLLASLLGARLAGPSLECKNAPVARQLLVPRIVKTASDLRGSEA

SEQ ID NO: 950266 - protein, 52 aa, Homo sapiens
AHDGCVCHGLHNASPGVSPSGGGGDSERGEGLLVCDGATDGDDVRVCTMPLA

SEQ ID NO: 950267 - protein, 72 aa, Homo sapiens
GLEMRWKEVEGRGHGGVVRGYSVDASGAGRVWEVVSLGKTAWDRSSRLNGGSVPCSEVCLAIGLEIPAAPGH

SEQ ID NO: 950268 - protein, 35 aa, Homo sapiens
MSPSPLFSLESCKGPGTDDQYENVIVLVSLTVTGD

SEQ ID NO: 950269 - protein, 49 aa, Homo sapiens
RSCCSRPAELSREYKLVLLGAGGDRKNAMTMQFISHRIPEDHDPTIEDA

SEQ ID NO: 950270 - protein, 57 aa, Homo sapiens
MAPTIYHIICLFLHIGRGLSYGSFLYSDKPEHIGFILHACKLIATAIPRLCPPRIQA

SEQ ID NO: 950271 - protein, 42 aa, Homo sapiens
MALLCEQGPSRSLWSCMVPRGPHWLCLVLRGKDGLNVSPLAP

SEQ ID NO: 950272 - protein, 46 aa, Homo sapiens
ALAPPMTVPASDRPSEKRYVCEKSCTAVTGNETLDYKHGSSGSRLS

SEQ ID NO: 950273 - protein, 200 aa, Homo sapiens
GYGRIHSTRGSFSPTVNISAHVLMAPWADSSVFPRTISPQLGLSKPRVVKVTGQCCEEWVCDEDSIKEPMEDQDGLLGKELGFDGSEVELTETNELIAVGKGSSLKRLPVFGMEPRILYKPLQRAEMYCSNNFMVPVLKDLWELVIFTRVTNDNPEWRLVKETRICEVRPCGQAVYSRLKKGTEMQGEQEIRETVRLLTL

SEQ ID NO: 950274 - protein, 39 aa, Homo sapiens
EYTQNVSKINLQKPPRVMEAAGVSCGRVLCEPAQNLMRA

SEQ ID NO: 950275 - protein, 164 aa, Homo sapiens
RRHADCRGARTGSAPAISAMGLSRGVREDTEPTLQGSEDGGPARPERSGTDASQQRRESPLNAQFALGDVLDVGLVREQVLQPLQEQQGLVVACDAPLTGLDHLVQGSRLHHLHSVAEDEPLGSDAVNAVQEPLLVQEEALHAHAQALAGHQADLVQLIQPGVR

SEQ ID NO: 950276 - protein, 202 aa, Homo sapiens
ESHSKRGSSSPTVTSVHMYDGAWLHSLCPKNYLSQLGCPLGWSKFTGQCCEEWVCDEDSIKDPMEDQDGLLGKELGFDASEVELTRNNELIAVGKGSSLKRLPVFWNGASHPIQPFTRPEMYCSSNSMVPVLKDLWNWYLHTVTNDNPECRLVKETRICEVRPCGQAVYSSLKKGKKCSKDKKSPEPVRLLTLEFECDSGGV

SEQ ID NO: 950277 - protein, 80 aa, Homo sapiens
FDGDLQRLSPDEEAEPSEPRLTAASRPSHSGHGHSSSLSWQSLLHTFRGRADSKCTVCGIFNWPPFNRKLTRLRTYEGTE

SEQ ID NO: 950278 - protein, 182 aa, Homo sapiens
EQISQSDGDKKPMVDAITSCRPETVSRENDFPSEAPISLNLSHNICNPMTVNSLPQYAEPSCPSLPAGPTGVEEDKGLYSPGDLWPTPPVCVTSSLNCTLENGVPCVIQESAPVHNSFIDGSATCEGQFSSAYCPLELNDYNAFPEENMNYANGFPCPADVQTDFIDHNSQSSWNTPPKMTA

SEQ ID NO: 950279 - protein, 34 aa, Homo sapiens
QLRFAGSECAVFHGFFSMPEYALPEAGAAPDGHP

SEQ ID NO: 950280 - protein, 48 aa, Homo sapiens
SLTFPFFAVYSSSSVILLLGIDIVILIIFSCPICPKLTQLLIFISILF

SEQ ID NO: 950281 - protein, 41 aa, Homo sapiens
RHLSSSSWMSAASSSSPPAGVERSSSSSSLALGHGRSLLIP

SEQ ID NO: 950282 - protein, 70 aa, Homo sapiens
RSRHCGNIRLRPPRNCEWTPGSQVVVIDIHTDSEEQASIAAVNDLKVPELHKVGVYGVSDGDHGMHLLDQ

SEQ ID NO: 950283 - protein, 52 aa, Homo sapiens
YDERKLLVSLEGGSSLEALMSAGPATCPEGHDWVMYLSPTGHLVMSRVFSPP

SEQ ID NO: 950284 - protein, 45 aa, Homo sapiens
MSPLSCSSRSGLSLLFFFSAGRCGQRSSSSSTLASEVMAVSLLIP

SEQ ID NO: 950285 - protein, 88 aa, Homo sapiens
MGAAHWKSLMSAGPPLVQRATSGCTVLEPTAIWDEPVFSHDVFYFISIELGEATISLRCGSSGGQETMKLGLEQVLCQMLHSSTSFVE

SEQ ID NO: 950286 - protein, 83 aa, Homo sapiens
TDGALLADLTDVLHCALLGLYVVGTLALVLLTASSGSSPAGVGYVFCPGVAPACEAYYTIAAYLKSTAARTIDPVNGGFDMGL

SEQ ID NO: 950287 - protein, 44 aa, Homo sapiens
CLRILYDEAKKGNAGSQFSHVLTEGFFCRGSTAFEMVGWWLGGF

SEQ ID NO: 950288 - protein, 45 aa, Homo sapiens
PLATAMKLQGRYKFFEASFQQDMEQYLLTGYLQIAERREPIGSMS

SEQ ID NO: 950289 - protein, 88 aa, Homo sapiens
MTYLAMLLDRVFYILLQFNSAPSMSVVGGYPRDFSLVTGAAGPPGEHTEELRAGKWTYSLTVPEKRFVLLGIIVLQADLQLHRLQELA

SEQ ID NO: 950290 - protein, 92 aa, Homo sapiens
MKVNTRLKEIARFTYTVLEEVARNTLGNVSKTVFEYRTRKGCEYSPIVASCTLMTLVVLQSRIWSWHVGPVMLFYSTQTRICKSHQNKIFNS

SEQ ID NO: 950291 - protein, 43 aa, Homo sapiens
NTQYRPLAVFENEYSYYTQIDYNPEDRLLYCLVTMATRSLTMC

SEQ ID NO: 950292 - protein, 39 aa, Homo sapiens
MRTYLLFMTYTVLRASYHLLPHVEFYKLREPYFSHTPPN

SEQ ID NO: 950293 - protein, 38 aa, Homo sapiens
TPVLHDVHCASGVLITCLLTLEFYDASMSLISPLPHPN

SEQ ID NO: 950294 - protein, 50 aa, Homo sapiens
ARENSIGSCFAIMWGAVMPWIATTRRNANISYAFDTHTNTQIVPRLLVRR

SEQ ID NO: 950295 - protein, 50 aa, Homo sapiens
TQLQERVRRGRGEIRLSKLIKFNVRSMNKYARSTVDGHKGAEVSQILLPG

SEQ ID NO: 950296 - protein, 111 aa, Homo sapiens
MRAMYPGTFYFQFKNLWEADASERNLAVLHRGRYQCAAQLSPGKTGVFRKPGGFVRPIVMQKGASSLGYCNDNTVSLTQRTRSTGNTSRKPLAHTVQGNSRPQFLGQAQAT

SEQ ID NO: 950297 - protein, 122 aa, Homo sapiens
HIRGPMRGLSRTYLPLEHDCGLTSSTYGSECVVVCSAVQGTFLTLFKPGPRIRGICLIRDSECKNASYFLASFLTVIYSCGVRFSASMYMCGISTVFSFNHSAAVPPGNNTENLVRGVDLSL

SEQ ID NO: 950298 - protein, 72 aa, Homo sapiens
MTLESSDPPPLRCTRDRTAPLWPEIERPGNCTIFAPYNAALGLLARCEMTSVCPGDSSGDLPYFPYWLGIKI

SEQ ID NO: 950299 - protein, 49 aa, Homo sapiens
QECCETINLPVSRVRSGRGESGSRRLIKFNVSVASYKDARCTVDGHEGA

SEQ ID NO: 950300 - protein, 93 aa, Homo sapiens
NGVSGYADPGLRRGEDFSLVESVSYRCAALSAQPRAMPGSLLTLQGVSLGRNPYWFSKFRLEGKILLRTHLYGDQGCPAGNLPSNVKLPRAFG

SEQ ID NO: 950301 - protein, 131 aa, Homo sapiens
VDFSYIHFGHHVFVVCKQGRELTCLIKTYAETRGTCCIRDSEAKNASYFLASFLTSFIFLWSIIQRLDIHMRNIHGLSTRHSAAGPPGHTQRHLGREVDLSLTVPKKRLSFWGSEFYTLICNSTVSRNLRR

SEQ ID NO: 950302 - protein, 61 aa, Homo sapiens
DGDLHGWAYKSIAKHGVEMDRGADELVQSLLVINKETKALEEEKAMPGQTWDLNPARALTH

SEQ ID NO: 950303 - protein, 45 aa, Homo sapiens
CCNLNLQEPCRRGREKSGSRSSLNSSEDACTRTPEAQWTVMKERR

SEQ ID NO: 950304 - protein, 178 aa, Homo sapiens
MYRRSYDYDRDDVETLLTLSYHPDQQTQTHGEGDAVLTWMEDGILNERDNCQYVYNVDQRDTDMDGVEISVTIAPWTIPDQLDSDSDRMDCDNQDDEDGIQNNLDNCPYVPNANQADHDKDGKGDACDHDDDNDGIPDDKDNCRLVPHPDQKDSDGDGRGDACKDDFDHDSVADIDDI

SEQ ID NO: 950305 - protein, 125 aa, Homo sapiens
LYEDLCEDRKYGLEIHPPVLDSELTNSPAHAGLAQRTVWVTCMRRLEDNNLLTEKQKLRVKKIHENEKRLEAGDHPVELLGRDFEKNYNMSSFPVHWQFGQLDQHPIDGYLSHTELAPLRAPLIR

SEQ ID NO: 950306 - protein, 42 aa, Homo sapiens
MCFGRPFTCFLTLNFMSFESLISPRTLLTRVLGRLRCRKNPL

SEQ ID NO: 950307 - protein, 48 aa, Homo sapiens
MIVCDHLVRGGRGSLHANQRKGQRGPWTTVELQISLKNYDPQKDKRFS

SEQ ID NO: 950308 - protein, 45 aa, Homo sapiens
PLLHDRPLCYRAVLSLCFLTLNYMRFESLISPRPLHNTAPYGRLR

SEQ ID NO: 950309 - protein, 66 aa, Homo sapiens
RFSEGRGSGRRALPYRRQVARAALKLDSVFEEPLSKKLFFFSGRQVWVYTGASVLAPRRLDKLGLG

SEQ ID NO: 950310 - protein, 51 aa, Homo sapiens
DSRDPSVVCELSLQERVRRGRGEIRLSKLRKFNVEEQATRTPEAQWTVMKE

SEQ ID NO: 950311 - protein, 35 aa, Homo sapiens
RHLDAIKVSCNLETGETCVVAESDPYDQKNWNISK

SEQ ID NO: 950312 - protein, 61 aa, Homo sapiens
AVSFRIRNNQVMECIPNAQLTSSGGCMPAVINTAYERKDGKFVFFKGDKHWVFDEASLEPS

SEQ ID NO: 950313 - protein, 108 aa, Homo sapiens
PDYEDPGSHAVELRPNRTGHRDPTYMNRGKIRPQPASHVFDIQGLQQQERNGLAVLLPDTKAVYPRDLKQLQKGSLPFLHSLNVIGQLFQKVSHQVRMDDGHVSKLLH

SEQ ID NO: 950314 - protein, 69 aa, Homo sapiens
ANLYMASTVLTVSPVVAKPAIWMHVLTKKRTVVNDISKAVLCFVLPPLSSKVYSFWSLFFKITLMIDFM

SEQ ID NO: 950315 - protein, 37 aa, Homo sapiens
SVSRIEALHRYVLLGLTKYVMAHTFSSTLKSKKLVRQ

SEQ ID NO: 950316 - protein, 36 aa, Homo sapiens
ALCTQCQIPKMPLFASLLGCGIDRFPCRSILHINFY

SEQ ID NO: 950317 - protein, 81 aa, Homo sapiens
TYWTDTGGCFHCAARYCDVILGSAQEFLTPSASFSAGEPRVLGLASGYPEHQIVTIEVQRESLTEPPYLLTTMALTFQDFH

SEQ ID NO: 950318 - protein, 117 aa, Homo sapiens
RSLLHTGGTAQMKTPPAVFCTFTVDMKFTVKDCDPTTGETDDERYKDKCVLKDLEVTVADHIQKVMKLNFEAAWDEVGDEFDEGGNFTLSTIKTLKEAVGNIVKFLGMHPCERSDKV

SEQ ID NO: 950319 - protein, 56 aa, Homo sapiens
MKQEQQRQLSSSAVPGDQQTPVRLQGSLTVTYTSARKRVVFRIHINSEVVITLLRC

SEQ ID NO: 950320 - protein, 89 aa, Homo sapiens
RQLHQRAKIYEDTWPATLLELRARADIKTGRETARQGRSWLCPRLSSHEYSGLEFHVRPFGHNELGGGEAGLCAGYSSCFRGYFLHISP

SEQ ID NO: 950321 - protein, 50 aa, Homo sapiens
MKEADCSQDMGVEKHLVTSIPSTLQAQWVVDLVPYAISTGVRANAVVRNP

SEQ ID NO: 950322 - protein, 124 aa, Homo sapiens
MIRVLAYSECITGDSWRLIIEEQNVRAYILYLKEVDITYCAELHRCLCSRDVDASRQPMSLGQTFGDKVMRWFQAMLQRMRTWWHGVLAWVKEKVVALVHAVQALWKQFQSFCCSLSELFMSSF

SEQ ID NO: 950323 - protein, 133 aa, Homo sapiens
EDCLAGCAPCTPRCGWRFQAHYRDEDGTWLPIPSDEELTMAMSYVKDDIFRIYIKEKQECRWDHCPPCAQEAPRNMVHPNVICDECNGPVVRNPLTCAGLPSYDLCSVCEENGFAPGAHKARIPQPLSGTLSE

SEQ ID NO: 950324 - protein, 32 aa, Homo sapiens
MFLRGDSVIVVLRNPLIAGKMGRLSVDRTHSS

SEQ ID NO: 950325 - protein, 47 aa, Homo sapiens
VTTRFSTSDLTGMGASRGITVLPGCSHPEPVQHDIPILEVSKGHGRL

SEQ ID NO: 950326 - protein, 117 aa, Homo sapiens
MGSEAMVLLSNFRGCCGGGLVLHLLKELVGWIFVAVLLHPGQVALLWGDSGVNLHHTMMNDVYCIFFSITKVMTITVAMTNTTTMSPMIAPLFEPTSSAKNTILDDELHILSHVGIC

SEQ ID NO: 950327 - protein, 44 aa, Homo sapiens
VPLYSLFHGHIVALRSSVRAYSVSKTCPFLRHSMVIPGSGDKAL

SEQ ID NO: 950328 - protein, 119 aa, Homo sapiens
RKGDTSVNHKMGMLLPTLFINGHRWVTEAIGHAVPTSEAASGGGLVLHLLKETCRYGLSVAVLLHLGQVALLWGDSGVNLQHTMMNGCDCFFFSITKVMTITVAMTTPTSMSPMIATFE

SEQ ID NO: 950329 - protein, 69 aa, Homo sapiens
MLTHQMRDLPSQVFEPSSKLGPNQNSAVIPAKSLSSLIKTEVNGFVPVSPQVSEDTPTSHVPAGALSSS

SEQ ID NO: 950330 - protein, 41 aa, Homo sapiens
DHVQKIPRTHASPGASLNPDGYEVAAQMGSEFGNWALGLWT

SEQ ID NO: 950331 - protein, 35 aa, Homo sapiens
VHWGEVGKQRPEKPEAGGMRGWKVSSGSGLGARTR

SEQ ID NO: 950332 - protein, 117 aa, Homo sapiens
RGPPNRGSQRCVLCTQHMVTCEVIKSPQNGTTVWSRSVWISDNTVSFLGMVSPGKICCSALENILKTNEFYMSYHLFIVGCAGAGATVICLVIYMMATTYNYAGLKFKSREDCCTKF

SEQ ID NO: 950333 - protein, 87 aa, Homo sapiens
CEYESILGYRAQRAVDLIQKHKSIEEIVAGDLTPQVPCDQKIGYHNGGSPCSSMEPRGARTQEYIVELEVGSAPNRSKSLIKLHCVS

SEQ ID NO: 950334 - protein, 80 aa, Homo sapiens
FLTWLHDGKLLPRKTAPLPCPLPEIKNSLTEALALLLVLWVGLWVLSGALQSPCLGALLCSHYPLLGACLVAVHMGHRSS

SEQ ID NO: 950335 - protein, 161 aa, Homo sapiens
ISAVIDVLSVAVKKRVMCNLVDENLTANEVQTPCDRTANVAILYPGGIDSMVIDPLLTVIYLYMHPIASSYCSFHQLKQKHHATSPLTEKGNPQNTYMCNITFSKHISQQHVAAAAAAQSSIHHVRVTSIESPGKGGHKGHYKLFSPSRIWTFCCKLMFLM

SEQ ID NO: 950336 - protein, 33 aa, Homo sapiens
MFSSTQCALLVAHWKPATTLSLISLRYCTPLVL

SEQ ID NO: 950337 - protein, 71 aa, Homo sapiens
SLDAAGDSDDYGSGGEICLCVYVYSYCKYMICCSALSPRTHLSFTVGALTGIVLAHSSLDIVLHDTLYVSA

SEQ ID NO: 950338 - protein, 112 aa, Homo sapiens
KRARDEPEEVELDVKLDKYTPLWIEEPHCPDDILGHATIIQELWSHIAIRHCHRENSATIRVIYKQLLQAKALQFLQIDSCRLGSVNENFSVLLMAKKFEIPVCPHAGGVGL

SEQ ID NO: 950339 - protein, 79 aa, Homo sapiens
KQRYWLRDQSVVQDRSIVAHCPGFVSHCCLIVLGATEDTFIADLVVGLCTGPDQEKVPLAGSERLTKYNQLLRIERGAG

SEQ ID NO: 950340 - protein, 47 aa, Homo sapiens
LEIQSVSLMITGVVRQWLSRGGEIEGFRLNAHCSCDSRHNTLQVDIN

SEQ ID NO: 950341 - protein, 43 aa, Homo sapiens
MCANPFQQQDVASAPDICARSASGPVAAFSRLSSLGLPQQGVL

SEQ ID NO: 950342 - protein, 151 aa, Homo sapiens
RCRVSQGHHTKDFTRQLRILPCHGNCHDSQKVVVWGHRRSQPRPFKRITSLQATYPMDLSRDPLSNWTIFPKSRYFQVEYKDFPKNNKNEFVSLINCSSQPPLISHGIGKDVESCHDMAALNILKLLSELDQQSTEMPRTGNGPMSVCGRC

SEQ ID NO: 950343 - protein, 58 aa, Homo sapiens
DLCGRKKWFLHTESFQSSNKNIRNPTPVLNIKIKTDDGPSDQGKVMDVMNLTRALTLC

SEQ ID NO: 950344 - protein, 61 aa, Homo sapiens
RTIHALLMPYGGGCIFMVIEGKKAAQDTDFNKLELRKDSSSERGSSYEGHNRVAEVSVLAG

SEQ ID NO: 950345 - protein, 99 aa, Homo sapiens
CGSVFWFGGRLELTLVYFAEELETVNVEVRPDAVVRKAVEPTEGWVMVVSVVVGMSVVREDRVMVVEVTMEPEVVETEEMAVVDVLTVEWMVEVKLGVL

SEQ ID NO: 950346 - protein, 110 aa, Homo sapiens
FSRINWRHSARVAAALHEIPGGALPEGSKASFAVSPGVIAEEQLRAEHVFICFHKNRENRAALLRTFSFSGFEIVRPGHPLVPIETRRVKQSMEIPISEIPSLMVLAVTT

SEQ ID NO: 950347 - protein, 74 aa, Homo sapiens
EIQTREIERDKDGRQFQTLLTEENMLKGQHEKEAADRKRKHEEQLETEHINPVTEQRLHVEQTRDEDLDTDSLN

SEQ ID NO: 950348 - protein, 37 aa, Homo sapiens
HRVDINLREIPVVFYPSRIVPVECRGMALENGAHSRS

SEQ ID NO: 950349 - protein, 74 aa, Homo sapiens
VLQTSCYSHPEYHSPYAHHSLIENNAKADIFTQLVITILLGLYFTLLQASEYFESPFTITDGFYRFRRSGYRRL

SEQ ID NO: 950350 - protein, 56 aa, Homo sapiens
MASYSGFLMLLWPWVKSSPENTGQALMTKAESNYGKDQDDNFLGTLGNLSSDEDVK

SEQ ID NO: 950351 - protein, 107 aa, Homo sapiens
RYYLASIRSPDIAWTLVIRVSYLRPETDVINFAVRRTACLHMLSYNVCSFTANGSHMPRLLHVQQSNRLTIYTPGLTVTPECAWTEGKVSRRMVLTPQYWIRIPGMT

SEQ ID NO: 950352 - protein, 163 aa, Homo sapiens
LEDPDQYTRFQAAAALITESLPPLGGRRKTIPSSRTDVPVLKMKTETKQRTLSPILVNPKGSPGLDDGGGYARELPKLPKKQTIAEQKSEPSGRGLNRNLKRQVEAKGEDESSSNGTAFSDNISFAAATKNSLNHEDYAERPSIPTIEGLYRQDPGRITFSGS

SEQ ID NO: 950353 - protein, 31 aa, Homo sapiens
MQMPECLRKRMSYVESLPTLWIKRNLNCSRI

SEQ ID NO: 950354 - protein, 42 aa, Homo sapiens
PYHPTRRALAPKQAYPAKSPRSPLLETSVLTRIRSINHLSSP

SEQ ID NO: 950355 - protein, 62 aa, Homo sapiens
GVYLEDPWETVLHDPLRTDEINGNVQAKSRCRTGPSNDVPASWDLTAAELLRPMQHNHAAGC

SEQ ID NO: 950356 - protein, 38 aa, Homo sapiens
MEGIPGELLKNFQDIMQKQRPERLSHLLQGYTLPNICT

SEQ ID NO: 950357 - protein, 43 aa, Homo sapiens
MIQRIPDPSTRSHAALELPPATDILFLCVSVAHSVTLRISMTN

SEQ ID NO: 950358 - protein, 95 aa, Homo sapiens
MLQKAGARDESEVSEQELLFWVPEVRPMSWVYGMAYGEFDGGVGAQIPVCNHSLEWKKSGLVPVPPVFRPGLNSGTWSAVGAVQVIIAAVVPGPV

SEQ ID NO: 950359 - protein, 87 aa, Homo sapiens
GANLSFYTAVPSHMLVGKGKHDREVHFVESKLDGNVEQSQRFSEKARHPRHAVPANRLAQQICTMDVSEPFFGKEDHSRSGAWNPGQ

SEQ ID NO: 950360 - protein, 162 aa, Homo sapiens
RTEEWVQWWFLESSPSTAALSSWALVSVPGDIIFNKFLYNYTENSENIKSEGLGKKREELSRKPELERSIQAKFDLLFDPLFWLLLLGLLLFGEFFLLLGVYLFSILCFDSLGFLEVGRVLADPLSLLFRIGELFLTGNSLVRGADRDALVRVVFVLIATLL

SEQ ID NO: 950361 - protein, 45 aa, Homo sapiens
MRIPERPCCMIQDEEGILHDQQRLILCLESGGKDGLHPVVTTTSR

SEQ ID NO: 950362 - protein, 74 aa, Homo sapiens
CEVISQVPVSVYSLQSHTTQVISHIALVVTAILIQTPWSFTGAVILIIAHGTYTPHLLFVPRQHSKLQYTFHAS

SEQ ID NO: 950363 - protein, 61 aa, Homo sapiens
SRRVEWNGYDLVKAMVTLVPQEALVLCRDETEGMVMPHEAMIIMREAYEKYRERTSNDNFA

SEQ ID NO: 950364 - protein, 139 aa, Homo sapiens
MRYRRNRENKAKIEDEKTDEEGTKTPKEYLNFGLTVMKNVDLPSAMVSGTRYTYAEALDRYEVKYSDAGQPMSIDLEFHFEPNEYFTNEVLTKTYRMRSEPDDSDPFSLDGPEIMGRTGCQIDRKKGKNVTLKTIKRKQ

SEQ ID NO: 950365 - protein, 42 aa, Homo sapiens
ASQMQAILRTPSLRRVAMSDEEEPYKRISICSSYKRIGCKEE

SEQ ID NO: 950366 - protein, 95 aa, Homo sapiens
EHKILTGGVDKNVVVFDKSSEQILATLKGHTNEGHQRGATPLSQDLVCCASPDAIIRIGSVPNASCVQLVRAHESAVTGPQLLMPPGDYLLSSSR

SEQ ID NO: 950367 - protein, 57 aa, Homo sapiens
RNCSGLNDEIFMASKEGKPCIIIKLTRVLGFKPKPPKNESLETYPVMQYNPHVLPVH

SEQ ID NO: 950368 - protein, 89 aa, Homo sapiens
NWVSHQAGCKKRKKDMMLKALALGVKEGGGIVADSFLSQSVFGEGCRIPACMCNGAALYISLGTTLASNTIPWPRVTTQGEDLSLTTLT

SEQ ID NO: 950369 - protein, 100 aa, Homo sapiens
MARPSVERDKNIFMEEEKIVNEVVASMEDFVLNDLKKDYHGSQADWLRLKNVEVRDFPTCVYVGAGCSYPDKENFQPIQNKMRAILRIEVEAVGFPEVGS

SEQ ID NO: 950370 - protein, 36 aa, Homo sapiens
KRTMARPSCKFSLFSKQLFGFPEAHFLSLRGLKKLP

SEQ ID NO: 950371 - protein, 114 aa, Homo sapiens
DRGSRSSSHQLDTFILPKGSKIPRSISSVMWKCNEPTYSLIGPALPLCKVFAMCCSSSFFLPRDALYYDVARLKTRGPVNPYSYEARELTSTQLHIMQFRWERLEFLSGWEQDA

SEQ ID NO: 950372 - protein, 56 aa, Homo sapiens
VLEIPTADVRMGTPDDIDECSSRRRNPLHLSAVVNVPVSYQCACPELGTTMTAKGK

SEQ ID NO: 950373 - protein, 172 aa, Homo sapiens
PVASTEDRELQHSLMMESDLARLVRKGLPSLLAKSKSPREVPSPKVIKTRELVKKTESPIKLSPATPSRKRSVAVSDEEEVEEEAERRKERCKRGRFVVKEEKKDSNELSDSAGEEDSADLKRAQKDKGLHVEVRVNREWYTGRVTAVEVGKHVVRWKVKFDYVPTDTTPRD

SEQ ID NO: 950374 - protein, 98 aa, Homo sapiens
MLNLNNHDHQLGIIVVWFPKVRRATCLTIPEWTETQTILGVFSLRKSGLSNWNHHLPWPKLYIRKMVMYNSKHGFTIYSHTTIVVTYFRRSSVYTCVA

SEQ ID NO: 950375 - protein, 38 aa, Homo sapiens
MLLLIDSSPESPSKLYHGLLALEGGQASPHSAQSVPDV

SEQ ID NO: 950376 - protein, 41 aa, Homo sapiens
MSPCRLALDGKTMRTRRQVQVKASKAAEPLLLLGTPALETS

SEQ ID NO: 950377 - protein, 71 aa, Homo sapiens
WCCLVQHEQRLPGVMKAPFLYMSALVGPVLTLCCRDMAVQVAGAAVGSLRGAECGGANTLVAVQAEAQGGA

SEQ ID NO: 950378 - protein, 104 aa, Homo sapiens
MLWVSVSEALLGSCGVCERGGLGDVNRMGKTEHHVNILSLEAQTPKAVNRLRDEGLYPVRVRVFPSIQHLHSSKLFLSPLGWHDRSELASLPEKTQGQLASSWL

SEQ ID NO: 950379 - protein, 60 aa, Homo sapiens
MLAHVSGSGGTEMDFLGNKRTLGLRGAYPKLKGFRETPPSSVGGQGSMAGSVGPVIKHLW

SEQ ID NO: 950380 - protein, 97 aa, Homo sapiens
VSLPLLAGLVLSHAALCDRLEELFDSWGTVYNFMVPELKRWVLNQLNEGNKKTPRYVPIYNQPFQENSCDLFLDGFRIALLQKVQHGALEVVSVAIW

SEQ ID NO: 950381 - protein, 51 aa, Homo sapiens
PPVVAVSVMSGRLGGHQAQTVSWMATSAWSEPWPSYSELKSHLVMLSPNQT

SEQ ID NO: 950382 - protein, 165 aa, Homo sapiens
GRTGDAVCCPPASWTPGPGVSQRWFRLQLPALATSREGHDGGRTTGLMMPMWFVTVTSRWTHPQEPEPADREHPEPRGKPARNPARTCCDLKMCSLTGRVESTGLTQTKGCNVDAIKVFCNMELVSTECTPFSPVWPRRTGYISKNPKDQRHVWIGESMTDGYPD

SEQ ID NO: 950383 - protein, 112 aa, Homo sapiens
VHQYYCKLCGLRQHTVITMWFLWVRNPGVTQLGSVQGYNHNVSQGSVLIWRLELVIDLLPGSSGCWQHSVPCRLLDSGPQVLAVLSFLPHGPLHLATHDMAAHIFKASKITS

SEQ ID NO: 950384 - protein, 80 aa, Homo sapiens
RSERIGIPILKTRSPVTFLSGLRRPLRVIQVNRGNRYTLKLIKACGALCGDSGHCAHPHHGHDIVSVSSITTTQADMDIF

SEQ ID NO: 950385 - protein, 191 aa, Homo sapiens
TPARYGQTTMRSELGNSLWTRVFREGDSLNASIVDAINQAAECWGIGCLRYEIKDIHVPPRVERVYADPVGGKSGVTGPQFQESEGDPESRAINCGSKGTKQAPDPWPRIPDQAEQINQAAGEASAVLGEGKGYKLKQCESLAAALTKHNVDAARSLTVGEQYVSAVSKVPRDSNSILLASNPGDVTSMLA

SEQ ID NO: 950386 - protein, 93 aa, Homo sapiens
TLADVVGRGGSVRGLSRDEALRLALEDVADCTGLSCCQFWDGTGVVKRWAETQHSQGGLVVQPPALWQIEKDDWTVPYGRIYLAGGAHALPAR

SEQ ID NO: 950387 - protein, 60 aa, Homo sapiens
VIDDMEDVSALDPQIVCQTVSLQTELSVAQCTQRTVDIVFLLYGSMRLGEQNFHKARRFC

SEQ ID NO: 950388 - protein, 39 aa, Homo sapiens
GARGGSAERGEHVHVTSLPKASTVGTTYCLRNGVRRPHA

SEQ ID NO: 950389 - protein, 98 aa, Homo sapiens
EHAIPEQSGDEEKQEPDKAHLDLLFRHNELPVRKSSPILKRTERGTAMNSSNFKKAKRVKTEDEKEKDPEEKKEVTEEEKTKEETPEAKGVKEEVKLG

SEQ ID NO: 950390 - protein, 89 aa, Homo sapiens
HWPRSLHSQEDELSAVQFMVPLLYEAKCVKVAIKDKQVTYFIPYSGWNHKYGLSGFRQSQSTQIRGTPNMQNQRELQKANQEQYAEGPA

SEQ ID NO: 950391 - protein, 70 aa, Homo sapiens
RRLEDPRDAGSYCCETYQYLRNRWMDGITDPYITDRFCIRNCVVKNILHHVWGDKADRMKRTNIIEGKSF

SEQ ID NO: 950392 - protein, 227 aa, Homo sapiens
SRREREQSRGRARSQAAMGRAPPVSGGERTAGAEQGQAGGVGARGRASRGRAGPSAERRSGGCGGGGWMEAAPPPRWRYLEVVLADVSYLIGLEKSKATPAARASKKILLPNPIRVNYLDRGEVTFEKIFFQKLGYLLFRDFYLNHLEDGQALWLEFYEEIKKYEKLEKEEEVVRSREIFDSYIIKELLACSHPFSKANEHFQGHLGKKQVPPDLFHPYIEEICQNL

SEQ ID NO: 950393 - protein, 149 aa, Homo sapiens
HRIRFAMAIFFFEFSLLMGKEKTRGELRAGVHNGFWFFKIAALIGIMVGSFYIPGGYFSSVWFVGGMIGAALFILIQLVLLVDFAHSWNESWVNRMEEGNPRLWYAALLSFTSAFYILSIICVGLLYTYYTKPDGCTENRFFISINLIL

SEQ ID NO: 950394 - protein, 31 aa, Homo sapiens
MWSYGVETCEERYILLMPSAANGRGRLEVKR

SEQ ID NO: 950395 - protein, 54 aa, Homo sapiens
VGVKLQEDIHFAITSVEDIENSNFDMCTMSENASDFIEKSNIGWLFRSVVKTSI

SEQ ID NO: 950396 - protein, 37 aa, Homo sapiens
EIQDFVSNNTAVEQFYQLFSICPFSLKDEPLETSDNK

SEQ ID NO: 950397 - protein, 37 aa, Homo sapiens
MKGKVYRTINILNELYARHVNYFSNCIDLGYKVVSVP

SEQ ID NO: 950398 - protein, 155 aa, Homo sapiens
QTQARGKKYTMGDAPDYVTVSHVAVIEKYKLALDFPNLPYLIDGAHQITQSSAILCYIARKHNLCGETKEEQIRVGIRENQAMHVSTQLARVCYSPDLAKLQPDYLEKLPTMLQHFSQSRGKRPWLVGDKITFVDYLAYDVLDLHGILESVLPAW

SEQ ID NO: 950399 - protein, 41 aa, Homo sapiens
EAQKLGNGINIIVATPGRLLDHMLNTPGFMYYELQCLVIDE
